United States Patent 10,858,665 (ISOLATED POLYNUCLEOTIDES, POLYPEPTIDES AND METHODS OF USING SAME FOR INCREASING ABIOTIC STRESS TOLERANCE, BIOMASS AND YIELD OF PLANTS) - sequence listing, part 4

SEQ ID NO: 5444 - DNA, 1067 bp, Tabernaemontana elegans
cagagctccaccacctccaacttcagacttccaaaatctctcgccggctaaaacagagtatccaacaattccccaaatcaaaagaaggaaaatggatctgaggctaatgggaatcgacgcaccactgctccataccctccagcacatgatcgataatgctaacgacgatgcggacaagtccaacggaccttcaagaacctatgtccgagatgccaaggccatggctgcaacaccggcagatgtgaaggagtactcgaaatcttatgtgttcgttgttgatatgccggggttgaagtcgggggacatcaaagtgcaggtggaggatgacaatgtgctcatcataagtggagagaggaaaagagaagaggaaaaagaaggtgcaaagtatctgagaatggagaggagggttggcaagtttatgaggaagtttgtgctgccggaaaatgcaaatactgatgccatttctgctgtttgtcaagatggggtcttgacggttactgtcgagaaattgcctcctcctgagccgaagaagccgaagactattgaagttaagattgcttgaatttgagtgtctgctctgttttgagtcatggtgtggtgtgccattgctatggctgttttctgaatgggaataacttagggaagaagtgttcttgttgccttgtttcgtttctttgttgattttctggagcttttcgttgctggcctatggtgtaagaaagaggatctgcagactgcagtaatgttgatgctgtattccttgcttattatgaatgagaagtgttattatatattagtatgaaaatgtatcacctacttcccactgttgatcttaatttatgaacaaaacttgcaaaattaggttaagaatgttttaggtatgctgacgatcatagactatttcttgatgagaagacataaagaatagacaaaaaaagtaaagctgtaagtaaagacctaccgagatgcgactattctctgcttattctgttgtatgatacctcgtcgtcttccgtccggggtagtaggggtaaattaaagtaacggaatactcgtactacgtttgg

SEQ ID NO: 5445 - DNA, 655 bp, Nicotiana benthamiana
tcaacatcctagcaattcaaatctaaaactcagaatcacaaaattccacatccaaaaaatcccaggatcaaccaagaagaggagaatggatttcaggctaatgggaattgacgcaccactctttcacactctccagcaccttatggacgccgccggtgaagattccgacaagtccgtcaacgccccatcgaggaactatgtacgtgacgctaaggccatggcttcaacaccagccgacgtgaaagagtaccccaattcctatgtttttgttgtggacatgccggggttgaaatccagagatatcaaagtgcaggtggaagatgacaatgtgctgctgattagtggagaaaggaagagagaagaagagaaagaaggggctaagtatatcagaatggagagaaggattggaaaattcatgaggaaatttactctgccggagaatgcgaatactgatgccatttctgctgtttgtcaagacggggtcttgattgttactgtccagaagttgcctcctcctgagcccaagaaacccaaaactatcgaggttaaaattgcatgagatattatagtagttaataattgatctgttttctggacatgggattaggaaatgctctgttttgatggtaataaaatggaagagatctaggggtgg

SEQ ID NO: 5446 - DNA, 952 bp, Theobroma cacao
gagactcatctttgcctaattccaggacaaaagtcaatgaaaacgaagcccatcttgcccaaaagagaattctagaccttccaaaacgtactggaaagcggaaaccattcgagaaagaatgtaatacaagcttctggaaatctcccgacattttcctccagaaacttcctacccaaccttataaattcgcaaaaccatctacactgcctacccaagacattgagtaaattcgcatccgaaaagccaaaacaaaattctaacaatcccagccaagattcctgcggcgaagaagaggagaatggatttcagaatcatgggtttggattctccattgatccacactctccagcacataatggacctccccgacgaaatggagaagaccactaacgtaccatcaaggacttacgtgcgtgatgccaaggccatggcagcgaccccagcggacatcaaagagtaccccaactcttatgtgttcatcgtcgacatgccggggctgaaatcaggggacatcaaggttcaagtggaggacgacaatgtgctgttgatcagcggagagaggaagcgagaggaagagaaagaaggagccaagtacgtgagaatggagaggcgggtcggcaagctcatgaggaagtttgtgctgcccgagaatgctaatgctgatgctatctctgcactgtgtcaagatggggttttgactgtcactgtggagaaattgccaccgcctgagcccaagaaacctaagaccattgaggtgaagattgcttgagagagttttagttggggaaggttttatggaccatggttatggcctatgaggctttaaataatttgggtttatcagtagttctgtgtttcctgtggtggcttctgagttctgagtgtgttttctgtttggtagttccgctcctgttgaatgttgggttatgatgaaatacctatgtttttaata

SEQ ID NO: 5447 - DNA, 832 bp, Manihot esculenta
cccgctataaattctcccacactgctcctcctcgctcgccaagaagtgtctgtttgcagaagaagaaacgcggagccacagtgtgtgagaaattcctctactgaagaaaaggaaaatggatcttaggctgtttggtttggaaacacccctcatccacaccatccaccaaatgatggacaccactgacgaagccgacaagtccttcaacgcccccactcgtacttatgtaagggatgcgaaggccatggcttcaactccggctgacatcaaagaatatcccaactcctatgtgtttatcatcgacatgccagggttgaaatctggggacatcaaagttcaggtggaggatgacaatgtgcttttgatcagcggagagaggaagcgcgatgaggagaaggaaggggctaagtatgtgaggatggaaagaagggttggcaagtttatgaggaagtttgtgctgccagaaaatgctaatactgataccatttcggcggtctgccaggatggagttctgacggtcactgtggagaaattgccaccaccggagccaaaaaagcccaagaccatcgaggttaagatagcttgaggagtactacaactgtctatggttgggtactgcaaataaagtggattgtgttagtgctcgttatcgactagtgctatctatgaatactagtagtttcattactaggctgtgtttttcttttgttttttttctttctgtttcccttgtggctttcctgtgtgagattggcttctgatgaggttgatatgcaccttacatgttatggaagttgtttctgaaatcaaatatcatctttgcttaattgcc

SEQ ID NO: 5448 - DNA, 781 bp, Coffea canephora
ccagaaaaaaccacccaatacacaatcattgtcaatccctttcggaatcaaaattcggaaaaagatatccccatctcaaatcatcaagcacggagagaaaaatggacgtcagactgctgggcttagacgctccactggttaacgccctccaccacctaattgacgccgcggatgatggagacaagattgccaatgcacccacaaggacctacgtccgagacgccaaggccatggccgccacccctgccgacgtgaaggagtatcccaattcctacgtgttcattgtggatatgcccgggttgaaatcgggggacatcaaggttcaggtggaggatgacaatgtgctggttgtcagcggagagaggaagagggaagaggagaaagaaggtgccaggtacgtgaggatggagaggagggtcggcaagttcatgaggaaattcgtgctgccggagaacgccaataccgatgcaatttctgctgtttgccaagatggggtattgactgtcaccgtccacaaattgccccctcccgagcctaagaagcccaagactattgaggtcaagattgcttgaagttggaaggtccagctttactgttgaaagatttatcttctgttttggatatataattatgtctggcttctaagatcagatttggaattgtgctgtaccacttagtatatgacttcatatggatcatcatgtttaggcctcttgttaacgttccttgtttttatgggctaaattttcagtggtgcaataaagtattctgttgttttcaa

SEQ ID NO: 5449 - DNA, 950 bp, Vitis vinifera
aagagaaccacctggaaccctccatgtctcaattatccatttccatctctctccagaaacttcccgtctgccttctctcctaaaccccatcacccataaaaccccactgcaacctcccatttcttcacacagcgaaagaagcagcttagagattctactcatcaatcatcgtctgaaaatccaatatggacttgagaatcatgggcttcgattctccactctcaaccctccaacacatgctcgacggcgtcgatgacgctgataagcccgtcagcgctccaacccgcacctacgttcgcgacgccaaggccatggctgcgacgccggccgacgtcaaggagtaccccaattcctatgtcttcatcatcgacatgccggggctgaagtccggcgacatcaaggtgcaggtggaggacgacaatgtgctggtgatcagcggagaaaggaagcgggaggaggagaaggaaggcgccaagtacgtgagaatggagaggagggtggggaagtttatgaggaagtttgtgttgccggaaaatgcgaatactgataagatctctgcggtttgtcaagatggtgtgttgaccgtcaccgttgagaagctgccaccgccggagccgaagaagcccaagaccattgaggtgaaggttgcttgagatctttggggtttggaaatttgaggtcatggatgtgacgagcttgtgtttatatcttcttggattttgcgtgattttgggttgtgtttgggttcggtgtatatgagggtgtgttggtttttgggatcttgtacccgatgtctcccaagtcagtatgtagtcttcaatcttcatctctacgagtgaaaccttttcccttatttttagtgtgccattttcattacctcaaatttaaggtgccatatatattaaggttttatgttgggattagattttggatttgctaaccgaattggg

SEQ ID NO: 5450 - DNA, 735 bp, Tropaeolum majus
atcacaacagaaaatttaaaattcaaaaactaagtgtccgagtaacaatcatcgttccaattttctaatcggaagttcaaaacacaaacaagaaaaagatggatttcagattgatgggtctcgattcaccactcttcgtaaatcttcacaacattatggacttagcagatcaagaagctgcaacagagaagtcatccaacgcgccgacgagaacctatgtgcgcgatgcgaaagcaatggctgcgacacctgcggatgtgaaggaatatccaaattcttacgtgttcgttatcgatatgccaggtttgaaatcaggggatatcaaggtacaagtggaggaagacaattttctgatgataagcggagagaggaaaaaggaagaagagaaagaaggggtcaagtacttgagaattgaaaggaggatcggtaaattcatgaggaagtttgtgctgcctgataatgctaatacagatgcgatatcagctgtttgccaggatggtgtgttgactgtggctgtagagaagctgccgccgccggagcctaagaagcccaagactatcgaggttaaaattgcctaaattcaatgcttgaatgattttcgtttaaaaataatagccgctgtttttatgaattagctctttgatttctgatgtaagtgtttgctggctgcttaatgatgagcaatgaactcgttttctttgtttaatgtttgaggagatattatcttggtatgat

SEQ ID NO: 5451 - DNA, 715 bp, Tropaeolum majus
aaaatttaaaattcaaaaactaagtgtccgagtaacaatcatcgttccaattttctaatcggaagttcaaaacacaaacaagaaaaagatggatttcagattgatgggtctcgattcaccactcttcgtaaatcttcacaacattatggacttagcagatcaagaagctgcaacagagaagtcatccaacgcgccgacgagaacctatgtgcgcgatgcgaaagcaatggctgcgacacctgcggatgtgaaggaatatccaaattcttacgtgttcgttatcgatatgccaggtttgaaatcaggggatatcaaggtacaagtggaggaagacaattttctgatgataagcggagagaggaaaaaggaagaagagaaagaaggggtcaagtacttgagaattgaaaggaggatcggtaaattcatgaggaagtttgtgctgcctgataatgctaatacagatgcgatatcagctgtttgccaggatggtgtgttgactgtggctgtagagaagctgccgccgccggagcctaagaagcccaagactatcgaggttaaaattgcctaaattccaatgtagccttgaataattttcgttttagaaaatattccgttgttttccttgatgagctctttgatttccaatgcaagtgtttgcgtaaatgtttgttggctgattaatgatgagcaatgaactcgttttctgtgtttgatg

SEQ ID NO: 5452 - DNA, 786 bp, Humulus lupulus
tctccgacattcctccagaaacttctcatctctccctataaatatccccaaaaccttcatcttcttccatcaaaatcaccgcacaaaaaaccgatttagaaaaataccacaaaacaagccaagaagatcatcaatcggatcagccatggatttcagaatcttgggattggactctccactcttcaccacactcaaccagatggtcgatccctccgacgaatccaacgaccacaaatccttcaacgctccgaccaggacctacgtccgcgacgcgaaggcgatggcggcgactccggcggacgtgaaggagtacccgaactcgtacgtcttcatcatcgacatgccggggctgaagtccggcgacatcaaggttcaggtggaggacgacaatgtgcttctgatcagcggcgagaggaagagagaggaggagaaagaaggagccaagtacgttaggatggagaggagagtcggaaagttcatgaggaagtttgtgttgccggagaatgctgataccgactcgatctccgccgtttgccaggacggtgttctgactgttacggtgaagaagcttccgccgccggagccgaagaagccgaagacgattgaggttaagattgcttgaatatgattatgaatgaatgaatgaatgtatgtggtttgtttgttatggctggctgtttggttaggggtatgtttgggtatgaggaatgttctgtttggtgtgcttattttgtgtttgttttttttgcttattcctagtagttgtatgaaatttgcaccaaattt

SEQ ID NO: 5453 - DNA, 750 bp, Nicotiana benthamiana
aatctaaagcgaaaatccaacaaaaatacaccaaacacgaaatccctaaatatctcaaaattgaaattcactcagttaatctaagaggaggaggatggatctcaggctaatgggtatcgatactccactgttccacactctccaccatctcatggacacagccggtgaagattccgacaagtccgtgaatgtcccatcgaggaattatgtacgtgacgccaaggcaatggctgcaacaccagccgacgtgaaagagtacccgaattcctatattttcgtggtggacatgccagggttgaaatctggagatatcaaagtgcaggtggaagatgacaatgtgctgctgataagtggagaaaggaagagggaagaagagaaagaaggggctaagtatatcagaatggagagaaggattggcaaattcatgaggaagtttgcgctgcctgagaatgcgaatactgatgccatttctgctgtttgtcaagatggagttttgactgtgactgtccagaagcctccacctgagcctaagaaacccaaaactatcgaggttaaagttgcatgagaaattggattagttattttgttactcttttgtgtcaactgggaattggaagtgctctgtttttatgcttgatagtctgactctgtaataaatggtagagatctaggagaggttatcttatcattgtcttctttatattttttagatattttatgctaaatgtgtaggtactctatctcctgttt

SEQ ID NO: 5454 - DNA, 763 bp, Nicotiana benthamiana
gcaactgaaagcgaaaacccaattcaaatacagcaaatcaaaatcctacattcaaaagtatctcaaaattgaaaccaattcaaccaagaagaggaagatggatttcaggctaatgggaatggacacaccactattccacactctccagcacctcgtggacgcagccggagatgattcagacaagtctgtgaatgccccatcaaggaactatgtacgtgacgctaaggcgatggctgcaacaccagctgacgtgaaagagtacccaaattcctacgttttcgttgtggacatgccagggttgaaatgtggagatataaaagtgcaggtggaagatgacaatgtgttgctgatcagcggagaaaggaagagagaagaagagaaagaaggggctaagtatatcagaatggagagaaagattggaaaattcatgaggaaatttactctaccggagaatgcgaatactgatgccatttctgctgtttgtcaagatggggtgttgactgtgaccgtgcagaagctgcctccacctgagcctaagaaacccaaaactatcgaggttaaaattgcatgagatattgtagtagttattaattactctgttttctggaatgtttgattgtgatttaggagcggcgatcttttgcttttctctctttaagttttcaactactatgtttatgagtatgatgaacggaaaaatgtgtcagtatgctatatcttgtgtttaatgcaagtgaaatgctacttttcagtctgtgattgc

SEQ ID NO: 5455 - DNA, 870 bp, Olea europaea
atcaagaaaatctttctgaagtatctgcatcaacaaatcatccatactaaaagttttttaattcgaaagaaaagaaatggatttcaggctaatgggattcgacactccacttttccacacacttcatcatctggtggactcggctgaggatggagagaacaggtccatgagtgcaccaacaagaacctacgtccgagacgccaaggccatggcggccacaccggctgacatcaaagagtacccgaattcctacgtgttcatcgtggacatgccgggactgaagtcgaatgacatcaaagtgcaggtggaggacgacaatgtgctgctgatttctggggagaggaaaagggatgaggaaaaagaaggtgcaaagtatgtgagaatggagaggagagttgggaaatttatgagaaaatttgttctgcctgaaaatgcaaatactaatgcaatttctgctgtttgtcaagatggggttttgactgtgactgttcagaagttgcctcctcctgagcccaagaaacccaagactattgaggttaaaattgcttgaatggaatgttgccgcagctggggaaatgggagttttatgaagtaatgagggctggaagtagtaataaaatttggatttgtgcttatttgctgtgtgtaatttgatggatatgtgtacatcaactatgcttattatgaatgagaatgtgtatctagaaacgtcactagctgttttttgcgttacttgtcatgatttaagccagcaataaaattaaaataagcaatcttgtacttttgaactggttactaggagagtgcatacaaccattttccaagcattcaagcaatgagatagtagacacgtttatttttaaaaatgcg

SEQ ID NO: 5456 - DNA, 767 bp, Fraxinus spp
gcagcaagaaaatctttccagagtatcaacaaatccgaattacaggttttacatttcgagagagaatggatttcaggctaatgggattcgacaccccacttttccacaccctccatcacctagtggacgcggctgaggatggcgagaacaagtccatgagtgcaccaacaagaacctacgtccgagatgccaaggccatggcggcaacaccggccgacatcaaagagtacccgaattattatgccttcgttgtcgatatgccgggattgaagtccggcgacatcaaagtgcaggtggaggaagacaatgtgctgctgatatctggggagaggaaaagagaggaggaaaagagggtgtaaggtatgtaagaatggagaggagagttgggaaatttatgaggaaatttgtgctgcctgaaaatgcaaatactgatgcaatttctgctgtatgtcaagatggggtcttgactgtgactgttcagaaattgcctcctcctgaacccaagaaacccaagactattgaggttaaaattggttgaaatggggagttcaatggaatcctaatataaatgttggaagggagtaatgtgttttcgttttgaagaagtttttggtttggttaaaaatttgcagtgtgagttgatggatatgtatctttttactgttgaatgggattattgtatgtcatgtatcttacaagaagtctactaacaaaactaatactaacctacatctattctgttcagacaataccaagaataaattcat

SEQ ID NO: 5457 - DNA, 947 bp, Eucalyptus grandis
caaatccaaactccgatcagtagctctccacttcgaatcgatctctcgaaaccctaatcaatctccttcctccagcttcaccgaccgagcagcagacgcgcgacgatggatttccgcctcaccggcctcgagtccccgctcttcgccacgctgcaccacctgatggacgtccccgaggaggccgagaagtccgccaacgcccccacccgcacctacgtccgcgacgcccgcgccatggccgccaccccggccgacgtcaaggagctcccggggtcctacgccttcgtcgtcgacatgcccggcctcggctccggggacatcaaggtccaggtcgaggacgacaacgtgctggtcatcagcggcgagaggcggcgcgaggaggagaaggagggcgccaagtacctgcggatggagcggcgggtgggcaagttcatgcggaagttcgtgctgccggagaacgccaacaccgaggccgtctcggcggtgtgccgcgacggggtgctgaccgtcaccgtggagaagctgcccccgccggagccgaagaagccgaagacgatcgaggtcaagatcgcctgaagtgggcccgcggagctgagctacgggtgtgccgatgaggatgctcattgggaatgaagaataacgatgggcgtgctttgcttttaagaaggttgttcttgtgttttgcgcgcggaacttgcaggttcttgcgcaggtgctatgtttttttttttccttttttttgggtcgaagcgcaggtgctatggttagtaggctatgtgtttgatgtttggctcgtgcttatcatgaatgaatatcggtggatgtgttgtattctgaactcgttcgtatcttcttttacctgatcttactcttcatgaatcgtaatctcgacatggacaaaagcaacttaaaatggcacgttgtgatccttcttgcttggaaatgcg

SEQ ID NO: 5458 - DNA, 620 bp, Citrullus lanatus
accaaaattttccttcgcacaagcattccttcagtgttctttcgctttactctcaaggatttctccaactaacaagaggaaaatggatctcagaatcatgggcctagactccccaatcttctccactctccagcacgtgatggacctcgccgacgaggccgacaagtcgttcagcgccccgacccggacatacgttcgggatgccaaggccatggcagccactccggccgacgtcaaggagtatccgaattcctacgttttcgtcgtcgacatgccagggctgaaggtgggggacatcaaggttcaggtcgaggatgacaatgtgctactgataagtggcgagaggaagagggaggaggagaaagagggagctaagtatgtgaggatggagagaagagtcggcaagttaatgaggaaattcgtgttgccggaaaatgctaacactgatgccatatcagcggtttgtcaggatggggtgctgactgtgactgtccaaaagttgccgccacctgagcctaagaagcccaagatcgttgaggtcaaggtcaattgatggggcgaggagtatcagtgatttctccaatccttggatcatgagttttcagaatatggaacatggt

SEQ ID NO: 5459 - DNA, 1015 bp, Citrullus lanatus
cttccaactcttctcaacacttccagaaaattcctccttctattccttcactctcactcattcacaacccaaatgcacctataaaatccaaccaaccgttctggcttcgccacaacccagacagctgaacccaagagcatctgccataaccaaaattttccttcgcacaagcattccttcagtgttctttcgctttactctcaaggatttctccaactaacaagaggaaaatggatctcagaatcatgggcctagactccccaatcttctccactctccagcacgtgatggacctcgccgacgaggccgacaagtcgttcagcgccccgacccggacatacgttcgggatgccaaggccatggcagccactccggccgacgtcaaggagtatccgaattcctacgttttcgtcgtcgacatgccagggctgaaggtgggggacatcaaggttcaggtcgaggatgacaatgtgctactgataagtggcgagaggaagagggaggaggagaaagagggagctaagtatgtgaggatggagagaagagtcggcaagttaatgaggaaattcgtgttgccggaaaatgctaacactgatgccatatcagcggtttgtcaggatggggtgctgactgtgactgtccaaaagttgccgccacctgagcctaagaagcccaagatcgttgaggtcaaggtcaattgatggggcgaggagtatcagtgatttctccaatccttggatcatgagttttcagaatatggaacatggtttctttttctttcgttcgttttttttcttttttttactctctttcttctttccgttggtggtgttttctgttgtaatgactgtaatgtgggggttacctctgtagtgtgtgttgaaggtttatgttaatgaatagtttaaggttttatcagaaatgtctactctttgctattatattgtaagattttttactccttctatggggcaggaaatggtcgtgtcgtataaatatgcaacaatgtcaatca

SEQ ID NO: 5460 - DNA, 480 bp, Lotus japonicus
ccatggacttcagggtgatgggtttgaattctccattgttccacactctttatgacatgatggacatgtcggacgacaccgcatccgacaagacactcaatgctccgacaaggacatacgttcgtgatgcgaaggcaatggcggcaacacctgcggacgtgaaggagaatccgaattcgtattttttcgtgatcgacatgcccgggttgaaatctggggacattaaggttcaggtggaagatgacaatgtgcttgtgattactggtgagaggaagagggaggaagagaaagaaggagttaagtatttgaggatggagagaagggttggcaaattcatgcgcaaattcgtgcttccagagaatgccaacactgatgctatctctgctgtgtgccaagatggagtgcttagtgtcactgtgcagaaattgccaccacctgagcccaagaaaccaaggactattgaagtcaagcttgcttaag

SEQ ID NO: 5461 - DNA, 897 bp, Solanum lycopersicum
agaagctcctagaaactttcttcattcttctttgatcatcctccagaactttccacttttccactatataaccctaacccctttaccccattctcactgcaattacaaatcaaaccaaaattgaaaaatttcacgcacaaaatcacaatatccaaaaatttctcaatactgaaaatggatttgaggttgttgggtatcgataacacaccactcttccacactctccaccatatgatggaagctgccggtgaagattccgacaagtctgtcaatgcaccatcaaggaactatgttcgtgatgctaaggccatggctgctacaccagcggatgtgaaggagtatcctaattcgtatgtttttgttgtggatatgccagggttgaaatctggagatatcaaagtgcaggtggaagaagacaatgtgctgttgattagtggtgaaaggaagagggaagaagagaaagaaggtgcaaagtttattaggatggagagaagggttgggaaattcatgaggaagtttagtctgccagagaatgcgaatactgatgcaatttctgcagtttgtcaagatggagttctgactgttactgttcagaaattgcctcctcctgagccaaagaaacccaaaacaattgaggtgaaagttgcttgaagttatggactctgttttgatggttggtggtatgatgtagtagaaataaagatgtaggagtagtgaacttttccttttatctttctgctatgttttcacgtctgtttgaaagttacaatagccatgggtattgtttgttttgatgtctaatgcagtgctatgcttctgtcgcattttctttaaacagaaatgactttcatttaattttcatggaaggattgcaacattaaaccataattaactctt

SEQ ID NO: 5462 - DNA, 2585 bp, Mimulus guttatus
aattaaaatttgctttcaagtacaaaacaaagctgaaatagcaattagaaccctgaaggctaaaccctgaaaattctcagcctcgtcgtccccactattactcaaagcgtgagctatggcgcggtggaagcctactgcagccctaagatcgacggttaaagagcggaagccgattgataagaagccgagcaatgccgaacgatcggctctcttcgccagacgagaagccgctaaagttttgcgcagcacgctccagggcgacgcccggcgccgagccgtcggctcaattaagtcgctcgtttacagcccttccgtcaggaacaaaaaggctacctttgccctggtctgccaaactctcaagcatctctcaattattaaggatgttttggaggaagcaaatgttctaagtgccaagtggaagaaacaccaagaactaatgtatatcatcgcatatgatttactctttggacaggaagtttcgttaagtggtgatgctgaaaagtatctcatgctgaagaaagatgcactacaatcagctctatcacgtattttaaggcgtaagggagtgaaaactgtagaagacttgctgggtcttgataaaaaatctgaagtaagaaaacctcgttatgttcgtgtgaacactttaaagatagacgcagaatacgccaaaagcgaattaagacaacaatattcggtccaagaggatgacatggtgccggatttgttgatcctcccaccaggtgctgatctgcacaatcatcctctagtcaagaacggaagtattttcttgcagggaagggcaagctcgatggctgccgtagctcttggaccgaaacctggatggaaggtcattgatgcttgctcagctcctggtaacaaaactgtgcatcttgccgctcttatgaagggcaaggggaaaattatagcttgtgaacttaacaaagacagggttaagcgcctgcaagataacgtcaaactggcgggagccataaatgtgaaagttaagcatggagacttcttaaatcttgaccctaaagatccttcatattcgaaggtacgagctatactcttagatccatcatgttctggatcaggcactgcctttgacagattagatcatttactcccatcgcatagcgcagaaggcacctctgatcatgttgatgtaaagcgacttcagaagcttgccggtttccaaaagaaggctctagaacacgcattatctttcccatcagtggagagaattgtttacagcacatgctcaatacatcaaactgagaatgaagatgttgtcaactctgttttgcattttgcttcatcacttggcttccaactcgcaacagcgtttccccaatggcctcgtcgtggtctccctactttcgacgggtctgaacatttgttacgaacagatccaacgatcgacaaagaaggcttcttcatctctctatttgttcgagaaggccttgcacaaaatgaagaacaccaaattcgcagaaactcccatagcagggctagaaaacctctaaacatcttcgtggcgaaaatgcttaaagtttcgaggcaccaccgatttaaactctcttgcaacagagcaaatgcagcatcgtctcgaggtatctaaacttttttgtagactatttattatacgcaatttttcaacttcaaaaattttgatacaaaattgagtataaagatgttgatttttagtgcaagaagattgaattcaaaacatagatcataatcattcatcatttcatttcaaaaaccacaataccacaaccacaaaagcaaaatcacatgacaaaaagttgtcatgtaaccaaaacaaaaacattattcaatactaactcgaaaccttaacacataacagaaatacacagaaccagtctcttcaagcaattttaacctcaatagtcttgggcttcttcggctccggtggaggcagtttctccactgtgacagtcaacactccatcctgacaaacagccgtgatcttatcagtgttggcattctccggcaacacaaatttcctcataaactttccgatccttcgctccattctgacgtacttggccccttccttctcctcttccctcttcctttccccgctgatcagcaaaagattgtcttcctcaacctgcactttaatgtcgccggattttaatcccggcatgtcgatcacgaaaacgtaggagttggggtattctttgacgtcagcaggcgttgccgccatcgccttggcgtcacggacgtaggttctggttggtgcgctgaccgatttggtcgagtcggaatcgtctgtgtcgagcatgttgtggagagtgtggaggagtggcgcgtcgaatcccattagtctgaaatccattttcttttttcacagaaatgtaggattaattcttttgagagaggattttttttttttctgatggtattttgcagatgttaattgacgagtagtgtggggggtggatttatagtgtgggtgtggaagaagaagaagtagaatgcagaagtttctagagagggaaaactgaattctggcgctatctggtagaattgatgggtttctagaaagtgaccggttc

SEQ ID NO: 5463 - DNA, 731 bp, Mimulus guttatus
aattaacatctgcaaaataccatcagaaaaaaaaaaaatcctctctcaaaagaattaatcctacatttctgtgaaaaaagaaaatggatttcagactaatgggattcgacgcgccactcctccacactctccacaacatgctcgacacagacgattccgactcgaccaaatcggtcagcgcaccaaccagaacctacgtccgtgacgccaaggcgatggcggcaacgcctgctgacgtcaaagaataccccaactcctacgttttcgtgatcgacatgccgggattaaaatccggcgacattaaagtgcaggttgaggaagacaatcttttgctgatcagcggggaaaggaagagggaagaggagaaggaaggggccaagtacgtcagaatggagcgaaggatcggaaagtttatgaggaaatttgtgttgccggagaatgccaacactgataagatcacggctgtttgtcaggatggagtgttgactgtcacagtggagaaactgcctccaccggagccgaagaagcccaagactattgaggttaaaattgcttgaagagactggttctgtgtatttctgttatgtgttaaggtttcgagttagtattgaataatgtttttgttttggttacatgacaactttttgtcatgtgattttgcttttgtggttgtggtattgtggtttttgaaatgaaatgatgaatgattatgatctatgttttgaattcaa

SEQ ID NO: 5464 - DNA, 765 bp, Nicotiana benthamiana
cgaaaagcccagttaaaatacagcaaatcaaaatcctacattcaaaagtatctccaaattgaaaccaattcaaccaagaagaggaagatggattttaggctaatgggtatcgacactccactgctccacactctacaccacctcatggaaacagcaggtgatgattccgacaagtccgtcaacgccccgtcaaggaactatgtgcgtgacgctaaggcaatggctgcaactccagccgacgtgaaagattacccaaattcctatgttttcgttgtagacatgccagggttgaaatccggagatattaaggtgcaagtggaagatgacaatgtgctgctgatcagcggagaaaggaagagagaagaagagaaagagggggaaaagtatatcagaatggagagaagagttgggaaattcatgaggaagtttacgctgcctgagaatgcgaatactgatgccattgctgctgtttgtcaagatggggtgttgactgtgaccatccagaagctgccgccacctgagccaaagaaacccaaaactatcgaggttaaaattgcataagattttgttactttgtttttgtggttacaaaagtgctctgttttgacgcaataaagatggtagagatttaagattggtttttctttccctctgttttctttatattttttctttgatttatgaaatgtgaggaagaatcaaatgtgtaggtgttctatccttgtttaaaatgcaagtgaaaattttcaagtggcccgttttttt

SEQ ID NO: 5465 - DNA, 868 bp, Mimulus guttatus
gaaccggtcactttctagaaacccatcaattctaccagatagcgccagaattcagttttccctctctagaaacttctgcattctacttcttcttcttccacacccacactataaatccaccccccacactactcgtcaattaacatctgcaaaataccatcagaaaaaaaaaaaatcctctctcaaaagaattaatcctacatttctgtgaaaaaagaaaatggatttcagactaatgggattcgacgcgccactcctccacactctccacaacatgctcgacacagacgattccgactcgaccaaatcggtcagcgcaccaaccagaacctacgtccgtgacgccaaggcgatggcggcaacgcctgctgacgtcaaagaataccccaactcctacgttttcgtgatcgacatgccgggattaaaatccggcgacattaaagtgcaggttgaggaagacaatcttttgctgatcagcggggaaaggaagagggaagaggagaaggaaggggccaagtacgtcagaatggagcgaaggatcggaaagtttatgaggaaatttgtgttgccggagaatgccaacactgataagatcacggctgtttgtcaggatggagtgttgactgtcacagtggagaaactgcctccaccggagccgaagaagcccaagactattgaggttaaaattgcttgaagagactggttctgtgtatttctgttatgtgttaaggtttcgagttagtattgaataatgtttttgttttggttacatgacaactttttgtcatgtgattttgcttttgtggttgtggtattgtggtttttgaaatgaaatgatgaatgattatgatctatgttttgaattcaa

SEQ ID NO: 5466 - DNA, 883 bp, Orobanche aegyptiaca
aacctacttcattctattcaatattctcaatcagcaaaccaaaatatccgataatttttcattgaaagcttctcagatcaaaatggatttcagattgatgggactcgacgctccactgatccacaccctccacaacatgctcgattccgacgaatcagacgccggaaaatccgtcagcgctccgaccagaacctacgtccgcgacgctagggccatggcggcgaccccagccgacgtcaaggagtaccctaactcgtacgtgttcgtgatcgacatgcccgggttgagatccggcgacatcaaggttcagatcgaggaggacaatctcttgctgatcagcggagagaggaagagggaggaggagaaggaaggggctaagtacgtgaggatggagaggaggatcggtaagttcatgaggaaattcgtcttgccggagaatgcgaacacggataagatcgcggcggtttgtcaggacggagtgctgactgtcacggtggagaaattgccgccgccggagccgaagaagccgaagactatcgaggtcaagattgcttgagttagttatgattgtcgatggaggattatcctctttcttgttttgtttatgttgagatttggcgttaagtatgaaataatgctttttgtggttcgattgaagttatgtgatctgtgttggaattactcttgttttgtttatgagattgctgttattagattttgctctctttgcactgttgcgtgtcttgttttatcaatttgatttagttgaggtatatcaggtgagcggtatttctgaacatttaacatcagtccaacaatggtgtgtaattgggaacaaatttatccaaataaaatttaatgaggaagatgaaggcttgatggt

SEQ ID NO: 5467 - DNA, 856 bp, Nicotiana tabacum
ggccattacggccgggggcaaaaccaaagcgaaaaaaaccaactcaaatacaccaaaatcaaaatctcataatatctcaaaattgaaacacactcagttaatcaaagaggaggaagatggatttcaggctaatgggtatcgacacaccacttctccacactctccagcacttcatggacgccgccggtgaagattccgacaagtccattaacgccccgtcaaggaactatgtacgtgacgctaaggcaatggctgcaacaccagccgacgtgaaagagtaccaaaattcctatgtgttcatcgtggacatgccggggttgaaatctggagatattaaagtgcaggtggaagatgacaatgtgctgctgatcagtggagaaaggaagagggaagaagagaaagaaggggctaagtatattagaatggagagaaggattgggaaattcatgaggaaatttacgttgccggagaatgcgaatactgatgcaatttctgctgtttgtcgagatggggttttgactgtgattgttcagaagttgcctccacctgagcctaagaaacccaaaactatcgaggttaaaattgcatgagatattggactagttattaattactctgttttgtggacacgggaattggaagtgctctgttttgatgcttgatagtatgactcagtaataaaaatggtatagatctaggagtggttatctcttcctctgttttctttatattttctagatgctttatggagtatgaaggaacaaaatgtttgggtatgctatctcttgtatactgcaagtgaaatgcttctactaatatccagtattgtttcatcgattgctatcaatattttcaa

SEQ ID NO: 5468 - DNA, 722 bp, Nicotiana tabacum
  misc_feature (287)..(287): n is a, c, g, or t
aatgggaattgacacaccactgttccacactctccagcaccttatggacaccgccggtgaagattccgacaagtccgtcaacgccccatcaaggaactatgtacgtgacgctaaggcaatggctgcaacaccagccgacgtgaaggaataccctaattcctatgttttcgttgtggacatgccagggttgaaatccggagatattaaggtgcaggtggaagatgacaacgtgctgctgatcagtggagaaaggaagagagaagaagagaaagaaggggctaagtatnttagaatggagagaaggattggaaaattcatgaggaaattttctctgccggagaatgcgaatactgatgccatttctgctgtttgtcaagacggggtcttgactgttactgtccagaagttgcctcctccagagcccaagaaacccaaaactatcgaggtcaaaattgcatgagatattagagtagttaataattactctgttttctggacatgggattgggaaatgctctgttttgatggtaataaaatggtagagatctaggagtggtggtctttccctctgtttgtctttaatatttcccatgttttttgaagtatgatgaaatgtgaagaactaaatgtctaggtgtgccatctcttcttgtttactgcaggggagatgctactactatctagttttgtttcttcgactactatcaatatagagagtgcaa

SEQ ID NO: 5469 - DNA, 861 bp, Juglans hindsii x Juglans regia
  misc_feature (37)..(37): n is a, c, g, or t
  misc_feature (106)..(106): n is a, c, g, or t
  misc_feature (516)..(516): n is a, c, g, or t
  misc_feature (529)..(529): n is a, c, g, or t
  misc_feature (549)..(549): n is a, c, g, or t
  misc_feature (558)..(558): n is a, c, g, or t
  misc_feature (645)..(645): n is a, c, g, or t
  misc_feature (661)..(661): n is a, c, g, or t
  misc_feature (672)..(672): n is a, c, g, or t
  misc_feature (678)..(678): n is a, c, g, or t
  misc_feature (688)..(688): n is a, c, g, or t
  misc_feature (698)..(698): n is a, c, g, or t
  misc_feature (702)..(702): n is a, c, g, or t
  misc_feature (737)..(737): n is a, c, g, or t
  misc_feature (746)..(746): n is a, c, g, or t
ttcgattccatttcaaagttatccaaaaacttgtctngcatctcgtgtgtcagtgacgaaaccagccaacttagaagagagaaatggatttcagaatcatgggtgnggattctccactgttctccaccctgcagcagatgatggacctggccgatgacaccgacaagtcgtccttcaacgctcctacacgcacctacatgcgcgacgccaaggccatggccgccactcccgccgatgtcaaggagtacccaagctcctacgtcttcatcatagacatgccggggctcaagtccggggatatcaaggtccaggtagaggaggacaatgtgctcgtgataagcggtgagaggaaacgggaggaggagaaagagggagccaagtatgtgaggatggagaggagggtgggcaagttcatgaggaagtttgtgctgcctgagaatgccaacacagatgctatctctgcggtttgccaggatggcgtgttgactgtgactgtggagaagcttccgcctccanagcccaagaagcncaagaaaattgaggttaagnttgcataancgcagtggttggtgatgggtcttgggtgactcgatggggtttgcccatttagttggattatgggaataatcgagtattttgtccttngtgtgttctgtcattncttgcaagtgnattttntcttttatcnttgtgccttnggtntgtgttaagaaaattgttcttaccaatgaagaatntgctatatnctatggtattgtagtgccgacaaccaaattccttcagaagcaggggctgccctgttcattggttaatgcgacgtgttttactcctttcatgaaatggttcggtttatttttttac

SEQ ID NO: 5470 - DNA, 673 bp, Cucurbita pepo
gttcctacacaacatctccttccgccaacatccttctcctgtgttctttccctaagcatcaaacaagagaaagatggatctcagagtcatgggcttggactccccactcttctccaccctccagcaggtgatggacttcgccgacgacgccgacaagtcttcagcgccccgacccgtacctacgtccgggacgccaaggccatggcagccactccggccgacgtcaaggagtatccgaattcctatgtttttgtcgtcgacatgccggggttgaaggttggtgacatcaaggttcaggtagaggaagacaatgtgctactggtaagtggcgagaggaagagggaggaggagaaagaaggggctaagtacgtaaggatggagagaagagtcggcaagtttatgaggaaatttgtgttgccggaaaatgccaacacggatgccattacggcggtttgtcaggacggtgtgcttactgtgactgtgcaaaagttgccaccaccggagcctaagaagcccaagatcgttgaggtcaaggtcaattgatggggcgggagtattatggatggattcctacttctgaactttggatcatgggttttcaagatatggcaccatggtgtacgtgtgtgttttattttccctttccttttgctgtcgtaataaccgatatgtg

SEQ ID NO: 5471 - DNA, 930 bp, Eucalyptus grandis
cagtagctctccacttcgaatcgatttctcgaaaccctaatcaatctccttcctccagtttcaccgaccgagcagcagacgcgcgacgatggatttccgcctcaccggcctcgagtccccgctcttcgccaccctgcaccacctgatggacgtccccgaggaggccgagaagtccgccagcgcccccacccgcacctacgtccgcgacgcccgcgccatggccgccaccccggccgacgtcaaggagctcccggggtcctacgccttcgtcgtcgacatgcccggcctcggctccggggacatcaaggtccaggtcgaggacgacaacgtgctggtcatcagcggcgagaggcggcgcgaggaggagaaggagggcgccaagtacctgcggatggagcggcgggtcggcaagttcatgcggaagttcgtgctgccggagaacgccaacaccgaggccgtctcggccgtgtgccgcgacggggtgctgaccgtcaccgtggagaagctgcccccgccggagccgaagaagcccaagacgatcgaggtcaagatcgcctgaagtgggcccgcggagctgagctacgggtgtgccgatgaggatgctcattgggaatgaagaataacgatgggcgtgctttgcttttaagaaggttgttcttgtgttttgcgcgcggaacttgcaggttcttgcgcaggtgctatgtttttttttttccttttttttgggtcgaagcgcaggtgctatggttagtaggctatgtgtttgatgtttggctcgtgcttatcatgaatgaatatcggtggatgtgttgtattctgaactcgttcgtatcttcttttgcctgatcttactcttcatgaatcgtaatctcgacatggacaaaagcaacttaaaatggcacgttgtgatccttcttgcttggaaatgcg

SEQ ID NO: 5472 - DNA, 768 bp, Vitis vinifera
tataagaaccacaccaccggcatgaattcctcataagaaaatcaattccaacattttcatttacaaatcttagcagatctcagagactaatcgctgaaaagcaaaatggatttgagggtcatgggttttgattctccactcttctcaaccctccaacacatgctcgacgccggcgacgattccgacaagtctctcaacgctcccacccgcacctacgtccgggacgccaaggccatggcggcgacgccggctgacgtcaaggagtacccgaattcctacaccttcatcgtcgacatgccggggctgaggtccggcgacatcaaggttcaggtggaggacggcaatgtgctggtgatcagcggagagaggaagcgggaggaggagaaggaaggtgccaagtacgtaagaatggagaggagagtggggaagtttatgaggaagttcgtgttgccggagaatgcgaattctgataagatctctgctgtatgtcaagatggggtgttgaccgtcaccgttgagaagctgccaccgccggagcccaagaagcccaagaccattgaggtcaaaattgcttgaaatgtagggggttttgggagggtatttctgggtttttaatagtaaataatgccacaggagcctttgtttgggtttgatcttgggtcaatggcttggggtgatgaagatactgatctcttcattacagtataatgtgtagttttgatttttcagtaccgtcaatgaagtctgccttttctcttccttgcctcg

SEQ ID NO: 5473 - DNA, 814 bp, Tropaeolum majus
gaaacttcattttcctcctcctccccattataagtacaactcaaaactccattcgattctcacagaaaaagccaaaaaccaacaatcaatatcgaaattctctttgtgtaattctcgtggcttgaagagaaagatggattaccgaatgatgggcctcgaatcaccactcttcgcgacgctccacaacatgatggacttaaccgatcaagagggccaaggcgaaaaatcctcttcccacgcaccaactaggacctacgtccgagatgcgaaagcaatggcgtccacacctgcggacgtcaaggagtacgccaagtcgtacgtgttcgtcgtcgacatgcctgggttgaaatccggtgatatcaaggtacaggtggaagacaatgtactgctgattagcggagagaggaagagggaggaagagaaagaaggagctaagtatgttaggatggagcggaggatcgggaaattcatgaggaaatttgcgctacctgataatgctaacaccgatgcaatttcagctgtttgtcaggatggtgtgttgacggttaccgtagagaaattgcctccaccggagcctaagaagcccaagactatcgaggttaagatcgcgtagatgctgatttgaagtcgtttctcgttgtttttgatgttttgagaaatgaatttgtgtttctttttggtgtttgtgttgatgaatcctatttcttcatgtcttttgatttagcttatcaagaatgatatcttctagctatgaatgcaaatatgcaaagtgtcgaatctatttctcatgttttctaattgatcttctattcta

SEQ ID NO: 5474 - DNA, 3207 bp, Citrus clementina
taaaattagaagtgtaggattaatcgattgccctagcgctagccatggcgcgcactaagacagcggcaactgccccatcgggagcatcagcgaagacatctcgaaacggccgactaagcaacgctgagcggtcggcttactttgcgaggagagaagccgcgaaggtcttgcggttggtcctccgaggcgacgcacgtcgccgagccgtcggctccatcaagtcgctcgtctatagcccctctgtgaagaacaaaaaagccactttcgctttggtttgtcaaactctcaaacatctctctattattaaacaagtgttggactctgctagcatactcaatagcaaatggaagaggcaagaagaattggtctacatactaacttacgacatcctctttggccaggaaatatcattagtaggtgatgcagagaagtttctcatgctccataaaggtgctatacaatcggctctagctcgacttttagtgaggaataaggtcaagagcattgaagacttaatggcactttatcaaactcctgatgttccaaagcctcgttacgttcgtgtcaatactctgaaaatggatgttgattcggcggtgcttgaattggggaagcagtttgtggtccaaaaggatgacttggttcctgacttattgatactcccaccaggttgtgatttgcacgatcatcctctgatcgtcaatggatgtgtattcttgcaaggaaaagcaagttctatggtagcagcagccctagcacccaaaccaggatggaaggttcttgatgcctgttcagctcctggaaacaaaactgtgcacctagctgctcttatgaaaggaaaaggaaagattgtagcatgtgagcttaataaggaaagggttagacgtctcaaagacaccattaagctctctggtgctgctaatattgaagtcctgcatggggactttttgaacttagacccgaaagatcctgcatactctgaggtccgtgccattctcttagatccatcttgctctggatctgggactgcagctgagaggttagaccatctactcccgtcacatgcttcaggtcatactgctgatcctactgaaatggaaagactgaataaactttcagctttccaaaagaaggcattgcgacatgcattatcttttcctggagttgagagagttgtgtacagcacctgctccatccaccaagttgaaaatgaagatgtcatcaaatctgtcctgcctattgctatgtcctttggctttcaattggcaacctctttcccccaatggaattgccgaggcctcccagtttttgaaggctctgagcatttacttcgaaccgatccagtggaagacaaagaaggcttttttatagctctatttgttaagggtaatatcatcgatcgctccaaaaatcccactatgccaagcagctataatagcaaagtaagtgaacacattaaaggaaataagaccataacgaagacaaagcgcatgaagctattcatgcataatagaatgttcaaaatatggtcccattgtttgttgagatccaggagacttgttctggatttgaaaaatgacaaacagttgcgttaaacttttgagaatctaatgaagcagctcttctagtgttaattgatatctcttatccattccctgttaacgttaatgagattccttgcttctttattgtcctctggagttgttttccaggacaatatattttgccaattgggcactcaaaaaaaggttcgggcatgagtaggtgacaactccagactattgtctttgcgagtatcgttataaattggctatttaattgtctttgggagatctttaatgttcaacattttcactcagtaatgtgaacccagtacctgatgtaaaatctcgctgccatgtttgttcgtgttttgtaaattgccatattgattttagtgcaagagattccaaaatttagtgaaagtttgtaataaatgtgctgcagtaaacaggtaaccgaggagcacgagaaacattcagataaaagctggatttttcattaattataacaactagatgtctaccagtagacggccgtcagcttcccctccggaatgccaaagaccgaaccacaaaccagtgaacagagagaattttggacaaaaaagggaagaaagagaaaaaaagaaaaaggaagaggagattacagaggcatagtaccgtcaaacccacaagcaaaattattcataacaaccggcaaatagaaaagacatcagcacccacaatccagcatattctctctctcaaagttcaagcaatcttaacctcaatggtcttgggcttcttgggctccggcggtggcagcttatcgacagtcacagtcaacactccgtcctgacacaccgccgaaatggcttcaacgttagcattctcaggcagcacaaatttcctcataaacttgccaaccctcctctccattctcacatacttggccccatctttctcctcctcccgcttcctctcaccgcttatgagcagcacattgtcgtcctccacttggaccttgatgtcccccgacttcagtccgggcatatcgacgatgaacacgtacgagttcggatactccttcacgtccgcaggcgtcgccgccattgccttggcgtctctcacgtacgtgcgcgtcggcgcgttggatgacttgttgtcagcggagtcgtccgcccccatctccatcatgtgctgcagagttgaaaagagtggcgatgagtccaaacccatgattctgaaatccattcttttgcgagtattagctgttgttgatgtttgctactgccaaatgaggattcgttcgtcttttgttggttaaaaaatgtggagagtgctttcagtatttatggaggagtatgggggaggaaaggaaagttctggagagagtttcgggaatgtctgggggagtttccagcagtttctattacgttctagttcttcatccgtccttctggagtcttacggacgctcgctttacagttttagaaaaagtcattgccaaaactaggaaataggtgggacaaaccaaactataattgtttgggctggcccaatgttgtttccgggttgcgcccacttgtatttagagatattttcaaggttatcccttatccgggatctactttgtcaattgggacctgacctattacatttttgcgaacatgagcaggtgatcacc

SEQ ID NO: 5475 - DNA, 3177 bp, Citrus sinensis
agcgcgagccatggcgcgcactaagacagcggcaactgccccatcgggagcatcagcgaagacatctcgaaacggccgactaagcaacgctgagcggtcggcttacttcgcgaggagagaagcggcgaaggttttgcggttggtcctccgaggcgacgcacgtcgccgagccgtcggctccatcaagtcgctcgtctatagcccctctgtgaagaacaaaaaagccacttacgctttggtttgtcaaactctcaaacatctctctattattaaacaagtgttggactctgctagcatactcaatagcaaatggaagaggcaagaagaattggtctacatactaacttacgacatcctctttggccaggaaatatcattagtaggtgatgcagagaagtttctgatgctccataaaggtgctatacaattggctctagctcaacttttagtgaggaataaggtcaagagcattgaagacttaatggcactttatcaaactcctgatgttccaaagcctcgttacgttcgtgtcaatactctgaaaatggatgttgattcggcggtgcttgaattggggaagcagtttgtggtccaaaaggatgacttggttcctgacttattgatactcccaccaggttgtgatttgcacgttcatcctctgatcgtcaatggatgtgtattcttgcaaggaaaagcaagttctatggtagcagcagccctagcacccaaaccaggatggaaggttcttgatgcctgttcagctcctggaaacaaaactgtgcacctagctgctcttatgaaaggaaaaggaaagattgtagcatgtgagcttaataaggaaagggttagacgtctcaaagacaccattaagctctctggtgctgctaatattgaagtcctgcatggggactttttgaacttagacccgaaagatcctgcatactctgaggtccgtgccattctcttagatccatcttgctctggatctgggactgcagctgagaggttagaccatctactcccgtcacatgcttcaggtcatactgctgatcctactgaaatggaaagactgaataaactttcagctttccaaaagaaggcattgcgacatgcattatcttttcctggagttgagagagttgtgtacagcacctgctccatccaccaagttgaaaatgaagatgtcatcaaatctgtcctgcctattgctatgtcctttggctttcaattggcaacccctttccccaatggaactgccgaggcctcccagtttttgaaggctctgagcatttacttcgaaccgatccagtggaagacaaagaaggcttttttatagctctatttgttaagggtaatatcatcgatcgctccaaaaatcccactatgccaagcagctataatagcaaagtaagtgaacacattaaaggaaataagaccataacgaagacaaagcgcatgaagctattcatgcataatagaatgttcaaaatatggtcccattgtttgttgagatccaggagacttgttctggatttgaaaaatgacaaacagttgcgttaaacttttgagaatctaatgaagcagctcttctagtgttaattgatatctcttatccattccctgttaacgttaatgagattccttgcttctttattgtcctctggagttgttttccaggacaatatattttgccaattgggcactcaaaaaaaggttcgggcatgagtaggtgacaactccagactattgtctttgcgagtatcgttataaattggctatttaattgtctttgggagatctttaatgttcaaccattttcactctcagtaatgtgaactcagtacctgctgtaaaatcttgccgccatgtttgttcgtgttttgtaaattgccatattgattttagtgcaagagattccaaaatttagtgaaagttgtaataaatgtgctgcagcaaacaggtaaccgaggagcacgagaaacatttagataaaagctggatttttcattaattataacaactagatgtctaccagtagacagccgtcagcttcccctccggaatgctaaagaccgaaccgcaaaccagtgaacagagagaattttcgaaaaaaagggaagaaaaacaaaaaaagaaaaaggaagaggaggttacagaggcatagtaccgtcacacccacaagcaaaattattcataacaacaaccggcaaatagaaaagacatcagcacccacaatccagcatattctctctctttaaagttcaagcaatcttaacctcaatggtcttgggcttcttgggctccggcggtggcagcttatcgacggtcacagtcaacactccgtcctgacacacagccgaaatggcttcaacgttagcattctcaggcagcacaaatttcctcataaacttgccgaccctcctctccattctcacatacttggccccctctttctcctcctcccgcttcctctctccgcttatgagcagcacattgtcgtcctccacttggaccttgatgtcccccgacttcagtccgggcatgtcgacgatgaacacgtacgagttcggatactcctttacgtccgcaggcgtccccgccattgccttggcgtctctcacgtacgtgcgcgtcggcgcgttgaatgacttgttgtcagcggagtcgtccgcccccatctccatcatgtgctgcagagttgaaaagagtggcgatgagtccaaacccatgattctgaaatccattcttttgcgagtattagctgttgttgatgtttgctactgccaaatgaggattcgttcgtcttttgttggttaaaaaatgtggagagtgctttcagtatttatggaggagtatgggggaggaaaggaaagttctggagagagtttcgggaatgtctgggggagtttccagcagtttctattacgttctagttcttcatccgtccttctggagtcttacggacgctcgctttacagttttagaaaaagtcattgccaaaactaggaaataggtgggacaaaccaaactataattgtttgggctggcccaatgttgtttccgggttgcgcccacttgtatttagagatattttcaaggttatcccttatccgggatctactttgtcaattgggacctgacctattacatttttgcgaacatgagcaggtgatcacc

SEQ ID NO: 5476 - DNA, 817 bp, Tropaeolum majus
taacatcaaacacagaaaacgagttcattgctcatcattaatcagccaacaaacatttacgcaaacacttgcattggaaatcaaagagctcatcaaggaaaacaacggaatattttctaaacgaaaattattcaaggctacattggaatttaggcaattttaacctcgatagtcttgggcttcttaggctccggcggcggcagcttctctacagccacagtcaacacaccatcctggcaaacagctgatattgcatctgtattagcattatcaggcagcataaacttcctcatgaatttaccgatcctcctctccattctcaagtacttgaccccttctttctcttcctcctttttcctctctccgcttatcatcagcaaattgtcttcctccacttggaccttgatatcccctgatttcaaacctggcatgtcgatgacgaacacgtacgagttcggatattccttcacatccgcaggtgtcgcagccattgctttcgcgtcgcgcacgtaggttctcgtcggcgcgttggataacttgtctgttgcagcttcttggtctgctaactccataatgttgtgaaggtttaccaagagtggtgaatcgagacccatcaatctgaaatccatatgtgttttgaacttccgattagaaaatttgaatgatgtttgttactctgtcgcttagtttttgagttttaatttttctgttgtgatgattcaattggaatttgagatgaatttatagcagtgagttggttaagttaatcggagaatgaagaaaatgaagtttatgaacagatggttctggaagacga

SEQ ID NO: 5477 - DNA, 1170 bp, Fagus grandifolia
gctcctggaacctcccaaagccaatttctttttcccacaaagagatagatccctctagaaatttctgtttctctcctataaattcccaccaccaccactcctctttcaaaccaaattcagcctacaaaacaaagccaattgcatttcatttttcaattcctcagcaagaaacaaaatggatttgagaatcatgggtttggaatccccactgttgtcgaccctacaacacatgatggagctgagcgacgactccgacaagtcatcgtcttccatcaacgccccaactcgcacgtacgtgcgtgacgccaaggccatggcgtccacaccagcggacgtgaaggagtacccgaactcgtacgtgttcgtggtggacatgcccgggttgaagtccggggacattaaggtccaagtggaggacgacaatgtgctgttgataagcggcgagaggaagagggaggaagagaaagaaggggctaagtacttgaggatggagaggagggttggtaagttgatgaggaagtttgtgttgcctgagaatgccaacactgatgctatctgtgcggtgtgccaggacggtgtgcttactgtcactatcaacaagttgccacctccagagcccaagaagcccaagactattcaggtttccattgcctaagactaaaaccaaggccactgtctctcatgtcatctggccttcaatatcatatgggaataaattagtcgagtcttttttgttttagtgttgtttttttattttgggtttgtgacttatgtatgacatcatgtgatgtgagtgggattttggcttgtgattgtatttgtgcctgcttttatcaaaatgttgttagaaatgaagcttatatgtgtttgtgcctatacaggatggtgttatcttcatcttcatcttcttcgtttttttagaacatttcctctttcctaaaaatgtcaattacaagaatctatccacaagttggaactttactatagttctaagaatttctatgattaagagctacacatttgtttgcagcaagtaaagaatctgacaatctgtagtccttaaaacagggataccatgaaatcttaaaacgttagctgccaaagcaactacactatcttatatggagggcctttggtgcttaaccgattaggcactattaagtaatggtt

SEQ ID NO: 5478 - DNA, 502 bp, Lotus japonicus
cgccaatggatttcaggttgatgggtttggagtctccattgttccacactctgaaccagatgatggatgtttcagatcacgacactgcatccgacaagacaaacaatgctctaacacagacttacgttcgagatgcaaaggcaatggctgcgactccagcagacgtgaaggaatatccgaattcctacgtgttcgtgatcgacatgccggggttgaaatccggggacatcaaggttcaggtggaagatgacaatgtgcttgtgataactggtgagagaaagagggaggaagagaaagaaggggttaagtatttgaggatggagagaagggttggcaaattcatgcgtaaattcgtgcttcctgagaatgctaacacagatgctgtctctgctgtgtgccaagatggggttctcagtgttactgtgcagaaattgccaccacctgagccaaagaagccaaggactattgaggttaagattgcttgaagcaatgaagctttcaa

SEQ ID NO: 5479 - DNA, 976 bp, Tropaeolum majus
cggccgggggtcgtcttccagaaccctctattcataaaacttctttccgatttactttaccaactcactgctataaattcatctcaaattccaattgaatcatcacaacagaaaatcaaaatttataaacagagcgtcagagtttcaaacgtcgatcaacgtttctaatcggaatttcaaaatacacacaagagaaagatggatttcagattgatgggcctcgattcaccactcttcgtaaaccttcacaatattatggaattagcagatcaagaagctgcaacagagaagtcatccaacgcgccgacgagaacctatgtgcgcgatgcgaaagcaatggctgcgacacctgtggatgtgaaggaatatccaaattcttacgtgttcgttatcgatatgccaggtttgaaatcaggggatatcaaggtacaagtggaggaagacaatttgctgatgataagcggagagaggaaaaaggaagaagagaaagaaggggtcaagtacttgagaattgaaaggaggatcggtaaattcatgaggaagtttgtgctgcctgataatgctaatacagatgcgatatcggctgtttgccaggatggtgtgttgactgtggctgtagagaagctgccgccgccggagcctaagaagcccaagactatcgaggttaaaattgcctaaattccaatgtagccttgaataattttcgtttagaagatattccgttgttttccttgatgagctctttgatttctaatgcaagtgtttgcgtaaatgtttgttggctgattaatgatgagcaatgaactcgttttctctgtttgatgttatacatgctcaaatttaacttgtagtgtcctcattatgctaatgatatagtaagaaaagagcctgcgtagccagaagcgtttttgcgcagaaacagccgaaattgtttaggcgaatccgcccgccctgactgatcatcagtcttatcgtt

SEQ ID NO: 5480 - DNA, 738 bp, Glycine max
aacttcagcaaaacaaacaaaccagagtaataaaaatcttcaacttttagcagttttttttttctatattgcagaagccatggatttcagggtgatgggtttggattctccattgttccacacgctgcaacacatgatggacatgtcagaggacgctgcaggggacaacaagacatacagtgctccgacacggtcatacgttcgagacgccaaagcaatggctgcaacacctgcggatgtgaaggaatatcccaactcctacgtattcgagattgacatgccagggttgaaatctggggacataaaggttcaggttgaagacgacaacgtgcttctgattagtggggagagaaagagggatgaagaaatagaaggggtgaagtatctgagaatggagagaaggattgggaagttcatgcgcaagtttgtgttacctgagaatgccaacactgatgcaatctctgctgtgtgccaagatggggtgcttagtgtcatagtgcagaaattgcctccaccggaacctaagaaacctaagactattgaggttaaggttgcttgaacaacttgtagaacgaagttaaataaacgtttgtttccctctctagtagaagcaggggaagtaatgttttttctgatttgaaggtttttctgttctcaaagcaatggttttatggtattgtgattttgtgatgttgtaatcagatgatgctatatcagttgtttagtatttgctgatct

SEQ ID NO: 5481 - DNA, 985 bp, Glycine max
ccgaactcgctggaagttccacagaagactactaccactattagttttctccagaaacttccatttccagcacgctattagttctgtccagaaacttccatttcttcccgaattatctatttcccccatataaatagtcacccaaccccttttgtctgtcaagaaacttcagcaaaacaaacaaaccagagtaataaaaatcttcaacttttagcagttttttttttctatattgcagaagccatggatttcagggtgatgggtttggattctccattgttccacacgctgcaacacatgatggacatgtcagaggacgctgcaggggacaacaagacatacagtgctccgacacggtcatacgttcgagacgccaaagcaatggctgcaacacctgcggatgtgaaggaatatcccaactcctacgtattcgagattgacatgccagggttgaaatctggggacataaaggttcaggttgaagacgacaacgtgcttctgattagtggggagagaaagagggatgaagaaatagaaggggtgaagtatctgagaatggagagaaggattgggaagttcatgcgcaagtttgtgttacctgagaatgccaacactgatgcaatctctgctgtgtgccaagatggggtgcttagtgtcatagtgcagaaattgcctccaccggaacctaagaaacctaagactattgaggttaaggttgcttgaacaacttgtagaacgaagttaaataaacgtttgtttccctctctagtagaagcaggggaagtaatgttttttctgatttgaaggtttttctgttctcaaagcaatggttttatggtattgtgattttgtgatgttgtaatcagatgatgctatatcagttgtttagtatttgctgatcttagttatttctaagttactctgtgctgtccaatttccatcccaatctccaaataacagaatttaacagaatgcgtttagatga

SEQ ID NO: 5482 - DNA, 882 bp, Phaseolus coccineus
aagaaacattcacagaacaaaatctcaaacaaaagtcttggctttctaagcagtgttttttcgtatcaaagtgatggatttgagggtcatgggtttggaatctcctctgttccacacgctgcatcacatcatggacatgtcggaggagggtgcaggggacaaggcacacaatgctccgacacggtcatacgtgcgggacgcgaaagctgtggctgcaacacctgcggatgtgaaggaatatccgaattcctatgtgttccagatcgacatgccgggtttgaaatgtggggacataaaggttcaggttgaagatgataacatgcttttgattagcggagagagaaagagggaagaagagaaagaaggggcaaagtatctcagaatggaaagaagggttggaaagttcatgcgcaagtttgtgttacctgaaaatgcaaacactgatgaaatctctgcagtgtgtgaagatggtgtgctaagtgtcactgtgcagaaattgcctcctcctgagcctaagaagccacggactattgaagttaaggttgcttgagcttgctgaactttttaagaactagataaataaagatatgaagagagaagagaagtgatgttgtgtgaagggcaagagggttgcctctgtttgagtttttatcagagttttttggttggttgtatcgtgttcttattgaagtgatctgtggctttgtgatgatttgatgaatcagttaatgatgttaccttaatttatcttctttagctatctgattccttatacaactgtaacaactatgttattggtgttatgtttttactagataaactagtagtattcttgcagaatttataggtggaaagaaagaacagtgtcatttgtaggtcaaa

SEQ ID NO: 5483 - DNA, 724 bp, Phaseolus coccineus
acagaaacataagcagaacaaaatctgagagaacaaacgaatatttgagaaatcttcatattttcaaattcagaaagtgatggatttcagagtgatgggtttggagtctcccttgttccacacgctgcaccgcatgatggacacgtcggaggaaggtgcaggggacaagacacacaatgctccgacacagacatacgttcgagacgcgaaagcgatggctgctacacctgcggatgtgaaggaatatccaaattcctacgtgttccagatcgacatgccgggtttgaaatctggtgacataaaggttcaaattgaagatgataacgtgcttttgattagcggggagagaaagagagaagaagaaaaagaaggggtgaattttctgagaatggaacgaagggttgggaagttcatgcggaagtttgtgttacctgaaaatgcaaacactgatgcaatctctgctgtgtgtcaagatggggtgctcagcgttaccgtgcagaaattgcctcctcctgaacctaagaagccaaggactattcaggtcaaagttgcttgagattgaagaactaaacaaattgtgtctgttagagcccaaaagttgtttaagtttcacttgtttcaagatgtttttgcttgatttggttacaagttcttattaatgtcatttcttgctttgtagttttgtgataatatcagcagtgattttggtttgatcatcttttca

SEQ ID NO: 5484 - DNA, 716 bp, Phaseolus coccineus
acagaaacataagcagaacaaaatctgagagaacaaacgaatatttgagaaatcttcatattttcaaattcagaaagtgatggatttcagagtgatgggtttggagtctcccttgttccacacgctgcaccgcatgatggacacgtcggaggaaggtgcaggggacaagacacacaatgctccgacacagacatacgttcgagacgcgaaagcgatggctgctacacctgcggatgtgaaggaatatccaaattcctacgtgttccagatcgacatgccgggtttgaaatctggtgacataaaggttcaaattgaagatgataacgtgcttttgattagcggggagagaaagagagaagaagaaaaagaaggggtgaattttctgagaatggaacgaagggttgggaagttcatgcggaagtttgtgttacctgaaaatgcaaacactgatgcaatctctgctgtgtgtcaagatggggtgctcagcgttaccgtgcagaaattgcctcctcctgaacctaagaagccaaggactattcaggtcaaagttgcttgagattgaagaactaaacaaattgtgtctgttagagcccaaaagttgtttaagtttcacttgtttcaagatgtttttgcttgatttggttacaagttcttattaatgtcatttcttgctttgtagttttgtgataatatcagcagtgattttggtttgatca

SEQ ID NO: 5485 - DNA, 651 bp, Euphorbia peplus
caatagaaaaagcaatcattttccaaaagctttgatccccagagatggatttcagaatcatgggaggcatcgaatcgccgctttttcaagccctgcatcaaatgatggacgccggcggcgaggaaaccgacaagtcctataatgctccaactcggacctatgtaagggacgcaaaagccatggcatcaacacctgcagatgtgaaagagtatccgaattcatatgtgtttatcatcgatatgcctggattaaaatccggcgatataaaggtgcaggtggaggatgataatgtgcttattattagcggagaaaggaagagagatgaagagaaagaaggagctaagtatgtgaggatggaacggagaattggtaagtttatgaggaagtttactctgccggaaaatgctaacaccgatgctatttctgctgtttgtcaagacggcgttttgactgttactgttaataaattgccaccgccggagcccaaaaagcccaagactattcaagttcaagtcgcttgatcgatcgattccacctctcaattaattatgctgtttttgttgtttttccttgttcctagtagtttatatgttttggctttaattgtagtgtgcttccgaaatgattatcggagtgtgtgggttgcgtttt

SEQ ID NO: 5486 - DNA, 526 bp, Solanum phureja
aatttgaacaatttcaaacacgaaatcacaacatccaagaagtgaagaatggatttgaggttgctgggtatcgataacacaccactcttccacactctccagcatatgatggaagctgccggtgaagattccgacaagtcggtcaatgcaccatcaaggaactacgttcgtgatgctaaggccatggctgctacaccagcggacgtgaaggagtatcctaattcgtatgtttttgttgtggatatgccagggttgaaatctggagatattaaagtgcaggtggaagaagacaatgtgctgttgattagcggagaaaggaagagggaagaagagaaagaagaggcaaagtttattaggatggagagaagggttgggaaattcatgaggaagtttagtctgccagagaatgcgaatactgatgcgatttctgctgtttgtcaagatggagttctgactgttactgttcagaaattgcctcctcctcagccaaagaaaccaaaaacaattgaggtgaaagttgcttgaa

SEQ ID NO: 5487 - DNA, 718 bp, Euphorbia esula
  misc_feature (38)..(40): n is a, c, g, or t
caatagaaaaagcaatcattttccaaaagctttgatcnnnagagatggatttcagaatcatgggaggcatcgaatcgccgctttttcaagccctgcatcaaatgatggacgccggcggcgaggaaaccgacaagtcctataatgctccaactcggacctatgtaagggacgcaaaagccatggcatcaacacctgcagatgtgaaagagtatccgaattcatatgtgtttatcatcgatatgcctggattaaaatccggcgatataaaggtgcaggtggaggatgataatgtgcttattattagcggagaaaggaagagagatgaagagaaagaaggagctaagtatgtgaggatggaacggagaattggtaagtttatgaggaagtttactctgccggaaaatgctaacaccgatgctatttctgctgtttgtcaagacggcgttttgactgttactgttaataaattgccaccgccggagcccaaaaagcccaagactattcaagttcaagtcgcttgatcgatcgattccacctctcaattaattatgctgtttttgttgtttttccttgttcctagtagtttatatgttttggctttaattgtagtgtgcttccgaaatgattatcggagtgtgtgggttgcgttttaaataatttcttttttgtaattttattttctgccattaaatgtgagtttatctcgtttttaaaaatt

SEQ ID NO: 5488 - DNA, 727 bp, Amsonia hubrichtii
acctatatatacacttcctacattcttccatcatcgtcagaaaaaacagtgagaatcctctagttcagagcttcacaatccccttcagttcaaacatccaaattctctcagccactatcccaaattcaccaaatcaagaagggaaaaatggatttgaggctaatcggactcgatgcaccactacttcacaccctccagcacatgatcgatgccgctactgatgatgctgacaagtccactaacggaccatcaagaacctacgttcgagacgccaaggccatggctgcgacaccggcagatgtgaaggaatacccgaactcctacgtttttgtggttgatatgcctgggttgaagtcagcggacatcaaggtgcaggtggaggatgacaatgtgctcatcataagtggagagaggaaaagagaagaggaaaaagaaggtgccaagtatgtgagaatggaaaggagggttggcaagtttatgaggaagtttgtgctgccggaaaatgcgaatactgatgccatttctgctgtttgtcaagatggtgtcttgacggttactgtccagaaactgcctcctcctgagcctaagaaggctaagactgttgaggtcaaggttgcttgaattttagtgtttgctttgttgtgggtaatgggtttggtctgtcattgccatgcctaccgcttaatggaataatctagctagggatttagggaagaagaacttttgt

SEQ ID NO: 5489 - DNA, 564 bp, Nicotiana benthamiana
  misc_feature (499)..(499): n is a, c, g, or t
  misc_feature (502)..(502): n is a, c, g, or t
  misc_feature (515)..(515): n is a, c, g, or t
  misc_feature (517)..(517): n is a, c, g, or t
  misc_feature (537)..(537): n is a, c, g, or t
  misc_feature (555)..(555): n is a, c, g, or t
ggggaattcaaattaaaactcagaatcacaaaattccacatccaaaaaatcccaggatcaaccaagaagaggagaatggatttcaggctaatgggaattgacgcaccactctttcacactctccagcaccttatggacgccgccggtgaagattccgacaagtccgtcaacgccccttcgaggaactatgtacgtgacgctaaggccatggcttcaacaccagccgacgtgaaagagtaccccaattcctatgtttttgttgtggacatgccggggttgaaatccggagatatcaaagtgcaggtggaagatgacaatgtgctgctgattagtggagaaaggaagagagaagaagagaaagaaggggctaagtatatcagaatggagagaaggattggaaaattcatgaggaaatttactctgccggagaatgcggatactgatgccatttctgctgtttgtcaagacggggtcttgattgttactgtccagaagttgnctncctcctgagcccnanaaacccaaaactatcgaggntaaaattgcatgagatantatagtagt

SEQ ID NO: 5490 - DNA, 774 bp, Orobanche aegyptiaca
aaatggatttcagattgatgggattcgactccccactgatccacaccctccacaacatgctcgattccgacgaatccgacgccggaaaatccgtcagcgctccgacccgtacctacgtccgcgacgctagggccatggcggcgaccccagccgacgtcaaggagtttcctaactcgtacgtgttcgtgatcgacatgcccgggctgaaatccggcgacatcaaggtccagatcgaggaggacaacgtgttgctgatcagcggcgagaggaagagggaggaggagaaggaaggggctaagtatgtgaggatggagaggaggatcggcaagttcatgaggaaatttgtcttgccggagaatgcgaacacggataagatcgcggctgtttgtcaggatggggtgctgagtgtgacggtggagaaactgccgccgccggagccgaagaggccgaagaccatcgaggttaagattgcttgagaataagatggttaagaacgggttcgtggggtttctaagtgctatcttttatgtctttttaatgtttaaataatgtgttggtcgaatggatatcattatgacttttgtagtgtgatttgatttggagttatcgttctgtttttgtttaattgagtgagacaccatttgtgatattttcatccttcgatctgatgtttttgttttcctctttaagtcgttaaagatttttttaccgcagttgatcggcacgtaaactcatgaatatgtgggtggaatgtatttaattttgcaagtgctc

SEQ ID NO: 5491 - DNA, 729 bp, Carica papaya
atctgcaaccaaaaatcaaactactcgacaaatcaaatagctcgccttcaagtcgtcggagagagaaagatggatgtaaggatgtttgaattagagtcacctatactgtcgtcgctgcgacagttgatggagctacaagatactgaaacagagaaatcattcaacgctccgacaagaacctacgtgcgagacgccaaggccatggcggcaactcctgctgacgtgaaggagtatccaaactcttacgtctttgttatagacatgccgggcttgaaatctggggatatcaaggttcaggtggaggatgacaacgtgctgcagatcagcggggagaggaagcgggaggaagagaaggatggagttaagtatttgaggatggagaggaggatcggcaagttcatgagaaagttttctctgccggataatgcaaacactgatgcgatatccgcggtttgtcaggacggtgttttgaccgtcactgtccagaagttgccgccaccggagcccaagaagccgaagacgattgaggttaagattgcctaaggtgtgataaactacgtaaatctagtttttgttggtgtacgtgctgtttccggatgtatgtgttccgagtttggtgtgttgcatcgtagtttctttctcttcacagtaaaaatgtgatttcatggttttcatgtaatccttgtgtgagtgataagataatgaaagagtaaaaataatttctaacaa

SEQ ID NO: 5492 - DNA, 863 bp, Vitis vinifera
aacattcaagcacttctacattcgcaattgcagttgttcacattctcacaccaacaaatctctggaacccaacatggattcgaggatgatgggcttcgattctccactcttctctgccctccaacacatgctagacgccaccgatgactccgacaagtccgtcagcgcccccactcgcacctacgtccgcgacgccaaggccatggcggcgacgcctgctgacgtcaaggagtacccgaattcctacaccttcatcgtcgacatgccggggctgaagtccggcgacatcaaggttcaggtggaggacgacaatgtgctggtgatcagcggagagaggaagcgcgaggaagagaaggaaggcgtcaagtacgtgagaatggagaggagggtaggcaaatttatgaggaagtttgcgttgccggagaatgcgaatactgataagatctccgcggtttgtcaagatggagtactgaccgtcaccgttgagaaggtaccaccgccggagcccaagaagcccaagacgattgaggtcaagatcgcttaaatctccgtgatttctgagtgggtaattgccgataagctggtctaattgggatttctgtgaatttggtcagggtatgatattgggtcattggcttctacatagaagctgatgatttctttacaaatattctagttttgagtatgaatgaaagccttcctgctctgtttttcttcttctttggtgtatctctcttctggttggaagcttcattgtatgcgtagagaagatgggaaaactgatcttcctaagaaatattaccctgaaactataaggcttttgtaagatttaagagtgattgagcaaaagttttattttaact

SEQ ID NO: 5493 - DNA, 917 bp, Gossypium hirsutum
gaaattctagaccttcccaaaacattctggaaaagtggaaatccttgaaggatatgtgacattataacacagccttctcgaaaactctcgacgtcttcttccagaaacttcctacccaaccttataaatgagctaataccgttcatgattctccatccaagccgagaaacgtagtgaatttgcaaccgaaaaccgaatcaaaatcttcgcaatctcatccagctacaaaaaagaaaaatggatctcagaatcatgggtttcgattctccgctcttgaatactctccaacatatgatggatctttctgacgatacggagaagatcccgaacgcaccatcaaaggtttacatgcgggatgccaaggccatggctgcaacaccagcggacattaaggagtaccccaagtcttatgtgttcatcgtcgacatgccggggctgaaatcaggggacatcaaggtccaagtggaggacgacaatatgctcttgatcagcggagaaaggaagcgagaggaagagaaagaaggagccaagtacgtaagaatggagaggcgggtcggcaagcttatgaggaaatttgcgttgcctgagaatgctaacactgatgccatctctgcaatctgtcaagacggggttttaactgttactgtggagaaactgccaccccctgagcctaagaaacccaagaccatcgaggttaaaatagcttgaagcagctttagatttacggttaattgtcaatgggggctttaaataagttgggggttagccctgtaagtagtttctagcgtttgccgtggtggtttctgagtgtgttaaacgtttgatatcagagttctatgtcgtgttgtgttgaaatcatgaaatgcagattttactgttagtattttcttgtattttccatctctggttttaatcac

SEQ ID NO: 5494 - DNA, 856 bp, Gossypium hirsutum
gtgacattataacccaaccttctcgaaaactctcgacgtcttcttccagaaacttcctacccaaccttataaatgagctaataccattcatgattctctatccaagccgagaaacgtagtgaatttgcaaccgaaaaccgaatcaagatcttcgcaatctcatcgagctacaaaaaagaaaaatggatctcagaatcatgggtttcgattctccgctcttgaatactctccaacacatgatggatctttctgacgatacggagaagatcccgaacgcaccatcaaaggtttacatgcgggatgccaaagccatggctgcaacaccagcggacattaaggagtaccccaagtcttacgtgttcatcgtcgacatgccggggctgaaatcaggggacatcaaggtccaagtggaggacgacaatatgctcttgatcagcggagaaaggaaacgagaggaagagaaagaaggagccaagtacgtgagaatggagaggcgggtcggcaagtttatgaggaaatttgcgttgcctgagaatgctaacgctgatgccatctctgcaatctgtcaagacggggtcttaactgttactgtggagaaactgccaccccctgagcctaagaaacccaagaccatcgaggttaaaatagcttgaagcagctttagatttacggttaattgtcaatgggggctttaaataagttgggggttagccctgtaagtagtttctagcgtttgccgtggtggtttctgagtgcgttaaacgtttgatgtcagagttctatgtcgtgttgtgttgaaatcatgaaatgcagatgttaccgttagtattttcttgtattttccgtctctggtttt

SEQ ID NO: 5495 - DNA, 1574 bp, Gossypium raimondii
atgaactctaaaatgttcgattttataggaatttttggactttgattttcgatttttctctaattttcttctttttggaagttattttttgctgttctttgtagttgtgttgttaaacggtttgccctaccgtttaactctaaccaatgattaaatagaaccattccaagaaaaacaaaacaaaatccggcccaccgcaccgtatgttgtgtcaatcaatgactcgctctttcctgtagtgtgtaagaaattctagaccttcccaaaacattctggaaaagtggaaatccttgaaggatatgtgacattataacacaaccttctcgaaaactctcgacgtcttcttccagaaacttcctacccaaccttataaatgagctaataccattcatgattctccatccaagccgagaaacgtagtgaatttgcaaccgaaaaccgaatcaagatcttcgcaatctcatccagctacaaaaaagaaaaatggatctcagaatcatgggtttcgattctccgctcttgaatactctccaacatatgatggatctttctgacgatacggagaagatcccgaacgcaccatcaaaggtttacatgcgggatgccaaggccatggctgcaacaccagcggacattaaggagtaccccaagtcttatgtgttcatcgtcgacatgccggggctgaaatcaggggacatcaaggtccaagtggaggacgacaatatgctcttgatcagcggagaaaggaagcgagaggaagagaaagaaggagccaagtacgtaagaatggagaggcgggtcggcaagcttatgaggaaatttgcgttgcctgagaatgctaacactgatgccatctctgcaatctgtcaagacggggttttaactgttactgtggagaaactgccaccccctgagcctaagaaacccaagaccatcgaggttaaaatagcttgaagcagctttagatttacggttaattgtcaatgggggctttaaataagttgggggttagccctgtaagtagtttctagcgtttgccgtggtggtttctgagtgtgttaaacgtttgatgtcagagttctatgtcgtgttgtgttgaaatcatgaaatgcagatgttaccgttagtattttcttgtattttccatctctggttttaatcacatatgtttttgctaacaatggtcaatggaattcctcatgccaggcagaaatttatggctaaaagagaaagggaaagacttgcagcaaattgtattaaaacttgggaggtaacatgacaaaacagggttgataaaaaaaatttaatcaaatagcaggctgttatttcaggttaaccctaaaactaggtttagaatataaaaacattttaaacattccgccaaacagggttggcattataattctcgcctctttcttgctaagatttttctttttagtacgctctacaagagacagatgagatgaatcagggctcagcgatgggtggattacggatccttcttccctgataaacagagcaatgaaaaagccttctttgtcctcacccgggtcagtccggagcaaatgttcaac

SEQ ID NO: 5496 - DNA, 2547 bp, Vitis vinifera
gggagccatggtgtcttcgaaaacggcggcgacgacagcctcacgcgccaagaagccgaaggagcagcggctaagcaaagccgaccggtcttcatacttcgctagaagggaagccgcgaaggtcctgcagtgcgttctccaaggagacgctaagcggcgagccgtcggctccatcaaatcgctggtctatagcccctcggtgaggaacaagaaggccaccttcgcgctcgtctgtcaaactctgaagcatctttcaattatcaaggatgttttggactctgctaggattctaaatgccaagtggaagaggcaagagggattgatgtatataatcacttacgatattctatttgggcaggaaatttcatcagttggtgatgcagagaaatttctactgcttcagaaagatgctatacagttagctctagcacggcttttggtgcgaaagaaggtgaaacgtgttgaagacttgatggctctttatcaaattcctgatgtttcaaaacctcgttttgttcgtgtaaatactctgaagttggatgttgagtctgccttccacgagttagggaaacagaacatggttcagaaagatgatatggttcctgacttgttaatactcccaccaggtagtgatttgcataatcatcctctggtcagaaatggtagtgggaaagcaagctcaatggtggcggtagcacttgggccagagcctggatgggaggttcttgatgcatgttcagctccaggaaacaagaccgtgcaccttgctgcacttatgaatggaaagggaaagattatagcatgtgaactggataatgaaagggttaaacgtttagaggacactgtccgactttctggggctgctaacatagaagttttgcacggggactttttaaacctaaatccgatggatccatcatactcaaaggttcgtgctattctcttagatccttcctgctctggatctggaaccactgccgagagattagatcatctgctcccgtcatatgctgcaggcgatgccacagatgttgctggcacagaaaggctaaacaagcttgctgcttttcaaaagaaggctttggaacatgcattatcttttccagcagtcgagaaagttgtctacagcacatgctccatccatcaaattgaaaatgaagacgtaatcaaatctgtcctaccccttgctgcatcacatggttttcaactcgcaacaccattccctcagtggcctcggcgtggcctccctgtttttgaaggctctgaacatctgcttcgaacccatccagttgaggacaaagagggcttcttcattgctctgtttgtcagaaagagcattgccagaagcttggaacagccaatcaaaacccgtaagaacaacaaggtgaaatctgccaaaagaaatgcaaccatgaaccataataaatctgtgatgccttttcctttcactagactgtccaaattgttgctacattctcatctgagattacagacttacaagaaactaaatctgtctacttgaaatactcccaagactataaaatacttttcttttgcctattagactcttatgtaaccccaaaagttcaaaattcttaaggaaatgtccttgatctctttgttttcctgttattgcttcaaatccctgtaagtatgctcttattttgcttggaattgcttaggtaggaaaacaacttatgaacttacttataatataagtagaggtactccattgataggatgctcaaaactacatactgataaagaaagcctgagcttcatcactagaaaccacacacacaaccatggtccatacttaaacctattatccaccacattttttaccataaaatccaccaaaaccccaaggatcttaggcgatcttcacctcaatggtcttgggtttcttgggctccggcggaggcaacttctccactgtgacggtcaacaccccatcctgacaaatcgcggagatcttgtcagtattggcattctcaggcaacacaaacttcctcataaacttccccacccttctctccatttttacatacttggcgccttccttctcctcctcgcgcttcctctctccgctgatcaccagcacattgtcgtcctccacctgcaccttgatgtcgccggacttcagccccggcatgtcgatgatgaaggcgtaggaattggggtactccttgacgtccgccggcgtcgcagccatggccttagcatcgcggacgtaggtgcgagtgggggcgctgacggacttgtcggagtcgtcggcggcgtcgagcatgtgttggagggctgagaagagtggagagtcgaggccaatcattctcaaatccatgttgggtttcagagattcgttggtgtgagactatgaacaactacaactgctgaatcggaaacgcttgaatgttgaagaaatgtgaggcggtggtgtggtttttataggacatgagttggggaaacaaaggaaggttctggaaataatgggaaggggaagaattgggaacttctgggagaatctgtttgatttttctccggtgg

SEQ ID NO: 5497 - DNA, 759 bp, Carpinus betulus
agagcgatacaatcaactagctaactccttagcaaaaatacgtccgagaaagaagaaaggaaatggattcagagtcatgggcctggattcccactcttctcgaccttgcagcatatgatggaccagaccgagaaaccgacaagtccttcaacgcccgaccctctcatacgtgcgcgacgccaaggcgatggcggcaactccggccgacgtgaaggagtacccaaactcctacgtcttcatcatcgacatgccgggggtcaagtccggggatatcaaggtccaggtggaggccgacaatgtgctcgtgataagcggcgagaggaagagagaggaggagaaagaggggcccaagtacgtgaggatggagaggaggatcggaaagttgatgaggaaatttgtgctgcctgagaatgccaacaccgatgccatctctgccgtgtgccaggacggcgtgctgactgtgacagtgcagaagttgcctcctccggagcccaaaaagcccaaaaccatcgaggtcaagattgcttgaagaatggatcggttgggttcgatgttgattttggtggggttatcagttatgggaataatcgattaattatcatttccgttgttgttgctgttgttggttttttttttttgtttgttgagagagaatcatttccattgttgcttgtgtgttctgtttgtggttatcagtttggtatgttgtgtttatcagcttataatatcagagttttcataccaaaaaaaaaaagtaaa

SEQ ID NO: 5498 - DNA, 588 bp, Fagus grandifolia
attgcatttcacttttcaattcctcagcaaaacaaaatggatttgagaatcatgggtttggaatccccactgttgtcgactctacaacacatgatggagctgagcgaggactccgacaactcatcgtcttccatcaacgccccaactcgcacgtacgtgcgtgacgccaacgccatggcttccacaccagcggacgtgaaggaatacccgaactcgtacgtgttcgtggtggacatgcctgggttgaagtccggggacattaaggtccaagtggaggacgacaatgtgctgttgataagtggcgagaggaagagggaggaagagaaagaaggagctaagtacttgaggttggagaggagggttggtaagttcatgagaagtttgtgttgcctgagaatgccaacactgatgctatctctgcggtgtgccaggacggtgtgcttactgtcactatcaacaagttgccacctccagagcccaagaagcccaagactattcaggtttccattgcctaagactaaaaccaaggccactgtttctcatgtcatctggccttcaatatcatatgggaataaattagtcgagttc

SEQ ID NO: 5499 - DNA, 2812 bp, Quercus alba
atatcgcgagggaattcccgggagttgtaaagcaggcaagccgaaaaccccaaaaggcagggaagtggaaagcgatggcggcggtagggcgtgggaagacgcggctgagcaacggggagcggtcggcgtacttcgcaaggagagaggcagcgaaggtattaggaagtgtcctccaaggcgatgctcgtcgccaagcagtggcctccataaaatctctgatatataggccttgtatcagaaacaagaaggccaccttcgctctcgtctgccaaacactcaagcatcttcctattattaaggatgttttggatgctgctaccattctcaatgccaaatggaagaggcaacaggacttaatttacattatcacatatgacattctttttggccaggccgtttcattagttggggatgccgagaaatttctgatgcaccagaaagatgctttacaaacagctctagcacgcctgttagttaagaaaaaagtgaagacccctcaagatttggtggatctttatcgaattcctgaaatttcaaagcctcgttatgttcgtgtcaatactctgaaaatggatgttgattcagccttacttgaattagggcaacaaaacatggttaaaaaggataacatggttcctgacttgttgatactcccaccaagtactgacttgcataatcatcctctggtcacgaatggaagtgtctttatgcaagggaaggcaagttctatggtggcagcagctcttgatcctaaaccaggatgggaggttcttgatgcatgctcagcccctggaaacaaaactgtccaccttgccgctcttatgagaggaaaggggaagattatagcatgtgagctgaataaggaaagggttatacgtctaaaagagaccattaaactctctggtgcctctaatatagaagttctgcatggagatttcttaaactgcaatccaaatgatccgtccttttccaaggttcgtgcgattcttttggatccttcatgctctggttctgggacagcctctgtgagattggaccatctgctcccatctaatgctgcaggtcatgcagctgatgttactgatactgaaagattgaacaagcttgcggctttccagagaaaagtgctcatgcatgcattatcttttcctgcagttgagagagtggtttacagcacatgttccatacaccaaattgaaaatgaagatgtcgtaaaatctgttcttcctcttgctgcatcatatggttttcaactggcaactcccttcccccaatggcagcgccgtggtctcccagtttttgaaggctttcaacatcttctgcgaaccgatcctgttgaggatggagaaggctttttcattgccttatttacaaagagagacgacaaaaatcactccgaaaagcaagcaacctgcagaaataattccaaatctcttgccagagacggctgcaccagtagatttagaagtgggaagaaaagaattgtaataaactttgcccatactaaattgtttctgatgtggttgcatgcaaaacagagtaggcgaaaaagggacaacttcaatactggtggctcgtatagaccaatgactactgattgcttttgaattttgaaaattatccaagtttttggtttaattatcttttctaaagatgaggtatagtcgcagacaactagtatgaatttctatcccagcgaattttttgatacacacagccccgcttcctgaatttgtagtactcattttgctactgcaaatctgctgtgattgtgctcagcaagaatattagctcaaatatgttgctctggcacctaatggattaagattttatgttgctcttagttttagaactgggttcctttacttgttgattagaatttcatgtcatactaacccatgtggggttggctcttccattgtgaaaaagaaaaaaattgggaacagtttgctacaaacagatgtatagctcttcatcagagaaattaaataggagagtctagaaaagctcctacttgctgaaaaactcatgcaattctcattacaagaagataacattacatattgaagaagataacatagcacacatgcttcattcattcctaacaacagaatgtaagcacaaatacaagcataacaagacacacacctaaacaagagcaaacaaacagagactggattgatttattctcccatatgatatgatagacagacgaagaagtcccattatgatggagtaataattaagcaatcttaacctcgatagtcttgggcttcttgggttctggaggtggcaacttgttgacagtaacagtgagcacaccatcctggcataccgcagagatagcttctgtgttggcattgtcagggagcacaaacttcctcatgagcttgccaatcctcctctccatcctcaggtacttggtcccttctttctcttcctccctcttcctctcgccacttatcaaaagcacattgtcgtcctccacctgcaccttaatgtccccagacttcaacccaggcatgtccaccacgaacacgtaggagttggggtactccttcacgtctgccggtgtggccgccatcgccttggcgtcgcggacgtacgtgcgacttgggccgttcaaggatgccgaagaagacttgtcgtcgctcagctccatcatctgctgcagggttgacaacagtggggatgattccaaacccatgattctcaaatccatattttaatttcttgattgaagaagaaaaggatgctaaaattgtgttttggaactagataattttaatttggtttgaaagaggaggtggtg

SEQ ID NO: 5500 - DNA, 1135 bp, Tropaeolum majus
aataaaataataaatttatcgaaaaataggatttatgattccttctctaacattctagcacttttccagaaacttcatttccagctctctccggaaacttcatttcctccccctttcttccgcttgttcatcgacacaccactatatatatataatcattcacctcaaatccacattccatcatcaacaatcaaatctaaatccaatatcaatcaagcaaagttttcgaatcctttcccctcgtttgatttccgaagcgaaagaaaaaacacgaaatggatatcaggttcatgggactcgattcaccactcttctcaacccttcaccacgtgatggacatggccgatcacgagtctgccggagaaaagtcatccaacgctccgacgaagatctacctccgcgacgccaaggcaatggctgcaacgcctgcggacgtgaaagaataccccaactcctacgcgttcgtgatcgatatgccagggctgaagtcaggggacataaaggttcaagtggaggacgggaatgtgctgttgataactggagagaggaagagggaagaagagaagaaggaagaagctaagtatgtgagaatggagagaaggatcgggaagtttatgaggaagttcgtgttgcctgataatgcgaatacggatgctatatcggctgtttgtcaggacggggtgttgactgtgagtgtggagaaattaccgcctccggaaccaaagaagccgaagacaattgaggttagggttgcttgatcgattatgcaaatcaaatacagatgctataccgaatgcttttatgtactgctttttctgattaactacaatgtagtgatggaaatgatgtgatctgagtgtctgttgttgaaatgtcttttggtgttctttgagtgcttaatgaatctagttttgcattagaaatgcttagtttcttctaatctttcttgcatggatggcttgaattacattacagttagtgatctcgaaagtaatcatcgcataataggaagatcatagattaaaatttagcgacaattcattctggatctaattgaaattttccctgtaattgttgtattcatctgaatgggatgatcggtaatagaaattgaaatgagtaatttcttactaag

SEQ ID NO: 5501 - DNA, 757 bp, Glycine max
ctcaaagaaaaaataaaggcaaaagcaaataactattaccaacaaactctactttcggcaaccttcaatttttttgaaagtcatggatttcagagtgatgggtttggagcctccgttgttccacacgctgcaacacatgatggacatgtcagaggacgctgcaggggaaaacaagacgtacagtgctccgacacggtcatacgttcgagacgccaaagcaatggctgcaacacctgcggatgtgaaggaatatcccaactcctacgtgttcgagatcgacatgccgggtttgaaatctggggacataaaggttcaggttgaagacgacaacgtgcttctgattagtggggagagaaagagggatgaagaaaaagaaggggtgaagtatctgagaatggagagaagggttgggaagttcatgcgcaagtttgtgttacctgagaatgccaacactgatgcaatctctgcagtgtgtcaagatggggtgcttagtgtcactgtgcagaaattgcctcctcctgagcccaagaaacccagaaccattgaggttaaggttttctgaggtttcaatcgaatgctcacgaaccaattatctttgttcgaataaatgtaacgggaacaatattagctttagtgaggaccaactattggtgttcctctgtgtttgtattgcagtggttctgtttcttaggttggcttgtcacttgtgtatggaaatatgatactactactataatgagattttattgaatgcttt

SEQ ID NO: 5502 - DNA, 769 bp, Glycine max
ctcaaagaaaaaataaaggcaaaagcaaataactattaccaacaaactctactttcggcaaccttcaatttttttgaaagtcatggatttcagagtgatgggtttggagcctccgttgttccacacgctgcaacacatgatggacatgtcagaggacgctgcaggggaaaacaagacgtacagtgctccgacacggtcatacgttcgagacgccaaagcaatggctgcaacacctgcggatgtgaaggaatatcccaactcctacgtgttcgagatcgacatgccgggtttgaaatctggggacataaaggttcaggttgaagacgacaacgtgcttctgattagtggggagagaaagagggatgaagaaaaagaaggggtgaagtatctgagaatggagagaagggttgggaagttcatgcgcaagtttgtgttacctgagaatgccaacactgatgcaatctctgcagtgtgtcaagatggggtgcttagtgtcactgtgcagaaattgcctcctcctgagcccaagaaacccagaaccattgaggttaaggttttctgaggtttcaatcgaatgctcacgaaccaattatctttgttcgaataaatgtaacgggaacaatattagctttagtgaggaccaactattggtgttcctctgtgtttgtattgcagtggttctgtttcttaggttggcttgtcacttgtgtatggaaatatgatactactactataatgagattttattgaatgctttattaatttgcca

SEQ ID NO: 5503 - DNA, 840 bp, Capsicum annuum
gcaccgaggtttttctcgagaagtttccacatttccactatataaccaaatctcttccttacaccagttcaatcaatcagaaactaagctagaatttgaacaattccaaacaaaaatcacagaggaaaatggatttcaggctgatgggtatggacaacacaccaattttccatgttctccagcacatgatggatagtgcaggtgacgaatcagacaagtctgtgaatgccccatctaggaactatgttcgtgatgctaaagccatggctgccacaccagcagacgtgaaagagtaccctaattcctatgttttcgttgtggatatgcccgggttgaaatctggagacatcaaagtgcaggtggaagaggaaaatgtgctgcttattagcggagaaaggaagagggaagaagagaaagaaggtgcaaagtatatcagaatggagagaagggttgggaaattcatgaggaagtttactctgccagagaatgctaatactgatgcaatttctgctgtttgtcaagatggggtgttaaccgtcactgttcagaagttgcctcctcctgaaccaaagaagcccaaaacaattgaggttaaagttgcttgacatgttgctctgttttctggatgtgttttgatggttagaggaattatatgtagtacaaataaaatggtagagatctatgtaggagtactcatgtcttgctctcactcttatgcttcttgatgtgtttcaagtttatttgcaagtattatgaatgtattttggggtattgtatgggcatgatattgtttgtttgattgatgtttaatgcagtgcaaagcttctagcattctgtttc

SEQ ID NO: 5504 - DNA, 629 bp, Solanum phureja
gtagaagctcctagaaactctcctcattcttcttcgatccacctccagaacattccacatttccactatataaccctaacccctcattccaaaattcactgcaatttgaaatcaaaccaaaattaaaaaaatttctcaatactgaaaaaaaatggatttgaggttgctgggtatcgataacacaccactcttccacactctccagcatatgatggaagctgccggtgaagattccgacaagtcggtcaatgcaccatcaaggaactacgttcgtgatgctaaggccatggctgctacaccagcggacgtgaaggagtatcctaattcgtatgtttttgttgtggatatgccagggttgaaatctggagatattaaagtgcaggtggaagaagacaatgtgctgttgattagcggagaaaggaagagggaagaggagaaagaaggggcaaagtttattaggatggagagaagggttgggaaattcatgaggaagtttagtctgccggagaatgcgaatactgatgcgatttctgctgtttgtcaagatggagttctgactgttactgttcagaaattgccccctcctgagccaaagaaaccaaaatcaattgaggtgaaagttgcttgaa

SEQ ID NO: 5505 - DNA, 1395 bp, Glycine max
agcttgggagtggagattcagcaccgcgtggtagtgtagcccagatctaaactccgttggtgaattaaatgtttttttattcaatacaaaatttgctacgtcttatcaatttgtatattaggtgtggaatccaatccatgcatccaaattgatagcacgtggattgattacaagatgccaacgtctaaacctcttttccccaaagagaagaaaacataatagatatctcattctcatcttcatctgcatctgcccatgtttcttgtttctgtctgcaattttcaattccaactctctctcacatgcaattctccatccaacaaaagtttctcatcatttctgtttcccataagcaattaattaaaatactgaatttggtataatttctttctcaaatataattagttttacaattattttatttctttttccttggattgtagccggggtttcttgttgtgagagaaaaacctttattctctgttttgggaacatctggggtctcaatttagtggaagttaaattttgaaactttggacgaagatggcgaattgggtccaaaagaagatcactgatccccttctttccattatccgaagaggagctgaaccaaaccacttggctttctctgctgctcttggtgttacattgggactatttcctatatgtggtgtcactgtgttcctctgtggaatggctattgcattgcttggatcattttgccatgctccaactgtgatgcttgcaaactttattgctactccaatagagttgagtctggttgtaccctttctacgctttggtgaggttatctctggtggatctcatttccctttaacatctgatgctttaaagaaagttcttactggccaagcttcacgtgaagtcttattaagtgttgcccatgcgttattagggtggctggttgcatcaccatttattttgggaactctatacatagttcttttaccatgcttcaaaattctagttcataaattctcaagtgttcctttaagtccaaagaagccgctcaatccacactcagaagtaaagctgaaggtaagggatgtttgacaaagtagcaacgagatcatagtgtcaaaatctgctttgtcacagtgatcagtcattgattcatgttcttgtgtgacacaaattgtacataattaacaaaaacttgtcactgtttatattgctgagattgatgtatcctatttgtaaactatgtatttgtaaagcatgccatgagtatgtgatgtgatgttattaccaaaaatagtatattgttattggccatgggacatttgaagatcataaggaacatggagatcaaatttttcaaataggctaaattaaaagtgccaataatgcagccgatattttgttgctttcatc

SEQ ID NO: 5506 - DNA, 1452 bp, Glycine max
agcttgggagtggagattcagcaccgcgtggtagtgtagcccagatctaaactccgttggtgaattaaatgtttttttattcaatacaaaatttgctacgtcttatcaatttgtatattaggtgtggaatccaatccatgcatccaaattgatagcacgtggattgattacaagatgccaacgtctaaacctcttttccccaaagagaagaaaacataatagatatctcattctcatcttcatctgcatctgcccatgtttcttgtttctgtctgcaattttcaattccaactctctctcacatgcaattctccatccaacaaaagtttctcatcatttctgtttcccataagcaattaattaaaatactgaatttggtataatttctttctcaaatataattagttttacaattattttatttctttttccttggattgtagccggggtttcttgttgtgagagaaaaacctttattctctgttttgggaacatctggggtctcaatttagtggaagttaaattttgaaactttggacgaagatggcgaattgggtccaaaagaagatcactgatccccttctttccattatccgaagaggagctgaaccaaaccacttggctttctctgctgctcttggtgttacattgggactatttcctatatgtggtgtcactgtgttcctctgtggaatggctattgcattgcttggatcattttgccatgctccaactgtgatgcttgcaaactttattgctactccaatagagttgagtctggttgtaccctttctacgctttggtgaggttatctctggtggatctcatttccctttaacatctgatgctttaaagaaagttcttactggccaagcttcacgtgaagtcttattaagtgttgcccatgcgttattagggtggctggttgcatcaccatttattttgggaactctatacatagttcttttaccatgcttcaaaattctagttcataaattctcaagtgttcctttaagtccaaagaagccgctcaatccacactcagaagtaaagctgaaggtaagggatgtttgacaaagtagcaacgagatcatagtgtcaaaatctgctttgtcacagtgatcagtcattgattcatgttcttgtgtgacacaaattgtacataattaacaaaaacttgtcactgtttatattgctgagattgatgtatcctatttgtaaactatgtatttgtaaagcatgccatgagtatgtgatgtgatgttattaccaaaaatagtatattgttattggccatgggacatttgaagatcataaggaacatggagatcaaatttttcaaataggctaaattaaaagtgccaataatgcagccgatattttgttgctttcatcaatatctggcataacgttcttagaatttcagcaggatgctttactcatgttccacac

SEQ ID NO: 5507 - DNA, 1157 bp, Cajanus cajan
atgcatccaagttggtagcacgtggagatgccaacgtattaacctctttccccccaaatagaatacagatctgaccactgtttttttgcaattccaattctccaaactatgacatgcaattctcaatccaacaaagtttcccataagcaattaattaatcaattcaaatgttgaaatttatctattttgtttctcaaatataaattagttttacaattatatttctttttcttttttccttggattggagctggggtttcttgtggtgagagaaacactgattctctggtttgggaacatcataccctttgaagttcgaagaaaaattttgaaactttggacgaagatggccaacggcaaagtgaggataaccaattgggtccaaaagaagatcactgatccccttctcgccattatccgcagaggagctgaaccaagccagttggctttctctggtgctcttggtattacactgggagtatttcctatatgtggtgtcactgtattcctctgcgggatggccattgcattgcttggatcattttgccatgctccaactgtgatgctggcaaacttcattgctactccaattgagttgagtctggttgtgccctttctacgctttggtgagttgatcactggtggatctcatttccctttaacatctgatgctttaaagaaggttcttactggccaagcttcccaagaagtcatattaagtgttgcccgtgcgatattagggtggctggttgcatcaccgtttattttgggagctctatatatagtacttttaccatgcttcaaaattctggttcataaattctcaggtgttccttcaagtccaaggaagccgctccatccacactccgatgtaaaggcgaaggtaagggatgtttgacaaaatagcaatgaggtcatagtcgcaaattctgctttgtcacagtgatcagtcattcattcatatgttctggcgtgacacaagttgtacatagttaacaaagacttgtcactgtttataaagctgagatttatgtatcctatttgtaaactatgtaagcatgttatgtaatgtgattgattaccaaaaatggtacatattgttattagtcatgggacaattgaagatcacaagtaacatggattttaaattcttcata

SEQ ID NO: 5508 - DNA, 978 bp, Lotus japonicus
ggaataatccaatcaaagattctctgtttctttctttgttttccataataatcaatcaactatagttctaaaattcttttatgcaccacaataatactatataattattcagagttggggtttcttgtggtgagagaaaaactctgattctgatctcaatttactggactacccttcagagttgaatgttaaagttctaaactttgcccaaagatggcgattgggaagatgggaataaccgattggttccacaggaagatcactgatccccttctttccattattcgccgaggagctgagcctaaccagttggctttttctgctgctcttggcattacatttggagtatttcctatatgtggtgtcactgtattcctctgtgcaatggctattgcattgcttggatcatattgccatgctccaactgtgatgcttgctaactttgttgctacgccaatagagttgagtctggttgtaccctttctacgctttggtgaagttatctctggtggacctcatttccctttgacatctgatgctttaaagaaagtttttactggtcaagcttcacgtgaagtcttattaagtgttgcccatgcgttattagggtggctggttgcatcaccttttattttgggaactctgtacatagtactattaccatgcttcaaatttttggttcagaaattctcaactgttcctttaagtccgaagaagcctcttctccatccacactcagaaataagcctgaaggtaagggatgtttgagaaaacaatttcacagtcactgtatctgcttagtgagagtgatcatcaatcattcataggttcttttgtgacataacttgtacataacaaacaaaagcgtgtcactgtttgtaacgctaagatttactttgtgaagtatgtgatgtgattatcaagaatagtaagcattggcaaatatataattaatgctctcattttagaaaaaaaaaa

SEQ ID NO: 5509 - DNA, 1078 bp, Phaseolus coccineus
atacaaattgataggactacaaagctctctctctctctctttcctctttctctgcaacattgtcattttcaattctcaatcaaccaaatcatttcatcatcactgtttccacaatcaatcaattaattaaactgctgaaatttatgtactttccttcagaaattcagagtaattagttttataatttttaattttgttcttcattggattggaggtgaggtttcttgtggctagagaaaccctaattctctggtttggaacatctggggtctcaatttagtgaaaaccctttgaagttggaagttaaagtttgaagctttgaacgaagatggccaatgggaaagtgggaacaaccaattggttccaaaagaaggtcaccgatccccttctctccattatccgcagaggagctgagccaaaccagttggctttttctgctgctcttggtcttacattgggagtgtttcctatatgtggtgtcactgtattcctctgtggggtcgctattgcattgcttggaccactttgccatgctccaactgtgatgctagcaaacttcattgctactccaatagagttgagtttggttgtaccctttctacgctttggtgaagctatcactggtggatctcatttccctttaacatctgatgctttaaagaaagttttcactggccaagcttcacatgaagtcatattaagtattgcccatgcgttattagggtggcttgctgcttcacctatcattttgggtattctattcatagtacttttaccatgcttcaaaattctggtacataaattctcaagtgttccttcaagtccaaagaagcccctccatccacactcagaaacaaagttgaaggtaagggctatttgaaaaagtagcatagcaacaatagtcacagtgaacacgcactcactcatgtgttcttgcctgacataaattgtacagaattaacaaagacttgtaatgctgagattgataacaatgtatcctatctgtaaactatggatttgtaaggtatgtaatgtgatgttattaccaaatatagtatttgttatctccctcaagttg

SEQ ID NO: 5510 - DNA, 1019 bp, Cicer arietinum
gaaactctgattctgttatttgggagcatttgatttcaattttgtggaataccctttaaatattccaacttaaatttcaacactttgaacgaagatgacgattgggaaaatggaaataaccaattggttccacaagaaaatcactgatcctcttttctccattcttcaaagaggagttgagccaaaacagttggctttctctgctgctcttggcattacattgggagtatttcctatatgtggtgtcactgtattcctctgcggaatggctattgcatttcttggatctttttgtcatgctccaactttgatgcttgcaaactttatggctactccaatagagttgagtctgattgtaccctttctacgcttcggtgaagttatgtctggtgggcctcatttccctttaacatctgatgctttaaagaaagttcttacaggtcaagcttcacatgaggtcatattaagtgtcgcccatgcgttacttggatggctgactgcatcaccttttattcttggaacactatacatagtgtttttaccatgcttcaaatatctgattcagaaattctcaagtgttcctttaagtccaaagaagtcgctgctcaacccgcattccgaagtaaggttgaaggtaagggatgtttgaaaaatatagtaacaatgtcggagtgatcgatcgattatgcatataatgttctttcacgacacgatgcaaattgtatataattatcaaaaacttgttaatgtttataagctgagatcgatgtaccctatgttgtaaagtatgttgtgacaaaaagtagtaaattatgaaacagttaaaactgggattgttcaaattcttctgataaacaagttcatagaggtagttcagaagcagtgttaaaatgcaagtatattgttgacatgtgaatttaacttctctaaagtgaatagttcattttagagtctaaaatgagtagtcttaatcattaacctaaaaaataaataaaatcaatggttagtatttcaaacat

SEQ ID NO: 5511 - DNA, 843 bp, Glycine max
atgcatccatttaataataatacggcatgtaaaccacgataagataaattgtttctcttctctgcaaaaaggcgtgtcctattgaaaacatattttggggaaaaaaagtataagaagattgaaatcaaattgagccctaaagatctctcgtcggacgcggagagtttcactttcacccttcggttctcgatgtcagcgtttgacaatgttgttggtgggaaattgaagttgaagggaaaagcactggatgtggctggtggagtgaagaagaagaaaaagaagaacaagagaaatcaggaacaacttctgcaagtcgccgaagatgaagtttcagcaggtggaaatacagaacaggccaaagatcctaatgatggagatataaatgatgtgagtgaattaagcgggaaagggaagacagcccattatgatgatcatcttacaccggcggagaggcgatacatagagcagagggagcaacttgatgttcacagattggctaagatttctaataaatctcaccgtgatagaattcaggatttcaaccaatatcttgcaaacatgagcgagcattatgatattcctaaagttggtcctggatgattcaatgaaggccaatccttatcatttgtatttgttcgttaatactactattaatgccgtgtgcccgcacaatggttattgtcactgcttattgatactctgttttggattaagctatatttcatatgatagatatatttggtttctcctcctgtggatggataagtatgttattgccttcgacgaaatttcgtcatttattattattattattgtgcaagaaaggaaaaatgcatattctac

SEQ ID NO: 5512 - DNA, 878 bp, Glycine max
gcgagatatgcatccatttaataataatacggcatgtaaaccacgataagataaattgtttctcttctctgcaaaaaggcgtgtcctattgaaaacatattttggggaaaaaaagtataagaagattgaaatcaaattgagccctaaagatctctcgtcggacgcggagagtttcactttcacccttcggttctcgatgtcagcgtttgacaatgttgttggtgggaaattgaagttgaagggaaaagcactggatgtggctggtggagtgaagaagaagaaaaagaagaacaagagaaatcaggaacaacttctgcaagtcgccgaagatgaagtttcagcaggtggaaatacagaacaggccaaagatcctaatgatggagatataaatgatgtgagtgaattaagcgggaaagggaagacagcccattatgatgatcatcttacaccggcggagaggcgatacatagagcagagggagcaacttgatgttcacagattggctaagatttctaataaatctcaccgtgatagaattcaggatttcaaccaatatcttgcaaacatgagcgagcattatgatattcctaaagttggtcctggatgattcaatgaaggccaatccttatcatttgtatttgttcgttaatactactattaatgccgtgtgcccgcacaatggttattgtcactgcttattgatactctgttttggattaagctatatttcatatgatagatatatttggtttctcctcctgtggatggataagtatgttattgccttcgacgaaatttcgtcatttattattattattattgtgcaagaaaggaaaaatgcatattctacaaaagcgatcaggtttcaatgaatttta

SEQ ID NO: 5513 - DNA, 954 bp, Cajanus cajan
atacatgtatttaataatttagtaataatacgataagataagttgtttttgttctctacaaaaagcgtgccctattgaaagcaatttctttttaggaaaaaagtatgaaaatattgaaatcgaattgaggcataaagatctggtcgggcgcggagagttcaccctttcattcaagctttcgttttcgagatgtcagcgtatgacaatgttgttggtgggaaattgaagctgaagggaaaagcactggatgtggctggtggagtgaagaagaagaaaaagaagaacaagagaaatcaagatcaacttctacaagtcaccgaagatgaaatttcagcaggtggaaatacagaacaagccaaagatcctaatgatcaagatgtaaatgatgcaaacgaattaagcggtaaagggaagtctgcacattatgatgatcaccttacaccggcagagaggcgatacatagagcagagggaacaacttgatgttcatagattggctaaaattgctaataaatctcaccgtgatagaattcaggatttcaaccaatatctcgcaaacatgagcgagcattatgatattcctaaagttggtcctggatgattcatacagctgtacaagtatgaagaccaatcctcatcacttgtatgtgttagttaatattaatgccgtgtgtatgcacaatgcttattggcactgcatattcatactgtgttggaccaagctatgcccatatttcataatttcgtatcatagatatattttattgcatcccctgcagatggtaagtatgttattgacttcaatttaatttcatcattattttgttaattgttcaagaataggttaaatgtcagtttgcttatgtttaatgaaattgtttttaaatcgttgaaagcaatttcgatgtatgtcactactttttaaaaaaatagaaattaataattcgaaatccaa

SEQ ID NO: 5514 - DNA, 2122 bp, Phaseolus coccineus
gtgattccttgatctgagagaatttgcagagagagagagaagaagaagaagaagaagatgaagaagaagacgatggagaagtcgaagtccgccaacagtgacaccgtgcattcgccgcttgtcacttatgcttccatgatttctcttctcacgctctgtcctccatttgtcattctcctatggtacaccatgacttctgctgacggatctgttgctcagacgtggaattatttgaagcagaatggggtgcagggcttcctccatatatggcccagaccaactgctacggcgtgcaaaatcattgtcgtctacgctgtctttgaagcggcgcttcagctccttctgcccgccaaaaccgtttatggccccatttctccaactggtcatcgaccagtctacaaggcaaacggtgtggcagcgtatttagtcaccttgattacttatattgccctttggtggtttgggatattcaaccctacaattgtttatgatcatttgggagaaatatattcagcactcatcttcgggagctttgtcttctgtattttattgtacataaaaggtcttttggcaccatcttccacagattctggctcaagtggaaacataatcattgatttttactgggggatggaactctatccgcgcattggaaaatactttgacataaaagttttcacgaactgcagatttggaatgatgtcatgggcggttcttgcattgacctactgtataaagcagtatgaagaaaatggaaaagtatctgactcaatgctcgtaaatactgcattaatgctagtatatgttaccaagtttttttggtgggaagctggatattggaacacaatggatattgcacatgatcgagctggattttatatttgctggggttgcttggtgtgggttccatctgtgtatacatctcctggaatgtaccttgtcaaccatcctgtaaatctcggcattgagctagcgctctcaattttattggctggcattctttgcatattcatcaactatgactgtgacaggcaaaggcaagaatttcgtaggacaaatggaaaaagcacggtctggggaaaagctccttcaaagatagaggcctcgtataccactactaccggggaaactaaaagaagccttcttttaaccgcaggatggtggggattatctcgtcattttcattatgtccctgaaatactggcagctttcttctggacagtcccagctctttttaatcattttttgccttacttctacgtgatatttcttaccatccttctctttgatcgagcaaaacgtgatgatgatcgatgcagatccaagtaagcgtatggcaagtactggaaactatattgcgacaagatgtcatcgtatgacaatgtagttggtgggaaattgaagctgaaggggaaagctctggatgtggctggtggagtgaagaagaagaaaaagaagaacaaaagaaaccaagatcaacttctgcaagttgccgaagatgagatttcagcaggtggaagcgcagaagaagctaaagatttgaatgatgaggatacaattacggccggggaattgagcagtgggaaagggaagggtgcccattatgatgatcatcttacaccagcagagaggagatacatagagcagagggagcaacttgatgttcacagattggccaagatttctaataaatctcaccgtgatagaattcaagatttcaaccagtatcttgcaaacatgagcgagcattatgatattcctaaagttggtcctggatgattgacccattgtgataaagccaaatccttatcatttgtacttgttagttaatttcaatggcgtgtgcactcacagtggttaatgtcactatatattcatactttgttttggaccaacctctatttcgtataatacatatatttgttttctcttcctgtccatggagatgtatgttgttgccgtcaacgaaatttcgtcatttgttttattaattgtgcaagggaaaatgcataatgtacagaagctgataaggttacaaggaattttagcgtgaaaagattttacttatttagggcaggaaatatataaattatgttagtatgtcaaataattttagtacata

SEQ ID NO: 5515 - DNA, 2117 bp, Phaseolus coccineus
agtgattccttgatctgagagaatttgcagagagagagagaagaagaagaagaagaagatgaagaagaagacgatggagaagtcgaagtccgccaacagtgacaccgtgcattcgccgcttgtcacttatgcttccatgatttctcttctcacgctctgtcctccatttgtcattctcctatggtacaccatgacttctgctgacggatctgttgctcagacgtggaattatttgaagcagaatggggtgcagggcttcctccatatatggcccagaccaactgctacggcgtgcaaaatcattgtcgtctacgctgtctttgaagcggcgcttcagctccttctgcccgccaaaaccgtttatggccccatttctccaactggtcatcgaccagtctacaaggcaaacggtgtggcagcgtatttagtcaccttgattacttatattgccctttggtggtttgggatattcaaccctacaattgtttatgatcatttgggagaaatatattcagcactcatcttcgggagctttgtcttctgtattttattgtacataaaaggtcttttggcaccatcttccacagattctggctcaagtggaaacataatcattgatttttactgggggatggaactctatccgcgcattggaaaatactttgacataaaagttttcacgaactgcagatttggaatgatgtcatgggcggttcttgcattgacctactgtataaagcagtatgaagaaaatggaaaagtatctgactcaatgctcgtaaatactgcattaatgctagtatatgttaccaagtttttttggtgggaagctggatattggaacacaatggatattgcacatgatcgagctggattttatatttgctggggttgcttggtgtgggttccatctgtgtatacatctcctggaatgtaccttgtcaaccatcctgtaaatctcggcattgagctagcgctctcaattttattggctggcattctttgcatattcatcaactatgactgtgacaggcaaaggcaagaatttcgtaggacaaatggaaaaagcacggtctggggaaaagctccttcaaagatagaggcctcgtataccactactaccggggaaactaaaagaagccttcttttaaccgcaggatggtggggattatctcgtcattttcattatgtccctgaaatactggcagctttcttctggacagtcccagctctttttaatcattttttgccttacttctacgtgatatttcttaccatccttctctttgatcgagcaaaacgtgatgatgatcgatgcagatccaagtatggcaagtactggaaactatattgcgacaagatgtcatcgtatgacaatgtagttggtgggaaattgaagctgaaggggaaagctctggatgtggctggtggagtgaagaagaagaaaaagaagaacaaaagaaaccaagatcaacttctgcaagttgccgaagatgagatttcagcaggtggaagcgcagaagaagctaaagatttgaatgatgaggatacaattacggccggggaattgagcagtgggaaagggaagggtgcccattatgatgatcatcttacaccagcagagaggagatacatagagcagagggagcaacttgatgttcacagattggccaagatttctaataaatctcaccgtgatagaattcaagatttcaaccagtatcttgcaaacatgagcgagcattatgatattcctaaagttggtcctggatgattgacccattgtgataaagccaaatccttatcatttgtacttgttagttaatttcaatggcgtgtgcactcacagtggttaatgtcactatatattcatactttgttttggaccaacctctatttcgtataatacatatatttgttttctcttcctgtccatggagatgtatgttgttgccgtcaacgaaatttcgtcatttgttttattaattgtgcaagggaaaatgcataatgtacagaagctgataaggttacaaggaattttagcgtgaaaagattttacttatttagggcaggaaatatataaattatgttagtatgtcaaataattttagtacata

SEQ ID NO: 5516 - DNA, 720 bp, Cicer arietinum
gggcgtttcattgttccattcgattaaagtgattcacagagatgtcggcgtacgagaacgttgttgggggtaaactgaagttgaagggaaaagcattggatgtggctggtggagttaagaagaagaaaaagaagaacaaaagaaatcaagaacagtttttgcaagctgctgaagatgaaatttcaacaggtggaagtacagaacaagctaaagatcctaatgatgatgaggaagtaaacgatgggagcaaattgagcagagaagacaagcctgctcattatgatgatcatcttacaccagcagagaggcggtacatagaacaaagggagcaacttgatgttcatagattggcgaagatcgctaataaatctcaccgcgatagaattcaggatttcaatcaatatctcgcaaacatgagtgagcattatgatattcctaaagttggtcctggatgattcaaggaattgttcgagtacgaagaaggcaaatctctgtcaattgtattttgtttgtttaacattgacaccatatgctgtaacgatagttttcactacatatttatattttgttggatttaatttactttatatttgtcagtgtaaaaagtttttacgctgatagtgaattataaccatccgatatttaaaaatatttgacttgtatggtaattacttttaaaatgatttgttgacagtgtaaaatattttatatgatgagtgc

SEQ ID NO: 5517 - DNA, 837 bp, Cicer arietinum
aaaaatggatatatatatatataaacccacagttgcagccaacaccattattatactagaattgattgaaaaaataatttcgggcgtttcattgttccattcgattaaagtatcagtgattcacagagatgtcggcgtacgagaacgttgttgggggtaaactgaagttgaagggaaaagcattggatgtggctggtggagttaagaagaagaaaaagaagaacaaaagaaatcaagaacagtttttgcaagctgctgaagatgaaatttcaacaggtggaagtacagaacaagctaaagatcctaatgatgatgaggaagtaaacgatgggagcaaattgagcagagaagacaagcctgctcattatgatgatcatcttacaccagcagagaggcggtacatagaacaaagggagcaacttgatgttcatagattggcgaagatcgctaataaatctcaccgcgatagaattcaggatttcaatcaatatctcgcaaacatgagtgagcattatgatattcctaaagttggtcctggatgattcaaggaattgttcgagtacgaagaaggcaaatctctgtcaattgtattttgtttgtttaacattgacaccatatgctgtaacgatagttttcactacatatttatattttgttggatttaatttactttatatttgtcagtgtaaaaagtttttacgctgatagtgaattataaccatccgatatttaaaaatatttgacttgtatggtaattacttttaaaatgatttgttgacagtgtaaaatattttatatgatgagtgcattcaaattaaactctattttgttttggaa

SEQ ID NO: 5518 - DNA, 760 bp, Vigna unguiculata
agattgagaatttaaaatccatttgaaccctaaaatcggaaagtttgacggacgtttctgcgtttatgtattgagatgtcatcgtatgacaatgttgttggtgggaaattgaagctgaaggggaaagcgctggatgtggccggtggggtgaagaagaagaaaaagaagaacaagagaaaccaagatcaacttctgcaagttgccgaagatgatatttcagcaggtggaagtacagaagaaggtaaagatggtaatgaagaggatacaaatacggcgagggaattgagcagtgggaaagggaaggttgcccattatgatgatcatcttactccggcagagaggagatacatagagcagagggagcaacttgatgttcacagattggcaaagatttctaataaatctcaccgtgatagaattcaagatttcaatcagtatcttgcaaacatgagtgagcattatgatattcctaaagttggtcctggatgattggttcactgcgctttgcgagtatgaagccaaatcctttatcacttgtatttgtgggttaatttcaatgccgtgtgcatttatcactatacattaatactttgttttggaccaagctgtatttcgtataatacgtatgttgttgtcttcaacgaaatttcttctttttttattaattgtgcaaggggaaatgcataatgcacagaagctgatatggttacaaggaattttaacgtgaaaaacgattacttgtttaaaaaaaaaaaaaaaa

SEQ ID NO: 5519 - DNA, 752 bp, Vigna unguiculata
  misc_feature (740)..(740): n is a, c, g, or t
gggtgtaagattgagaatttaaaatccatttgaaccctaaaatcggaaagtttgacggacgtttctgcgtttatgtattgagatgtcatcgtatgacaatgttgttggtgggaaattgaagctgaaggggaaagcgctggatgtggccggtggggtgaagaagaagaaaaagaagaacaagagaaaccaagatcaacttctgcaagttgccgaagatgatatttcagcaggtggaagtacagaagaaggtaaagatggtaatgaagaggatacaaatacggcgagggaattgagcagtgggaaagggaaggttgcccattatgatgatcatcttactccggcagagaggagatacatagagcagagggagcaacttgatgttcacagattggcaaagatttctaataaatctcaccgtgatagaattcaagatttcaatcagtatcttgcaaacatgagtgagcattatgatattcctaaagttggtcctggatgattggttcactgcgctttgcgagtatgaagccaaatcctttatcacttgtatttgtgggttaatttcaatgccgtgtgcatttatcactatacattaatactttgttttggaccaagctgtatttcgtataatacgtatgttgttgtcttcaacgaaatttcttctttttttattaattgtgcaaggggaaatgcataatgcacagaagctgatatggttacaaggaattttaacgtgaaaaacnattacttgttta

SEQ ID NO: 5520 - DNA, 1858 bp, Cicer arietinum
attttttgcattcatatactaaaaagaaaaagtgaaagtagcatcccattctcatttctcatttctcatctctttataaatctatagtcttcgctaagtcgttgtttctttctctcactcacaagaaaacaagtcaagagtgaagatcgaaattcgaaaatgggggaatcgaaaaacgacaccgttcattctccaattgtgacctatttttccatgatatcacttctcacactatgtcctccttttgttattctactatggtatacaatgactgctgcagatggatcaattttgcgtacatttgattacttgattaataacggcttaaacggctttgttgatttatggcctaagccgactcttcttgcatgcaaaatcattggagtttacgccgtttttgaagccgcgcttcagcttttccttcctggtcacactgtttatggtcctatttctccctccggtaatcgacctgtttacaaggcgaatggtgttgctgcatatttagtcaccttggttacttatgttgttctttggtggtttgggatattcaacccaacaatcgtttatgatcatttgggagagatatactcaacactcatctttgggagctttatcttttgtattttcttatacataaaaggtcatttggcaccatcttctactgattctggctcatctgggaacataatcattgatttttactggggtatggagctctatccacgcattggaaaatattttgacataaaagttttcacaaactgcagatttggaatgatgtcatgggctgttcttgcacttacctattgcataaagcagtatgaagaaaatgggaaagtagctgactcaatgcttgtaaataccacactgatgctggtgtatgttaccaagtttttctggtgggaagctggatactggaacacaatggatattgctcatgatcgagctggattttatatttgctggggctgtttggtttgggttccatctatttatacatctcctggaatgtaccttgtcaaccatccagtaaatcttggcatccagctagcgctctttattttagtggcaggcattctgtgcatatacatcaactatgattgtgacaggcagaggcaagagtttcgtaggacaaatggaaaaggctcggtatggggaaaagctccatcgaagatagaggcctcatatactactacttctggggaaacaaaaagaagccttcttttaacatctggatggtggggattagctcgtcattttcattatgtccccgaaatactagctgcattcttctggacagtcccagctctttttaatcattttttgccttacttttacgtgatatttcttaccatccttctttttgatcgagcaaaaagagatgatgatcgatgcagatccaagtatggcaagtactggaaactctattgcgacaggatgtcggcgtacgagaacgttgttgggggtaaactgaagttgaagggaaaagcattggatgtggctggtggagttaagaagaagaaaaagaagaacaaaagaaatcaagaacagtttttgcaagctgctgaagatgaaatttcaacaggtggaagtacagaacaagctaaagatcctaatgatgatgaggaagtaaacgatgggagcaaattgagcagagaagacaagcctgctcattatgatgatcatcttacaccagcagagaggcggtacatagaacaaagggagcaacttgatgttcatagattggcgaagatcgctaataaatctcaccgcgatagaattcaggatttcaatcaatatctcgcaaacatgagtgagcattatgatattcctaaagttggtcctggatgattcaagg

SEQ ID NO: 5521 - DNA, 845 bp, Medicago truncatula
ctcttttctccagaactagaaagaagcgcttttttctccttttctccctcgcaagttcagttcctcatctctcactctcacccacccgcaatcaggccgcgaccggtgaaatctccgtcgtactcaaagcctccatatcctctctctgtatcaatctctgactctgatttttcatgtttcaatctctccacaaaccctaaaactgttaaaaaattatatgtcggactatgagaatgttgttggtggtaaactgaagctgaagggaaaagcattggatgttgctggtggaatcaagaaaaagaaaaagaagaacaaaagaaatcaacaacagtttttgcaagcaaccgaagatgaaatctcagcaggtggaagtacagaacaagctaaagatcctaatgatcaagaagtaaatgatgagagtgaattgagcagggaagagaagcctgctcattatgatgatcatcttacaccagcagagaggcggtacatagaacagagggagcagcttgatgttcatagattggccaagatttctaataaatctcaccgtgatagaatccaagatttcaaccaatatctcgcaaacatgagcgagcattatgatattcctaaagttggtcctggatgattcaaggagttgttcaactatgaagaaggcaaacccctgtcatttctatttctttgtttagtattgacaccatatgcttgcacaatagctgttttcactacatatctttattttgttgtgtactatgctatacttctgatgataaaatttgacttattttctgtggatggggaaagtgatgttattattgccttcaatgaaattttcatatttgcag

SEQ ID NO: 5522 - DNA, 706 bp, Trigonella foenum-graecum
gttcaactatttgaacctttgccaccatcgtttttacgcacgattcctgaagatctatctgttctgctacggtttcgtttccattccatttaagatatgtcggcatatgagaacgttgttggtggtaaactgaagctgaagggaaaagcattggatgttgctggtggaatcaagaagaagaaaaagaagaacaaaagaaatcaagaacagtttttgcaagcaactgaagatgaaatttcagcaggtggaagcacagaacaagctaaagatcccaatgatcaggaagtgaatgatgggagggaattgaacagggaagagaagcctgctcattatgatgatcatcttacacctgcagagaggcggtacatagaacaaagggagcaacttgatgttcatagattggccaagatttctaacaaatctcatcgcgatagaatccaggatttcaaccaatatcttgcaaacatgagtgagcattatgatattcctaaagttggtcctggataatttaaggagttattcaagtatgaagaaggaaaatccttgtcatttctatttgtttgtttagtattgacaccatatgcttgcacaatagctgtttttactacatatttttattttgttttgtactatgctatacttcttatgataaaatttgacttattttctgcggatgggggaagtgatgttattattgccttcaatg

SEQ ID NO: 5523 - DNA, 796 bp, Cyamopsis tetragonoloba
cacgaggcttttgaatgtgaatctccaccgttgaatccctttctatacatcacccgcactatacaaagccaatgtcagacgcggattgtaattcaattgagccctaaggatctggttctgtgctgggcgtttcaccctttcattccgttcaagttttcagctttttagagatgtcagggtatgacaatgttgttggtgggaaattgaagctgaagggaaaagcactggatgttgctggtggagtgaagaagaagaagaaaaagaagaacaaaagaaataatcaagatctacttttgcaagccactgaagatgaaatttcagctggtggaagtacggaactagataaggatcctaatgatgaagatacaaatgatgtgagcaaattgaatgaggaagggaagcctgctcattatgatgatcatcttacaccagcagagaggcgatacatagaacagagggagaaacttgatgttaatcgattggctaagatttcaaataaatcacaccgcgataggattcaggatttcaaccagtatctggcaaacatgagtgagcactatgatattcctaaagttggtcctggatgattcaatgaagtgtattatgaaggccaatccctatcatctgtatttgttagtttaatattcactccatgtgcatgcacagtggttgttgttcttgctatgtgaattgtgatgtaattttgtatgactttcgattggggaagtgatgttgccttaaagggaatttccatctttttttaatgtacaaggaataaaaaaacctattttaccta

SEQ ID NO: 5524 - DNA, 640 bp, Lotus japonicus
gggaaaaatactttcatgaacagaactgagccctgcctgaagatctggtcgagcgagtggagtttcaccctttcattcgattcaagagatgtcgtcgtatgacaatgttgttggtgggaagttgaagctcaagggaaaagcattggatgtggctggtgggatcaagaagaagaaaaagaagaacaagagaaatcaagaacaattttctcaagttgttgatgatgaaatttcagcaggtggaagtacagaacaagcaaaagagcctgatgagcaagacgagataaatgatgatggcagattgagcggagaagaaaagactgcgcattatgatgatcatcttacaccagcagagaggcgatacatagagcagagggagaaacttgatgtcaatagattggccaagatttctaataaatcacaccgtgatagaattcaggatttcaaccagtatcttgcaaacatgagtgagcattatgatattcctaaagttggtccaggatgattcagtgaggtgtataagtatgaaggacaatcccctatcgtttgtgtttgttagtctaagtttgatgccttgtgcatgcacatttgttgtcactatacatttatcttttggctttaagtatgctatatttcacgagac

SEQ ID NO: 5525 - DNA, 750 bp, Arachis hypogaea
atttatttattattattattatactcaaacgtgttttaacagctatgtataaatatgatgagaagaggagaaggaaacaggaattaggaaagcagattggaagataattgatttcagatttgagatttgagagaggcgtcgtcggagttcccagctctgtttgattccatttaagacagagatgtcagcgtatgaaaatgttgttggtggaaaattgaagctcaaaggaaaggcacttgatgtgaaggctggcggagtgaagaagaagaaaaagaagaacaaaagagatcatgagaatcagattttgcagactaccgaagatgatatttcagcaggtgggagcacagagcaatccttggctacggatgatcaaaatgcgaacgatgagggcaaactgagtggggaagggaaggatgctcactatgatgatcatcttacaccagcagagaaacgatacatagaacagagggagcagcttgatgttcataggttggccaagatctccaacaaatctcaccgcgataggattcaggatttcaaccaatatcttgcaaacatgagcgagcattatgatattcctaaagttggtcccggatagtatgaaggccaacaacccctattgtttagtattgataccatgtgttgtgtgtgtactatcattacagaaccatgtttatctcgcttaagcggtatttcagatgatatacttcggtttctttgcttttaatggagtattaatgttattgcctt

SEQ ID NO: 5526 - DNA, 676 bp, Arachis hypogaea
aaagcagattggaagataattgatttgagattcgagatttgagatttgagatttgagagaggcgtcgtcggagttccccgctctgtttgattccatttaagacagagatgtcatcgtatgaaaatgttgttggtggaaaattgaagctcaagggaaaggcacttgatgtgaaggctggcggagtgaagaagaagaaaaagaagaacaaaagagatcatgagaatcagattttgcagactaccgaagatgatatttcagcaggtgggagcacagagcaatccttgggtacggatgatcaaaatgcgaacgatgagggcaaactgagtggggaagggaaggctgctcactatgatgatcatctgacaccagcagagaaacgatacatagaacagagggagcaacttgatgttcataggttggccaagatcgccaacaaatctcaccgcgataggattcaggatttcaaccaatatcttgcaaacatgagcgagcattatgatattcctaaagttggtcccggatagtatgaaggccaacaacccctattgtttagtattgataccatgtgttgtgtgtgtactatcattacagaaccatgtttatctcgcttaagcggtatttcagatgatatacttcggtttcttgccttttaatggagtagtaatgatattgcctt

SEQ ID NO: 5527 - DNA, 752 bp, Acacia harpophylla
gacagatctgaaggatttaagaacctaaaacacgataaagagagaagccgagggaggcatccggaatcgcaagggggcacaatcttccggagaaatcacggtcttcatcgcagagatcacgcactgtcttcgtcatcgtcggtgaggagtgacaggaaccagagggcagccggaatcgtaggggaaccttcttcatcaccgctcgatcagaacggaggggaaaaagcacagatcgacagaacctgagagatgtcagcttatgaaaatgttgttggtgggaaattgaagctcaagggaaaggccttggatgtgaaggctgggggagtgaagaagaaaaagaagaagaataagaatcatgatcaaatattagaatcctctgaaaatgaacttttggcaggtggaagtgctgaacaagctaatgatcctaatgatcatgacaaggatgatgtgaacaaatcgacaggagaagagaagcctcctcattatgatgatcatcttacgccagcagagagacggtacatagaacaaagagaacaacttgatgttcatcgattggcgaagattgccaataaatctcaccgtgacagaattcaggatttcaatcagtatttggcaaacatgagcgagcactatgatatccccaaagtaggcccgggatgattgaacccttcatttgtctctatcatgtgtaatttctgtgttgtgcacaattgctgctggcactcaaacaatcttggaatgctttgtaatgc

SEQ ID NO: 5528 - DNA, 2631 bp, Phaseolus coccineus
caacacagagagtgagagagtattagggaaaatgggaagaaacggaggaggaaggtctctgcaacaagccctccgtcgccgcattgatacctgcaagtccaaatactccacggcggaagaaatcgccaaccatctccgttcgacttaccccgattatcaccgaactaaacaccaaaccctaattcgatttgttcaggaagcggttcattccaccgcgcagcataatcaaacttccacgccgaagtattccgatggtgacgatgacgacaacatggagtcccgaagcgcgtctcgaaagcgtaggaagaaaattgacgagggtgaagagaggttgaagaagatggaagcgttacacgcgcgaaggagggtgcaggatccttcctcgtcgtcctctgcttcttcggagagtgatgatgaggaagcggtgtcgacttcggaggacgcaatttacggggagaaggtggagcctcagtttgatttgatgaaggaaatgctaaggaagtcgtatacgccgaagaaggtggtggcggcggcggcggtggaaaagaacgttgaattggagatgagtaatagaagtaaaggcactgttctgaatgaggtgaatgaggtgcggaagcaatctctgcgttcggtttcgaatagtgaagtttcaaatggtgaggggaaggggaaggatggaccgagatttaaggatttaggtgggatgaaggaggttttggaggaactgaagatggaagtaattgtacctttgtttcatccccagttgcctaagcagttaggagtgaagccaatggctggcattttgttgcatggtccacctggatgtgggaagaccaaacttgctcatgctatagctaatgagactggtcttcctttctatcagatttcagctactgaggtagtctctggagtctcaggtgcatctgaagaaaatattagagaactttttgctaaagcttacagaactgcaccttcgatcgtctttattgatgagattgatgcaattgcttctaaaagagagaatttgcagcgtgagatggagaaacgaattgtgacgcaattaatgacttgcatggatcaatcaagtaggcttccaacggatgattcagagagtgctggctatgttcttgtaataggagctacaaataggcctgatgctgttgaccctgccctgagaaggcctggtcggtttgatcgtgaaattatcattggtcatcctgatgaatttgccagggaggagatcctatctgtgcttacttccaatcttagacttgagggtttatttgatctacagaaaatagccagggctacatcaggttttgttggtgctgatttggcagctctggttgacaaggctggtaatttggcaatgaagagaataattgatgaaaggagacgtgaattatctgaagaactcacgagcgagcatgttgaagactggtggagggaaccttggtcggctgaagaagtggacaagcttgccatcaaaatgtccgattttgaggaagcatccaaaaaggtacaaccttcattaagaagagaaggattctctatcattcctaatgttaaatgggaagacgttgggggccttgatctcttaaggaaagagtttgaacgatatattgtaaggcgaataaaatatcctgaagattatgaggggctcggggttgatcttgagactggatttttgctttatggacctcctggttgtggtaaaacgctgattgccaaagctgttgccagtgaggcaggggctagttttatccatatcaagggtcctgaacttttaaataaatatgttggagaaagtgagcttgcagttcggacattgtttagccgtgcaaggacatgtgcaccttgtatacttttctttgacgaggttgatgctttgacaactaaacgtggtaaggaaggtggttgggttattgaacgactgttgaaccagttgcttattgagttggatggtgcaggacatcgaagaggtgtttttgtgattggtgctacaaataggcctgaggtgatggatcgtgctctcttacggcctggtagatttggtaaacttctgtacgttccactacccagcccagatcagcgagttttgatattgaaagctcttgcaaggaataaggctattgatgccactgtggatttgagtgcgatggcaaccatggcaggttgtgaaaacctaagtggcgctgatcttgctgcattgatgaatgaagcggcaatggctgctgtggaagagaaacataaaactatcaacagtactcattttgaagtagcactaagtaaagtctcgccgtcagtgtctgacaggcaaaagaagtactatcagcacttgtcggagagctttaaagtagcatgaacaacgtgacttggttataatttatggtttataatttattctgtttacgaacatgccattcatagaagatgacaaaaataaaaaccccacaaaagtaaaacccttatggtttgttcagtgaaggtttttatttttattttttagggtttcagtctataccttattgcttttcataattttttgaatttaaattgaattaatagtactttgtcatattctaatctttctgtcagttaaaaaaataaggacgtggttaacagccttaa

SEQ ID NO: 5529 - DNA, 2646 bp, Phaseolus coccineus
tgaagaagaagaagacaacacagagagtgagagagtattagggaaaatgggaagaaacggaggaggaaggtctctgcaacaagccctccgtcgccgcattgatacctgcaagtccaaatactccacggcggaagaaatcgccaaccatctccgttcgacttaccccgattatcaccgaactaaacaccaaaccctaattcgatttgttcaggaagcggttcattccaccgcgcagcataatcaaacttccacgccgaagtattccgatggtgacgatgacgacaacatggagtcccgaagcgcgtctcgaaagcgtaggaagaaaattgacgagggtgaagagaggttgaagaagatggaagcgttacacgcgcgaaggagggtgcaggatccttcctcgtcgtcctctgcttcttcggagagtgatgatgaggaagcggtgtcgacttcggaggacgcaatttacggggagaaggtggagcctcagtttgatttgatgaaggaaatgctaaggaagtcgtatacgccgaagaaggtggtggcggcggcggcggtggaaaagaacgttgaattggagatgagtaatagaagtaaaggcactgttctgaatgaggtgaatgaggtgcggaagcaatctctgcgttcggtttcgaatagtgaagtttcaaatggtgaggggaaggggaaggatggaccgagatttaaggatttaggtgggatgaaggaggttttggaggaactgaagatggaagtaattgtacctttgtttcatccccagttgcctaagcagttaggagtgaagccaatggctggcattttgttgcatggtccacctggatgtgggaagaccaaacttgctcatgctatagctaatgagactggtcttcctttctatcagatttcagctactgaggtagtctctggagtctcaggtgcatctgaagaaaatattagagaactttttgctaaagcttacagaactgcaccttcgatcgtctttattgatgagattgatgcaattgcttctaaaagagagaatttgcagcgtgagatggagaaacgaattgtgacgcaattaatgacttgcatggatcaatcaagtaggcttccaacggatgattcagagagtgctggctatgttcttgtaataggagctacaaataggcctgatgctgttgaccctgccctgagaaggcctggtcggtttgatcgtgaaattatcattggtcatcctgatgaatttgccagggaggagatcctatctgtgcttacttccaatcttagacttgagggtttatttgatctacagaaaatagccagggctacatcaggttttgttggtgctgatttggcagctctggttgacaaggctggtaatttggcaatgaagagaataattgatgaaaggagacgtgaattatctgaagaactcacgagcgagcatgttgaagactggtggagggaaccttggtcggctgaagaagtggacaagcttgccatcaaaatgtccgattttgaggaagcatccaaaaaggtacaaccttcattaagaagagaaggattctctatcattcctaatgttaaatgggaagacgttgggggccttgatctcttaaggaaagagtttgaacgatatattgtaaggcgaataaaatatcctgaagattatgaggggctcggggttgatcttgagactggatttttgctttatggacctcctggttgtggtaaaacgctgattgccaaagctgttgccagtgaggcaggggctagttttatccatatcaagggtcctgaacttttaaataaatatgttggagaaagtgagcttgcagttcggacattgtttagccgtgcaaggacatgtgcaccttgtatacttttctttgacgaggttgatgctttgacaactaaacgtggtaaggaaggtggttgggttattgaacgactgttgaaccagttgcttattgagttggatggtgcaggacatcgaagaggtgtttttgtgattggtgctacaaataggcctgaggtgatggatcgtgctctcttacggcctggtagatttggtaaacttctgtacgttccactacccagcccagatcagcgagttttgatattgaaagctcttgcaaggaataaggctattgatgccactgtggatttgagtgcgatggcaaccatggcaggttgtgaaaacctaagtggcgctgatcttgctgcattgatgaatgaagcggcaatggctgctgtggaagagaaacataaaactatcaacagtactcattttgaagtagcactaagtaaagtctcgccgtcagtgtctgacaggcaaaagaagtactatcagcacttgtcggagagctttaaagtagcatgaacaacgtgacttggttataatttatggtttataatttattctgtttacgaacatgccattcatagaagatgacaaaaataaaaaccccacaaaagtaaaacccttatggtttgttcagtgaaggtttttatttttattttttagggtttcagtctataccttattgcttttcataattttttgaatttaaattgaattaatagtactttgtcatattctaatctttctgtcagttaaaaaaataaggacgtggttaacagccttaa

SEQ ID NO: 5530 - DNA, 2640 bp, Cajanus cajan
caggagcaagggttggggcgagatgggaagaagaaacggtggcaggtctctgcaagaaactctccgccgtcgacttgactcttgcaagtccaaatactccaccgccgaagaaatcgccacccatctccgctcaacttaccccgattaccaccgaacaaagcaccaaaccctaattcgattcgttcaggaagctcttcactccgccgccaagcccgatcacattcccacgctcaagcatttttccgacgatgacgacgaccgagactttccaagcccctctccgaaaagacggaaggaagaggacgaagacagggaagaagcggtggtgtcgtcttcggaggatgcggttttcgggaagaagatggaacctgagttcggcttgaggaagacggtgctgcgaaactcgtataagaagattgcggcggaggagaagaacgtggaattggaagtggggggtggcaggaagggtattgttgctagcagtgttgtgaatgaggaaaggaaggaagtgaggggttcggtttcgaacggtgaggtgaaggggaaggatggacctaggtttagggatttgggtgggatgaaagaggttttggaggaattgaagatggaagtgattgtgcctttgtgccatccccaattgcctagacagttaggtgtgaggccaatggctggcattttgttgcatggaccacctggttgtgggaagactaaacttgcacatgctatagctaatgaggctggtcttcctttctatcacatttcagctactgaggttgtttctggagtctcaggtgcatcggaagaaaatattagagagcttttctctaaggcgtacaagactgcgccgtcgattgtctttattgatgaggttgatgcaattgcttccaagagagagaatttgcagcgtgagatggagaaacgaattgtgacgcaattaatgacttgcatggatcaatcaaataggcttcttcaaaaaggagacgagtcagagagctccgatggtcaacatcctggatatgttcttgtcattggagctacaaatagacctgatgctgttgaccctgccctgagaaggcctggacggtttgatcgtgagattatcattggcattcccaatgaatctgccagggaggagatcctttccacgcttactagcaatcttaaagttgagggattatttgatctacggaaaatagccagggctacaccaggatttgttggtgctgatttggcagctctggttaacaaggctggtaatctggcaatgaaaagaataattgatgaaaggaaacgtgaattatctcaagttctcatgaatgagggtgatgaagactggtggagagaaccttggttgactgaagaaatagataagcttgccatcaaaatgtccgattttgaggaagcagtcaaaatggtgcaaccttcatcaagaagagaaggtttctcttccattcctaatgtaaaatgggaagatgttggagggcttgattttctaagacaggagtttgaacgttatattgtaaggcgtataaaataccctgatgattatgagggacttggggtagatcttgagacaggatttttgctttatggacctcctggttgtggtaaaacactgattgccaaagctgttgccaatgaggcaggggctaattttattcatattaagggacctgaactcttaaataaatatgttggagaaagtgagcttggagttcggacaatgtttagccgtgcaaggacatgtgcgccttgtatacttttttttgatgaggtggatgctttgacaaccaatcgtggtaaagaaggtagttgggttattgaacgactgttgaatcagttgcttgttgagttagatggggcagagcaacggcgaggcgtttttgttattggtgctacaaataggcctgaggtgatggatcgtgctctcctacggcctggtaggtttggtaaacttctttatgttccacttccaggcccagatgaacgagttttgatattgaaagctcttgcaaggaagaagcctgttgattcctctgtggatttgagtgctatagcaaaaatggaagcttgtgaaaacctaagtggcgctgatctttctgcattgatgaacgaggcagcaatggctgcacttgaagagaaattgactgagacaacttacgatacagtgaccatcaagaaaaatcattttgaggtagcactgagtaaagtctctccgtctgtgtcagacaggcaaaagcactactatcagcacttgtcagagagctttaaagtagcatgagcagcatggcgttgactttttttagtcggtgatgacattattttatgctttgtttgggggaggaggcaaaattgaagtaaatgaaagagaataggtgataattgatttgataagaaataggtaagaaatagaattgaatttgtagttgtttgttagattaaaattacgtgagaaatagtgaaaaattagtattttaaaattgtattttatatagttagatcattataaaataatataaatacctaccattttacccttctttttatgttgacatataatattggaatttcaatttttttttatatatagtttagtagcataatcagttatgttagtttacatggctgattttgctaccg

SEQ ID NO: 5531 - DNA, 2551 bp, Cajanus cajan
ggtttagggacgatgggaagaagaaacggtgggaggtctctgcaagacaccctccgtcgtcggcttgagtcatgtaagtccaaatactccaccgccgaacaaatcgccaaccatctccgctccacttaccccgactaccaccgaaccaagcaccaaaccctaattcgttttgttcaggaagctcttaactccactccctcgctcaaccattcttccgacgatgaccatgaagctcagcctccaaccgcctctcgtaagcgccggaagagagtcgaccaaagcgaggagaggttgcagaggatcgaagccttgcacgtgcgaaggaggctgcagaccgattcctcttcggaggaagaaaacgtctcgtcttccgaagacgcgatttacggggagaaggtggagcctcagtttgacttgatgaagacaatgctgcgaaagtcgtatatgccgaagaaggagaagaacgtcgagttggaggtggggaatagcaataagggtactgtgactagcactcttatgaatgaggaagggaaggaagtcaggggttcggtttcgaatgttgatgtgaaggggaatgattggcctaggtttagggatttgggtgggatgaaggaggtcttggaggagctgaagatggaagtgattgtgcctttgtatcatccccaattgcctagacagttgggtgtgaggccgatggctggcattttgttgcatggaccacctggttgtgggaagactaaacttgcacatgctatagctaatgagactggtcttcctttttatcagatttcagctaccgaggtggtttctggagtctcgggtgcatcggaagaaaatattagagagcttttctctaaagcatacaggactgcaccatcaattgtctttattgatgagatcgatgcaattgcatcaaagagagaggatttgcaacgtgagatggagaaacgaattgtgacacaattaatgacttgcatggatcaatcaaataggcttcttcagccagaaaatgagtcagagggttctgatggtcaacatcctggctatgttcttgtaattggagctacaaataggcctgatgctattgaccctgccctgagaaggcctggtcggtttgatcgtgagattattattggcattgctgatgaatctgccagggaggagatcctttccacgcttactaacaatcttacaactgaaggtttatttgatctacggaaaatagccaaggatacggcaggatatgttggtgctgatttggtggctcttgttaacaaggctggtaatctggcaatgaagagaataattgttggaaggagacatgatttatctcaagatcacatgaacgagcatgctgaagactggtggagagtacattggttgcctgaagaaataaataagcttgccgtcaaaatgtctgattttgaggaagcagtcaacatggtgcaaccttcgttaagaagagatgggttctctcctattcctgatgtgaaatgggaagacgtaggagggcttgatcttttaagacaggagtttgaacgttatattgtaaggcgtataaaatatcctgaagattatgagggacttgggatagatctcgagatgggatttttgctttatggacctcctggttgtggtaaaacgctgattgccaaagctgttgcccatgaggcaggggctaattttattcatgttaagggaccttcacttctaaataaatatgttggagaaagcgaacttgcagttcgtagaatgtttagcgatgcaaggacatgtgcaccttgtataatattttttgatgaggtggatgctttgacaaccacacgtggtaaagaaggtggttgggttattgaacgactgttgaatcagttgcttattgagttagatggcgcagagcgaagacggggtgtttttgtgattggtgctacaaataggcctgaggtgatggatcgtgctctcctacggcctggtaggtttggtaagcttctttatgttccacttccaagcccggatgagcgggttttgatattgaaagctcttgcaaggaagaagtgtattgatgcctcagtagacttgagtgccatagccaaaatggaagcttgtgaaaacctaagtggcgctgatctttctgcattgatgaacgaggctgcaatggctgtaattgatgagaaagaaaccttgaccgacttaacgcactatacaaggaccatcaagagaaatcattttgaggtagcacttaggaaagtctctccgtctgtgtcagacaggcaaaaacagtactatcagcgcttgtcacagagctttaaagcagcatgagcatggctttgactttcttttagccgctgatggagtgaaagaaatcatttatacatcttaaagagtacatatttcctgcaatcaggatataatttttggcgaatgcttgtaatttattcttcactttatccatcatattgcttgaatattttttaaacaatgtaactaaaaattattttatatcttttgtaaacaattttattaaaatttatttttattaataaaggtgatctgt

SEQ ID NO: 5532 - DNA, 994 bp, Cyamopsis tetragonoloba
cacgaggcagcaacctcacttcactggtcccttggcagaaccagaaccagaagcactagcagaaccaccgttatgggttggctcacacggttcattacggcggtggctttcttagccatcggagtgatattttcgccggagacacttggatcaaaatcaaccgctctttccacctacctcaaattggctcaccttctcagcttctccaccgctttcggcgccgcactatgggtcaccttcatcggcggcatcatcatgttcaagaatctgccgcggcatcagtttggtaacctgcaaagcaagatgtttccggcgtatttctcaatggtcggtgtctgttgcgccgtatcggtggcttcctttggctacctccacccctggaaaacttcctccactactgaaagataccagcttggctttttgctctcttcctttgcgttcaatctcaccaatttgtttgtctttacacccatgaccatcgagatgatgaagcaaaggcataaagtggagagagaaaataatattggggaggaagttggatggtcaaaaaatgtggaagttgcgaagaaaaacccaaagcttgcagccatgaataagaagtttggtatgatacatggattatcttctctcgccaatatcatgtccttcggaagccttgcaatacactcctggtacttagcaggtaaaattaatctctgattcagtttctgcttcccattctatttaaggtggttgagctccttgtgaagtcatgtcagtgttctctttatttggcatttcttgttttcatgccaagtaaaagaagtctggaatgtcggtgcaatttgggaaatgtatgtactatcaaagtattacagtgtattggttgatcaagagttttatgaattgccatggaaacttagtctaatcattctacatcacatgaataaaacaattagactctgaacctttctgtagtccaaagtaataaacataagtctctctgcccctcgtg

SEQ ID NO: 5533 - DNA, 1006 bp, Vigna unguiculata
gttctggtcccttggtagaagcagaaccacatttactgttcacttaatcactcagtcactttcatcttctgctgcatgggttggcttagtcggttcatcaccgccgtggctttcttagccgtcggagtcatattttcaccggagactctgggttcaaaatcacccactctttccacctacctcaaactcgctcacctcctcagcttctccaccgcattcggtgccgctctatgggtcaccttcatcggcggcatcattatgtttaaaaacctgccgcggcatcagtttgggaacctgcagagcaagatgtttccggcgtatttctcgatggtgggggtgtgctgcgccgtatcggtggcttcctttggctaccttcacccgtggaaaacttcctccactactgagagataccagcttgggtttttgctctcttcctttgcgttcaatcttaccaacttgtttgtcttcacacctatgaccatcgagatgatgaagcaaaggcataaggtggagagagaaaacagtataggggaggaagttgggtggtcgaaaaatgtggaagttgctaagtcaaacccaaaacttaaagccatgaataagaaatttggtatgattcatggattatcctctcttgccaacataatgtcttttgggagtctagcagtacactcttggtacttggcaggaaaaattgatctttgattcagtttgtgcctccaattctattctatttaaggcaaatgaactccttgagaagaacaatataagtgaggatcctagtgttccctttatcttccacttgttttattgtcaagtaaaataagtctaggatgtctgtataatggaaacatgatgcctcctcacatgaataaaatcagcagtatctgctccttgttcactttttgttggttacttgagagggtttacagctttactctttgttcagaataggggtgtggaatggatggattggataaatttgaatttaaatgtatggattcaaaat

SEQ ID NO: 5534 - DNA, 1022 bp, Vigna unguiculata
ggatagaccacctcgttcagtgttctggtcccttggtagaagcagaaccacatttactgttcacttaatcactcagtcactttcatcttctgctgcatgggttggcttagtcggttcatcaccgccgtggctttcttagccgtcggagtcatattttcaccggagactctgggttcaaaatcacccactctttccacctacctcaaactcgctcacctcctcagcttctccaccgcattcggtgccgctctatgggtcaccttcatcggcggcatcattatgtttaaaaacctgccgcggcatcagtttgggaacctgcagagcaagatgtttccggcgtatttctcgatggtgggggtgtgctgcgccgtatcggtggcttcctttggctaccttcacccgtggaaaacttcctccactactgagagataccagcttgggtttttgctctcttcctttgcgttcaatcttaccaacttgtttgtcttcacacctatgaccatcgagatgatgaagcaaaggcataaggtggagagagaaaacagtataggggaggaagttgggtggtcgaaaaatgtggaagttgctaagtcaaacccaaaacttaaagccatgaataagaaatttggtatgattcatggattatcctctcttgccaacataatgtcttttgggagtctagcagtacactcttggtacttggcaggaaaaattgatctttgattcagtttgtgcctccaattctattctatttaaggcaaatgaactccttgagaagaacaatataagtgaggatcctagtgttccctttatcttccacttgttttattgtcaagtaaaataagtctaggatgtctgtataatggaaacatgatgcctcctcacatgaataaaatcagcagtatctgctccttgttcactttttgttggttacttgagagggtttacagctttactctttgttcagaataggggtgtggaatggatggattggataaatttgaatttaaatgtatggattc

SEQ ID NO: 5535 - DNA, 996 bp, Phaseolus coccineus
gggttcggtttggtaggtagaaaaaattaatagcatctagttttcttcaacttataaacaacttcttcagtgtagtcccttggtagaagcagagcaacactaactgttcactctctcattcaatcactctcatcttcttctgcatgggttggcttagtcgcttcatcgccgccgtggctttcttagccatcggagtcatattctcaccggagactctgacttcaaaatcaaccactctttccacctacctcaaactcgctcacctcctcagcttctccaccgcattcggcgccgctctatgggtcaccttcatcggcggcatcatcatgtttaaaaatctgccgcggcatcagtttgggaacctgcaaagcaagatgtttccggcgtatttctcgatggtgggtgcgtgttgcgccatatcggtggcttcctttgggtaccttcacccgtggaaaacttcatccactactgagagataccagcttgggtttttgctctcttcctttgcgttcaatcttaccaacttgtttgtcttcacacctatgaccatcgagatgatgaagcaaaggcataaagtggagagagaaagcaatataggggaggaagttgggtggtcaaaaaatgtggaagttgctaagtcaaacccaaaacttaaagccatgaataagaaatttggtatgattcatggattatcgtcccttgccaatataatgtcctttgggagtctagcaatacactcttggtacttggccggtaaaattgatctttgattcagtttctgcctccaatcctattctattaaagacaaatgaactccttgtgaagagtaatataagtgaggatcctggtgtttccattatcttccactcgcttgttttattgccaagtaaaataagtctagaatgtctgtaatttatgggttgccatggaaacatgatccctcctcacatgaataaaataatagtatctgctccttgttcacttgttttttggcta

SEQ ID NO: 5536 - DNA, 1080 bp, Phaseolus coccineus
gggttcggtttggtaggtagaaaaaattaatagcatctagttttcttcaacttataaacaacttcttcagtgtagtcccttggtagaagcagagcaacactaactgttcactctctcattcaatcactctcatcttcttctgcatgggttggcttagtcgcttcatcgccgccgtggctttcttagccatcggagtcatattctcaccggagactctgacttcaaaatcaaccactctttccacctacctcaaactcgctcacctcctcagcttctccaccgcattcggcgccgctctatgggtcaccttcatcggcggcatcatcatgtttaaaaatctgccgcggcatcagtttgggaacctgcaaagcaagatgtttccggcgtatttctcgatggtgggtgcgtgttgcgccatatcggtggcttcctttgggtaccttcacccgtggaaaacttcatccactactgagagataccagcttgggtttttgctctcttcctttgcgttcaatcttaccaacttgtttgtcttcacacctatgaccatcgagatgatgaagcaaaggcataaagtggagagagaaagcaatataggggaggaagttgggtggtcaaaaaatgtggaagttgctaagtcaaacccaaaacttaaagccatgaataagaaatttggtatgattcatggattatcgtcccttgccaatataatgtcctttgggagtctagcaatacactcttggtacttggccggtaaaattgatctttgattcagtttctgcctccaatcctattctattaaagacaaatgaactccttgtgaagagtaatataagtgaggatcctggtgtttccattatcttccactcgcttgttttattgccaagtaaaataagtctagaatgtctgtaatttatgggttgccatggaaacatgatccctcctcacatgaataaaataatagtatctgctccttgttcacttgttttttggctacttgagagggtttacattttgctatactgaacaggggtgtggaatggatggattggataaattttgaatttcaatttatagatt

SEQ ID NO: 5537 - DNA, 1078 bp, Glycyrrhiza uralensis
tagatatccattcgaccattccaatgagcggaggttggtaagaattaacaaagcatcttcgtttgcttgcttcaacctctcatcaactacttctcacttggcacttggcagaagcagaagcaggactcagagttacttcagatcgatgggtagggtggctatgataataacggcggtagctttcttagccatcggagtgatattctcaccggagacattcgaatcaaagtcaaccgctctttccacctacctcaaactggctcatctcctcagcttctccatcgctttcggcgccgctctctgggtcaccttcatcggcggcgtcatcatgttcaagaatctgccgaggcatcagtttgggaacctccaaagcaagatgtttccggcatatttctcaatggttggtatctgttgcgccgtagcggtggcttcctttggctacctccacccgtggaaaacttcctccactaccgagaaataccaactcggcttcttgctctcttcctttgccttcaaccttgccaatttgtttgtctttacacccatgaccatcgagatgatgaaacaaaggcataaggtggagagagaaaataacattggtgaggaagttgggtggtcaaaaaatgtcgaagttgcaaagaaaaacccaaagcttgcagccatgaataagaagtttggtatgattcatggattatcttcccttgccaatatcatgtcattcggaagccttgcaatacactcttggtacttggcaggtaaacttgatctctgattcagtttctgcctcccattctattgaagatggctgagcacattatgaataattatattccgccaggatccttgtgttctctttatctgcaagttacttgttctcttgcctagtaaaaggagtctagaatgtctatgcaatttgtgaaatttactatcacagcattatacagtattggtttaccatatgtcttgccatggaaacataatgtaatcaccctacttcagatgaataaaataagtagtctctgtacctttctgtcgtcaaaggtaacaaacattgggatgcaagtgattacattttgct

SEQ ID NO: 5538 - DNA, 1216 bp, Cicer arietinum
cgggagaataaaatctaaaactacatgggcctaggccaggcccaatttaattgaagttgggccgaacattctagaaaaaagaaagtcaacagaaaaccggttatgcatttgatggtttggtagatagaaacaactgagtaattaacaaaaaaagcattttgctttgcttgcttcaacacttcaaccacctaaccactcctttgacagaagcagaaccactcagtatcaatgggtagagccgctccgataataacggcggtggtcttcttagccgtcggagttatattctcaccggagacattcggatcaaaatcaaccgctatctcaacctacctcaaactagctcacctcctcggtttctccatcgctttcggcgcggctctatgggtaacatttatcggtgggatcattatgtttaagaatttgcctaggcatcagtttggtaatttgcagagcaagatgtttccggcttatttttcaatggttggtgtttgtatcgccgttgcagtggcttcctttggttaccttcacccgtggaaaacttcatccacaactgaaaaataccaacttggcttcttgctttcttcccttgctttcaatcttgctaatttattcgtctttacgccgatgaccattgagttgatgaaacaaaggcataaagtggagagagagaatagcatcggagaggaagttgggtggtcaaaaaatgttgaagttgcaaagaaaaacccaaagcttgcagcgatgaacaagaagtttggtatgattcatggattatcttcccttgccaatatcatgtcatttggaagtcttgcgatacactcttggtatttggcaggtaaaattgatctctgattcagtttttgcctcccattttatagagatggttgagcaccttgtattccctttgtctacaaattacttagttcttgccatgtagaagaagtatagaatgtatgtgcaatttgtgaaatgtactagcaaagcattacacggtgttggtttaccgagagtatcttgtgtcttgccgtgcaaacataatgtaatcaccttaattgacatgaataaaataagaagtctctgtacctttctgtagtcagaggtaacaaacattatggtataaattatataagctacctacttgcttttactcaatgtgctactctctggttttcttttggataaaacatttatacaattattacttaggtattgg

SEQ ID NO: 5539 - DNA, 1000 bp, Cicer arietinum
ctaaaaaagcattttgctttgcttgctcaacacttcaaccacctaaccactcctttgacagaagcagaaccactcagtatcaatgggtagagccgctccgataataacggcggtggtcttcttagccgtcggagttatattctcaccggagacattcggatcaaaatcaaccgctatctcaacctacctcaaactagctcacctcctcggtttctccatcgctttcggcgcggctctatgggtaacatttatcggtgggatcattatgtttaagaatttgcctaggcatcagtttggtaatttgcagagcaagatgtttccggcttatttttcaatggttggtgtttgtatcgccgttgcagtggcttcctttggttaccttcacccgtggaaaacttcatccacaactgaaaaataccaacttggcttcttgctttcttcccttgctttcaatcttgctaatttattcgtctttacgccgatgaccattgagttgatgaaacaaaggcataaagtggagagagagaatagcatcggagaggaagttgggtggtcaaaaaatgttgaagttgcaaagaaaacccaaagcttgcagcgatgaacaagaagtttggtatgattcatggattatcttcccttgccaatatcatgtcatttggaagtcttgcgatacactcttggtatttggcaggtaaaattgatctctgattcagtttttgcctcccattttatagagatggttgagcaccttgtattccctttgtctacaaattacttagttcttgccatgtagaagaagtatagaatgtatgtgcaatttgtgaaatgtactagcaaagcattacacggtgttggtttaccgagagtatcttgtgtcttgccgtgcaaacataatgtaatcaccttaattgacatgaataaaataagaagtctctgtacctttctgtagtcagaggtaacaaacattatggtataaattatactaaagctacctacttgc

SEQ ID NO: 5540 - DNA, 1104 bp, Lotus japonicus
cttgcttcaatcttcatcgtcccttgcagaatcgaaacaccactcactctttcactcactgcaatcatgggttggctgagtcggtttctaacggcggtgactttcttagccgtcggagtattattctcgccggagacactcgcttcaaaatcaacagctctttcaacctacctcaaactcgctcacctcctcagcttctccaccgccttcggttctgctctctgggtcaccttcatcggtggaatcatcatgttcaagaatctgccgaggcatcagtttggtaatcttcagagcaagatgtttccggcgtatttctcactggtgggaacgtgtggcgccattgcggtggcttcctttgggtacctgcacccgtggaaaactgcttccactagtgaacgataccagcttgggttcttgctctcttcctttgcattcaatctcaccaacttgtttgtgtttacgcctatgaccattgagctgatgaagcaaaggcataaagtggagagagaaaataatgttggagaggaagttgggtggtcaaaaaatgtggaagttgcaaagacaaacccaaagcttgcagccatgaataagaagttcggtatgattcatggattatcttccctctctaatatcatgtcgtttggaagccttgcagtacactcttggtacttggcaggtaaaattaatctgtgaatcaatttctgccacacgttctattcgacatggctgagcaccttatgaaaagttatattaagtcaggatcccagtgttctctttatctgctagttaatcgttttacttgccaagaagtctagaatgtcaatttgtgaaatgtaccatgagagcattttaccgtatcgatttaccaagaatgcctggccatggacacataatgtaatcgccctagttcatatgaataaactatgttgtctgtgtacctttctgtagtcaaaggtaacaaatattgtagactccagctgttatcatatgttagcatttgtttttctaggtgtactatttctctgttattttttcccatattgagggggactacattttgctagtctctgagttcaatgttgaggtctattttgttgttctctt

SEQ ID NO: 5541 - DNA, 997 bp, Trigonella foenum-graecum
ccaaaccaaccaacgagcgctggaatctggtttggtagatagaaacaatcaaatcaatcaataaacacaacaaaagcatctactttgcttcttcaaccaccttaccagtcaccactcagtaaccaccaccacaaccatcaatgggtagagccgctctaataacaacagcggttgtcttcttagccatcggagtaattttctctccagaaacattcggctcaaaatcaaccgctctttcaacttacctcaaactcgctcacctcctcggcttttccattgctttcggcgccgctctatgggtaaccttcatcggcggaatcatcatgttcaagaatttacctaggcatcaatttggtaatttacagagcaagatgtttccggcttatttttcaatggttggtgtttgtatcgctacttcagtggcttcttttggttaccttcatccgtggaaaacttcttccactgctgaaagataccaacttggattcttgatctctgctcttgcattcaatcttactaatttatttgtctttacaccaatgacaattgagatgatgaaacaaaggcataaattggagagagagaataatattggagaggaagttgggtggtcgaaaaatgttgaagttgcaaagaaaaatccaaagcttgcaaagatgaataagaagtttggtatgattcacggattatcttcccttgccaatatcatgtcatttggaagccttgcaatacactcttggtacttggcaggtaaacttgatctctgattcagttttagcctcccattctagtagagatacttgtctgtggaagttgtgaaatgtactatcaaagcatcgcacggtattggtttaccaagagtatcttgtttcttgctgtgcaaacataatgtaatcgccttaattcacatgaataaaataattagtgctctgtacctttctgtagtcaaaggtaacatacattatgctataaattatatacagtactcatttgcttt

SEQ ID NO: 5542 - DNA, 1103 bp, Medicago truncatula
ttttttttaacacccgtaattaatatggggtggctgtattaggtgtgaaatgtaatgttctagaaaccgaacatcatttagtcaatccaaaccaacgagcgctgaaatctggtttggtacattgaaagagtaaacaaacaaacaaacaaacaaaagcatctcactttgcttcttcttcaccccattcaaccaccaccgttatcaatgggtagagccactctaataacaaccgcggtagttttcttagccatcggagtaattttctcaccagaaacattcggatcaaaatccaccactctttccacttacatcaaactcgctcatctcctcggcttctccatcgctttcggcgcagctctatgggtaaccttcatcggcggtatcatcatgttcaagaatttgcctaggcatcaatttggtaatcttcaaagcaaaatgtttccagcttatttctcaatggttggtgtttgtattgctgtcactgtggcttcctttggttatcttcatccgtggaaaacttcttccactagtcaaagataccagcttggattcttgatctccgctcttgctttcaatcttaccaatttgttcgtctttacaccaatgacaattgagatgatgaaacaaaggcataaagtggagagagagaatagtattggagaggaagttggatggtcaaaaaatgtcgaagttgcaaagaaaaatccaaagcttgcaaagatgaataagaagtttggtatgattcatgggttatcttcccttgccaacatcatgtcatttggaagccttgcaatacactcttggtacttggcaggtaaacttgatctctgattcagtttttgcctcccattctagtagagatacttgtctgtgcaatttgtgaaatgtattatcaaagcatcacacagtattgatttaccaagagtgtcctgtgtcttgctgtgcaaacgtaatgtaatgtgcaaacataatgtaatcgccttagtttacttgaataaaataattagtccatgtacctttctgtagtcaaaggtatacatacattatgctataaattatataaggtactcatttgatttttctcagtgtgctactctccggtt

SEQ ID NO: 5543 - DNA, 851 bp, Pisum sativum
taaccaccgctatcaatgggtagagccgctctcataacgacggcggtagttttcctagccgtcggagtaattttctctccggaaacattcggatcaaaatcaaccactctttccacttacctcaaactagcccacctcctgggtttctccatcgctttcggcgccgctctatgggtaacctttatcggcgggatcatcatgttcaagaatttgcctaggcatcagtttggtaatcttcaaagcaagatgtttccggcttatttctccatggttggtgtttgtatctctgtcgcagtggcttcctttggataccttcacccatggaaaacttcatctactagtgagaaataccaacttggcttcttgctctctgctcttgcgttcaatcttactaatttgttcgtctttacgccaatgacaattgagatgatgaaacaaaggcataaagtggagagagagaataagattggagatgaagttgggtggtcaaaaaatgttgaagttgcaaagaaaaacccaaagcttgcagcgatgaacaagaagtttggtatgattcatggactatcttcccttgccaatatcttgtcatttggaagccttgcaatacactcttggtacttggcaggtaaacttgatctctgattcagtttttgcctccctttctagtagacgagaaacttgtccatgcaatgcaatttgcgaaatgtactagcaaaacgttacacagtattcgtttatcaagagttcttgtgtctttgtgtgaaagaaaacctaatgtaattgctttaattctcacatgaataaaattagtcagtgtacctttctgtagttgaaggtaaaaaaaaaaaaaa

SEQ ID NO: 5544 - DNA, 897 bp, Populus trichocarpa
ttgtatttgtacccgcagctcagaaattaaaataaaaaatccttcgttcctccctttcttcaatctcctgcggcaaagcattcttctgagagagagaaagatgggttggctaagtcgattcctagcagcgatagcattctttgctataggcgtgctcttttctccagaaacgttcggatcaaaatcggtcactcatctctccgcttacttgaagttggctcacctcctctgcttctccaccgcttttggctccgctctctgggtcactttcattggcggcatcatcatgttcaagaacttgccgaggcatcagtttggtaatttgcaaagcaagatgtttcctgcgtattttttattggtgggcgtttgctgtgcaatctctgtggcagcgtttggttatctgcatccatggaaatcagcatccactgcagagaagtaccagcttggattcttgctttcatcttttgctttcaatctcaccaatctgtttgtctttactccaatgaccattgagatgatgaagcaaaggcacaaggtggagcgtgaagagaacattgggactgaagttggatggtcaaagaacagggaagtggcgaaggccaatccaaagcttgctgccatgaacaagaaattcggaatgattcatgggttatcatcccttgctaatatcatgtcatttggcagtcttgccatgcactcatggtacttggcaggtaagattaatctgtaatttgtgatattcttgaaaattagttggccatggacttgtctactttaccattagtattctctgattgttcccgtgccaacttatgtactccgaatgtgtcaagactaagaagtttgttgtgagaacatgcttagcaataaattctgcacacctattctccaaagtta

SEQ ID NO: 5545 - DNA, 1070 bp, Populus trichocarpa
gaggagtaaatcgaaattactctttgtcaagaattacaagtggcattttagtcaaaccaactaaatccggccaccattaaagtctcaaacaactaccaatttcttgtatttgtacccgcagctcagaaattaaaataaaaaatccttcgttcctccctttcttcaatctcctgcggcaaagtattcttctgagagagagaaagatgggttggctaagtcgattcctagcagcgatagcattctttgctataggcgtgctcttttctccagaaacgttcggatcaaaatcggtcactcatctctccgcttacttgaagttggctcacctcctctgcttctccaccgcttttggctccgctctctgggtcactttcattggcggcatcatcatgttcaagaacttgccgaggcatcagtttggtaatttgcaaagcaagatgtttcctgcgtattttttattggtgggcgtttgctgtgcaatctctgtggcagcgtttggttatctgcatccatggaaatcagcatccactgcagagaagtaccagcttgggttcttgctttcatcttttgctttcaatctcaccaatctgtttgtctttactccaatgacaattgagatgatgaagcaaaggcacaaggtggagcgtgaagagaacattgggactgaagttggatggtcaaagaacaaggaagtggcgaaggccaatccaaagcttgctgccatgaacaagaaattcggaatgattcatgggttatcatcccttgctaatatcatgtcatttggcagtcttgccatgcactcatggtacttggcaggtaagattaatctgtaatttgtgatattcttgaaaattagttggccatggacttgtctactttaccattagtattctctgattgttcccgtgccaacttatgtactccgaatgtgtcaagactaagaagtttgttgtgagaacatgcttagcaataaattctgcacacctattctccaaagttatcgaatgtgttttgaagaacttcgagcttatgttgtaaattgaatctttgtgtgatgacctcttgcctat

SEQ ID NO: 5546 - DNA, 1525 bp, Prunus mume
caaatattgaacacgtgtcactgcctacgagagaagacgaacaacacggagcccgaaccgaagcccatgataactaaacttgtgttgggtgaatcaccaaccgcccactggatgagtttggtaaatcgaagggtcatcaatgagtaaccctttccatttattcgacgacaattcaatccactccagaagagaagagaagagaagagaagagtgaggctgggtggcactggcggtactagttggtaaagctttgcttacgggtccggggtccttatatcgagttcaatcgttcgttgttgggtttggtggtcttctcgtcttctcttcttccttcccaaaccactacaaccctaaaaaataaaaaagcctttgggtttgcaaaatttgaattgagcgagatggcttggttgactcgattcctagcagccgtggctttcttagccatcggagtgattttctccccggagacctttggatccaaatcggatggtctgaattcacccaccctctccacctacctaaaactggctcatctcctcaccttctccaccgctttcggtgcggctctctgggttaccttcatcggcggcatcatcatgttcaagaatcttccgagacatcagtttggtaatcttcaaagcaagatgtttccagcgtatttctcaatggtggggatctgctgtgcagtatcagtagcctcgtttgggtatttgcatccctggaactcttcttccgttgccgaaaagtaccagctcggctttttgctctcttccttggccttcaatctcaccaatttgttcgtcttcacacccatgaccgtcgagatgatgaagcaaaggcataaggtggagagggaacagaacattggggaagaagttgggtggtcgaaaaatgttgaagtggcaaaggtaaacccaaaactagcagccatgaataagaaatttgggatgattcatgggttatcatctctagccaacatcatggcctttggcagccttgctatgcactcatggtacttggctagtaaacttaatctgtaaccaaataaaacaaggaaggaaaagaagaaaaagaaaaaaagaccccaagtttccttttgtttggggattggggattggggattgaataaaatagtagggctctctatgctttcttctcagtttgattcaacgttatacatacaagaatatgattatctcctttgtctatgaaatatgaagctctaagcagtgtgtcatatgatatgaccagtggaaatgtgagtttataatgaagatgatatactttgctattgtttagctatttttactcatgcgtcagccggagtctgttgccctggccctatattgacgatcagtaattactaattactgaatgagatgggaatagcccaaaaccgtttcttttagtttagcagtttagcagtaataacaatcactgataaactgaaattggatttggttacatgctaaaatcattgtaatgtgccctaacattgacatgtatggaattcagtttttctgta

SEQ ID NO: 5547 - DNA, 1232 bp, Ricinus communis
cggcttttcagaaaagtcattgttttgggctctgaacaattttagttttgggcttcaagagataacaaaattttcagaaggaaaagaagtttctccagttccgcctggtgacttttttatttggcaattttggttgtatagaagtaaataaaccaaacccactggttgttccatttctcgaatcgtcgacgatgggttggttaactcgatttgtagcagcagtggctttcttagccataggcataatattttccccagaaacctttggatcaaagtcagtcggtcaactgtccacttacctgaaactggctcacctcctctgcttttccacggcttttggtgccgctctttgggtcacctttatcggtggcatcatcatgttcaagaatcttccaaggcatcagtttggtaatctgcaaagcaagatgtttcctgcatatttttggttggtaggtgtgtgctgcgcgatatgtgtggcatcatttggttatttgcatccctggaaatcagcatccaccgcagagaagtaccagcttgggttcttgctttcttccttggctttcaatcttgctaacttgtttgtgttcactcccatgactattgagatgatgaagcaaaggcacaaggtggagcgagaacagaacattggagaagaagttggatggtcaaagaaccaggaaattgcaaagactaatccaaagcttgctgccatgaacaagaaattgggcatgatccatggtttttcatcccttgccaatattatgtcttttggcagtcttgccatgcattcgtggtacttagcaggtaagatgaatctgtaatattgaatttcagattgaaacttgtttaaggctatggattatatttattggatagacataagtgctctctcgttgatatattttcgtagttcctggccaagttatgtagtttttggaagtgtaagaagttcatcatcctcagatatgttgaaatggttatgtacttttgaaagttcaagaagtccatcatcgtcaatgaagttcacatgaggctagtagttgtctagttgatggatatatacttgtgcttttcgatatgagatgttgaaacaagcattctagttctcaaacaataattgccctttggctttttatgtatacaattatctttcattttgagaattgtgtgaatgcttaacttgtgcttccgcttttggcacaatatcggatctttttgcatctcaatttcca

SEQ ID NO: 5548 - DNA, 1109 bp, Prunus persica
atcaactccagtataggagaagagaagagtgaggctgtgtggcacttgcggtactagttggtaaagctttgcttacgggtccggggtccttgtatcgagttcaatcgttcgttgttgggtttggtggtcttctcgtcttccttcaaaaaccactaaaaccctaaaaaataaaaaagcctttgggtttgcaaaatttgaattgagcgagatggcttggttgactcgattcctagcagccgtggctttcttagccatcggagtgattttctccccggagacctttggatccaaatcggatggtctgaattcaccaaccctctccacctacctaaaactggcccatctcctcaccttctccaccgctttcggtgcggctctctgggttaccttcatcggcggcatcatcatgttcaagaatcttccgaggcatcagtttggcaatcttcaaagcaagatgtttccagcgtatttctcaatggtggggatctgctgtgcagtatcagtagcctcgtttgggtatttgcatccctggaactcttcttctgttgctgagaagtaccagctcggctttttgctctcttccttggccttcaatctcaccaatttgtttgtcttcacacccatgaccgtcgagatgatgaagcaaaggcataaggtggagagggaacagaacattggggaagaagttggatggtcgaaaaatgtgcaagtggcaaaggtaaacccaaaactagcagccatgaataagaaatttgggatgattcatgggttatcatctctagccaacatcatggcctttggcagccttgctatgcactcatggtacttggctagtaaacttaatctgtaaccaaataaaacaaggaaggaaaagaagaaaacgaaaaaaaaccccaagtttccttttgttttgaggattggggataggggattgaataaagtagtagggctctctatgctttcttctcagtttgattcaacgttatatgtacaagaatatgattatctcctttttgtctatgaaatataatgctctaagcagtgtgtcatatgatatgaccagtggaaatgtgagtttataatgaagatgatatgctgcgttattgttt

SEQ ID NO: 5549 - DNA, 978 bp, Manihot esculenta
aatcgttgaggtatccccggagagagagagagatgggttggcttagtcgatttgtggcggccgtggctttcttagccatcggggtgatattctctccggaaacatttggatctaattccattgttcagctacctacttacctgaaactggctcacctcctcagcttttccacggcttttggtgccgctctctgggtcaccttcatcggtggcatcatcatgttcaagaatctgccaaggcatcagtttggtaatttgcaaagcaagatgtttcctgcatacttttggttggtgggagtgtgctgtgcaatatctgtggcttcatttggttatttacatccatggaaatcagcttccgctgcagagaagtaccagctggggttcctgttatcttccttggctttcaatcttgccaacttatttgtcttcactcccatgactatcgagatgatgaagcaaaggcacaaggtggagagggaacaaaacattgggaatgaaattgggtggtcaaagaaccaggaagttgcaaaggctaacccaaagcttgctgcaatgaacaagaaatttggcatgatccatggtttttcatcccttgctaatatcatgtcttttggaagccttgccatgcactcatggtacttagcaggaaagatgaatctgtaatttgtaagtcaggtgaaagcatgtctttggctatgaatttgtacttcatgagttgcttggatatttctgattgttcctggccaagctgtgtaattctgaacaatgtgatatgtttaagaagttcatcattccgacatactctgaaataaaaattcacagatttacgcatctatttccctttttggctctattatcagtttctcaaatgaggtcagtatatggtgcagatgtgtattttggcataaaatgttgaaagaagcagtcatcatctaactgccttttggtgtattatgtgtatgttaataatactatatat

SEQ ID NO: 5550 - DNA, 849 bp, Hevea brasiliensis
cagagagagagagcgatgggttggctaagtcgatttgtggcggccgtggctttcttagccatcggggtgatattctctccggaaacctttggatctaattccattgctcagctaccgacttatctgaaactggctcacctactcagcttttccacggcttttggtgctgctctctgggtcaccttcatcggtggcatcatcatgttcaagaatctaccaaggcatcagtttggtaatttgcaaagcaagatgtttcctgcatatttttggctggtgggggtgtgctgtgcgatatctgtggcatcatttggttatttgcatccatggaaatcagcttccccttctgagaagtaccagctgggtttcctgttatcttccttggctttcaatcttaccaatttgtttgtctttactcccatgactatcgagatgatgaggcagaggcacaaggtggagcgggaagaaaacattgggaatgaaattgggtggtcaaagaaccaggaagttgctaaggctaacccaaagcttgctgcaatgaacaagaaatttggcatgatccatggtttttcatcccttgctaatattatgtcttttggaagccttgccatgcattcatggtacttagcaggaaagatgaatctgtaatttgtacttccggtgaagcttgtttctggctataaattaaattaactgggcaaggacatgagtgctttctctttgattatttctggttgagtggttgttcctggccaagctgtgtattgtcctgaacaatgtgttaagtttaagaagttcatcgacctcacatattctgaaataaaagttcacagatttataaaaaaaaaaaac

SEQ ID NO: 5551 - DNA, 773 bp, Scabiosa columbaria
ctactagaccttggctgtcactcaactctatttcattcatcttcaacctgattcgattacaacaagaaacaagaagaagaatccatgggttggttaactagattcttggccgccgtatcatttttagccatcggaattctttactcgccggagacattcggatcaaaatcccccaatatccccactttcatcaaactcgctcatctcctatgcttctccactgcttggggcgccgcactttgggtcaccttcatcggtggaatcatcatgttcaagaatcttccgaggcatcaatttggtaatctacaaagcaagatgtttccggcctacttttccatggtcggagtttgttgtgcggtctctgttgcagcttttggttacttgcatccatggaagtcatcttcttctgctgaaaagtaccagcttgggtttcttctctctgcctttgccttcaatctcaccaatcttttcatctttacccccatgaccattgagatgatgaagcaaaggcacaaagtggaaagggaatcgaatataggggaggaagtggggtggactaagaacaaggaaattgcaaaggtgaatccgaaacttgcagcgatgaataagaaatttgggatgatccatggactatcctctcttgccaatatcatgtcttttggtagccttgcaatgcattcgtggtacttagctggtaaaattgatctttagattcaactttgtttcccgtatgattttgatcgagtcatgctacacgttaaaaccaaataaaa

SEQ ID NO: 5552 - DNA, 1129 bp, Malus domestica
gggcgaatgaaagaagcaaagcacctacctgccatttgcgacaattccagagaagaagaaaatagtgagagagtagagactactaggcacagacagattagtgagagagaaagtgtgtaaggcttcaagcttcaatcgttcaatctcttgccatggcttggttgacgcgattcctagcagccgtggctttcttggccatcggagtgatattctccccggagacctttggatcgaaatcggacggtctgaaatcgcccaccctctccacctacctaaagctggctcatctgctctgcttctccaccgcattcggcgccgctctctgggtcaccttcatcggcggcatcatcatgttcaagaatcttccgcggcatcagttcgggaatcttcagagcaagatgtttccggcttatttcaccatggttgggatatgccttgcagtatcagctgggtcgtttgggtatttgcatccgtggagctcttcctctgttaccgacaagtaccagctcggctttttgctctcttcctttgctttcaatctcaccaatctcttcgtcttcactcccatgactatcgagatgatgaagcaaaggcataaggtggagagggagcagaacattggggaagaagttggagggtcaaagaatgtgcaagttgcaaaggtaaacccaaaactggcagccatgaataagaagtttggtatgattcacggactgtcatctcttgccaacatcttggcatttggcagccttgctatgcactcgtggtacttggctggtaaacttgatctgtaagaaaataaaaccccaacttccccttcgctatgttggttttcttctcggtttcagaaagtaaaacacttacgattcatgttggaagcatattgtgttgtgccattggccatcggagatgtgagttttctatccaagatgatatatatgcttttgttttggtaggcaatttttgtttgtgggaatctgatcggaaatttgttctggccgcccaccgatggtgtggcatctttcagtgatgaatagatgttatggccatcgaaaatgtgttcttgctgcgtatagcatcttttagtgatgaataaatgtgactgagtcaatgtagcactgattccaaa

SEQ ID NO: 5553 - DNA, 914 bp, Rosa hybrid cultivar
aaatctctgaaatttttgggacttgtaatctccagagagacaaattctgaggtatgggctggctgactcgatttctagcggccgtggctttcttagccatcggagtgattttctcgccggagaccttcggatccaaatcggacggtctgaagtcgccgacactctccacctacctgaagctggctcatctgctcagcttctccaccgcgttcggcgccgctctctgggtcactttcatcggcggcatcatcatgttcaagaatcttccgaggcatcagttcggtaatctgcagagcaagatgtttccagcttatttcagcctggtggggatttgctgcgccatatcggttgcttcgtttgggtatttgcatccgtggaactcttccactgtagcagacaagtaccagctcggctttttgctttcttccttggccttcaatctcaccaatttgttcgtcttcacgcccatgactattgagatgatgaagcagaggcataaggtagagagggaagagaacattggggaagaagttggatggtccaaaaatgtgcaagttgcaaaggtgaacccgaaactagcagccatgaataagaagttcgggatgattcatgggttatcatctcttgccaatattatggcctttggcagccttgccatgcactcatggtacctggcaggtaaacttaatctgtagttcgtgaataaacccaagttcccctttatttggggattggaggaagggaaatgttctgggctctagttgaactatggatttgatccatgacctaatgtcttattctctgcttgaatgttacatgtaaacgaatacaattatctcatgcttgtctaggaatcataatttcataagacttgatcatcggaagtatgagttctaatgaagatgatttacttc

SEQ ID NO: 5554 - DNA, 741 bp, Centaurea maculosa
aaaattttccaaattcaatcttcaatttacagactaagatcatgggttggatgactcgatttctgaccgccgttgccttcttggcaatcggagtcatcttctcgccggaaaccttcggatcaaaatcagcaaagatcacaactttcgtcaaacttgcacaccttctatgcttctccactgcttggggagcagctctctgggtcaccttcatcggcggtatcatcatgttcaagaatctgccaaggcatcagtttgggaatctgcaaagcaagatgtttccggcttactttatgatggttgggatatgctgtgcggttactgtggggtgttttgggtattcacatccatggaagtcttcatcaactgctgagaagtatcagcttggatttttggtctctgctttcgtcttcaatctcaccaatctttttgtctttactcccatgaccattgagatgatgaagcaaaggcacaaggtggagagagagtcgaacattggagaagaagttgggtggacaaagaaccaagaggttgcaaaggtgaacccaaagctagcagcaatgaacaagaagtttgggatgattcatgggttatcttctctagctaacatcttgtcttttggtagtcttgcaatgcattcatggtatttagcaggcaaaatcgatctctagacccatcccatcccatggttgaataatgtaccattttcctagcaatggcaccttcctgcacattagtatgtta

SEQ ID NO: 5555 - DNA, 1791 bp, Linum usitatissimum
ccgtcaacaagagctcgtttccagagtcgctgcagcatcgagagggccgaccattttggtcctaatgtctggtggaccgatcgatgtttcgttcgcaacgaacgacccaaagatatcgggtatcatatgggccgggtacccgggacaagccggcggagctgctattgctgatatattgtttggcaccacaaatccagggggtaagctgccaatgacgtggtacccacaagaatacctaacgaatctaccaatgaccgagatggggatgcgagcaatcgactcgaacggctatcccggacgaacctaccgattctacaaaggtccagtggtgtacccatttggtcacggtctaagctacacaacattcgtagagaacatcgcaaccgctccaaccacagtccaggtcccactccatggccatcgcaacccaaacaacacggtattgaacaaggcgatcaaggttacacacgtcagatgcggtaagctctcgataggaattgaagcggacgtgaagaacacaggtcgtgcagacggaactcacacattattgatctactcatcgtcgccacgtgcctcgacagccaaaggatgggcgcctcacaagcagttgatagccttccgcaaggtgcacttggcggcgggtgcaggacaacgagtgaagattaacatccatgtgtgtaagtacctaagcgtcgttgatagggttggtactcggcgaattccgatggggacacatagtatccacgtcggaaatgtccagcatctggtttcgctccaagcgataacgcttggagtgatcaagaattagtgtcatttatattcttcatctcaattggatatagattattaggttaaacaaaattggattcgcatctaaatgtactattgatcaaacatctgtaatgaagatcatccgttacaatattaactgcagaagcatctgatccaagatacacagaacaacatcatatgataacggcagaaattatctaagtttcagatgtcatgaccgagaggagaagttggctgaatattcaacccgattctcgaaatttgatgtgaatttcagttacgcaaacagagaattacagattcaacttacctgccaagtaccaagaatggatggcgaggccaccaaaggacatgatgttagcaagcgacgagagtccgtggatcatgccgaatttcttgttcatcgaagcgagcttaggatcactctttgcaactttcaagttcttcgaccatcctacttcttccccgatgttcaactctcgctctaccttgtgcctttgcttcatcatctggacggtcatgggagtgaagacgaacaaattgcagaggttgaaagcaaaggaagataacagaaaccctagctgatatctctcagcagtggaagctgattgccaagggttgaggtagccgaaagcagctaccgagatggcgcagcaaactccaaccatggagaagtaagcaggaaacatcttgctctgcaggttaccaaattggtgtctcggaaggttcttgaacatgatgatgccgccgatgaaggtgacccatagagcggcgccaaaggcggtggagaaggcgaggaggtgagcgagcttgaggtaggtagagagctgcttgacggaattggatgatccgaaggtctcaggggagaagacaacgccgacggctaggaaagcgacggccacaaggaatcggctcagccaacccatgttgctctgcgtcggcgggagtcaacagcgacggcgacgagtgaagtagagaattctgagagaggaggtttcg

SEQ ID NO: 5556 - DNA, 835 bp, Ambrosia trifida
gtaattaacttagtattaaactaatttaacttttagtaaaaaaaaaaaaattacccctaattcttctgaatccatcacaaactttacatcatgggttggatgacaagatttctgacagcgatcgccttcttagcaatcggagtaatattttcaccggaaacattcggatcaaaatccgcaaagatcacaactttcgtcaaactcgcgcacctcttatgcttctccaccgcttggggcgctgccctttgggtcaccttcatcggcggcatcatcatgttcaagaatctgccgcgacatcagtttgggaatctgcaaagcaagatgtttccggcgtattttatgatggtcggcatatgttgtgcggtgtcggtcgggtgttttgggtacacacatccatggaagtcttcatcaactgctgagaagtatcagcttgggtttttggtcgctgctttcgtcttcaatctcaccaatctgtttgttttcacccccatgaccattgagatgatgaagcagaggcacaagatagagagggaatcaaacataggtgaagaagttgggtggacaaagaaccaagaggttgcgaaggtgaacccgaagctagctgcaatgaacaagaagtttggaatgattcatggactgtcttcgcttgccaatataatgtcttttggtagtcttgcaatgcattcatggtacttagccggcaaaattgatctctagatccattgtgttttatatggcttgtatgttgatttatgatcgtaatgtaccattttccttatgtaaaaggatgatcatgcttacctatgaataatacatatcacatgctagatttctg

SEQ ID NO: 5557 - DNA, 740 bp, Ambrosia trifida
aaaaataaaatacccatcttctgaatccatcacaaactttacatcatgggttggatgacaagatttctgacagcgatcgccttcttagcaatcggagtaatattttcaccggaaacattcggatcaaaatccgcaaagatcacaactttcgtcaaactcgcgcacctcttatgcttctccaccgcttggggcgctgccctttgggtcaccttcatcggcggcatcatcatgttcaagaatctgccgcgacatcagtttgggaatctgcaaagcaagatgtttccggcgtattttatgatggtcggcatatgttgtgcggtgtcggtcgggtgttttgggtacacacatccatggaagtcttcatcaactgctgagaagtatcagcttgggtttttggtcgctgctttcgtcttcaatctcaccaatctgtttgtcttcacccccatgaccattgagatgatgaagcagaggcataagatagagagggagtcgaacataggtgaagaagttgggtggacaaagaaccaagaggtcgcaaaggtgaacccgaagctagctgcaatgaacaagaagtttggaatgattcatggactgtcttcgctagccaacatcatgtcttttggtagtcttgcaatgcattcatggtacttagctggcaaaattgatctctagatccattgtgttttatatggcttgtatgttgattatgaccgtaatgtaccattttccttatggtaaag

SEQ ID NO: 5558 - DNA, 831 bp, Arnica chamissonis
caatccatttcacaaactttacatcatgggttggatgacaagatttctgactgcgatcgccttcttggcaatcggagttatattttctccggaaacgttcggatcaaagtcggcaaagatcacaaccttcgtcaaacttgctcaccttctgtgtttctccaccgcatggggggcagcgctttgggtcaccttcatcggcggcatcatcatgttcaagaatctaccgagacatcagtttgggaatctgcaaagcaagatgtttccagcgtactttatgatggttggtatatgttgtgcggtgtcggttgggtgttttgggtatacacatccatggcagtcttcatcaacttctgagaagtatcagctagggtttttggttgctgctttcgtcttcaatctcaccaatctttttgtctttacacccatgaccattgagatgatgaagcaaaggcacaaggtggagagggagtcaaacataggtgaagaagttgggtggacaaagaaccaagaggttgcaaaggtaaacccaaagctagcagcaatgaacaagaagtttggtatgattcatggactatcttctctagccaacataatgtcttttggtagtcttgcaatgcattcatggtacttagctggcaaaattgatctctagatccattctgtttcatatggcttgtatgttgacaatgacagtaacgtaccattttcctcgggacggttctccctgctgtgcagagtgatgccaattatataccctatattaatgttataaaacaggatttgacagtgttttatcttgtaaatcgatgcgtcaattcataacctatacta

SEQ ID NO: 5559 - DNA, 871 bp, Cirsium arvense
tctccatcgcctccttctcctcttccctttagatttctggaaaattttccaaattcaatcttcaatttacagactaagatcatgggttggatgactcgatttctgaccgccgttgccttcttggcaatcggagtcatattctcgccggaaaccttcggatcaaaatcagcaaagatcacaactttcgtcaaacttgcacaccttctatgcttctccactgcttggggagcagctctttgggtcaccttcatcggcggtatcatcatgttcaagaatctgccaaggcatcagtttgggaatctgcaaagcaagatgtttccggcctattttatgatggttgggatatgctgtgcggttacggttgggtgttttgggtattcacatccatggaagtcttcaacaactgctgaaaaatatcagcttggatttttggtgtctgctttcgtcttcaatctcaccaatctttttgtcttcactcccatgaccattgagatgatgaagcaaaggcacaaggtggagagagagtcgaacattggagaagaagttgggtggacaaagaaccaagaggttgcaaaggtgaacccaaagctagcagcaatgaacaagaagtttgggatgattcatgggttatcttctctagctaacatcttgtcttttggtagtcttgcaatgcattcatggtatttagcaggcaaaatcgatctctagacccatcccatcccatggttgaataatgtaccattttcctagcaatggcaccttcttgcacattagtatgttataaaagcaatgtttaagagtgttctaaaccctgcacattaatgtgttaaactcataatctcgttggcaatggcttgtattacaacagcag

SEQ ID NO: 5560 - DNA, 915 bp, Taraxacum officinale
tttcgataattcaatattttactaccctttacatttcctgttaatttccaccaattcaattcaattcacaaactttagtcagtaagatcatggcttggatgacacgatttctcactgcggttgccttcttggcaatcggagtcatattttcaccggaaacgttcggatctaaatcagcaaagatcacatccttcgtcaaacttgcacacctcctatgcttctccaccgcctggggcgcagcgctttgggtcaccttcatcggcggcatcatcatgttcaagaatttgccaaggcatcaatttgggaatctgcaaagcaagatgttcccggcgtactttatgatggttggaatatgctgtgcggtgaccgtgggatgttttggctacacgcatccatggaagtcttcttcaactgctgagaagtatcaacttgggtttttggtctccgcttttgtcttcaatctcaccaatctctttgtctttactcccatgaccattgagatgatgaagcaaaggcacaaggtggagagggagtcaaacatcggggaagaagttgggtggacaaagaaccaggaggttgcaaaggcgaacccaaagctagcagcaatgaacaaaaagtttgggatgattcatggactgtcatctctagctaacatcatgtcttttggtagtcttgcaatgcattcatggtatttagcaggaaaaattgatctgtagaccctcccatggcttccaataatgtatcattgtcctagcatggggtccttcttgcttggagagtgatgccagttatatgatattgatgttacaaaagaactttaacagctatatgttgttttgtgttttaaactcgcaatctttgatgtgtatactgtgtaattatatccgaaaatgaagtaccacaactgttgcatga

SEQ ID NO: 5561 - DNA, 674 bp, Euphorbia peplus
cggacgattttaatctggatcatcatcatcaactaccctagaaagttggacagagaatgggttggcttactcgattcttggccgcatcggctttcttagccatcggagtaattttttcaccggaaacctgcggttctaactccatcggccaattatccacttacctgaaactggctcacctccttagcttctccacggcgtttggtgcggctctttgggtcactttcatcggcggcatcatcatgtttaagaatcttccgaggcatcagtttggtaatttgcaaagcaaaatgtttcctgcatatttttggttggttggggtatgctgtgcaacatctgtggcatcttttggttatctgcatccatggaaatcagcatccactacagagaagtaccagcttggattcctgctctcttccttggctttcaatctcactaacttgtttgtcttcactcccatgaccatcgagatgatgaggcaaaggcacaaagtggagcgagaagagcaaattggggatgaaattggttggtcgaagaaccaggaacgtgccaagtctaatccaaagcttgctgctatgaacaagaaatttggcatgatccatggtttttcatcccttgctaatattatggctttcggtagccttgccatgcactcatggtacttggctggtaag

SEQ ID NO: 5562 - DNA, 796 bp, Euphorbia peplus
tgggttggctaagtagatttatggcggcatcggcattcttagccatcggagtgatattttcaccggaaacattcggttcaaactccgtgggtcaactatccacttacctcaagctagctcacctcctcagcttctccacggcgtttggtgctgctctttgggtcactttcatcggcggcatcatcatgttcaagaatcttcccaggcatcagtttggtaatttgcaaagcaagatgtttcctgcatatttttggttagttggggtatgctgtgcaacatctgtggcatcttttggttatctgcatccatggaaatcagctaccacttcagagaagtaccagcttggttttctgctctcttccttggctttcaacctcactaacttgtttgtcttcacgcccatgactatcgagatgatgaagcaaaggcacaaagtggagcgagaagagaaaatcggggatgaaatcggatggtcaaagaaccaggaacgtgcaaaggctaatccaaagcttgctgctatgaacaagaaatttggcatgatccatggcctttcttcccttgcaaatattatggctttcggcagccttgccatgcattcatggtacctagctggtaagctgaacctgtaactcaaccttcagttgtttccgatcatggattataaatcatagcagactgggatatacgtgtttgcttgtggatatctctatattattcccggtcaatcatgtacaattgaacaatgtgttacttttaaggagttcatcgttaccaaatactttgaaataaaagttca

SEQ ID NO: 5563 - DNA, 710 bp, Flaveria ramosissima
acttcacaatcatggcttggatgacaagattcctcactgcaatcgccttcttagcaatcggagtaatattctcaccggaaaccttcggatcgaagtccgcaaagatcacaactttcgtcaaactcgcacacctcttatgtttctccaccgcttggggcgcagcgctttgggtcaccttcatcggaggcatcatcatgttcaagaatttgcctaggcatcagtttgggaacctgcaaagtaagatgtttccggcttattttatgatggttggtgtgtgttgtgcggtgtccgtcgggtgttttgggtatacgcatccgtggaagtcttcgtcaactgctgagaagtatcagctagggtttttggttgctgcttttgtcttcaatctcaccaatcttttcgtctttacccccatgacaattgagatgatgaagcaaaggcacaaggtggagagggagtcgaacataggtgaagaagttgggtggacaaagaaccaggaggttgcaaaggtaaacccaaagctagcagcaatgaacaagaagtttggtatgattcatggactatcttctctagccaacataatttcatttggtagtcttgcaatgcattcatggtacttagctggcaaaattgatctctagattcatcctgtttcatatggcttgtatgttaacaataacagtaatgtaccgtcttcctcttgtgtaaaggat

SEQ ID NO: 5564 - DNA, 763 bp, Acacia harpophylla
ggacccgataaacaaacaccggtcattgctgtcgatgtaagtgccggagtgatttggttcacccacccgcgttgaagcttcgactggggcagaggagtaggaggagaagagattttccgtcgtcgtctgagatggcttggctcactcgattcttggcggctgttgctttcttagccattggagttatattctcccctgaactctttggatcaaaatcagacgcttccaattcactcaaactgtcaacctacctcaaattggcgcatctcctaagcttctccacggcttttggtgccgctcaatgggtcaccttcatcggcggaattattatgttcaagaatctcccgaggcatcagtttggtaacctgcaaagcaagatgtttcctgcatatttctcaatggtcggtatctgttgtgcgatatcggtggcgtcgtttgggtatctacatccttggaaatcttcgtccacggctgaaagataccaacttggcttcttgctctcgtcattcgcgtttaatcttgctaacttgtttgtcttttctccgatgactatcgagttgatgaggcaaaggcataaagtggagagagaaaatagcattggagaggaagttggttggtcaaaaaatattgaagtcgcaaagaagaatccaaagcttgcagccatgaataaaaagtttggaatgatccatggattatcttcccttgccaatatcatgtcctttggcggccttgccatgcactcttggtacctggccggtaaaat

SEQ ID NO: 5565 - DNA, 639 bp, Manihot esculenta
atgggctggctaagtcgatttctggcggccgtggctttcttagccattggggtgatattttcaccggaaacgtttggatcaaattccatcgttcagctaccgacttgtctgaaactggcccacctcctcagcttttccacggcttttggtgccgcgctttgggtaaccttcatcggtggcatcatcatgttcaagaatctaccaaggcatcagtttggcaatttgcaaagtaagatgttccatgcatatttttggttggtgagtgtgtgctgtgcgatatctgtggcgtcatttggttatttgcatccatggaaatcagcatccactgcagagaagtaccagctaggcttcctgctgtcttctttgtctttcaatctcgccaatttgtttgtctttacgcccatgactattgagatgatgaggcaaaggcacaaggtggagagagaacagaacattggaaatgaagttgggtggtcaaagaatcaggaagttgcaaaggttaatccaaagcttgctgcgatgaacaagaaatttgggatgatccatggtttttcatcccttgctaatattatgtcttttggaagcctagccatacactcatggtacttagcaggaaagctgaatccgtagtttatactt

SEQ ID NO: 5566 - DNA, 1115 bp, Centaurea maculosa
  misc_feature (4)..(4): n is a, c, g, or t
  misc_feature (60)..(60): n is a, c, g, or t
  misc_feature (635)..(635): n is a, c, g, or t
  misc_feature (716)..(716): n is a, c, g, or t
  misc_feature (992)..(992): n is a, c, g, or t
  misc_feature (995)..(995): n is a, c, g, or t
  misc_feature (1006)..(1006): n is a, c, g, or t
  misc_feature (1008)..(1008): n is a, c, g, or t
  misc_feature (1020)..(1020): n is a, c, g, or t
  misc_feature (1026)..(1026): n is a, c, g, or t
  misc_feature (1039)..(1039): n is a, c, g, or t
  misc_feature (1041)..(1041): n is a, c, g, or t
  misc_feature (1045)..(1046): n is a, c, g, or t
ctancggggagataattcatcaatcttcatcgcctccttcttctcttccctttttagtantagatttctgaaaatttcccaaattcaatccatttcacagacttaagatcaccaagatcatggcttggatgactcgatttctgaccgccgttgccttcttggcaatcggagtgatattctcgccggaaaccttcggatcaaaatcagcaaagatcacaagtttcgtcaaacttgcacaccttctatgcttctccactgcttggggagcagctctttgggtcaccttcatcggcggtatcatcatgttcaagaatctgccaaggcatcagtttgggaatctgcaaagcaagatgtttccggcctactttatgatggtcgggatatgctgtgcggtttcggttgggtgttttgggtactcacatccatggaagtcttcatcgactgctgagaagtatcagcttggatttttggtctctgctttcgtcttcaatctcaccaatctttttgtctttactcccatgaccattgagatgatgaagcaaaggcacaaggtggagagggagtcaaacattggagaagaagttgggtggacaaagaaccaagaggttgcaaaggtgaacccaaagctagcagcnatgaacaagaagtttgggatgattcatggcttatcttctctagctaacatcttgtcttttggtagtcttgcaatgcattcntggtatttagctgccaaaatcgatctctagaagacccatcacatcacatcccatcccatggttgaataatgtaccattttcctagcaatggctccttcctgcacattagtatgttataaaaacccatgtttaagagtgtttctaaagcctgcacattaatatgttaaactcataatctcgttggcaatggcttgtattacaacagcagcagctacatgtgaagcacacccttaatgtaacagtggttgtatatctgttgaaaacgatgaacttaanacntgtgggcatcnangttgtgaataanttcacnatatacctccaananaggnncatggtaaatattgttttctttttcatagagcagagaagatgagagtaaggactgcatatttcaccttt

SEQ ID NO: 5567 - DNA, 852 bp, Cichorium intybus
tggcggggagataattcaatcttcatctccttcacatttcttgaaaattttcactaatttaattcattttacaaagttcagttcagtaagatcatggcttggatgacacgatttctgactgcggttgccttcttggcaatcggcgtcatattttcaccggaaacattcggatcaaaatcagcaaagatcacatcattcgttaaacttgcgcacctcctatgtttctccaccgcctggggcgcagcgctttgggtcaccttcatcggcggcatcatcatgttcaagaatctgccgaggcatcagtttgggaatctgcaaagcaagatgtttccggcgtacttcatgatggttgggatatgttgtgcggtgaccgtggggtgttttggttatacacatccctggaagtcttcatcaactgctgagaagtatcagcttgggtttttggtctctgcttttgtcttcaatctcaccaatctttttgtctttactcccatgaccattgagatgatgaagcaaaggcacaaagtggagagggagtcgaacattggagaagaagttgggtggacgaagaaccaggacgtagcaaaggtcaacccaaagctggcagcaatgaacaagaagtttgggatgattcatggattatcatctcttgctaacatcatgtcttttggtagtctggcaatgcattcatggtatttagctggcaaaattgatctgtagaccctcccatggcttctaataatgtgtcattttccttcattttgtggagactgatgttaaatatacaataggtaccatatattgaggttacaaaagaagggcaaaaacagctgtgtgttttagcttggacaa

SEQ ID NO: 5568 - DNA, 770 bp, Valeriana officinalis
gcaataatcatcgatgggttggttaactagattcatcggagctgtatcatttctagcaatcggaattatcttctctccagagacattcggagcaaaatccccaaatttaccgacttttatcaaactcgcacatctactatgcttcgccactgcttggggagctgctctttgggtcaccttcatcggtggcatcatcatgttcaagaatcttccgaggcaccagtttggtaatctgcaaagcaagatgtttccggcctacttctccatggtcggagtttgttgtgccgtctgtgtggcagtcttttgggtacttgcatccatggaagtcttcctcttgtgcagaaaagtaccagcttggcttccttttatctgcttttgtcttcaacctcactaatcttttctatctttaccccactgactattgagatgatgaaacaaaggacacaaggttgaaagagaatcgaatataggagaagaagtagggtggacaaagaacaaggaaatagcgaaggtcaatccaaaactcgcagcaatgaacaagaaattcggaatgattcatgggctttcttctctttctaacatcttctcttttggtagcctcgcgatgcactcatggtggttagccggaaaaattgatctttaacttgtgaactatgtaagtgctatgtccctttagcctgcttatgtacatctattctataagttgtagcatttcaagggttcacctgtagtaaacttaaatcttatttcaatcaataatgattttgttt

SEQ ID NO: 5569 - DNA, 989 bp, Malus domestica
aaaatagtgagagaaagaaagtagataaagcttcaagcttcattccttcaatccttcaatccttcaatcgcttgcgaattgcgatggcttggttgactcgattcctggcagccgtggctttcttggccatcggagtgatattctccccggagacctttgggtcgaaatcggacggtctgaaatcgcccaccctctccacctacctaaagctggcacatctgctctgtttctccaccgcattcggcgccgctctctgggtcaccttcataggcggcatcatcatgttcaagaatcttccgcggcatcagttcgggaatcttcagagcaagatgtttccggcgtacttcacgatggtggggatatgccttgcagtatcagctgggtcgtttgggtatttgcatccgtggagctcttcctctgttgccgacaagtaccagctcggctttttgctctctgcctttgcattcaatctcaccaatctcttcgtcttcactcccatgaccatcgagatgatgaagcaaaggcataaggtggagagggagcagaacattggggaagaagttggatggtcaaagaatgtgcaagttgcaaaggtaaacccaaaactggcagccatgaataagaagtttggtatgattcacgggctatcatctcttgccaacatcttcgcatttggcagccttgctatgcactcgtggtacttggctgctagacttgatctctaagaaaataaaaccccaacttccccttttctatgggggctttcttctcggtttcaaaaaacaacacacttaagatgatgtatactcgcttcttgttttggtaggtaattgttgagtccgttccaatagcatcttttagtgatgaataaaaatggctttgtaatatttcgataatgtgcattcaaacgatattgccaagagtcagttttgcaaatttcctcccaaaacatcataaattgatttaatcagttttgtcttactgtcata

SEQ ID NO: 5570 - DNA, 689 bp, Actinidia deliciosa
cccctgcgaccctccgtctcgaagaatcacatataggtagagagagaaagagtcaccaatcggaaaacatgggttggatgagtcgattcatagcggcggtgactttcttggcaatcggagtcatattctcgccggagacatttggatcaacatcagacggtcaacaaccgccgaagctctccaccttcctcaaattggctcatcttctctgcttctccacagcctttggcgctgctctttgggtcactttcatcggcggcatcatcatgttcaagaaccttccgaggcatcagtttggaaatctgcagagcaagatgtttccggcgtacttcgcgatggttggggcttgctgcgcggtgacggtggcgtgttttgggtatttacatccatggaagtcggcttccactgcagagaagtaccagctagggtttcttctctccgccttcgctttcaacctcaccaatctttttgtgtttacgcccatgaccattgagatgatgaagcagagacacaaagtcgagagagaagagaaaattggagaggagattgggtggtcaaagaatgtggaagttgcaaaagtaaacccaaagcttgcagccatgaacaagaaattcgggatgattcatggcttatcatctcttgctaatatcatgtcttttggtagccttgccatacattcatggtactta

SEQ ID NO: 5571 - DNA, 1050 bp, Lactuca sativa
ggcttagcaattaacatttagcacccccagctgagtgttaggtgaggtttaatcctttacccttcacattacattttgtgtaaatttccatctattcaattcatttcacaaacttcagtcagtcgctaagatcatggcttggatgacacgatttctcacagcggttgccttcttggcaatcggagtcatattttcgccggaaacgttcggatcaaaatcagcaaagatcacatcgttcgtcaaacttgcacatctcctatgtttctccaccgcctggggcgcagctctttgggtcaccttcatcggcggcatcatcatgttcaagaatttgccaaggcatcagtttgggaatctgcaaagcaagatgtttccggcatactttatgatggttgggatatgctgtgcggtgactgtgggttgttttggttatacacatccatggaagtcttcatcaactgctgagaagtatcagcttgggtttttggtctctgcttttgtcttcaatctcaccaatctttttgtctttactcccatgaccattgagatgatgaaacaaaggcacaagctggagagagagtcaaacattggagaagaagttgggtggacaaagaacaaggaagttgcaaaggtcaacccaaagctagcagcaatgaacaagaagtttgggatgattcatggactctcatctctagctaacatcatgtcttttggtagtcttgcaatgcattcatggtatttagcagccaaaattgatctctagatccacccttccccatggcttttaataataataataataatatatgtaccattttcttgatttggatcgttaccatgtattatgatatgttataaaagaagagctttagcagctgtgtattttagttttaaactcctaatctttgatgtgtataatcatggttgtatctgaaaaatgaagtatctcaattgttacatgagaagataaaagagttggaatataactagatgaatatccaattttcatacgatatgttctttctcaataatgaagtgtaacatatgcccgtg

SEQ ID NO: 5572 - DNA, 922 bp, Castanea mollissima
cagacacagactcagactcagactcagactcagactcagagagagagagagagagatgggttggctaacgcgattcctaggggccgtggcattcttagcggtcggggtgatattctcaccggagagctttggatcgaaatcggacggtgggaattcaactagtaagctagctatctatctcaagctagctcatcttctctgctactccaccgccttcggcaccgctctctgggtcaccttcatcggcggcatcatcatgttcaagaatcttccgaggcatcagtttggaaatttgcaaagcaagatgtttcctgcgtatttctccatggttgggatctgttgtgcagtatcggtggggtcatttgcgtatctgcatccctggaagtcatcgtctactgctgagaagtaccaactcgggttcttgctatctgcatttgcattcaatctcgccaatctgcttgtttttacacccatgacaattgagatgatgaaacaaaggcataaggtggagagagaatcaaacattggggaagaagttgggtggtcaaagaacgtggaagttgcaaaggtgaatccaaagcttaaagccatgaacaagaaatttgggatgattcatgggttatcatcccttgctaatatcatgtcctttggcagcctagccatgcactcatggtacttagcaggtaaacttaatctgtagtttcaatctggtttccctttaatagggaaggtagtgctttcgctctatagattacatcaatagagagaggacctacgtgctttcacttttttataaatactttgaaatccttctttccaagttatgtatgattgaacaataagtttagggaagaatccttgtggatgaattataagttacgacattatgagctataataatatggttaccatgttgataaac

SEQ ID NO: 5573 - DNA, 768 bp, Flaveria ramosissima
tccacttcacaatcatggcttggatgacaagatttctcactgcaatcgccttcttagcaatcggagtaatattctcaccggaaaccttcggatctaagtccgcaaagatcacaactttcgtcaaactcgcacaccttctatgtttctccaccgcatggggcgcagcgctatgggtcaccttcatcggaggcatcatcatgttcaagaatctgccgagacatcagtttgggaacctgcaaagtaagatgtttccggcgtattttatgatggttggtgtgtgttgtgcggtgtccgtggggtgttttgggtatacgcatccgtggaagtcttcgtcaactgctgagaagtatcagctagggtttttggtcgctgcttttgtcttcaatctcaccaatcttttggtattcacccccatgacaattgagatgatgaagcaaaggcacaaggtggagagggagttgaacataggcgaagaaactgggtggacaaagaaccaggaggtagcgaaggtaagcccaaagctagcagcaatgaacaagaagtttggtatgattcatggactgtcttctctagccaacataatgtcttttggtagtcttgcaatgcattcatggtacttagctggcaaaattgatctctagattgatcctgttgcatatggcttgtatgttgacaatagcagtaatgtactgttttcctcttgtgtaaaaggatacttaagcttaattttaaattaatacaaaccacatgtctattatctgatgatcg

SEQ ID NO: 5574 - DNA, 913 bp, Lactuca sativa
gcggggcagctgagtgttaggtgaggtttaatcttttacccttcacattacattttgtgtaaatttccctctattcaattcatttcacaaacttcagtcagtcgctaagatcatggcttggatgacacgatttctcacagcggttgccttcttggcaatcggagtcatattttcgccggaaacgttcggatcaaaatcagcaaagatcacatcgttcgtcaaacttgcacatctcctatgtttctccaccgcctggggcgcagctctttgggtcaccttcatcggcggcatcatcatgttcaagaatttgccaaggcatcagtttgggaatctgcaaagcaagatgtttccggcgtactttatgatggttgggatatgctgtgcggtgacggtgggttgttttggttatacacatccatggaagtcttcatcaactgctgagaagtatcagcttgggtttttggtctctgcttttgtcttcaatctcaccaatctttttgtctttactcccatgaccattgagatgatgaagcaaaggcacaagctggagagagagtcaaacattggagaagaagttgggtggacaaagaacaaggaggttgcaaaggttaacccaaagctagcagcaatgaacaagaagtttgggatgattcatggactctcatctctagctaacatcatgtcttttggtagtcttgcaatgcattcatggtatttagcagccaaaattgatctctagacccacccttccccatggcttttaataataataataataatatgtaccattttcttgatttggatcgttaccatgtattatgatatgttataaaagaagagctttagcagctgtgtattttaaactccccatctttgatgtgtataatcatggttgtatctaaaaaagaagcat

SEQ ID NO: 5575 - DNA, 837 bp, Helianthus annuus
catcatcatggcttggttgacaagatttctcaccgcgatctccttcttagcaatcggagtcatcttttcaccggaaaccttcggatcaaattccgcaaagatcacaaccttcgtcaaactcgcacacctcttatgcttctccaccgcttggggcgcagccctctgggtcaccttcatcggcggcatcatcatgttcaagaatctgccgagacatcagtttgggaatcttcaaagcaaaatgtttccggcgtactttatgatggtcggcatatgttgtgcggtgtcagtggggtgttttgggtatacacatccgtggaagtcttcatcaactgctgagaagtatcagttagggtttttggtggctgcttttgtgtttaatctcaccaatctttttgtcttcacccccatgaccattgagatgatgaagcaaaggcacaaggtggaaagggaggcaaacataggtgaagaaaccgggtggacaaagaaccaggaggttgcaaaggtgaacccgaagctagccgcaatgaacaagaagttcgggatgattcatggactgtcttctctagccaatataatgtcttttggcagtcttgcgatgcattcatggtacttagctggcaaaattgatctctagatccatcctgtttcatacgggcctgtatgttgattatgaccgtattgtatctttttccgttatgtaaaaggatgatcaagcttagctttgaataatacaaaccacatgccagatttccgcgcagatcttttgtgcagagccacaattggtaaaagatcagtggcgaatccaagaattttcgtcagccagaccgacaaagggct

SEQ ID NO: 5576 - DNA, 960 bp, Euonymus alatus
gctcttaccgactctcctgaccaaattttccacgagaatcacagttctgcatttcagaggtaggtgagactgtgttacacaaaataatcggaagtatcttcaggaggaatctgtgtgaggcaggtcagacaaattgagatgggttggttaactcgatttctagcagcggtggctttcttggccgtcggcgttatattttcaccggagacttttggatcgaaatcggatggtcagaaatcatcgcatctatcaacatacctgaaactggctcatctcctctgcttctccacggcttttggtgccgctctctgggtcaccttcatcggcggtatcatcatgttcaggaatctgccaaggcatcagtttggtaatctgcaaagcaagatgtttcctgcatatttctcgttggtgggggcttgtgcagcaatgtcagtggcctcatttggttatttgcacccatgggtgaccgcctcaacggtggagaaataccagctcggattcctgctgtcttcatttgcttttagtctcagcaatttattcgtcttcacacccatgaccattgagatgatgaagcaaaggcataaggtagagagagaacaggatattggagatgaagttgggtggtcaaagaacagggaagctgcaacggttaatccaaagcttgctgccatgaacaagaaattcggtatgatacatggattatcatcccttgctaacattatgtcatttggaagccttgccatgcactcgtggtacttagctggtaagatgagtctgtaatttagaactttgatgggaagtttgtgtcacttccacatttaaaatcagttaagaaaggacttgcttgtttctcattgataagttgttatcttggccaatttatgtatggttgaacaataagtcaagctaaataagttagttttcttgtgctttatgaaataaaaatcagagataagtatg

SEQ ID NO: 5577 - DNA, 790 bp, Valeriana officinalis
tgagttcgatcatctgcaatttacagcaataatcatcgatgggttggttaactagattcatcggaactgtatcatttctggcaataggaattctattctctccagagacattcggagcaaaatccccaaatttaccgacttttatcaaactcgcacatctgctatgcttcgccactgcttggggagctgctctttgggtcaccttcatcggtggaatcatcatgttcaagaatcttccgaggcaccagtttggtaatctgcaaagcaagatgtttccggcctacttctccatggtcggagtttgttgtgccgtctgtgtggcagcttttgggtacttgcatccatggaagtcttcctcttgtgcagaaaagtaccagcttggcttccttttatctgcttttgtcttcaacctcactaatcttttcatctttaccccatgaccattgagatgatgaaacaaaggcacaaggttgaaagagaatcgaatataggagaaggtagggtggactaagaacaaggaaatagcgaaggtcaaatccaaaactcgcagcaatgaacaagaaattcggaatgattcatgggctttcttctcttgctaacatcttctcttttggtagcctcgcgatgcactcatggtggttagccggaaaaattgatctttaacttgtgaactatgcaagtgctatgtccctttagcctgcttatgtacatctattctataagttgtagcatttcaagggttcacctgtagtaaacttaaatcttatttcaatcaataatgattttgttt

SEQ ID NO: 5578 - DNA, 950 bp, Fagus grandifolia
aaaaaaatagagagagaatagttgacgatcttaaccagtcagaataaaacccagcattttctcaactacccatcattttgcgcacagagagtcagagagagagatgggttggctaacgcgattcctaggtgccgtggcattcttagcaatcggggtgttattctcgccggagacctttggatcgaaatcggacggtcagaattcaacaactaagcttgctaccttcctcaagctcgctcatattctctgctactccacggccttcggctccgctctctgggtcaccttcatcggtggcatcatcatgttcaagaatcttccgaggcatcagtttggaaatctgcaaagcaagatgtttcctgcgtatttctctatggttgggatctgttgcgcagtatcagtgggttcgtttgggtatctgcatccctggaagtcgtcatctattgctgagaagtaccagcttgggttcttgctgtctgcgtttgcattcaatctctccaatctgtttgtctttacacccatgacaatcgagatgatgaaacaaaggcataaggtggagaaagaatcgaacattggggaagaagttgggtggtcaaagaacgtggaagttgcaaaggtgaatccaaagcttaaaggcatgaacaagaaattcgggatgattcatggattttcatccctcgctaatatcttgtcctttggcagcctagccatgcactcatggtacttggcaggtaaaatggatctgtaatttcaatctggtttcccgttatttgggatggtagtgttctggctatagattacatcaattgagagaggacctatgtgctttctctttgttataattactttgaaatcctcctggacaagttgtgtatggttgaacaatatgtttagtgagagaatcctttccctgtctttgaattataataatatgggtaccatgttaataa

SEQ ID NO: 5579 - DNA, 893 bp, Cucurbita pepo
gaagtacacctttctcggccatcttctcagtcttcaataccatttccttcttcttcttcttcttcttcttcgcacagctcgagatacagagagacagagatggcgtggttgaccagattcctagcggcggtggctttcctagcaattggagttgtattttcgccggagaccttcggatccaactccaaaacttttaatgcgccaaatctttctctgtatctcaaattggctcatcttctctgctactctaccgcttggggcgcctctctatgggttaccttcatcggcggcatcattatgttcaagaatctgccgaggcaccaatttggtaatcttcaaagtaagatgttccctgcctacttctcgatggttgggatttgctgtgccatatctgttgcagcttttggttatctacatccatggaagtctgcagcaacttctgaaaggtaccagcttgggtttctgatatcggcgtttgcttttaatttggccaacctgtttgtcttcactccaatgactattgagctgatgaaacaaagacacaaagtggagagggaaaataacattggcgaggaagttggatggacaaagaatgtagaagttgcgaaggtgaacccgaaacttgcagcgatgaacaagaaattcggtatgattcatggcttatcatcccttgctaatatcttagcatttggtagtcttgcaatgcactcctggtatttggcaggtaagattaatctgtaactcaagaatttaccttcccattttatgggaggaggagtaagtgtatgactgtatcttacttccactaaacaattgtcctactgctctttctcttgtagactgacattatcttgtctgtttggatggtttgatacagaaaaaggtggaaataa

SEQ ID NO: 5580 - DNA, 1074 bp, Tabernaemontana elegans
agcattaagcctctgttcaaggggttggtgagactcgagtcttgaggagaaatctctgtatctgatcaagcaagaggggagaagacctaaaactccgaatcctcagaacccgtgaaaaatcttgaagagagatgggctggacaagtagatttttgactgcggtggtattcttggctattggtgtcatcttctcccctgaaaccttcggatcaaaatccgatggacagcatcctgggaagctcctaacgttcctcaaacttgctcaccttctctgcttctccactgcctggggtgccgctctctgggtcaccttcatcggcggcatcatcatgttcaaaaatctcccgaggcatcaatttggtaatctgcagagcaagatgtttccggcctacttctccatggttggggtgtgttgcgcggtgtcagtggcatcctttgggtacttgcatccttggaagactgcctctactacccacaagtaccaattgggcttccttctggctgcatttgctttcagtatgagcaatcttttggtatttacgcccatgaccattgagatgatgaaacaaaggcataagatagaaagagaagcaaaaattggggaagaagttggctggaccaagaatcaggaagttgcaaaggtaaatccacagcttgctgccatgaacaggaaatttggcatgattcatggactgtcatctcttgccaatattatgtcttttggttgtcttgccatgcactcttggtatctagcgggtaaaattgatatctagcttaaactatacatcccagctgctacttggaaccatgctattattagttctttaagctggcttcatctgatacctaagttgctaagcttaaagttccgagttatgtaacatggaaacaacttgaatagcaagttcacaatttgcatatttgcggacattattctcaccaaactacaaaggccgtgggcagaaaaagcaaacatgtaatgttagcttatctgggttgggtgtgattttctgcaaatttgtaatgtttaaacatcactgtctctagaataaaaaccatctgatgtgaatttga

SEQ ID NO: 5581 - DNA, 994 bp, Citrullus lanatus
acgaaacaagaaccaataccttaccctctcacccatctgctcaattcttcttcaatttctatttccttctgcacgcaactcaactgaagagaccgagagagaaatggcgtggttgacccgattcctaacggcggtggtttttctcgccatcggagtagtattttcgccggagaccttcggatcgaactccaaaaccttcaatgcgccgaagctttcgatgtatctcaaattggctcatcttctcagctactccaccgcctggggcgccgctctctgggtcaccttcatcggcggcatcatcatgttcaagaatctgccaaggcaccaattcgggaatcttcaaagcaagatgttccctgcctacttctcaatggtagggatttgctgtgccacatccgttgcagcttttggttatcttcatccatggaagtctgcagcaacttctgagaggtaccagcttgggtttttgatatcggcgtttgcttttaatttggcaaacctgtttgtcttcacacccatgaccattgagctgatgaaacaaagacacaaagtggagagggaaagtaatattggcgaggaagttgggtggtcaaaaaatgtagaagttgcaaaggtgaatccaaaacttgcagcaatgaacaagaaattcgggatgattcatggcttgtcatctcttgctaatatcctagcatttggtagtcttgcaatgcactcctggtatttggcaggtaaaattaatctgtaactcaaaaattgtccttccctatgactgtagttttacgtccatgaagcaattgcctcggtgctctttctctgatagactgacatattattgttgtagtacaatacaattgcctgtttggatggtgataaagaaaaagtgggaaataaaagtgttgtattgatatcactgtttatgtttagtgtcagagaaatgttgtttgtttattgtcatgtgctgcaaagggattttgatctgtttatttatttctgc

SEQ ID NO: 5582 - DNA, 914 bp, Tragopogon dubius
gttaggtgaggtttacgataaattcaatcttttacatttcttgaaatcaatccgtttcacaaccttcagttcagtaagataatggcttggatgacacgattccttactgcggttgccttcttggcaatcggagtcatattttcgccggaaacgttcggatcaaaatcagcaaagatcacatctttcgtcaaacttgcgcacctcctatgtttctccaccgcctggggcgcagcgctttgggtcaccttcatcggcggcatcatcatgttcaagaatcttccgaggcaccagtttgggaatctgcaaagcaagatgtttccggcgtactttatgatggttgggatatgctgcgcggtgacggtgggttgtttcggttatacacatccatggaagtcttcatcaagtgcggagaagtatcagcttgggtttttggtttctgctttcgtcttcaatctcaccaatctttttgtgtttactcccatgaccattgagatgatgaagcaaaggcacaaggtggagagggagtcgagcattggagatgaagttgggtggacaaagaaccaggaggttgcaaaggtgaacccgaagctagcagcaatgaacaagaagtttgggatgattcatggattatcttctctagcaaacattatgtcttttggtagtctggcaatgcattcatggtatttagcggccaaaattgatctctagacacacccacccacccctttcctggcttttaataatctgccatttttcttcctgctgtgaagagggatagtaccaagtaccaaccatatattaatgttataaaaaagaactttatgttgtattgtagtgtcttcaactcacaaacaatctttgatgcctatatcactgaaaaaaggaataatcaggtctgttcattggattcatat

SEQ ID NO: 5583 - DNA, 772 bp, Camellia sinensis
cgggggagagagagagagagtcgacgatcggaaaagatgggtggatgagtcgattcatagcagcggtggctttcttggcaatcggagtcatattctcgccggagacatttggatcatcttcatcaaagctccccacctacctcaaactcgctcacctcctctgcttctccaccgcatggggcgctgctctctgggtcaccttcattggcggcatcatcatgttcaagaatcttccgaggcatcagttggaaatctcaaagcaagatgtttccggcgtatttcacgatggttggggcttgctgtgccatttcagcggcgtctttgggtatttacatccctggaaatcggcttctattgcagagaagtatcagctagggtttcttctctctgccttcgctttcaatctctccaatctctttgtctttacacccatgaccattgagatgatgaagcaaaggcacaaagtcgagagagaagagaacattggagaggaaattgggtggtcgaagaaccaagaagctgcaaaagtcaacccaaagcttaaagcaatgaacaagaaatttgggatgattcatgacttatcatctctgctaatatcatgtcattaggtagcctcgccatgcactcttggtacttagcaggtaaaatggatctttagatcgtgtcctatttccccgcactgggaaagtatgtattctcaccgtggtttcatgttttacttgtttacattccaagtcatgtatcaccaagcaacacattttgaataaacaag

SEQ ID NO: 5584 - DNA, 1046 bp, Mimulus guttatus
acaatccacaattcaacagcatcatcaatgttgaacttctggaagtagcacgagtaggtgaatacagaaaagtgaaaactcatttttattcaactcaataatcctgaaaaatctcaatcaaccaagaggtaaaaatatggcttgggtgacaagatttttaactgcggtggcgtttttggcaatcggtgtaattttctcgccggaaaccttcggatcgaaatcggacggccagaaatcaccgatgtttctcactgtgttgaaacttgcttacctcctctgcttctccaccgcctggggtgctgctctgtgggttaccttcatcggcggcatcatcatgttcaaaaatttgccgaggcatcaatttggaaacttgcaaagcaagatgtttccagcctacttctccatggtgggggtttgctgtgcagtggcagtagggtcgttcggttacttgcatccatggaaaacttcgggagctactgagaaataccagcttggattcctgcttgctgcctttgctttcaatctcagcaatcttgttatctttacgcctatgaccattgagatgatgaaacaacgacacaagatagagagagaagcaaatatcggggaagaagttgggtggacaaaaaacaaagaggaagcaaagaagaatccgaagctcgctgccatgaacaagaagtttggaatgattcacggattgtcttctcttgctaatatcttttcgttcggtagccttgctatccactcctggtatttagctggtaaaatcgacttttaaatgtaattcatatccttctttcgcccgaagatgatatgcttgtgtaataatatcaaaccgcccacgaatctgtccctcttacgttttcttcaaactccaatacaattgcttcacatacgaaattatgtacttgtggacaaaataataacaataaacacttttgatgtctgaaaccttttgcaccgtgtgtgtatgtaaggtataacaagattctcgagtattattaatttgtttaattaactgaattggataagcatgtattcttgtt

SEQ ID NO: 5585 - DNA, 1113 bp, Mimulus guttatus
acaatccacaattcaacagcatcatcaatgttgaacttctggaagtagcacgagtaggtgaatacagaaaagtgaaaactcatttttattcaactcaataatcctgaaaaatctcaatcaaccaagaggtaaaaatatggcttgggtgacaagatttttaactgcggtggcgtttttggcaatcggtgtaattttctcgccggaaaccttcggatcgaaatcggacggccagaaatcaccgatgtttctcactgtgttgaaacttgcttacctcctctgcttctccaccgcctggggtgctgctctgtgggttaccttcatcggcggcatcatcatgttcaaaaatttgccgaggcatcaatttggaaacttgcaaagcaagatgtttccagcctacttctccatggtgggggtttgctgtgcagtggcagtagggtcgttcggttacttgcatccatggaaaacttcgggagctactgagaaataccagcttggattcctgcttgctgcctttgctttcaatctcagcaatcttgttatctttacgcctatgaccattgagatgatgaaacaacgacacaagatagagagagaagcaaatatcggggaagaagttgggtggacaaaaaacaaagaggaagcaaagaagaatccgaagctcgctgccatgaacaagaagtttggaatgattcacggattgtcttctcttgctaatatcttttcgttcggtagccttgctatccactcctggtatttagctggtaaaatcgacttttaaatgtaattcatatccttctttcgcccgaagatgatatgcttgtgtaataatatcaaaccgcccacgaatctgtccctcttacgttttcttcaaactccaatacaattgcttcacatacgaaattatgtacttgtggacaaaataataacaataaacacttttgatgtctgaaaccttttgcaccgtgtgtgtatgtaaggtataacaagattctcgagtattattaatttgtttaattaactgaattggataagcatgtattcttgtttaatgtgtcgaattctggactttgctcttgtatctggagaatgaacaactagtctttatcagctcaa

SEQ ID NO: 5586 - DNA, 1229 bp, Fragaria vesca
gtgcagtggcgggacgactaactttcacgcttgtttacacgtggaccatcatcttccgtatgtgtcgcttgacccgacccggaggctcataaacccgaacaattggattagacgagtgtgaagtccacacctaccctcgcttaaagcttgaagagtctttgatcgactgctaagaatttgttgagaattttgagggatgggttggctgacaagatccctagcagctgtggctttcttggccatcggagttattttctcgccggagactttcggatcgaaatcggacggtccgaagtcgccggcactctccacctacctgaagctggctcatctgctcagcttcgccaccgcgttcggcgccgctctctgggtcaccttcatcggcggcatcatcatgttcaagaatctcccgaggcatcagttcggtaatctgcagagcaagatgtttccggcttatttcaccatggtggggatttgctgtgccatttcagtagcttcgttcgggtatttgcatccatggagctcttccactgtggcagacaagtaccagctcggctttttgatctcttccttggccttcaatctcaccaatttgttcgtcttcacacccatgactattgagatgatgaagcagaggcataagatagagaaggaacagaacattggggaagaagttggatggtccaagaatgtgcaagttgcaaaggtgaacccgaaactagcagccatgaataagaagttcgggatgattcacgggctatcttctctcgccaatattatggcctttggcagccttgccatgcacacatggtacttggcaggtaaacttgatctgtaattcatagacagaacccaagttccccttcatttggggatgggggaatgaaatgttctggtctcttgttgaactatggattctgtccgtcaaacaagggcctaatgtcttattctctgcttgaatgttatgtgtacaagactacacttttatcatgctcataatttcataagacttgatcatcggatgtatgacttctaaatgaagatgatttactcctgttgttcttcccttgcatgtctcattcaaaacaaagctttttctgcaatgaaaatcaatgaatgtataatattaagatttcagaggttgtgcttttctatttgcctaatgtctacaaaagactagatttcagtaattaatggattgaaggatggggaagtgtaattatttctag

SEQ ID NO: 5587 - DNA, 1099 bp, Vaccinium corymbosum
ctcccttacccttccccgttggtcgttcggtccgttcgggcgtacgttcctacgagagcgagtgtagcacggagggggcggtacggcggagggagtgtatacacgagagggcgctacgtacggcggggccgacggattagaagttgtagcagtcgtaagtagttccttcaacaaccccgtctccaagatctcttgttcgtgatttgaggcgtgcgtgagagagagaatcatcggagagagaaagatgggttggatgactagattcacaggagcggttgctttattggctgccggagtcatattttcgcctgagacgtttggatcaacatcatcagacgctctacaaaagctctccacctacctcaaactggctcatctcctctgcttctccacagccttcggcgctgccctatgggttactttcatcggcggcatcattatgttcaagaatctgccgaggcatcagttcgggaatctgcaaagcaagatgttcccggcctacttcgccatggttggtgtttgctgtgctatatgtgtcacgtgttttgggtatttacatccatggaaggcggcttccacttcagaaaaataccagcttggcttgcttctctccgcctttgttttcaacctcgctaatcttgtcgtctttacacccatgaccgttgagatgatgaagcagaggcacaaagtcgagagggaagaaaacattggagaggaagttgggtggtcaaagaatgttgaagttgcaaaagtaaacccaaagcttaaagccatgaacaagaaatttgggatgattcacggcttatcatctcttgctaatattatgtcctttggtagcctagccgtgcactcgtggtacttagcaggtaaaatgaatctgtagattgtgctaaattccctgcattgggaaaggatgggatggatcctcaacatggtttcatgtgttttaattgaatacatgctaagtcatgtatgaccaagcaaacatattgtgagtatgcaagatacttgtttattattactgagaaattgcacggctttgatagctactgtctggtaaagaagttatcctattgacatccatggggaatgaaataat

SEQ ID NO: 5588 - DNA, 821 bp, Artemisia annua
aaaaaaatcaaatcaatcatggggtggatgacaagattcttaaccgcaattgctttcttagcagtgggagtaatattttcaccagaaacattcggatcaaaatcagcaaagataacaacgtttgtaagacttgcacatctgttatgtttttcaaccgcttggggtgctgctctttgggtcactttcatcggtggtatcatcatgttcaagaatttgccgaggcatcagtttgggaatctgcagagtaagatgtttccagcgtattttatgatggttgggatatgctgtgcggtttcagttgggtgttttggatatacgcatccatggaagtcgtcagcaactgctgagaagtatcagctagggtttttggttgctgcgtttgtgtttaatctcactaatctgttcgtgtttactccaatgacgattgagatgatgaagcaaagacacaagattgagagggaatcaaacattggagaagaagttgggtggacaaagaaccaagaggttgcaaaggtgaacccaaagctagcatcaatgaacaagaagtttggaatgattcacggactatcgtctctagccaacatcatgtcttttggtagtctcgcaatgcattcatggtatcttgcaggaaaacttgatctctagacacatcatgtcatatggcttgtatgttgactttgacaataatgtatcagtttcctgcgttggataccatgtgttgatgttacaaaatgaagatttcagtgtcttttagtctgcacattactatgttaatcttgtaatcttcaatgttcataactatggtatatttgtctttggtg

SEQ ID NO: 5589 - DNA, 887 bp, Senecio madagascariensis
aagcagtggtatcaacgcagagtacgcggggaccataaattcaatcaaaatcaatttcacaaactcacacaactaaaatcaatcaactaatcatgggttggatgactagatttttaacggcgatcgcttttctggcaatcggagtcatattttcgccggaaacattcggatcaaaatcagcaaatatcacagctttcgtcaaacttgcacacttactatgcttttccaccgcttggggcgcagctctttgggtcaccttcatcggaggaatcattatgttcaagaatctgccgagacatcagtttgggaacctgcaaagtaagatgtttccggcgtattttatgatggttgggatatgttgtgcggtggctgtagggtgttttgggtatactcatccttggaagtcttcttcgactgccgagaagtatcagttagggtttttggtttctgccttcgtgtttaatctctcgaatctctttgtgtttactcccatgacaattgagatgatgaagcaaaggcacaagttagagagggaatcgaacattggagaagaagttgggtggaccaagaaccaggaggttgctaaggtgaacccgaagctagcagcaatgaacaagaagtttggtatgattcatggactatcgtctctagctaacatattctcttttggtagtcttgcaatgcattcatggtatttagcaggcaaacttaatctctagacgtatcctgttccatgtggcttgtatgttgacaatgacaaataatgtaccattttcctcgtgttgggtcttccatcgtggtcagtgatgtcggtcatatcgtaggtaatgctgtgaacaccctgtattgatgttataaaacaaagttttacaatgtgttttacctgt

SEQ ID NO: 5590 - DNA, 795 bp, Aquilegia formosa
cttccatcaatcgtcagagtacagagaaacagaaatggcttggcttactcgatttctgacagcagtagctttccttgcatttggaattctcttctctccagaatcctttggatccaaatcggacggttcatattcctctaagctttccatcacacttaagctttttcatctcttgagcttcgctactgcttggggtgctgctctttgggtcacttttattggtggaatcattatgttcaaaaatttaccaagacatcagtttgggaatcttcaaagcaaaatgtttccagcttatttctctatggtttctatatgttgtgctatatctgtggcttgttttggttatattcacccatggaagacttcttcagctactgagagatatcagttggggtttctgctttcagcttttgctttcaatctcaccaacttgtttgtcttcacaccaatgacaattgagatgatgaagcaaaggcataaaattgagagagaagagagcattggagaagaagttgggtggactaagaatagggaagttgcgaaaaagaacccaaagttagctgccatgaacaagaagtttgggatgattcatgggttatcttcactcgctaatattttctcctttggtagtcttgctttacactcgtggtatctagcaggtaagattgatctgtgattttgctttacattcatttgaatggggcgacccatggtgattgggtgtttggatgaatctttgtttcatcgtatacaacaacattgtgattgaaataaaattaatgaatagttatgttg

SEQ ID NO: 5591 - DNA, 1065 bp, Amsonia hubrichtii
aggaactttaccttcaactaccaccaaagcccaaaactcacaggcacttgggtcttcggacaaagcaccagtgcaattcattgaagctctggtcaagtggtaggtgaagtccgaggaaacctttgatcaagcaaaaaaaggagagaacccgaaacgccgaatcctcagaacctgtgaaaaatcttgaggagagatgggttggacgagtagattcttgactgcggtggcgttcctggccattggaatcatattttcacctgaaacattcggatcaaattcggatggccagcatcccgcgaagctcctaacgttcctcaaacttgctcaccttctctgcttttccacagcctggggcgccgcgctctgggtcaccttcatcgggggcatcatcatgttcaaaaatctaccgaggcatcaattcggtaatctgcagagcaagatgtttccggcctacttctcgatggtgggggtctgttgcgcagtgtcggtggcatcctttgggtacttgcatccttggaaaactgcctctactacccacaagtaccaactgggcttcctcctggccgcctttgctttcaatatgagtaatctattggtatttacgcccatgaccattgagatgatgaaacaaaggcacaagatagaaagagaagtaaaaattggggaggaagttgggtggaccaagaatcaggaagtcgcgaaggcaaatccgcagcttgctgccatgaacaagaaattcggcatgattcatggactatcatctcttgctaatattacgtcttttggttgtcttgccatgcactcttggtatctagcggctaaaattgaattctagtttgaaccatacatccttgttattactgggacttatgcttccagctattgttattactgggacttatgcttccagctattattattagtaaacatacatccttgttattactgggacttatgcttccagccattattagttcctgaaaaattcaacttttgtaagctgacttggtctgtgatgttctgccggcttaaagttcttcgttatgtaagacaggaatatcaaat

SEQ ID NO: 5592 - DNA, 795 bp, Aquilegia formosa
cttccatcaatcgtcagagtacagagaaacagaaatggcttggcttactcgatttctgacagcagtagctttccttgcatttggaattctcttctctccagaatcctttggatccaaatcggacggttcatattcctctaagctttccatcacacttaagctttttcatctcttgagcttcgctactgcttggggtgctgctctttgggtcacttttattggtggaatcattatgttcaaaaatttaccaagacatcagtttgggaatcttcaaagcaaaatgtttccagcttatttctctatggtttctatatgttgtgctatatctgtggcttgttttggttatattcacccatggaagacttcttcagctactgagagatatcagttggggtttctgctttcagcttttgctttcaatctcaccaacttgtttgtcttcacaccaatgacaattgagatgatgaagcaaaggcataaaattgagagagaagagagcattggagaagaagttgggtggactaagaatagggaagttgcgaaaaagaacccaaagttagctgccatgaacaagaagtttgggatgattcatgggttatcttcgctcgctaatattttctcctttggtagtcttgctttacactcgtggtatctagcaggtaagatcgatctgtgattttgctttacattcatttgaatggggcgacccatggtgattgggtgtttggatgaatctttgtttcatcgtatacaacaacattgtgattgaaataaaattaatgaatagttatgttg

SEQ ID NO: 5593 - DNA, 784 bp, Ocimum basilicum
gcacgcggtgttatcgagatttctgacggccgtggcgtttttggcgatcggcgttgtgttctcgccggaaacgttcggatcgaaatcggacggccagaattcccaggtgctggtctccgcgctgaaattggcgcacctcctctgcttctccaccgcctggggtgctgctctctgggttaccttcatcggcggtatcatcatgttcaagaatttgcctaggcatcaatttgggaatttacaaagcaagatgtttcctgcatacttttccatggtgggagtgtgctgtgctgtggctgtcgggtcttttggttacttgcacccatggaagacatcgggcccaactgagaaatatcagctcggcttcctgattgctgcatttgctttcaatctcagcaatcttgttatctttacgcccatgaccatcgagatgatgaaacaaaggcacaagatcgagagagaagctaatattggggaagaagttgggtggacaaagaaccaagaagtagcaaaaaaaaacccgaagcttgcggccatgaacaagaaatttgggatgattcatggattgtcttctctggcaaatatattctcattcggcagccttgccatgcactcgtggtatttagccagtaaaattgatctatagatcatattggctcagaacaatgtgtgtggctgtggctgtggctgtattttcttgtaacatcaaccattatacactttcctcgtggtgtagtttcaaagaaatagtgtattttcggactaaatatcgagaataatacttttc

SEQ ID NO: 5594 - DNA, 993 bp, Catharanthus roseus
ccagtccccttcaccaactaccactgctgctaagcattcaattgaaccgtgaatcttccattcaaatttggttggtgacaggaaaaaatatctgatcaatcaagaacctgtggaaaaatccttgagcggagatgggttggatgagtagattcttaactgcggttgcatttttggcgattggtgtcattttttcacctgagatattcggatcgaaaccggacggccagcatcctccgaagctactgacgttcctcaaacttgctcatctactatgcttctccactgcttggggtgccgctctttgggtcaccttcatcggcgggatcatcatgttcaaaaatctgccgagacatcaatttggtaatctgcagagcaagatgtttccggcatatttctcgatggttggggtgtgttgtgcagtgtcagtggcatcatttgggtacttgcatccatggaagactgcatctaccacccacaagtatcaaatgggcttccttctggctgcttttgctttcaatatgagtaatcttttgatattcactcccatgaccattgagatgatgaagcaaaggcacaaggtagaaagagacgcaaaaattggagacgaagttggatggaccaagaatcaagaagttgccaaggtaaatccacagcttgctgccatgaacaagaaattcggcatgattcatggactatcatctcttgccaatattatgtcttttggttgtcttgccatgcactcttggtacctagctggtaaaattgatttctagtttaagtactatatagcctttttactactaggaattgtatctccagctatttttattgataaaatacaagcagctatcccacattctaagctggtctgaattcgagagttatgtaatattgaaatcagaagaataaagagttacaccatttgcgtattgaaatcatgaaaatacaaaggtgtaaccttagcttttctggcctggacagtatccgattctt

SEQ ID NO: 5595 - DNA, 899 bp, Solanum tuberosum
ctcgaagtgtggtaggagtaggtaaaaccaaagccaagatccatttctgaccagaaacccacttccttcttcgtcttctcatcatatagcaaaaacaatttggatcatagaacagcaatcatgggttggatgacacgattcttatctgctgtagctttcttggcaattggagtacttttttctccagaaactttcggttcaaaatcagatggtcaacatcctccaaagctcgcaacttttctgaaattagctcatctcctctgcttttcaactgcttttggtgctgctctatgggtcactttcatcggtggtatcatcatgttcaagaatttgccaaggcatcagtttgggaatctgcagagtaaaatgtttcctgcttacttttccatggtgggggtatgttgtgctgtgtctgtgggttcttttgggtacttgcatccatggaagactgcctctgcttctgagaagtaccaacttgggttcattcttgctgcatttgctttcaacctcagcaatctctttgtctttactcctatgacaattcagatgatgaaggaaaggcataagatagagagggaggcgaacatcggggaagaagttggatggacgaagaaccaagaagtcgcaaaggtcaatccaaagctttcagcaatgaacaagaaatttgggatgattcatggcctatcttcccttgctaacatcttctccttcggttgcctcgcaatgcattcctggtacctggcaggaaaattggatctctagattgtttagagattctaaattgctctataaattgtattagtctgtctgctactttctagtttttaccattgctctaatggcttgtgtattgtgttaaaatgtaacttgacaccaagtaagaataaaaatacacacgt

SEQ ID NO: 5596 - DNA, 969 bp, Solanum lycopersicum
aattaaaagaaataagtatttatttatagagtgaaaccacatagtaggaggaactggaaatagcagtttcgaagcttctcgaagtgtggtagaagtaggtaaaaccaaaggcaagatccatttctgacctgaaacccacttccttcttcgtcttctcatcatatagcgaaaacaatttcgatcaaagaagagcaatcatgggttggatgacacggttcttatctgctgtagctttcttggcaattggagtacttttttctccagaaacttttggttcaaaatcagatggtcaacatcctccaaagctcgcaacttttctgaaattagctcatctcctctgcttttccactgcttttggtgctgctctatgggtcactttcatcggtggtatcatcatgttcaagaatttgccaaggcatcagtttgggaatctgcaaagtaaaatgtttcctgcatacttttccatggtgggggtatgttgtgctgtgtctgtgggttcttttgggtacttgcatccatggaagactgcctccgcttctgagaagtaccaacttgggttcattcttgctgcatttgctttcaacctcagcaatctctttgtctttactcctatgaccattcagatgatgaaggaaaggcataagatagagagggaggcgaacatcggggaggaagttggatggacgaagaaccaagaagtcgcaaaggttaatccaaagctttcagcaatgaacaagaaattcgggatgattcatggcctatcttcccttgctaacatcttctccttcggttgcctcgctatgcattcctggtacctggctggaaaattggatctataaattgtattaatccttctgctactttctagtttggcatttagtttctaccatggcttgtgtattgtgttaaaatgtaacttgacaccacctaagtaagaataaaaatacacacgttaccaagttgctcaaa

SEQ ID NO: 5597 - DNA, 921 bp, Triphysaria pusilla
cacagcgacgtctagaagcagagaagtaggtgaacaagtcgataaattcagctcactccttttgaattacagttcaattctatagtcctaatcaaccagcagacagtaaaaaaagatggcttggctgacaagatttttgaccgcagtggcgtttttggcgatcggtgtaattttctcgccggaaacattcggttctaaatcggacggagagaattcgccggtgctcgtcactggattgaaattggctcacctgctatgcttctccaccgcctggggcgctgccttgtgggtgaccttcatcggaggcatcatcatgttcaaaaatttgccgaggcatcaatttgggaacttgcaaagcaagatgttcccagcatatttctccatggtgggtgtatgctgtgcagtttcagtcgggtcatttggatacttgcacccttggaagacatcaacagctaccgagaagtaccagcttgggtttctgctagctgcctttactttcaatctcagcaatctggttatctttacgcccatgacaattgagatgatgaaacaaaggcacaagatagagagagaagcaaatattggggaagaagttgggtggaccaaaaacaaagaggctgctaagaaaaatccaaagcttgcttcgatgaacaagaaattcgggatgattcatggattgtcgtctcttgctaatatctttgcatttggtagccttgccatgcattcttggtatttagctggaaaactaaatctatagatctaatatttatcctttctactgcggataatatgtttggatgtatttatgtgttaacatcaaatgtcgtccattgcggttaatcccaaacaggattatgtatttctgaacaaatgttgagaataatcacttttccattgctttgaacagcttggttttgtgca

SEQ ID NO: 5598 - DNA, 791 bp, Vinca minor
gggttgggcaagtagattcttaaccgcagttgcgttcttggctattggcgtaattttttcacctgaaacattcggatcaaaacccgacggcggccagcatcctccaaagctcctaactttcctcaaattagctcatcttctttgcttctccacggcctggggtgccgctctttgggtcaccttcatcggcggcatcatcatgttcaaaaatcttccgaggcaccaatttgggaatctgcagagcaagatgtttccggcatatttctcgatggtgggtgtgtgttgtgcggtgtcagtggcatcctttgggtacttgcatccatggaagactgcaactactactcacaagtaccaactaggatttcttctggctgcctttgctttcaatatgagcaatcttttggtattcactcccatgaccattgagatgatgaagcaaaggcacaaggtagaaagagacgctaaaatcggggaagaagttgggtggaccaagaatcaggaagttgctaaggtaaacccacagcttgctgccatgaacaagaaattcggcatgattcatggactatcatctcttgctaatattttttcttttggttgtcttgccatgcactcttggtatctagcgggtaaaattaatttctaggttaaaccaatatatttgttactaaaagaaatattgtactttcagctgttattcgctccttaaaatttaagaatcacgttgtaagctggcttcatcagtgcccattctgctgggttgaagttccggagatatgtaagatggaaataat

SEQ ID NO: 5599 - DNA, 1042 bp, Nicotiana benthamiana
tagttaagaagcttctggaagtgaagtaggtaaggccaaagctaagaaccccttttaaatcagaacccagaaaaagcacttctcctgatattctgatcgtccggcaacagtaatttcgatcgaagtacagaaaccatggcttggatgacacgattcttagctgctgtagcgttcttggcaattggagtactcttttctccagaaactttcggatcaaaatcagagggtcaacatcctccaaagctcgtaactttgctgaaattggctcatcttctctgcttctccactgcctttggtgctgctctttgggtcactttcatcggtggtatcatcatgttcaagaatttgccaaggcatcagtttgggaatctgcagagtaaaatgtttccagcctacttttccatggtgggggtgtgttgtgctgtatccgtaggttcttttgggtacttgcatccttggaaggctgcctctgcagctgagaagtatcaacttgggttcattcttgctgcgtttgctttcaacctcagcaatctctttgtctttacccctatgaccattcagatgatgaagcaaaggcataagatagagagagaggccaatatcggggaagaagtcggatggaccaagaaccaggaagttgcaaaggctaatccaaagcttgcagcaatgaacaagaaatttgggatgattcatggactatcttcccttgctaacattttctccttcggttgcctcgccatgcattcctggtatttggcgggaaaactgaatctgtagtgtttagataagtctgctgttagagacaccagaatatcttaaagatttatatgccagctattttgaatcattactccaacggcttctgtattgtgttaagatgtaacttgacaccaaagtgggaataaagatatacaggttataggcttgaaatctttgtcctagttagcgcaaattgatttgcatttcaagtaaatgtaaatttgtcaaaatggctttagtagtaatgtataagcttttagtagaagctgcccaaattgtgtac

SEQ ID NO: 5600 - DNA, 1161 bp, Sesamum indicum
ctctggtttcatattccataatccacacattgaacttctggaagcagcagcactggtaggtaggtaaatacagaaacttcatcttccttcaccggtcaataaacgctttgcacagctatatatcaaagttcagtcctgaattcgggatctatcaagaattgaaagatggcttggatgacaagatttttgaccgcggtggcatttttagcagtcggggtcattttctcgccggaaaccttcggatcaaaatcggacggctataactcaccgctgctcatcactttactgaagttggctcacctcctctgcttctccaccgcctggggcgctgctttatgggttaccttcattggcggcatcatcatgttcaaaaatttgccgaggcatcaatttgggaatttgcagagcaagatgtttccagcatacttttccatggtgggggtttgctgtgcaattgcagtaggggcattcggctacttgcacccatggaagacttcaggagctgccgaaaagtaccagcttgggttcctggtcactgcctttgctttcaatctgagcaatcttattatttttactcccatgaccatcgagatgatgaaacaaaggcacaagatagagagagaagcaaatattggggaagaagttgggtggaccaagaaccaagaagttgccaagaagaatccgaagcttgctgccatgaacaagaaattcggaatgattcatggattgtcttctcttgctaatatcctgtcattcggtagccttgccatccactcctggtatttagctggtaaaatcaatttatagatataaggcatatccttttctctgaggatgatgtgtttggccgtagctatgtgtaatatcaaacatcaaacttgctccttttacctttacttcaaggtccattctgattgcttcccaagcaagaatttgtatctctggacaaaatcttgaaaataatactttttccatctctagcttgggaactgctttgacgactatacatgtgtcacactatgtgataggacttgatatttttcctttttacttttatcacgatgaagttctccatattgttgactacagcaaacttgtaataaatctcactggtatttattgaatcttaacgagtgtaatagagaattattttcaagattt

SEQ ID NO: 5601 - DNA, 873 bp, Solanum melongena
aaacccacttccttcttcatcttctcatcatcgggcgaaaacaattttgatcaaagaacagaagacatgggttggatgacacgattcttagctgctgtagcgttcttggcaattggagtacttttttctccagaaactttcggatcaaaatcagatggtcaacatcctccaaagctcgcaacttttctgaaattggctcatctcctctgtttttccactgcctttggtgctgctctttgggtcactttcatcggtggtatcatcatgttcaagaatttgcctagacatcagtttggaaatttgcagagtaaaatgtttcctgcctatttttccatggtgggggtatgttgtgctgtgtccgtgggttcttttgggtatttgcatccttggaaggctgcctcctctgctgagaagtaccaacttgggttcattcttgctgcatttgctttcaacctcagcaatctatttgtctttactcctatgaccattcagatgatgaagcaacggcataagatagaaagagaggcgaacattggggaggaagttggatggacaaagaaccaagaagtcgcaaaggtcaatccgaagcttgcagcaatgaacaagagatttggggtgattcatggcctgtcttcccttgctaacattttctccttcggttgccttgcaatgcattcctggtacctggcaggaaagttggatctctaagttgtttagatatatgtctgctctcaaaagatgctaaaattgctttaatgaattgtattcgtttctctgctactgtgaaccattacagtaatggtttctgaattgtgttaaatgtaaacttgacaacaagtaggaataaaaatacacacgttaccagctcttcac

SEQ ID NO: 5602 - DNA, 1065 bp, Lippia dulcis
tattcagcaatccagatttgaatggtgggctttctatagactagaaggagtagaggtacgagagtaatttccaatcagtagtgagcagctgcagattatacacttcatttttaccagaattctgaatcagtcaaccggttaaagatggcgtggctgactaggtttctcacggcggtggcatttttggcgatcggcgtagttttctcgccggaaaccttcggatctaaatcggacggccagcactcgcagttgctcctctcctcgctgaaattggcgcacctgctctgcttctccaccgcctggggggccgctctctgggttaccttcattggcggcatcatcatgttcaagaatctgcctaggcatcagtttgggaacttacagagtaagatgtttccagcatacttttctatggtgggagtgtgctgtgcagtagcagtagggtcttttggatacttgcacccatggaagacgtcagggtcgactgagaaataccagctcgggttcctgcttgctgcctttgctttcaatctaagcaatcttgttatctttacgcccatgaccatcgagatgatgaaacaaaggcacaagatcgagagagaagtaaatattggtgaggaagttgggtggacgaagaaccaagaagttgcgaagaaaaatccgaagcttgctgcgatgaacaagaaattcgggatgattcatggattgtcttctcttgctaatatcttcgcatttggtagccttggcctccactcatggtatttagctggtaaactcaatctgtaactctgctgcatatcattttcactgagaaaattatgcttggctatatttacatgtaacatcaaacataaaatctgcccattatatctttttccaaagaaaaacagtagtatgtatttcaggacttacctttgtaataatacatttccattctcttgattgggaagttggaactgctatttatgggcatgcttgtgaacactgttttggagctgccccattggttgtactggcatctgtaatggccaacattatagagaggagatattgattaaaaaagaa

SEQ ID NO: 5603 - DNA, 941 bp, Solanum phureja
tttatagactgaaaccacatagtaggaggaactggaacagaagtttcgaagcttctcgaagtgtggtaggagtaggtaaaaccaaagccaagatccaccatttctgaccagaaacccacttccttcttcgtcttctcatcatatagcaaaaacaatttcgatcaaagaacagcaaccatgggttggatgacacgattcttatctgctgtagctttcttggcaattggagtacttttttctccagaaactttcggttcaaaatcagatggtcaacatcctccaaagctcgcaacttttctgaaattagctcatctcctctgctattcaactgcttttggtgctgctctatgggtcactttcatcggtggtatcatcatgttcaagaatttgccaaggcatcagtttgggaatctgcagagtaaaatgttccctgcttacttttccatggtgggggtatgttgtgctgtgtctgtgggttcttttgggtacttgcatccatggaagactgcctctgcttctgagaagtaccaacttgggttcattcttgctgcatttgctttcaacctcagcaatctctttgtctttactcctatgacaattcagatgatgaaggaaaggcataagatagagagggaggcgaacatcggggaagaagttggatggacgaagaaccaagaagtcgcaaaggtcaatccaaagctttcagcaatgaacaagaaatttgggatgattcatggcctatcttcccttgctaacatcttctccttcggttgcctcgcagtgcattcctggtacctggcaggaaaattggatctataaattgtattagtctgtctgctactttctagtttttaccattcctctaatggcttgtgtattgtgttaaaatgtaacttgacaccaagtaagaataaaaatacacacgttaccaagttactcaa

SEQ ID NO: 5604 - DNA, 1246 bp, Fagopyrum esculentum
taccaacccaattcaattctcatttctcacaatctccgcctctaattccaaaccctcacaactatatagttgcgacttgcgattgcgagtcaacaatcaccaacccaatctcgattctccttacctccaaaccctaacattctatcagacatagaagagatccaatgggttggctaagccgattcgtagtggccgtggcgttcctagccatcggagtaatcttctcgccggaatcctttggctctagctctggcgtcggttcctccccttacttgaagctcgtccacctcctatgtttctccaccgctttcggcgctgccctctgggtcaccttcatcggtggaatcatcatgtttaagaatctgccgaggcaccaatttgggaatctgcagagcaagatgttcccggcgtacttcacactagttggggtttgttgcgcagcagcggttgcggctttcggttaccttcatccatggaagtcgtgctctcagaccgagaagtatcaattagggttcctggctggttccttcctctttaatctttccaatctgttcattttcacccccatgaccatccagatgatgaagaagaggcacaaggtggagcgggaacagaacattggagaagaagtagggtggtcgaagaacagagaagcagctaaggtgaacccagagcttgcaggcatgaacaagaagttcggaatgatccatggtttgtcttctctggctaacatactctcctttggttgtcttgcgatgcactcctggtacttggccggtaagctcgacctatgatgagctccatcatacctctagatgattgttactcaataatgctgaatcaaacgttcatagcactctgttatgtataattaattatatacccaaagatgatctgtcagtttgcaaagcctcagtttatgtttatgtaacctgtcttccaccgtgttgagcaacaacaagctcctgcaagttgtggagtagacatcaaggcagcttcaggtgcgaagagcttgatacatataaatgatataagggatcaacaactactctgagtctgactcatccgcgttgccttttgctctaggcgatcaaagtgcttcggatgacaatgtgcttttgtacgcagtccatctacggacaaccccttcttatcattcacctacagatccctctattcttcgatttctaattgtcttctttatgctagctttgatacaatgaattatataacctttagtgtttgc

SEQ ID NO: 5605 - DNA, 870 bp, Vinca minor
ctctcatcatcaagtattaggtgagtcgtgcaagaacccagaaaacctccgaatcctcagaaactttgatcccaaaaaatgggttggacgagtagattcttaaccgcagttgcattcttggctattggtgtcattttttcacctgaaacattcggatcaaaacccgacggcggcggccagcatcctccgaagctccttacgttcctcaaactagctcatcttctctgcttctcgacggcttggggtgccgctctttgggtcacctttatcggtggcatcatcatgttcaaaaatcttccgaggcatcaatttggaaatctgcagagcaaaatgtttccggcctatttctcaatggtgggggtgtgttgtgcggtgtcggtggcatcctttggatacttgcatccatggaagactgcatctattacccacaagtaccagctcggatttcttttggctgcatttgctttcaatttgagcaatcttttggtgttcacccccatgaccattgagatgatgaagcaaaggcacaaggtagaaagagatgctaaaatcggggatgaagttgggtggaccaagaatcaggaagctgctaaggtaaacccacagcttgcagcaatgaacaagaaattcggcatgattcatggactatcatctcttgctaatattacgtcttttggttgtcttgccatgcactcttggtatctagcaggtaaaattaatttctaggttaaatcctagatacgtgttactaaaaggaattgtactttcagctattattagttccttaaaaattcaagaatcgcactgtaagctggcttcatcagtgcctattctgctgggttgaaattccgatttatgtaagatggaaat

SEQ ID NO: 5606 - DNA, 720 bp, Flaveria ramosissima
acttcacaatcatggcttggatgacaagatttctcactgcaatcaccttcttagcaatcggagtaatcttctcaccggaatccttcggatcgaagtccgcaaagatcacaactttcgtcaaactcacacaccttctatgtttctccaccgcatggggcgcagcgctttgggtcaccttcatcggtggcatcatcatgttcaagaatttgcctaggcatcagtttgggaatctgcaaagtaagatgtttccggcgtattttacgatggttggtgtgtgttgtgcggtgtcggtggggtgttttgggtatacgcatccgtggaagtcttcgtctactggtgagaagtatcaattagggtttttggttgctgcttttgtattcaatctcgccaatcttttggtattcacccccatgacaattgagatgatgaagcaaaggcacaaggtggagagggagttgaacataggcgaagaaactgggtggacaagaaccaggaggttgcgaggtaagcccaaagctagcagcaatgaacaagaagtttggtatgattcatggactatcttctctagccaacataatgtcttttggtagtcttgcaatgcattcatggtacttagctggcaaaattgatctctagattcatcctgttgcatatggcttgtatgttgacaataacagtaatgtactgttttcctcttgtagtaaaagaatacttaagctt

SEQ ID NO: 5607 - DNA, 790 bp, Guizotia abyssinica
aggttttcaataaattcagtcttcatcatctttgcatttcttcaaaattccagtttacaaacttcacatcatggcttggatgagaagatttctgaccgcgatcgccttcctggcaaacggagtaatattttcaccggaaacgttcggatcgaagtcggcaaagatcacaaccttcgtcaaacttgcgcaccttctatgtttctccaccacctggggcgcagcgctttgggttaccttcatcggcggtatcataagggtcaagaatctgccgagacatcagtgtggaaatctgcaaagcaagatgtttccggcgtactttatgatggtcggtatatgttgtgcggtgtcagttgggtgttttgggtacacacatccatggaagtcttcatcctctgctgagaagtatcagctagggtttttggtcgctgctttcgtcttcaatctcaccaatctatttgtgtttacgcccatgaccattgagatgatgaagcaaaggcacaaggtggagagggagtcaaacataggtgaagaagttgatggacaaagaaccaggaggttgcaaaggtaaacccaaagctagcagcaatgaacaaaaagtttggaatgattcatgggctatcttctcttgccaacataatgtcttttggtagtctcgcaatgcattcctggtacttggctggcaaaattgatctctagatccatcctgtttcatatggcttgtatgttcacagtgaccgtaatgtaccattttcccctatgtaaaaggatgctcagacttaacctttaaata

SEQ ID NO: 5608 - DNA, 945 bp, Capsicum annuum
acttggcctacttttacaccgggagaagtcatagttagtaagtgaagcttctggaagtgtagtaggtagggcaaagctacgaacgtcctcaatctcacccccaaaattcagaccaatatcctgtgacggaagaagagaaaagcatggcttggatgacacgattcttaggtgcagtagcgttcttagcaattggagtgctattttctccagaaacattcggatcaaaatcagacggtcaacatcctcctaagctcgccacttttctcaaattggctcatatcctatgcttttctactgcctttggtgctgctctatgggtcactttcatcggcggtatcatcatgttcaagaatttgccaagacatcagtttgggaatctgcagagtaaaatgtttcctgcctacttttccatggtgggggtatgttgtgctgtgtcagtgggttcttttgggtacttgcatccttggaagtctgcgtctgcttctgagaagtaccaacttgggttcattctagctgcatttgctttcaacctcagcaatctctttatctttactcctatgaccattcagatgatgaagcaaaggcataagatagaaagagaggccaacattggggaggaagttggatggacgaagaaccaggaagttgcaaaggttaatccaaagcttgcagcgatgaacaagaaatttgggatgattcatggcctatcttcccttgctaacattttctccttcggttgcctcgcaatgcattcctggtacctggcaggaaaattggatctgtaagttatttttagagaatgcctcctgtcagagatgctaaaattgcttaatgaattgtaatgtctgctactttgaaccattactctattggcttctgttttgtgttaaatgtaactcgacaacaagaaggaataaaatatacacgttagccgcttgaagtgtt

SEQ ID NO: 5609 - DNA, 1089 bp, Fraxinus spp
agtaacattcaaagcattggtacaatttcaaccagttactggtcagaaatccaactactatatattctttaggactgaaccctaaatttactagagagattgaattaggaaaaaatcagagaatgggttggatgagtagatttttagcggcagcgacattcttggcaatcggtgtgatttttttgccggagaaattgggatcggaatctgaggatcagcattctccgaaactcatcactctattgaagttggctcacttgctctgcttctccaccgcgtggggcgccgctctctgggtcaccttcatcggaggcattatcatgttcaagaatttgccaaggcatcaatttgggaatttgcagagcaagatgtttccggcatacttttcaatggtgggagtttgttgtgcagtggctgttgcatcttttggatacctgcatccgtggaagtcttcaacagctgctgagaaataccagctcggcttcctcatggctgcctttgctttcaatctctgcaatcttgtagtctttacacccatgacgatcgagatgatgaaacaaaggcacaagatagaaaaggaagcaaatattggggaagaagttgggtcgacaaagaaccaagaagttgcgaaaaaaaatccaaagcttgctgccatgaacaagaaatttggaatgattcacggactatcatctctttctaatatcatgtcattcggtagccttgccatgcattcttggtatttagcaggtaaaatcgatctgtagatcggatcaaatataccatttctctcgggtggacgtttctggctgtgattacgtgtcgaaatgaatacggactctgaatccgttaggtttcttggacgtacaagttacgtatgaaagaacaagatatgttagaataaaaagtcgctattttcaatttgcccttttatattgggaagacgtattaggctgccgctacgagtcaaaatggatatcgactctgaatcctttagctttctttgatgccgattgtgcttgcttccacaagttacgtattgatatagacattgatcttgtggaggtattgtgtaataatattcaattaaaa

SEQ ID NO: 5610 - DNA, 680 bp, Actinidia deliciosa
  misc_feature (389)..(389): n is a, c, g, or t
ctgcgaccctccgtctcaaagaatcacagaggtagagagagagagagattcatcaatcggaaaagatggggtggatgagtcgattcatagcggcggtgactttcttggcaatcggagtcatattctcgccggagacatttggatcaacatcatcggacggtcaacaaccgccgaagctccccacctacctcaaattggctcatcttctctgcttctccacagcctttggcgctgctctttgggtcaccttcatcggcggcatcatcatgttcaagaatcttccgaggcatcagtttggaaatctgcagagcaagatgtttccggcgtacttcgcgatggttggggcttgctgtgcaataacggtggcgtgttttgggtatttacatccntggaagtcggcttccactgcagagaagtaccagctagggtttcttctctctgccttcgctttcaacctcaccaatctttttgtgtttacgcccatgaccattgagatgatgaagcagaggcacaaaatcgagagagaggagaaaattggagaggagattgggtggtcaaagaatgtggaagttgcaaaagtaaacccaaagcttgcagccatgaacaagaaattcgggatgattcatggcttatcatctcttgctaatatcatgtcttttggtagccttgccatacattca

SEQ ID NO: 5611 - DNA, 1121 bp, Cucumis melo
tcttcttctcgcccatcggctcagttcttcttcaatttcaatttccttctatacacaaatcgactgaagagaccgagagagaaatggcgtggttgacccggttcctaacggcggtggtttttctcgccatgggagtagtattttcgccggagaccttcggatccaactccaaaaccttcaatgcgcccaagctttccatgtatctcaaattagctcatcttctcagctactccaccgcttggggcgcctctctatgggtcaccttcatcggcggcatcatcatgttcaagaatctgccgaggcaccaatttggtaatcttcaaagcaagatgttccctgcctacttctcgatggttgggatttgctgtgccacatccgttgcagcttttgcctatcttcatccatggaagtctgcagaaacttctgagaggtaccagcttgggtttttgatatcggcgtttgcttttaatttggccaacctgtttgtcttcacacctatgacaattgagctgatgaaacaaagacacaaagtggagagggaaagtaacattggcgaggaagttggatggtccaaaaatgtagaagttgcaaaagtgaacccaaagcttgcagcaatgaacaagaaatttgggatgattcatggcttgtcttctcttgctaatatcctagcatttggtagtcttgcaatgcactcctggtatctggcaggtaaacttaatctgtaactcaaaatgttctccttccccttttaagtgtatgactgtagttttacatccattaagcaattgctcaagtgctctttctctgctagactaaacatatatcgttggatggtttgatgaagaaaaaagtgggaaataaaggtgttgtattgatatcactgtccacgcttggtgtctgtcagaggaatgttgctcgttttttgttcagtgctgcaaagggatgttgttatatttctactagttcgagctatactaagtttctatactatgtgaaatccttttatttaggaatcaaataagtaaagaggaagatgactacatagaccaccaccaatcatatctaagattttcatttttcattttgacattttccatgtttttaaatttttcttgcttgct

SEQ ID NO: 5612 - DNA, 905 bp, Olea europaea
gcatccacagaattgaatcgaaagtcctgctcgaagatggggtggatgactagatttctaacggcagcggcatttttggcagttggagccgtattttcgccggaaacctttggatcaaaatcaatcggcctgcattcgccgatgctcatcactctcttgaagctggcccacctcctctgcttctccaccgcctttggcgccgccctctgggtgacctttgttggcggcatcatcatgttcaagaatttaccgaggcatcagtttgggaatttgcaaagcaagatgtttccagcttacttctcaatggtgggggtatgctgtgcagtgtcgatgggtgcttttgggtacctgcatccatggaagacttcaaccactgctgagaagtaccagattggattcctgctcgctgcctttgctttcaatctcactaatctctttgtctttaccccgatgaccatagagatgatgaagcaaaggcacaagatagagagagaagcaagtatcggggacgaaattggatggacgaagaaccaagaagttgcaaagaaaaatccaaaacttgcatccatgaacaagaagtttggaatgattcatggactatcttctcttgctaatatcatatcatttggtagccttgctgtgcattcttggtatttagcaggtaaaatcgacttgtagatctcattatgtattatccctgtatctggagacggtgcatttggctaaaagaaagtgactgatactaatagatgataatccatcttgttttcacacattttaattctgattgttcttattaaagcaagagagcaagcaatgtatattgccagaacaactaaagatgtacttctgctatttgaacttggacacataccaatagttgatagaaaaaatcagcttgagac

SEQ ID NO: 5613 - DNA, 984 bp, Olea europaea
aggtgtactattctccttttcaaccagccgtgcatccacagaattgaatcgaaagtcctgctcgaagatggggtggatgactagatttctaacggcagcggcatttttggcagttggagccgtattttcgccggaaacctttggatcaaaatcaatcggcctgcattcgccgatgctcatcactctcttgaagctggcccacctcctctgcttctccaccgcctttggcgccgccctctgggtgacctttgttggcggcatcatcatgttcaagaatttaccgaggcatcagttcgggaatttgcaaagcaagatgtttccagcttacttctcaatggtgggggtatgctgtgcagtgtcgatgggtgcttttgggtacctgcatccatggaagacttcaaccactgctgagaagtaccagattggattcctgctcgctgcctttgctttcaatctcactaatctctttgtctttaccccgatgaccatagagatgatgaagcaaaggcacaagatagagagagaagcaagtatcggggacgaaattggatggacgaagaaccaagaagttgcaaagaaaaatccaaaacttgcatccatgaacaagaagtttggaatgattcatggactatcttctcttgctaatatcatatcatttggtagccttgctgtgcattcttggtatttagcaggtaaaatcgacttgtagatctcattatgtattatccctgtatctggagacggtgcatttggctaaaagaaagtgactgatactaatagatgataatccatcttgtttttcacacattctaattctgattgttcttattaaagcaagagagcaagcaatatatattgccagaacaactaaagatgtacttctgctatttgaacttggacacataccaatagttgatagaaaaaatcagcttgagacatggagatgtgtcattgtatgaccctcaggtttgtttcataggttaa

SEQ ID NO: 5614 - DNA, 940 bp, Capsicum annuum
acttggcctacttttacaccgggagaagtcatagttagtaagtgaagcttctggaagtgtagtaggtagggcaaagctacgaacgtcctcaatctcacccccaaaattcagaccaatatcctgtgacggaagaagagaaaagcatggcttggatgacacgattcttaggtgcagtagcgttcttagcaattggagtgctattttctccagaaacattcggatcaaaatcagacggtcaacatcctcctaagctcgccacttttctcaaattggctcatatcctatgcttttctactgcctttggtgctgctctatgggtcactttcatcggcggtatcatcatgttcaagaatttgccaagacatcagtttgggaatctgcagagtaaaatgtttcctgcctacttttccatggtgggggtatgttgtgctgtgtcagtgggttcttttgggtacttgcatccttggaagtctgcgtctgcttctgagaagtaccaacttgggttcattctagctgcatttgctttcaacctcagcaatctctttatctttactcctatgaccattcagatgatgaagcaaaggcataagatagaaagagaggccaacattggggaggaagttggatggacgaagaaccaggaagttgcaaaggttaatccaaagcttgcagcgatgaacaagaaatttgggatgattcatggcctatcttcccttgctaacattttctccttcggttgcctcgcaatgcattcctggtacctggcaggaaaattggatctgtaagttatttttagagaatgcctcctgtcagagatgctaaaattgcttaatgaattgtaatgtctgctactttgaaccattactctattggcttctgttttgtgttaaatgtaactcgacaacaagaaggaataaaatatacacgttagccgcttgaa

SEQ ID NO: 5615 - DNA, 978 bp, Petunia hybrida
taaggaatcttctggaacttggagctttggtaggtaaagctaaagccaagaatcaaaatattaactcacttttgacccaaaaaaccaatttcgttttacatcttgtcaacaattttggatcaaaagaagagaaccaaatatgggttggatgacaagattcttagcagcagtagccttcttagcaattggagtacttttttctcctgaaacttttggatcaaaaacagatggtcaaccacatgctccaaagctcttaactttattaaaattggctcatctattatgcttctccactgcttttggtgctgctctctgggtcactttcattggtggtatcatcatgttcaagaatttgccaaggcatcagtttggcaatctgcagagtaagatgtttccagcctacttttccatggtgggagtatgttgtgctgtgtccgtgggttcatttggatacctgcatccttggaaggcttcctctgctgctgaaaagtaccaacttgggttcattcttgctgcatttgctttcaacctcagcaatctctttgtctttacccccatgaccattcagatgatgaaggaaagacacaagatagagagagaggccaacataggggaagaagttggatggaccaagaaccaagaggttgcaaaggttaacccaaagcttaaagcaatgaacaagaaatttgggatgatacatgggctatcttcccttgctaacattttctcattcggttgccttgctatgcattcctggtatctggctgggaaattggatctgtagattctttaggcatgtctgtggttagaaatactaaaattgcttaaattgtatgcgttctattttgaccattactcttatggcttctttattgtgttaaatgtaacttgacactagtgggaacaaaaataagcaggttatcgcttgaagtcctaatccagaaagtttgtttctggagttaccaaaaaaaaaaaacg

SEQ ID NO: 5616 - DNA, 822 bp, Antirrhinum majus
cggcacgaggtcgaagcagttggtagatagaggagaaaattcagttctcacctttatattgattgaagttcagtcctcaatttctgaattcatcgaagatggcgtggatgacgagatttttaacggcggtaacgtttttggcagtcggtgtaatattctcgccggaaactttcggatcaaaatcggacggtgagaaatcgccggtactcatcactggcttgaaattggcccaccttctatgcttctccaccgcctggggtgccgctctatgggtcactttcatcggagggatcatcatgttcaagaatttgccgaggcatcagtttggtaacctgcagagcaagatgtttccggcctacttttcgatggtgggggtgtgttgtgcggtggcggtaggggcgtttgggtacttgcacccatggaagactgcaggagctactgagaagtatcagctaggtttcctgctcgcggcctttgctttcaatctcagcaatcttgttatctttacgcccatgacaatcgagatgatgaaacaaaggcacaagatagagagagaggcaaattggggaagaagttgggtggaccaaaaacaaagaagtcgcaaagaaaaacccaaagctggccactatgaacaagaagtttggaatgattcatggattatcttctcttgctaatatcatgtcgtttggcagtcttgccattcactcttggtacttagctggtaaactcaatctatagatgtaattgcatatccttgtcactgaggtggctgtagttatgcgttaatatcaaacgtcaaacctgctttttgccttttacttt

SEQ ID NO: 5617 - DNA, 815 bp, Nicotiana benthamiana
aagaccaaagctaagaaccccctttttcagaacccagaaaactcacttctcctgatattatgatcgtcctgcaacagtaattttgatcgaattacagaaaccatggcttggatgacacgattcttatctgctgtagcgttcttggcagttggagtactcttttctccagaaacttttggatcaaaatcagagggtcaacatcctccaaagctcgtaactctgctgaaattggctcatcttctctgcttctccactgcatttggcgcagctctttgggtcactttcatcggtggtatcatcatgttcaagaatttaccacggcatcagtttgggaatctgcagagtaaaatgtttccagcctacttttccatggtgggggtgtgttgtgctgtttctgttggttcttttgggtacttgcatccttggaaggctgcgtctgcagctgagaagtaccaacttgggttcattcttgctgcgttttctttcaacctcagcaatctctttgtctttacccctatgacaattcagatgatgaagcaaaggcataagatagagagagaggccaatatcggggaagaagtcggatggaccaagaaccaggaagttgcaaaggctaatccaaagcttgcagcaatgaacaagaaatttgggatgattcatggactatcttcccttgctaacattttctccttcggttgcctcgccatgcattcctggtatttggcgggaaaactgaatctgtagtgtttagataagtctgctgttagagacaccagaatatcttaaagatttatatgccagctattttgaatcat

SEQ ID NO: 5618 - DNA, 838 bp, Platanus occidentalis
tttaagggaggaaggagtagagtctgtagagaaaaagagccaagtaggaaaaccctagaattctagcaaagagagcaaaggatggcctggttaactcgatttctcgtagcagtagctttcctggccttcggggtcctcttctctcctgaaaccttcggatcaaattccgaagccgggtattcgtccaagctctccatctctctcaagcttgctcatctcttgagcttctcaaccgcttggggttccgctctttgggttaccttcattggcggaattatcatgttcaagaatcttccgaggcatcagtttgggaatctgcagggaaagatgtttccggcttatttctcgttggtgggagtttgtggtgcgatatcggtggcatcatttggttacctccatccatggcgatcttcgtcctctgcggagaagtatcagcttgggtttctgatttcttcctttgctttcagtctcactaatctgttcgtcttcacgcccatgacaatagagatgatgaagcagaggcacaaggtggagaaggaagagaatattggggaggaagttgggaggtccaagaacatagaagtggccaaggttaatccgaagctggcggcaatgaacaagaaattcggaatgattcatgggctgtcatcgcttgccaatcttatgtcctttggtagcctcgccatgcattcatggtacctggcaggtaaaatcaacctgtgacttagcttccgcgtccgagcgtcgagaatgatgagttctagctgttgttatagatatcaccaatagaggaggaactgcttttgtcagtaaataaacacctctgaggctctgaatc

SEQ ID NO: 5619 - DNA, 914 bp, Salvia sclarea
ctactagaccttggctgtcactcagaatggcgagctagagctttctagaagcagtagaattaggtgaagtcagttttctgcagctgctgttgaattacacttcatttttcagctgaattccaaaccattcaaccagtgagagatggcgtggctgactagattcctgacggcggtggcgtttttggcgatcggcgttgttttctcgccggaaaccttcggatctaaatcggacggccagcattcgcagctgctcctctcctcgctgaaattggcgcacctgctctgcttctccaccgcctggggcgccgcgctatgggttaccttcatcggcggcatcatcatgttcaagaatctgcctaggcatcagtttgggaacttgcaaagcaagatgtttcctgcatacttttctatggtgggagtgtgctgtgcagtggcagtagggtcttttggatacttgcacccgtggaagacggcgggttcgactgagaaataccagctcggcttcctgattgctgcctttgctttcaatctgagcaatcttgtgatctttacgcccatgaccatcgagatgatgaaacagaggcacaagattgagagggaagtagacatcggggaggaagttgggtggacgaagaaccaagaagtcgcaaagaaaaacccgaagcttgctgccatgaacaagaagttcgggatgattcatggattgtcgtctcttgctaacatcttcgcgtttggtagcctcgccctgcactcgtggtacttagctggtaaactcaatctataaactatatgttgcatatcaaatatgcttggttgtatttacatgtaacatcaaacaaaaaatctgcccattatacctttttttcttcttccaagaaacaatatgtgactgttcgcagtgagtgacaggctag

SEQ ID NO: 5620 - DNA, 1004 bp, Nicotiana tabacum
  misc_feature (842)..(842): n is a, c, g, or t
  misc_feature (852)..(852): n is a, c, g, or t
  misc_feature (865)..(865): n is a, c, g, or t
  misc_feature (871)..(871): n is a, c, g, or t
  misc_feature (876)..(876): n is a, c, g, or t
gatgcgacacatttgctcgttatgtaacacgaaatccaaacaagctctttcggaagcttctggaagtgaagtaggtaaagccaaagctaagaacccccttttaatcagaacccagaaaacccacttctcctgacaatctgatcgtccggcaacaataatttcgatcaaagtgcagaaaccatggcttggatgacacgattcttagctgctgtagttttcttggcaattggagtacttttttctccagaaactttcggatcaaaatcagagggtcaacatcctccaaagctcgtaactttgctgaaattggctcatctcctctgcttttccactgcctttggcgctgctctttgggtcactttcattggtggtatcatcatgttcaagaatttgccaaggcatcagtttgggaatctgcagagtaaaatgtttccagcctacttttccatggtgggggtgtgttgtgctgtttccgtgggttcttttgggtacttgcatccttggaaggctgcgtctgctgctgagaagtaccaacttgggttcattcttgctgcatttgctttcaacctcagcaatctctttgtctttacccctatgaccatccagatgatgaagcaaaggcataagatagagaaagaggccaacatcggggaggaagttggatggaccaagaaccaggaagttgcaaaggctaatccaaagcttgcggcaatgaacaagaaatttgggatgattcatggactatcttcccttgctaacattttctccttcggttgcctcgcaatgcattcctggtatttggctggaaaactgaatctgtagtgtttaggtaagcctgctgntagagacacnaaaatttcttaangatttntatgncagctattttgaaccattactccaatggcttctgtattgttttaaatgtaacttgacaccaaagtgggaataaagatatacaggttataagcttgagcggccgcataaggggtacctgtcctctccaa

SEQ ID NO: 5621 - DNA, 946 bp, Fagopyrum esculentum
gaattctcataatctccgcctccaaagtccaaaccctcacattctatcagacaatcaccaacccaatctcaatcctccgtacctcaaaaccctcacattctatcagacagagaagagatccaatgggttggctaagccgattcgtggtggccgtggcgtttttagccatcggagtaatcttctcgccggagtcctttggctctaactccggcgtcggttcctccccttacttgaagctcgtccacctcctatgtttctccaccgctttcggcgctgctctctggtgaccttcatcggtggaatcatcatgttcaagaatttgccgaggcaccaatttggtaatctgcagagcaagatgttcccggcgtacttcacgctagttggggtttgttgcgcagcggccgttgcggctttcggttacctccatccatggaagtcgtgctctcagagcgagaagtatcaattagggttcctggctggctccttcctctttaatctttccaatctgttcattttcacccccatgaccatccagatgatgaagaagaggcacaaggtggagcgggagcagaacattggagaagaagtagggtggtcgaagaacagagaagcagctaaggtaaacccagagcttgcaggcatgaacaagaagtttgggatgatccatggtttgtcttctctggctaacatactctcctttggttgtcttgcgatgcactcctggtacttagcgggtaaactcgacctatgatgagctccatcatacctatagatgaatgttactcatccatcatacctctacatggatgttactcaataatgctgaatcaaacgttcatagcattctgtaatgtataattatttatatacccaaagatttcacgtgagcttatgatctgttagtttacataccctctgtttctgctttgtcagtctgtctccgaac

SEQ ID NO: 5622 - DNA, 625 bp, Arnica chamissonis
gattgctttcttggcaatcggagtaatattttcgccggaaacgttcggatcaaaatcggcaaagatcacaaccttcgtcaaacttgcgcacatcctatgtttctccaccgcttggggtgcagcggtttgggtcaccttcatcggcggcatcatcatgttcaagaatctgccgagacatcagtttggaaatctgcaaagcaagatgtttccggcgtattttatgatggttggtatatgttgtgcggtgtccgttggatgttttggctatacacatccatggaagtcgtcatcaaccgctgagaagtatcagctagggtttttggtctccgctttggctttcaatctcgccaatttgtttgtctttactcccatgaccattgagatgatgaagcagaggcacaagatggagagggaatcgaacataggtgaagaagttgggtggacaaagaaccaggaggttgcaaaggtgaacccgaagctagcagcaatgaacaagaggtttggaatgatccatggactgtcttctctagccaacataatgtcatttggtagtcttgcaatacattcatggtatctagcaggcaaaattgatctctaaaacccgttgctacccttatgaattgta

SEQ ID NO: 5623 - DNA, 688 bp, Liriodendron tulipifera
ctctctctccctctctctccaaagcatcacagaaatggcttggctaacccgatttctgagcgcactggccttcctggccatcggcatcctcttttcgcccgagacctttggatcaaaatccgacggcggacattcgtccacgctcaccatctctctcaagctggcccacctactgagctttgccactgcctggggcgctgctctctgggtaacattcatcggcggaatcataatgttcaagaaccttccgaggcatcagtttgggaatttacagagcaagatgtttccggcgtatttcttgactgtgggcgcctgcggcgcaatctcagtggcggcgttcggctacctccatccttggaagacagcttcatcgtcggagaggtatcagctgggttttcttctgtcatcgtttgcgttcaatctcacaaacctgtttgtgtttacgcccatgacgatcgagatgatgaagcagaggcacaaggtggagagggaagaaaagattggggaggaggtcggatggacgaagaacgtggaagtagctaaggttaacccgaagcttgcggccatgaacaagaaattcggaatgattcatgggctgtcgtcgcttgccaatatcatgtcattcggcagccttgccatgcattcatggtatttagcaggtaaaattcactttaagtatgtatgtttt

SEQ ID NO: 5624 - DNA, 856 bp, Silene vulgaris
aacaatggggtggctatcaagattcacaattgcagttgcatttttagccgttggagtcatcttctcacctgaaaccttcaaatcagacggctcagattcatcctcaccagctctcaacactgcgcttaagctctctcatctactttgtttctccacagcatggggtgccgctttatgggtcaccttcatcggtggcatcatcatgttcaagaatttgccaaggcatcaatttgggaatttgcagagtaagatgtttccagcatactttacaatggtgggtatttgttgtgcggtttcgatggcggcatttgggtatttgcatccatggaaatcggcttcgtctactgagaaatatcagttggggtttttgggttttgcctttttcttcaatcttaccaatttggtgatttttactcctatgactattgagatgatgaagcaacgacacaaggtggagagggaaaacaacgtaggtgaagaagtaggatggtcaaagaacaaagaagtcgcaaagtcaaacccacaactcgcatcaatgaacaagaagtttggaatgatacatggcttgtcttcacttgcaaacatttttgcatttggatgccttgctatgcattcatggtatttagctggtaaactcaacctttgatctggaattcagcaagagaggcgacgtgaaactatcaaagtaaacacacatgattacaaaagtctagagttcctgtgtctttatgtttcttctgcttatttgtactcaaactagctgttccatgtttcatatgagaatttgtgtccaaaatttacagtacttgaattgccagctccatttcgtaaataacgagtttgtattaattggatt

SEQ ID NO: 5625 - DNA, 817 bp, Utricularia gibba
tctgagttgactgcggggaaagatgggttggatgacgagattcgtgacggcggttgcgtttctagcagtcggagtaattttctcgccggagacttttggatcgaagtcgggaactgaaaagtcaccggtggttgttactgttctgaaattggttcaccttttgtgcttcgcaactgcctggggtgctgctctgtgggttactttcatcggagggatcatcatgttcaaaaacctgccaagacatcagtttgggaacttgcagagcaagatgttccctgcatacttctccatggtaggcgtatgttgtgcagccgctgttggggcgtttgcgtacttgcacccgtggagaagttccggggctacagagaagtatcagcttggtttccttgttgctgccttcgccttcaatctgtccaatctagttgtcttcactcccatgaccatcgagatgatgaaggagaggcacaaggtagaaagggaagccaacatcggagaagaagtgggttggagcaagaaccagcaggaggcgaagaagaatccgaagctggctgccatgaacaagaagtttgggatgatacacgggctgtcatcccttgcaaacatcttctccttcggtagccttgccatccattcctggtatctggccggtaaaatcaacctgtagctctggttctgtgacatcacactggtcctctgtctctgttgcatcaacaagctttcctttaaaaccctgtaagccatcctccatcttcaatggactttatttctggatggtttggaacaaaaaaattggttagagatccaccgaagtggaaag

SEQ ID NO: 5626 - DNA, 874 bp, Plantago ovata
gataaaattcgcagttcttctttgagtgaggtcatcatcaacgaacaagcttaaccatggcgtggctgacaagattccttacggcggtgacatttttggccgtcggtgtagttttctcgcctgtaaacctcggatcgagcggcgacaaatcgctgttgctcatgaacggactcaaattggcccatctcctctgcttctccactgcctggggcgccgctctatgggttaccttcattggcggtatcatcatgttcaagaatttgccgaggcatcaatttgggaacttgcaaagcaagatgtttcctgcttacttttccatggtgggtgtttgctgtgcggttgccctagggtgttttgggtatttgcatccatggcagacttcaggagttactgaaaagtaccagctagggttcctgctggctgcctttgttttcaatctcagcaatcttatcatctttacacccatgaccattgagatgatgaaacagaggcacaagatagaaagagaagcaaatattggggaagaagttggttggaccaagaacaaagcggaagcaaaaaaaacccgaagcttgctgccatgaacaagaaatttgggatgattcacggtttatcttctcttgctaatatcttttcatttggtagccttgctatgcattcttggtatttagctggtaagatcgacttgtagatcccagatgcgtatcttcttcactgtgaatctccttgttgtatttgcgttaaaaatgacacatgtcactttccaagtccattatgtttggaaccctgtgaatgcgaataaaataatactttataatcctagctaacttttaactgctgtgacttgcaatgtagtttatctagttttatgaac

SEQ ID NO: 5627 - DNA, 823 bp, Ipomoea batatas
gcgggggagcaagcagtgaatcacttgacttttccgattagcttctagttttccggcgacttcctgcgctctgtagagatggggtggatgactcgattctcaacagttcttgctttccttgcgatcggagtggtgttttcaccggaaactttcggatcaaaatccgacggtcaatatcctctcaaggccgtcacttttctgaaattagcgcacctgctctgcttctccaccgcttggggcgccgctctatgggtcaccttcatcggcggcattatcatgttcaagaatctgccgaggcatcagtttgggaatctgcagagcaagatgttcccggcgtactttactttggtcggggtgtgttgcgcggtctcagtggcggcctttgggtacatgcatccatggaagacgtcgagtagtgctgaaaaatatcagattggcttcattctcggtgcctttgctttcaacctcagcaatcttttcgtgtttactcccatgactatccagatgatgaagcaaaggcataaaattgagagagagtcaaatattggagatgaagttgggtggaccaagaatcaggaagtcgccaaggttaatccaaagcttgctgccatgaacaagaaattcggaatgattcatggactctcttctcttgcgaatatcgtgtcttttggttgccttgccatgcactcctggtatttagctggaaaaattaatttttagattgaattgctgaaatatgaccgccctcggatgttgtgggcgttatgactatgtattaaaatccagagataatttgtgtggcaataaaataaaaattcctgat

SEQ ID NO: 5628 - DNA, 713 bp, Chelidonium majus
aggagagaagtgaaagatggcttggattactcgatttctcgtcgcagttgcttttctagcattcggaattctattctctccggagacattcggatcaaaatcagatggtgaatactcatccaagctcataattgccctaaaattaggtcatttattgagcttctcaacatcttttggtgcagctctttgggtcaccttcatcggcggaatcatcatgttcaagaatcttccgagacatcaatttggaaatcttcagagtaagatgtttcctgcgtatttctcaatggtgactgtttgttctgcgacatcattggcgtcgtttggttatctacatccatggaaatcgtcgtcttctgcggagaagtatcagctagggtttttgtctctctaccttcgctttcaatctatccaatttgttcgtcttcacccccatgaccattgagatgatgaagcaaagacacaagttggagagagaagagaatatcggagaggaagttgggtggtctaagaacagagatgtcgcaaaagtgaacccaaagcttgctgccatgaacaagaagtttggtatgattcacggtttgtcatcacttgccaacattctgtcctttggtagccttgctatgcactcttggtacttagctggtaaactcaatctgtaatttcccgcattaaactgaatctgtcctagctctacatttacatcctgccgatta

SEQ ID NO: 5629 - DNA, 1046 bp, Coffea canephora
cggccggggggccggtactaagcgaagttggtggtgggtggtcttcctcttcgcctcactatataattgagcaagaacccacgtttaaaagaaaaaaacaacaaaattagaaaagggagagatgggttggatgagcagattcctagctgcagtgacgttcttggccgtcggggtgatattctcccctgaaaccttcggatcaacatccccccaggatggccagcagcaccatcatccaaagcttctttccttcctcaaactcgcccacctcctctgcttctccactgcctggggggctgccctctgggtcaccttcatcggcggcatcattatgttcaagaatctgcctaggcatcaattcgggaatctgcagagcaagatgttccctgcctacttctccatggtcggggtgtgttgtgcggtctgcgtggcgtcctttgcctacctgcatccctggaagactgcctccatggctcataaataccaactcggctttctcctagctgctttcgctttcaacctcaccaatcttcttgtctttactcccatgaccatcgagatgatgaaacaaaggcacaagatagaaagagaagcacaaattggggaagaagtcgggtggacgaagaatcaagaagttgcaaaggcaaatccaaagcttgctgccatgaataagaagttcggcatgattcatggactgtcttctcttgctaatataatgtcttttgggagtcttgccatgcattcctggtatctgtctggtaagatcaatttttaggacacagattaggagaaggtttctggccattcttctacattacattcgaatgtggacttgtgtaaagctggctataattgacaattgacaccaaatctgttggttcggtgccgagttatgtacgctactgaacaatagtaagaataacgaatccgctatgtcatgtttgtattactgggcatcattctgaggaaatacaagggcggtatgggctcttgttttgtagaagatgatctaatcgtttcttgatagttgtcagagtggacatgtt

SEQ ID NO: 5630 - DNA, 941 bp, Olea europaea
gaagaaatgggttggatgagtagatttttagcggcagcgacattcttggcaatcggtgtgacttttttgccggagaaatcggaatcggaatctgcgaatcagcattctccgaaactcgtcaatctattgaagttggctcacttgctctgcttctccaccgcgtggggtgccgctctctgggtcaccttcatcggcggcattatcatgttcaagaatttgccacggcatcaatttggaaatttgcagagcaagatgtttccggcatacttttcaatggtgggagtttgttgtgcagtggctgctgcagcttttggatacctgcatccatggaaggcgtcaacagctgctgagaaataccagctcggcttcctcacgtctgcctttgctttcaatctctgcaatcttgtagtctttacacccatgacgatcgagatgatgaagcaaaggcacaagatagaaagagaagcaaatattggggaagaagttgggtcgacaaagaaccaagaagttgcgaagaaaaatccaaagcttgctgccatgaacaagaaattcggaatgatccacggactatcatctctttctaatatcatgtcattcggtagccttgccatgcattcttggtatttagcaggtaaaatcgatttgtaaatcggatcaaatataacttttactctcgggtggatgtatctggctgtgattatgtgttaaaatgaatacggactctgaatcctttagctttcttggacgtacaagttatgtatgaaagaacaagatgcgttagaataaaaatgttgtaattttcaatttgccttgcgagtcaaaatggatatcaacactgaaaccattagcttgcttggatgtcgattgtgcttgcttccacaagttatccattgatatagacattgatgttgtggagggattgagtaataatattcaattaa

SEQ ID NO: 5631 - DNA, 1522 bp, Beta vulgaris
aaagtgaagaaaacacaccttaaatccttaatcagaccaatttcgccaaacactgcgattagcttggaattaaatgcacagttggtaatccaatcaatatattactccatttctcgtcaacgaagctcaattccatccacaattctccaatttcaagaaccaacaacaaaaaatggggtggttaacaagattcatagtagcactatcattcttagcaattggaatcatcttttccccagaaaccttcaaatcagacgcctcaaattcatcatctctctctactttcctcaaactatctcatcttctctgcttctcctccgcatggggcgctgctttgtgggccaccttcataggcggtatcatcatgttcaagaatttgccaaggcatcaatttgggaatttgcagagtaaaatgttcccagcttattttactttggtgggtgtttgttgtgctatttcaacggcgtcgtttgggtatttacatccatggaaatcatcttcttctactgagaagtatcagttagggtttttgggttttgcttttctatttaatctttccaatttgctggttttcactcctatgacaatcaagatgatgaagcaaagacacaaagtggagcgggagaacaacatcggggaagaagttgggtggactaagaacaaagaagttgcaaagacaaacccacagcttgcagcaatgaacaagaagtttggtatgatccatggcttgtcttctcttgcgaacctcttttcattcggttgccttgccatgcactcgtggtatttagcttgtaaactcgacctatgattggatcacgccatcatcttctcatcaggaatattgccaagctcagtgtggcagttgaagaataaagtttatacaggcgttcttctgatgttaagcttgtacctgtttcgatgggtaaactctggtttttttcacaaggtttcaacttttgaaatattgtggtggaaattggcactgcaattcttactgaaaaattcctgggactcaaaaaaaaaaaaaaaaaaaacttcaggggggcccgggacccaattcccctaagggagccattacaattctgggcggccttttaaactcctgacgggaaaacctgggttacccaaataatcccttggaaaatccccttttccaggggggaaaacaaaaggccccccttccccttccaaaatggcccccaaagggaaggcaattgaccgtaaatttttaaatccggaatttgtaaaacccctttttacaaggccaaaggaaaccttaaaaaaaaaaacaaaagggtagtttccctttaaaaacccttaaaaaggccccccagggaaacctttgggggcccccgcacccccaattttgggaggcgaaaaaaaaacaaggccttttttggaaccacgaaaaaaaaaaaaggggggcggagaccccccccccccgcggggggtttggggccttttatatctcaaaaaaaaaaaatctttttttcctccaaagggcccccatttgcctaacaac

SEQ ID NO: 5632 - DNA, 1396 bp, Glycine max
ttcttgtgcataaatatgacagtgcacactcactctgaatcccctcttcttccataaaccctacttctacttccctttgttctcaaaccttatcccttatcctcccaaaaccaaaccatgtctacctccgcagcttctctcgcactcccaaccctcactctccgaactcgacaacctctctgttctccccaatgcttctcctcgtccctctccctcacccctaactccaaacccatttccatttccgccgttttcctcaaaacaacgctgtcgtcgtcgtcgccgttgtcgctgtcgtctcgcttcgttccccatgtctctgtgttggagcaggaggaggacaccttcggcgacggagacggccccagcttctcccgcgaccttaagctctttgtcgggaatctccccttcagtgtcgacagtgcgcggctcgcggagctcttcgagagtgcggggaatgtggaggtggttgaggttatttatgataagactactgggaggagcagggggtttgggtttgtgaccatgtcttccgttgaggaagctgaagcggctgctaagcagttcaatggctatgaacttgatggaagatcattgagagtgaattctggaccacctcctgctcggaatgagagtgctcctcggtttagaggtggttcttctttcggttccagaggtggtggtccttcagatagtgaaaaccgtgttcatgtaggtaatcttgcttggggtgttgacgatgtagcacttgagtctttgttccgtgaacaagggaagaaggtcttggaagctagggtaatctatgacagggaaagtggacgatctagaggctttggattcgtgactttcggtagccctgatgaggtcaaaagtgcaattcagtccttagatggtgtggacttgaatggcagagctatacgagtctcattagcagattccaagcccaagcggttctgaagcttttcatctatacccgagagaggatttcggtagttgggacttgggagttatacagctgcaagatgtcattggcaatcagtttggacaagaaatacacttacatgcattgagactagatgtacacacagtttcaatatctgacagaggagaatatatcagtgtctcttgaagtttaaatgtatgttccaaatttgattgttgtcatttgtaactgatttgtagtccgtattttcactatagaagtagatgtctcaaatatttattggttaccccgttccaacattgttgtggaagaattttataattgcaatgtgcctggaaaattatctaccacagatttatcttttggttcaattgtttggtggaaaagtttatgttgaggacttaaggtaaatacaaccaagaatttggttatcggtgaggtatcgtcacaatt

SEQ ID NO: 5633 - DNA, 1375 bp, Glycine max
ttcttgtgcataaatatgacagtgcacactcactctgaatcccctcttcttccataaaccctacttctacttccctttgttctcaaaccttatcccttatcctcccaaaaccaaaccatgtctacctccgcagcttctctcgcactcccaaccctcactctccgaactcgacaacctctctgttctccccaatgcttctcctcgtccctctccctcacccctaactccaaacccatttccatttccgccgttttcctcaaaacaacgctgtcgtcgtcgtcgccgttgtcgctgtcgtctcgcttcgttccccatgtctctgtgttggagcaggaggaggacaccttcggcgacggagacggccccagcttctcccgcgaccttaagctctttgtcgggaatctccccttcagtgtcgacagtgcgcggctcgcggagctcttcgagagtgcggggaatgtggaggtggttgaggttatttatgataagactactgggaggagcagggggtttgggtttgtgaccatgtcttccgttgaggaagctgaagcggctgctaagcagttcaatggctatgaacttgatggaagatcattgagagtgaattctggaccacctcctgctcggaatgagagtgctcctcggtttagaggtggttcttctttcggttccagaggtggtggtccttcagatagtgaaaaccgtgttcatgtaggtaatcttgcttggggtgttgacgatgtagcacttgagtctttgttccgtgaacaagggaagaaggtcttggaagctagggtaatctatgacagggaaagtggacgatctagaggctttggattcgtgactttcggtagccctgatgaggtcaaaagtgcaattcagtccttagatggtgtggacttgaatggcagagctatacgagtctcattagcagattccaagcccaagcggttctgaagcttttcatctatacccgagagaggatttcggtagttgggacttgggagttatacagctgcaagatgtcattggcaatcagtttggacaagaaatacacttacatgcattgagactagatgtacacacagtttcaatatctgacagaggagaatatatcagtgtctcttgaagtttaaatgtatgttccaaatttgattgttgtcatttgtaactgatttgtagtccgtattttcactatagaagtagatgtctcaaatatttattggttaccccgttccaacattgttgtggaagaattttataattgcaatgtgcctggaaaattatctaccacagatttatcttttggttcaattgtttggtggaaaagtttatgttgaggacttaaggtaaatacaaccaagaatttggttat

SEQ ID NO: 5634 - DNA, 1551 bp, Cajanus cajan
gtgcataaatatcacagtgctcactcactctgaatcctctcttcctccataaaccctatttcttcctcttactctcaccaaaaaccttatccgttcgtttcccaaaccaaaccatgtctacctctgcagcttctctcgcacttcccacactcactctccgaaccagacaacctctgtgttccccgcaatgcttctcctccctctccctcgcccccaactccaaacccatctccatttccgcagttttcctcaagccaacaacgttgtcgttgtcctctcgcttcgttccacgtgtcgctgtttcgtcggagctggagcaggaggaggacactttcagcgacggcgacggcgacagcgacagccccagtttctcccccgaccttaagctcttcgtcggaaaccttcccttcagcgtcgacagcgcgcagctcgccgagctcttcgagagcgccgggaatgtggaggtcgtagaggtgatttatgataagaccactgggaggagcagggggtttgggtttgtgaccatgtcttcggttgaggaagttgaagcggcggctcagcagttcaatggctatgaactggagggaagggcgttgagagtgaatgctgggccacccccttcccggagtgagagttctcctcgttttagaggttcttccggtcccagaggaggtggtggtggtttttcagatagtgaaaaccgtgttcatgtaggtaatcttgcttggggtgttgacaatttagcactcgagtcattgttccgggaacaaggaaaggtcttggaagctagggtaatctatgacagggaaagtggacgatcaagaggatttggatttgtgacttacagtagccctgatgaggtcaacagtgcaattcagtccttggatggtgtggacttgaatggcagagctatacgagtctcaatggcagattctaagcccaagcggttttaaggttttaatggtttatctccttgagaggggatttcggtagttgcgagttatacagctgcaaggtggttgacattggccaacagtttggggaaaaaagatacttgcatgcattgagactacatgtacacacaatatcaatatcagaccctcttcggtctagaggatacctgatcagtgtctcttgaagtttaaatgtatgctccatggttgtcttttgaaactaatttgtagttcaaatttcactatagaagtagatgtctaaaatattattggttaccctgttacaaaatccctacatttttgtggaagaatttattgtgccaggagaattatcaatcacaggtttatgttttgctttaattgtttggtgggaagagattatgtgatttgtgaacctagttcttgtgaagatattgtcacaatttgatctgggattcatttttccttcaaaaagatcttttgttcgatttctattgtgtactggattttttttaatcatttttgttgttaatgatgaaccttacatagtcttgcacaactacttatttaagaaatgtttgatgtgtggacatatataatgaagcaggaaaaaactggc

SEQ ID NO: 5635 - DNA, 1483 bp, Glycine max
tgagtttgaacgtccccgttctctgattgggcggttgcacgttgtaggctctttgtacgttttacacgtcagctcttcaaaacgacgcctccatcagatctctgcagccccaaagggtgccgttttgttgcgttgcactcgcggaagcggagaaaaccaaagaatcaagcttcgtcaaagtgtctgtcacacacagtctttaagatctggaagcgcttctcacttgcccacaataagaattcctctcaaatttcaatttttcatttgaaaataataaaaccctaaaagaggggttgcaagcaaaatgagaagctcgaagatgtggatggttttcatgtgtctgacggtgagcttcttcgctcgcattgaatcgctatccgtgacggtgaacgacgtcgagtgcgtctacgagtacgtactttacgagggcgacaccgtttcggggaactttgttgtcgtcgaccatgacattttctggagctctgatcaccccggcattgatttcacggtgacaactgctgcagggaatactgtccacagtatcaagggaacctctggtgacaagttcagttttaaagccccatcacatggaatgtataaattttgttttcataacccttactcaacacctgagactgtttctttctacattcatgttggtcacatcccctctgagcatgatcttgccaaagatgagcatttggacccaattaatgttaagatcgctgagctcagagaggcactagaatctgttacagctgaacagaagtacttgaaagcccgtgatgcaaggcatcgtcatactaatgagagcacacggaagcgtgttgtattctacactgtgggagagtaccttctcttggctgctgttagtgcactgcaagtcatatacattaggcgccttttcagcaagtcagtggcctacaatcgtgtttgagtcgccttcatgattaacgttaatggcttccttcattagcaacagggttaggtttacatatgcgttctctattcattcaacagtacgattacgatcccttggtgaacactttttttttttcttttcaacagagactccacttgtatgttgatacccaacaagatatttaaattccttagcttgaatttcaatggattcacagaaatcaaaccgtgtgggaatcaataccaagtttgtaaaatggtagtctgagttcctaaaatggttgaaaaactgaaagtaaaattagacttttttggtaactctaagcccatactgcttattttttacctgttcttttaggacttggctctttatgttgttcacttctactggcaaaaggtgaaacatctccacaaattaaaaatttgatgttatatatgattgtaatttgtaatatgcttttagtccttctattacaatgaaagtgtgatcttggtctttgaataatttattaagcaaattcaatctttccatttcagttcttccatttctttttttcaacat

SEQ ID NO: 5636 - DNA, 1251 bp, Glycine max
cccaaagggtgccgttttgttgcgttgcactcgcggaagcggagaaaaccaaagaatcaagcttcgtcaaagtgtctgtcacacacagtctttaagatctggaagcgcttctcacttgcccacaataagaattcctctcaaatttcaatttttcatttgaaaataataaaaccctaaaagaggggttgcaagcaaaatgagaagctcgaagatgtggatggttttcatgtgtctgacggtgagcttcttcgctcgcattgaatcgctatccgtgacggtgaacgacgtcgagtgcgtctacgagtacgtactttacgagggcgacaccgtttcggggaactttgttgtcgtcgaccatgacattttctggagctctgatcaccccggcattgatttcacggtgacaactgctgcagggaatactgtccacagtatcaagggaacctctggtgacaagttcagttttaaagccccatcacatggaatgtataaattttgttttcataacccttactcaacacctgagactgtttctttctacattcatgttggtcacatcccctctgagcatgatcttgccaaagatgagcatttggacccaattaatgttaagatcgctgagctcagagaggcactagaatctgttacagctgaacagaagtacttgaaagcccgtgatgcaaggcatcgtcatactaatgagagcacacggaagcgtgttgtattctacactgtgggagagtaccttctcttggctgctgttagtgcactgcaagtcatatacattaggcgccttttcagcaagtcagtggcctacaatcgtgtttgagtcgccttcatgattaacgttaatggcttccttcattagcaacaggagactccacttgtatgttgatacccaacaagatatttaaattccttagcttgaatttcaatggattcacagaaatcaaaccgtgtgggaatcaataccaagtttgtaaaatggtagtctgagttcctaaaatggttgaaaaactgaaagtaaaattagacttttttggtaactctaagcccatactgcttattttttacctgttcttttaggacttggctctttatgttgttcacttctactggcaaaaggtgaaacatctccacaaattaaaaatttgatgttatatatgattgtaatttgtaatatgcttttagtccttctattacaatgaaagtgtgatcttggtctttgaataatttattaagcaaattcaa

SEQ ID NO: 5637 - DNA, 1138 bp, Cajanus cajan
gcacgttgtaggtttgacacgtcagcactacgaaacgacgcctgaaacaaatctgtgcaatcccaaatgttctgctgcagtggctgagttgagaaacggagaaagaagaaagaagaaagaagaaagaagaaagattggattcacactttgagatctgaaagcgcttctcactgtttcaaaatgagaggcgccaacgtatggacggttttcatgtgtctgatgctcagcttcttcgctcgcattcaatcgctctccgtcacggttaacgacgtcgagtgcgtctacgagtacgtgctttacgagggcgacaccgtttccggcaactttgtcgtcgtcgaccatgacatcttctggagctccgatcaccccggcattgatttcacggtgacaactcctgcagggaataccgttcaaaatatcaagggaacatctggtgacaagtttagttttaaagccccaacacatggaatgtataaattttgtttccataacccttactcaacacctgagactgtttctttctacatccatgttggtcatatcccctctgagcatgatcttgccaaagatgagcatttggacccagttaatgttaaaattgctgagcttagagaggcactagaatctgttacagctgaacaaaagtacttgaaagctcgtgatgcaaggcatcgtcacacgaacgagagcacacggaagcgtgttatattctacactgtgggagagtaccttctgttggctgctgttagtgcactgcaagtcatatacatcagacgccttttcagcaagtcagtggcctacaaccgtgtttgagtctccatcattaacattatggcttccttcattagcaacagggttaggtttacatgtgttatctatttaacattacgtttacgatcccttggtgaaacacttttttttcttttcaacaaagacgcggcttgtattttgatatccaacaagattttaaattccttagcttgtgaatttcaatggattgacagaaattaaaccgtgtgagaatcgatactacgtttgtaaaatgttagtagtctgagttcttaaacggtggataacttgaaaataaaataagacgcttttggttaatcgaaacctatctgcatttttttttacctgt

SEQ ID NO: 5638 - DNA, 1194 bp, Phaseolus coccineus
gcactgtagaagcagcggtataaacgcatgaacattacgggcgccgttttgttgtgttgagttgtgttgccttgcagtcgcagagaaggaaagaagaaaaagaaggagagaaagaagaaaacttcgtcaaagtgtgtcacaatcagtctttaagatctgaaagagcttcttgcttccccttaaccaaaatttctcttactttcaattcttttctttcaaaataataaaaccctaagagaggggcgcaaacacaatgagaagcgtcaagatgtggacggttttgatgtgtttgattttgatcttctttgctcgcattgaatcgctgtctgtgacggtgaacgacgtcgagtgcgtctacgagtacgtgctttacgagggtgacaccgttacggggaactttgttgtcgtcgaccatgacatcttttggagttccgatcatcccggcattgatttcacggtgacatcccccggcgggaatactgtcacaaatataaagggaacctctggtgacaagtttgattttaaagccccaaaacatggaatgtataaattttgtttccataacccacagtcaacacctgagacggtctctttctacatccatgttggtcatattccctctgagcatgaccttgccaaagatgagcatttggacccagttaatgttaaaattgctgaactcagagaagcactagagtctgttactgctgaacaaaagtacctgaaagctcgtgatgcaaggcatcgtcataccaacgagagcacccggaagcgtgttgtattctacacagttggagagtattttctcttggccgctgttagtgctttgcaagtcctatacatcaggcgccttttcagcaagtcagtggcatacaaccgtgtttgagtccccttcattattaaccttatgctttcctttgttagcatcagtgttaggtttacatgtgctctctatttaaaagtatgatttcttggtgaacacttttttctacagaaacacgacctgtattttgttgatactcaacaagatctttaaatttcttagtttgatttcaatggattgcagaaattaaaccatgtgagagtcaatactaagtttgtaaaatggtaatatatgagttctcaaacgtttgttgcaaacttgaagtatactagtaagacatttttggtaactgaaatcctatattttgctta

SEQ ID NO: 5639 - DNA, 1216 bp, Phaseolus coccineus
gcactgtagaagcagcggtataaacgcatgaacattacgggcgccgttttgttgtgttgagttgtgttgccttgcagtcgcagagaaggaaagaagaaaaagaaggagagaaagaagaaaacttcgtcaaagtgtgtcacaatcagtctttaagatctgaaagagcttcttgcttccccttaaccaaaatttctcttactttcaattcttttctttcaaaataataaaaccctaagagaggggcgcaaacacaatgagaagcgtcaagatgtggacggttttgatgtgtttgattttgatcttctttgctcgcattgaatcgctgtctgtgacggtgaacgacgtcgagtgcgtctacgagtacgtgctttacgagggtgacaccgttacggggaactttgttgtcgtcgaccatgacatcttttggagttccgatcatcccggcattgatttcacggtgacatcccccggcgggaatactgtcacaaatataaagggaacctctggtgacaagtttgattttaaagccccaaaacatggaatgtataaattttgtttccataacccacagtcaacacctgagacggtctctttctacatccatgttggtcatattccctctgagcatgaccttgccaaagatgagcatttggacccagttaatgttaaaattgctgaactcagagaagcactagagtctgttactgctgaacaaaagtacctgaaagctcgtgatgcaaggcatcgtcataccaacgagagcacccggaagcgtgttgtattctacacagttggagagtattttctcttggccgctgttagtgctttgcaagtcctatacatcaggcgccttttcagcaagtcagtggcatacaaccgtgtttgagtccccttcattattaaccttatgctttcctttgttagcatcagtgttaggtttacatgtgctctctatttaaaagtatgatttcttggtgaacacttttttctacagaaacacgacctgtattttgttgatactcaacaagatctttaaatttcttagtttgatttcaatggattgcagaaattaaaccatgtgagagtcaatactaagtttgtaaaatggtaatatatgagttctcaaacgtttgttgcaaacttgaagtatactagtaagacatttttggtaactgaaatcctatattttgcttattttagaggcgtttaaggattt

SEQ ID NO: 5640 - DNA, 1050 bp, Vigna unguiculata
gaggaagaaaggagaaagaagcaagcttcgccagagggtgtcacagtctatctttaagatctgaaagcgcctcttacttccccgcaaccaaaaattcatttactttcaattctttgctttcaaaataataaaaccctaagagaggggtgcaaacacaatgagaagcgcaaagatgtggacggttttgatgtgtttgattatgagcttattcactcgcactgaatcgctgtctgtgacggtgaacgacgtcgagtgcgtctacgagtacgtgctttacgagggcgacaccgtttccgggaattttgttgtcgtcgaccacgacattttctggagttccgatcaccccggcattgatctcgaggtgacatcccccggtgggaatactgtcaaaagtataaagggaacctctggtgacaagtttgattttaaggccccaacacatggaatgtataaattttgtttccataacccatactcaacacctgagacagtctctttctacatccatgttggtcacattccctctgagcatgaccttgccaaagatgagcatttggacccaattaatgttaaaattgctgaactcagagaagcactagagtctgttactgctgaacaaaagtacttgaaagctcgtgatgcaaggcatcgtcatacgaacgagagcacgcggaagcgtgttgtattctacacagtaggagagtattttctcttggccgctgttagtgctctgcaagtcctatacatcaggcgccttttcagcaagtcggtggcatacaaccgtgtttgagttcccttcattattaaccttatgctttccttcgttagcatcagtattaggttcacatgtgctctctatttaaaagtatgatttcttggtgaacactttttttacagaaacacgacctgtattttgatacccaacaagatttttaaattccttagtttgaatatcaatggattgacagaaattaaaccatgtgagaatcaatactaagtttgtaaaagggtaatctacaagttctcaaacgtttgatgcaaacttgaagt

SEQ ID NO: 5641 - DNA, 1021 bp, Vigna unguiculata
gggccgttttgtggtgttgcattcgccgaggaagaaaggagaaagaagcaagcttcgccagagggtgtcacagtctatctttaagatctgaaagcgcctcttacttccccgcaaccaaaaattcatttactttcaattctttgctttcaaaataataaaaccctaagagaggggtgcaaacacaatgagaagcgcaaagatgtggacggttttgatgtgtttgattatgagcttattcactcgcactgaatcgctgtctgtgacggtgaacgacgtcgagtgcgtctacgagtacgtgctttacgagggcgacaccgtttccgggaattttgttgtcgtcgaccacgacattttctggagttccgatcaccccggcattgatctcgaggtgacatcccccggtgggaatactgtcaaaagtataaagggaacctctggtgacaagtttgattttaaggccccaacacatggaatgtataaattttgtttccataacccatactcaacacctgagacagtctctttctacatccatgttggtcacattccctctgagcatgaccttgccaaagatgagcatttggacccaattaatgttaaaattgctgaactcagagaagcactagagtctgttactgctgaacaaaagtacttgaaagctcgtgatgcaaggcatcgtcatacgaacgagagcacgcggaagcgtgttgtattctacacagtaggagagtattttctcttggccgctgttagtgctctgcaagtcctatacatcaggcgccttttcagcaagtcggtggcatacaaccgtgtttgagttcccttcattattaaccttatgctttccttcgttagcatcagtattaggttcacatgtgctctctatttaaaagtatgatttcttggtgaacactttttttacagaaacacgacctgtattttgatacccaacaagatttttaaattccttagtttgaatatcaatggattgacagaaattaaaccaaaaaaaaagaaaaaa

SEQ ID NO: 5642 - DNA, 850 bp, Cyamopsis tetragonoloba
cacgaggagaagcgcgaagatgtggatggttttgatgtgtttgatgatcagcttctttggtcgcatcgaatcgttatcagtgacggtgaacgacgtcgagtgcgtctacgaatatgttatctacgaaggtgacaccgtttcaggcaattttgtcgtcgtcgaccatgacattttctggagctccgatcaccctggcattgatttcacggtgacatctccttcaggtaatacggtccacgatatcaagggaacctctggtgacaagtttcagttcaaagctccagtacatggaatgtataaattttgttttcataacccttactcaacacctgagactgtttctttctacatccatgttggtcatattccctctgagcatgaccttgccaaagatgagcatttggacccaattaatgtcaaaattgctgagctcagagaggcactagagtcggttacagctgaacaaaagtacttgaaagctcgtgacgcaaggcatcgacatacgaacgagagcacacgtaagcgtgttgtattctacacgataggagagtactttatgttggcagctgttagtgcattgcaagtcatttacatcaggcgcctcttcagcaagtcggttgcctacaaccgtgtttgaatctcctcattaatcttatgctttccttcttaatttaggaacaggtttaggttttgcagatatgtgttctatgtgaaactatataatcctttttctctttccaacattgtattttgatacccatcaacgtttttaaattccctcgttttaatttcaatggattgacaggaactataccgtgtggatggataatatattttgaaattatcaagg

SEQ ID NO: 5643 - DNA, 1013 bp, Arachis hypogaea
acggcggtgccgttttgttgcgttggactagcagagacctgaaacgaagaaagtactcaacaccttgtcaaagtttttgactttaagatctgggtaccacctctcacttgcccactgcatcgaatttatcgcaatttgatttcagaagacaaaattcccaaaaataaataagagggggaaagatatggagcaaacgcagtggaagagaagctcgaagatgtggatggttttggcgtgtttgatgatgagcttctttagcggcattgagtcgctatcggtgacggtaaacgacgtcgagtgcgtctacgagtatgtgctttatgagggtgacactatttcggggaactttgttgtcgtcgaccacgatattttctggggctctgatcaccctggtatcgatttcacggtgacatctcctgctggtaatacagtccaaaatatcaaggggacctctggtgacaagttccaatttaaagccccgacacatggaatgtataaattctgttttcacaaccctcactcaacacctgagactgtttctttctacatccatgttggtcatattccatctgagcatgatcttgccaaagatgagcatttggacccaattaatgtaaaaatcgctgagctcagagaggcactagaatctgttacagctgagcaaaagtacttgaaagctcgtgatgcaaggcatcgccacacgaatgagagcacacgaaagcgtgttatattttacaccgtaggagagtaccttctgttggctggtgttagtgcactgcaggtcatatacatcaggcgccttttcagcaagtccgtggcctacaaccgcgtttaagcctcccctcctcctccttaacattatggcttccttctttatttatttagcaacagtgttgtgttctttgtgaccactgttttcactttcacagaaagtctgtgacttgtgtattatgataattcacagcaatgttagattctttagttttcgtttcaatggatttatagaatttata

SEQ ID NO: 5644 - DNA, 941 bp, Medicago truncatula
gaaaaacaagagaaaggatcaaaaccttctcaaaaatccaatctttaagatccacacaacacttctcaattttctcattctatttttcaattcagaaaaaatcacaaataaaaaaaccctaaaattcagaaaggggggaaaatgatggaaaagagaaacgcgaagatgtggatggcgttgatgtgtttggtgtttatcttcgttgatcgcattgaatcgttatctgtaactgtgcaagacgttgaatgtctctatgagtatgtgctttacgaaggggacaccgtttcggggaattttgttgtcgttgaccatgatattttctggagttccgatcaccctggcattgatttcacggtaacatctcctggaggtaatgttgtccaagatatcaaggggacatctggagacaaatttcaatttaaggccccagtacacggaatgtataaattttgttttcataacccatactcaacacctgagactgtttctttctatatccatgttggtcatattccctctgagcatgaccttgccaaagatgagcatttggacccaattaatgttaaaattgctgagcttagagaggcattggaatctgttacagctgaacaaaagtacttgagagctcgagatgcaaggcatcgccacacaaacgagagtacacataagcgtgttatcttctacactgttggagagtaccttctgttggctgctgttagtgcactgcaagtcatatacatcagacgccttttcagcaagtcagtggcatacaaccgtgtttgagtcccctccatcattaaccttatgctttccttcttttagttaagttaaattaaagggttaggggtttatagacttgtttctctgtgaaacattataattattattcttggtgaacattttgttgttctcttttcgtctttgacatcaattatgctttg

SEQ ID NO: 5645 - DNA, 953 bp, Lotus japonicus
gacgccaacagtggtgccgttttgcttcatcgccgcaccttcaccgcacagaccaaaacggatcacaattttctcaaacttgcaatcttctgagatctgagaaccacaattttgattccacagggtaaataaatgatggagggaaagagaattgcgaacaagatgtggatggttttgatgtgtttgatgctgagcttcgttgctcgcattgaatcgctctctgtcactgtgcacgaggttgagtgcatctacgagtatgtgctctatgagggtgacaccgtttccgggaacttcgttgttgttgaccatgacattttctggggctccgatcaccccggcattgatctcacggtgacatctcctgcaggtaatactgtccacgacatcaagggaacctctggcgacaagtttcaatttaaagccccagcttctgggatgtacaaattttgttttcataacccatactcgacacctgagactgtttccttctacatccatgttggtcatattcccaatgagcataaccttgccaaagatgagcatctggacccaattaatgttaaaattgctgagctcagggaggcactagagtctgttacagctgaacaaaagtacttgaaagctcgtgatactaggcatcgccatacaaatgagagcacacgctcgcgagtcatattctacactgtcggagagtaccttttgttggctgctgttagcacactgcaagtcatatacattaggcgccttttcagcaagtcagtggcctacaaccgtgtttgagacttagagtctcctgatgattaacgttatgctttctttctttagcaacagatgtgcaacaatatattccttttcttttcaacggacacattactcatgtttttatacccaacaggatttttaatttccttagtttgaagttcagtgtactatgacagaaattaaattaagcc

SEQ ID NO: 5646 - DNA, 1038 bp, Cicer arietinum
tacttttgctacttcagagtgagagaacgagaagatcacagaccttctacaaattcagtcttaagatctggaataacactctcaacactatttctattcttttcataccaaaaaaaattcccaaataataataataggggaaaagcgatggagcaagcgcagggaaagagaagcgcgaagatgtggatggctttgatgtgtttgatgtttatcttcgttgatcgaattgaatctttatctgttacagtgaacgacgttgaatgtatctatgagtacgtgctttatgaaggtgacaccgtttcggggaattttgttgtcgttgaccatgatattttctggagctccgatcaccctggcattgatttcacggcaacatctcctggcggtaatgttgtgcaagatatcaagggaacctcaggagacaagtttcaatttaaggccccagtacacggaatgtataaattttgtttccataacccttactcgacacctgagactgtttctttctatatccatgttggtcatattccctctgagcatgaccttgccaaagatgagcatttggacccaatcaatgttaaaattgctgagctcagagaggcactggaatctgttacagccgaacaaaagtacttgagagcccgtgatgcaaggcatcgccacacaaacgagagtacacatacacgtgttatcttctacaccgtgggagagtaccttctgttggctgctgttagtgtactgcaagtcatatacatcaggcgccttttcagcaaatcagtggcttacaaccgtgtttgagtcattaaccttatgctttccttctttagttaaattaattaaaggggtagtcagggttttcgacatgttttctctgtgaaacaatattatatagttattatattcatggtgaacacttgtttttctctgtccgacacagactttacttgtattttgatacaaggtttttaaaattccttggtctgaatagtagtggattttaactgaaaattaaatcgtgtgggagcaatacttcgtatg

SEQ ID NO: 5647 - DNA, 1583 bp, Cicer arietinum
attggctgatgcacgttgtatctctctctgcgttttacacgtaagctctttctaaacgacgcttcattcatatcgaataaactacccttcaagaccacgacgactagagtggtgccgttttgcacttccagagtgacgagaaacggagaaaggatcacagaccttctcaaaattcaagtctttaagatctgggaataacacttctcaaccacaattttcgtaattcttttttcattccaaaaaaaaaaaaattccccaaaataaataaataaataagggggaaaaagcgatggagcaagcgcagggaaagagaagcgcgaagatgtggatggctttgatgtgtttgatgtttatcttcgttgatcgaattgaatctttatctgttacagtgaacgacgttgaatgtatctatgagtacgtgctttatgaaggtgacaccgtttcggggaattttgttgtcgttgaccatgatattttctggagctccgatcaccctggcattgatttcacggcaacatctcctggcggtaatgttgtgcaagatatcaagggaacctcaggagacaagtttcaatttaaggccccagtacacggaatgtataaattttgtttccataacccttactcgacacctgagactgtttctttctatatccatgttggtcatattccctctgagcatgaccttgccaaagatgagcatttggacccaatcaatgttaaaattgctgagctcagagaggcactggaatctgttacagccgaacaaaagtacttgagagcccgtgatgcaaggcatcgccacacaaacgagagtacacatacacgtgttatcttctacaccgtgggagagtaccttctgttggctgctgttagtgtactgcaagtcatatacatcaggcgccttttcagcaaatcagtggcttacaaccgtgtttgagtcattaaccttatgctttccttctttagttaaattaattaaaggggtagtcagggttttcgacatgttttctctgtgaaacaatattatatagttattatattcatggtgaacacttgtttttctctgtccgacacagactttacttgtattttgatacaaggtttttaaaattccttggtctgaatagtagtggattttaactgaaaattaaatcgtgtgggagcaatacttcgtatgcaaaatggtaccctatacttacatgttcacaagtatttcttgagggtatgtatggttgtattggagttgagaggagagactattttatactttatatgtttcgtatagttgtctggttcaaatttttatggagggaatgcaaatgaaagggagagaggggatgagaggaattttacatgttttgtgtttagtttgaagatgagagatgagatatttcaatggaggaaaagtgtagacttactcttttttcacctttccataatttaatgtcactctaaataacaaaaatttaatgggagctgaagttggttcatgagagctttctctccatcccttttcatgtccttcaaaaaattgattcaaagaactattacttaaaatatttcctttcattcattttcac

SEQ ID NO: 5648 - DNA, 1047 bp, Trigonella foenum-graecum
gatggaacgagtgaagggaaagagaattgcgaagatgtggatggtgttgatgtgtttggtgtttatcttcgttgatcgaattgaatcgttatctgtaactgtgcaagaagttgaatgtctctatgagtatgtgctttacgaaggtgacaccgtttcggggaattttgtcgtcgttgaccatgatattttctggagctctgatcaccctggaattgatttcacggtaacctctcctggaggtaatgttgtccaagatatcaagggaacctctggagacaagtttcaatttaaggccccagtacatggaatgtataaattttgttttcataacccatactcaaccccggagaccgtttctttctatattcatgttggtcatattccctctgagcatgaccttgccaaagatgagcatttggacccaattaatgtcaaaattgccgagctcagagaggcattggaatctgttacagctgaacaaaagtacttgagagctcgagatgcaaggcatcgccacacgaacgagagtacacataagcgtgtaatcttttacactgttggagagtaccttctgttggctgctgttagtgcactgcaagtcgtatacatcaggcgccttttcagcaagtcagtggcatacaaccgtgtttgagtcccctccctcattaaccttatgttttccttcttttagttgagttaaattaaagggttaggggtttatagacttgttttctctgtgaagcattataattattattcttggtgaacatttggtactctcttttcgatacagacatcacttgtgctttgttacaacaagaatttttaaattcctcggtctgaatttcagtggattttgactgaaaattaaattgtgtgggagcaatactacttaagcaaaatggtaccttgtacttttatgtttgaattcaaccgagggttgaggggatgagagaaattttaatggaaaagaggggagaggttttagatatgtgttgtgtttggcttgacgatggcacaaatatgcataagttggttttcgattct

SEQ ID NO: 5649 - DNA, 1276 bp, Cannabis sativa
aggcccaacagaaagctgaagcccaaacttaagctccatcatcaatcatctagcaagtgttcgatcaaatctcataaagacgagtactgaatcttcacgttgtcctcctcctcatccttccttcagctccctaaataacatttataaaaccagttttgtcagccctaaaaataagattcagaacagagaaaagagaatcaatggacagaaaattgagatatgggaatgggtcctcgatggcccaattgctattgtgctttcttcttctgacgagcttcgttggacgaatagcttccctctcggtcacggtcaacgatgttgaatgtgtctatgagtacgttctttacgagggtgataccgtttctggcaattttgttgtagtcgaccatgatattttctggaacgccgatcaccctggcatcgatttcaccgtaagtgctcctggtggtaacaccgtgcacacattgaagggaacatctggagacaagtttgagtttaaggctcctcgaaatggaatgtacaaattctgttttcacaatccttactcaaccccagagactgtttcattctacatacatgttggtcatatccctaatgagcatgaccttgctaaagatgaacatttgaaccccattaatgttaaaattgctgagttgagggaggcattggagtctgtcactgctgagcagaagtatctgaaagcacgtgatgctcgtcatcgtcatacaaatgagagcacgaggaagcgtgttgtattctacacagttggcgagtatcttttgctggctgctgtaagctcacttcaggttttatacattcgccgtcttttcagcaagtcggttgcctacaaccgggtttgagctatgcattaacagcgttagtctgtgtcggtttagtaaaacaggatgaggcttgtaggtggttttggacgatttactttcacatcatttgcatacatgtatcaaagatgatttattattttattgctaacaactttgaaacttccaaacacagctataattgttgttttacagtttccacctttacttgtgtctcctatatccagacgaacttgacaaggtatagatacttatggaagaaagtaaaaaacaaacaaacaaaaaaactgagagaaggtgaaaagaaaaagggaaaaataaggtagtacgattggataaaattcttaacaaacaatgtgcttataattactgtttttagtgctgaatttggagtatgttatgttttttttttttttttgaacaaaagtgctatgtta

SEQ ID NO: 5650 - DNA, 1175 bp, Theobroma cacao
ggaagctcaaataaatgtgaaaagtccaaacatctggcttcttcgtgaaattgaaccaaatcaaatcagggaaaaaaaagttaaaaaaaaaaaactccaaatcgaaatccaaaaagatggaaaagggatggggaaagatgtgggctttgatggttttgcttcttttgaattgggtgagtaacgtctcctccctttcggtgaccgtaaacgaagtcgagtgcgtgtatgaatacgtgctttacgaaggggacacggtttcaggcaactttgtcgtcgtcgaccacgatattttctggagctctgatcaccccggcattgatttcactgtgacttctcctgggggtaatacagttcagaatttgaaggggacatctggggacaagtttgaatttaaggccccacgaagtggaatgtacaaattttgttttcacaatccctactctacaccagagactgtttctttctatattcacgttggccatattcccactgagcatgatcttgccaaagatgaacatttggacccaattaatgtgaaaattgctgagctgagagaggctttggagtctgtaacagcagaacaaaagtacttgaaagcacgtgatgctcggcatcgtaatacaaatgagagcaccagaaagcgtgttataggctacacagttggagagtacgttctgctagctcttgctagtgcacttcaagtcatctatatccgccagctcttcagcaaatcagttgcatacaaccgagtttgagccacctgattatacttttagttctctgttccattaaccagagagtcacagggacaaatcctatagatgagtcacgagttcaccaaaaatccgattcgtgtaacagatcatttttggtgttttatgttattcgagtcttgtatttcaattacaatgtagcttttcgaccctaaatgttttagactaactattatcaaatttgagctaccttttttttttttttccttatcctgagcctcattagcagctgtacaatgcttccatccagtctgatggagggctggcttaatagttaatattaataatggctgtcatgaataatagaagaatttgccaagtttggtttctcgcttctattgcaaagctaccattacttcagggaaaaaccctcaaaactgtcaatacagtaaaaaggattgt

SEQ ID NO: 5651 - DNA, 944 bp, Heritiera littoralis
gatccgatcgacaaacgtctagacttttgacttcttagcgaaagtgtaagaaatcaaatcgaaaaaaaaaaaactccccgaatcaaaaccatagaagatggagaggagatggggaaagatgacggctttgattattttgcttcttttgaattgggtgagtaacgtttcctccctttcggtgaccgtaaacgacgttgaatgcgtgtatgagtacgtgctttacgaaggagacacggtttcaggcaactttgtcgtcgtcgaccacgatattttctggagttctgatcaccccggcattgatttcactgtgacttctcctgggggtaacacagttcagaatttgaaggggacatctggggacaagtttgaattcaaggccccacgaagcggaatgtacaaattttgttttcacaacccgtactctacaccagagactgtttcattctatattcatgttggccatattcccactgagcatgatcttgccaaagatgaacatttggacccaattaatgttaaaattgctgagctgagagaggctttggagtctgttacggcagaacaaaagtacttaaaagcacgtgatactcgccatcgtcatacaaatgagagcacaagaaagcgtgttataggttacacagttggagagtacattctgctagctcttgctagttctcttcaagttatctatattcgccgtctgttcagcaaatcagttgcatataaccgagtatgagccacctaattattaatttagtttctctgttccatcaactagaggatcacagggagaatcctatagatgagttcacaaaaatctgaatcgtgcaactaaacggtatggtgtttatgtttattcagtctggtatttcaattacattgtagttttttctgacttggcatgtgttttagactaatttttataagtttgagttgctttttaa

SEQ ID NO: 5652 - DNA, 1058 bp, Populus trichocarpa
gtaaataacaaataataataacgcaaaaggcaatttcacggacaaaagaacccaactttctcatctctgcaataaacgaagaagctaaaatagtttttattattttttagaaaaagaaaaaaatcacaaaatccagagagatagagggatagatcagagatggagaggaggagaaagcagatctacgtagtggcagctcttttaatgagctttattagccgcatctattctctctccgtcaccgtaaacgacgtcgaatgcgtttacgagtatgtcctctatgaaggcgacaccgtttccggaaacttcgttgttgtcgatcacgacatcttctggggctccgatcaccccggcatcgatttcactgcaacatctcctggagataatacggtgcacactgtaaaggggacatctggagataagtttgagttcaaggctccaagaagtggaatgtacaaattttgttttcacaatccctacgcaacacctgagactgtctcgttttatattcatgtgggccatattcccagcgagcatgaccttgccaaagatgagcatttgaacccagttaatgttaaaattgctgagctgagggaggcattggagtctgttacagcagagcagaggtacttgaaagcccgtgatattcgacatcgtcatactaatgagagcacaagaaggcgtgtcatagcctacacagttggagagtaccttttgctggccgctgccagcacactccaagtcgtgtatatccgtcgtctcttcagcaagtcagtggcatataacagggtttgagccctgattaagtcagtgacatataacatgctgaatttgataagacaacttttgcacaaatgtatggtctgttgtttcatggttgtttagttttcgcatttcatttataatacaaagtttagaacccatatttatttcaacttctcatctttgatttttgtctattatattccgaatcttaacatgttgacgtattgggtatctgcaatggtcattatctaggaggcggctttctttgggccctggaaagtgtaaaaccatgg

SEQ ID NO: 5653 - DNA, 798 bp, Momordica charantia
agagagagaggagattcggatacctgttggcgggtcttcttctggtgagcctaatcgccggaatcgattccatttcagtcaccgtgaacgagattgaatgcgtctacgagtacgtattgtacgaaggcgacaccgtttcaggaaatttcgtggtggtcgatcatgacattttctggggcgccgatcaccccggcatcgactttactgttacatcccccgcaggtaatgtggtacactctttgaaggagacatctggtgacaagtttgagtttaaggctcctcgcagtggaatgtataaattttgttttcacaatccctactcgactccggagaccgtttctttccacatacatgttggtcatattccaaacgaacatgaccttgccaaggatgaacacctagacccaataaatgttaaaattgccgagcttagagaggcattggagtcggtcactgccgagcagaaatatttgaaagcacgtgatacacgccaccgtcacacaaatgagagtacaagaaagcgtgtaattttctacacagtgggagagtatttgttgcttgctgttgtaagtggccttcaggtcatttacatccgtcggctcttcagcaagtcggttggatataaccgggtgtgagcatcctagtctcttaacattgttgtctgtttgttagatttcaggaaccttagaaatgaattatagacaatcatatgttgaaaaagttacattggtatattatataatcttcacttttttgactatgctacagcttttaattttaataagttgggttctttag

SEQ ID NO: 5654 - DNA, 964 bp, Salvia sclarea
aatcgttggatcgtagttcaatggagacgacgggagggattacgaggtgcggcggggcagcctacgcccttttaggcctccttcttctcagcgcgcttagccgtatctcggcgctttcggtgacggtaaacgacgtcgaatgcatatacgagtacgtcttgtacgagggcgacaccgtttcggggaatttcgtcgtcgtcgatcacgacatcttctggagctccgatcatcctggaatcgacttcacggtaacatcgccagcaggtaattctgtgcacactttgaaaggaacatctggggacaagtttgagtttaaggcccctagaagtggaatgtacaaattttgcttccacaacccatattctacaccggagacagtctctttctacattcatgttggccatattcccactgaacatgaccttgcgaaggatgaacatttggaccccattaatgtcaaacttgctgaactgaaggaagctttggaatctgtgactgcagagcagaagtacttgaaagctcgtgatacacgtcatcgccatacaaacgagagcacgagaaggcgtgtcatattttacacggttggggaataccttttgctagcgctagtaagcggacttcaggttgtctacatacgccgcctgtttagtaaatcggtcgcatacaaccgtgtttgatcaaactgctagctacattcctctcctcaaatctggtctgattgttgagctggggaagaacatggcgcggtttgtacaacagaaatggtttttgtccttatttaattttaactgcccttgttgtttgaaatcaccgagcaactccttagttatacgtgatttagttagaggaatcttgagtatgtaatttatttcagttagttcttgatgatcgtcagatttttgactgaggtttcatcaagtacaccccaataaatctctatcgtcagctgatttgggctattgca

SEQ ID NO: 5655 - DNA, 660 bp, Fagus grandifolia
gagaggagagagagatgcggtaagatgtgcatgttaatgggtatggtggtgatgagctttttgattgggagaatatcatcgctatcggtcacggttaacgacatggagtgcgtctacgagtacgtgctctatgaaggcgacaccgtttcgggaaacttcgtcgtcgttgaccacgacatcttctggagctccgatcaccccggcatcgatttcaccgtgacatctcctgcaggaaatgtagtgcaaactttaaagggaacatctggggaaaagtttaacttcaaggccccacgaagtggaatgtacaaattctgttttcataatccttactcgacaccagagactgtttctttctacatacatgttggtcatattcctaacgagcacgacctcgccaaagatgaacatttggacccaataaatgttaaaattgctgagctgagagaatcattggagtctgttacagcagagcagaagtacttaaaagcacgtgatgctcggcatcgtcgtacaaatgagagcacacggaagcgtgttatattctacactgttggagagtacattttgcttgctgctgcaagtgctctgcaagtcatctatatacggcagctcttcagcaaatctgtggcatacaaccgagtttgagctgccttggttatt

SEQ ID NO: 5656 - DNA, 841 bp, Castanea mollissima
caaaaacccaaaattgaaggaaaaggaaaatggaggtaaggtctgagaagaagatgtggatggtgttggtaatggtaacgctgagcttggttggaaaaatatcgtctttatcggtgacggtaaacgaggtggagtgcgtgtacgagtacgtgctctacgaaggcgacaccgtttcaggaaatttcgtggtggttgaccacgacatcttctggagctccgatcaccccggcatcgatttcaccgtgacatctcccgcaggtaacgtggtgcaaactttaaagggtgtttctggggacaagtttgacttcaaggccccacgaagtggaatgtacaaattctgttttcataatccttactcaacaccagagactgtttctttctacattcatgttggtcatattcccaatgagcacgacctcgccaaagatgaacatttggacccagtaaatgttaaaattgctgagctgagagaggcattggagtctgttacagcagagcagaagtacttaaaagcacgtgatactcggcatcgtcatacgaacgagagcacccgaaagcgtgttttattctacactcttggagagtatcttttgctggctattgcaagtggtctgcaagttatctatatacggcagctcttcagcaaatctgtggggtacaaccgagtttgagctgcctgattaatgtttatgtctgtttagcactagatgaggcttatagatgagtttcttttgtgaaacaaaaatatgctggtttatactttatactattaatttattgcttctgaactacaatgtgagttttaagcaaaatgactgatttagcttaccttaaattcaaa

SEQ ID NO: 5657 - DNA, 935 bp, Tabernaemontana elegans
aatcacagtaataaatcgaaatccgaaaagggttttgaggggtgggctctgagcctgaaaatcgccataggatagtagattgaaagatggagaagagaagagataggaccgggtgcctgaaggtttatgggcttgtcgtgctcctgcttttaagctttgtcggagacctctctgtctcggcgctgtctgtaacggtaaacgatgttgaatgcgtgtatgagtacgtgctttatgaaggtgataccgtttccggaaacttcgtcgtcgtcgatcacgatattttttggagttcagatcatcccggcatcgacttagtcgttacagctcctggaggtaacacagtgcacactgtgaagggaacgtctggggagaagtttgaatttaaggccccaagaagtgggatgtacaagttttgttttcacaatccttactcaacacctgaaacagtatctttctacattcatgttggccatattcctagtgaacatgaccttgctaaagatgagcatttggatccaataaatgttaaaattgccgaattgagggaggcattggaatctgttacagcagagcagaagtacttgaaagcacgtgatgctcgtcatcgccatactaacgagagtacacggaagcgtgttatcttttatactgttggagagtacattttactagctctagcaagtgcactccaagtcatctatattcgacgcttgttcagcaaatcagttgcctacaaccgggtctaatgaattccctaagactgccagactaggtattctggtttctgttttcttcaaaggattggatcaatgtaagttagacaatgaacttagagaagcaattttttcttttttttaacatgtaacgaaacgtaatactttttcatacttgtccattctatcacacactttaatagatcatcgatctgattgttt

SEQ ID NO: 5658 - DNA, 1093 bp, Mimulus guttatus
gtatccaataatatcactccacgtagataaacacacacacaaatcaaagacccaaaaaccagttcacataatattgctacacgacgaccgacttcactttcggggctccgaatagatagttagatccagttcacaatggagagggggaggggaggaattatccggtgcggcgcggcggcgtacgctcttctgtgcctcctgattttgagcaccgtgagccgtgtgccggcgctttcggtgacggtcaacgacgaggagtgcatatacgactacgttttgtacgaaggcgacaccgtttccggcaatttcgtcgtcgtcgatcacgatatcttctggaactccgatcatccaggcatcgacttcactgtgacatctccagcgggtgataccgttcacaatctgaaaggaacatctggtgacaaatttgagttcaaggcccctaaaagtggaatgtacaaattttgtttccataatccattttccacgccagaaacagtctctttctatatacacgtcggccatattcccaccgaacatgacctagcaaaggatgaacatttggaccccattaatgtcaaaattgctgaactgagggaggcactcgaatctgttacggcagagcagaattacctgaaagcgcgcgatacacgtcatcgtcataccaacgagagcacaagaaagcgcgtcatattttacactgtcgcagaatacattctgctagcactcgtaagtggacttcaggttgcgtacattcgtcgtttgttcagcaaatcggtggcatacaatcgtgtctgattacactcggaaaatatttttcctctagaaatgcttctaatgtgaagggtaaaaaggtaaaaagagtgaggaggaaagtgaattgtgtggttttgtatactgaaaatggtaatttattttgcagcccttttgattatttatttagggaatctagatatagatgtgaaatactgaacctagttttctcatgggatttattatgaattgccgacagatgattgatcttttctcaaacctttttagaggataattaatattaatcttctgtattaaatattaattactgaacttgaatttt

SEQ ID NO: 5659 - DNA, 917 bp, Manihot esculenta
acgaacttgaacaattctttctttgcgctgagctgagcttctggttttggatctcttgagcatccggggtgaagcaaacaaacaataatcagaattcagaaagagaggcatagggatggagagaaggcagatctacgtagtggcagctcttctatttaccctaattggccgtatatcttctatctccgtcaccgtgaacgacgttgaatgcgtctacgagtatgtcctctacgaaggcgacaccgtttctgggaacttcgtggtggttgatcacgacattttctggagctcggatcacccaggaattgatctcaccgtgacatctcctgcagataatgtggttcacactgtgaagggaacatctggggacaagtttgagtttaaggccccaaaaagtggaatgtacaaattctgttttcacaatccctactcaacaccagagactgtatccttctatattcatgtgggtcatattccgaatgagcatgatcttgcaaaagatgagcatttgaatcctatcaatgtgaaaattgctgagctgagagaggcattggagtctgttacagcagagcagaagtacttaaaagcacgtgatgctcgacatcgccgtaccaacgagagtacacgaaagcgcgttataggctacacagtgggagaatacattttattggctattgtaagcgtacttcaggttgtatatattcgtcgcctcttcagcaaatcagttgcatacaaccgagtctgagcccccttattttctgttaattatagaggagttcagagaaatgtttcaatgcacttgaaaaaagttaaccgatggtttatgctgttcaatttttgtacttcaaccataatgcaattttagaacttcaagatatagtttagctctctctctctcattgtttttcatttaaaaa

SEQ ID NO: 5660 - DNA, 1388 bp, Citrullus lanatus
ttccataatgaaagggctagttttccgtaaacaaagagaacaaagggtagttttacaaattgaatgggggcaaagggcttcctaaccccgttcagcattgttagatttcggaccaagaaagatctgtagaggaagaagaaacccgaaaaggagagaaaatggagaggaggctgagagagaaaggattccgatatctgttggcgggtcttcttctggcaagcctaatcgccagaatcgattcaatttcggtcactgtgaacgagattgaatgcgtctatgagtatgtattgtacgaaggcgatactgtctcggggaattttgtcgttgtcgatcatgatattttctggggcgctgatcatcccggcatcgatttcactgttacatctcccgcaggtaatgtggtacattctttgaaggagacatctggtgataagtttgagtttaaggctcctcgcagtggaatgtacaaattctgttttcataatccctactcgactccggagacagtttctttctacatccatgttggtcacattccaaatgaacatgaccttgctaaagatgaacacctagaccctataaatgttaaaattgcagagcttagagaggcattggagtcagtcactgctgagcagaagtatttgaaagcacgtgatgcacgccaccgtcacacaaacgagagtacaagaaagcgtgtaattttctatacagtgggagagtatttgttgcttgctgttgcaagtgggcttcaggtcatttacattcgtcggctcttcagcaagtcggttgcttataaccgggtctgagcatccatcctagtggtaacattgttgtctctttaggtttcagaaaccttaggaatgaattataaactatcatttgttgaaaaagttacattggtatattatataatcacttttgactatgctacagttaattataagttgggttcaagtgttagcatcttcttgaagatagggagaagccatttaccctataatagtataatgcttcaaagggggatgtatgtggctatcctcattgcccctccattattatgagaagttgaaagtctatatacactaaaactagatcaatatactactcatcaaattgaaactgtgtgaaatgagttcattgtcatgctgattaggcaccaattatcattttaaggttgacgtttgatctctatctactattgttcatactcataggagatgagaaataaaaaaaacgtctctactttatagtctctaaccatttgtaagagatggttaaatccctcaccatatttctgatggtataatctaaggaagaatatgactggagtttgggaagggttggcatattttgggtttgatgtcggagcttgttagaatttcttttcc

SEQ ID NO: 5661 - DNA, 772 bp, Tripterygium wilfordii
cggagagggagaccgagatgtggagggggaatatacttgttggctttgttgattgtgagctctattggacgaatttcgggtctatcggtgactgtgaccgacaaggagtgcgtccaggattacgtcctatatgaaggcgacaccgtctccgggaactttgtggtggtcgaccacgacatcttctggaacagcgatcatccaggaatcgatttcaccgtgacatctccagcaggcaatgttgtgcagactttcaaggggacatccggggacaagtttgagtttaaggcaccacgaagtgggatgtacaaattctgctttcataacccgtattcaactccagagtcagtctccttttacatccatgtgggtcatattcccagcgagcatgaccttgcaaaagatgagcgatttggacccaattaatgttaaaattgctacattgagagaggcattggagtctgttacagcagagcagaagtatttgaaagctcgtgatgctcggcatcgtcacacaaatgagagcacaagaaagcgcgtcataggttacactgttgcggagtactttttgctgggcgctgcaagtgcacttcaagtcatatacatacgtcgccttttcagcaagtctgttgcatacaaccgggtttgagacaactgattaatgttactagatgttcttaagcaacagggataattcaattagttgaggttggcaggaagtaaattatgcaacagaacagtatgctctcatgtacaattgtttattttacacatt

SEQ ID NO: 5662 - DNA, 1121 bp, Mimulus guttatus
gtatccaataatatcactccacgtagataaacacacacacaaatcaaagacccaaaaaccagttcacataatattgctacacgacgaccgacttcactttcggggctccgaatagatagttagatccagttcacaatggagagggggaggggaggaattatccggtgcggcgcggcggcgtacgctcttctgtgcctcctgattttgagcaccgtgagccgtgtgccggcgctttcggtgacggtcaacgacgaggagtgcatatacgactacgttttgtacgaaggcgacaccgtttccggcaatttcgtcgtcgtcgatcacgatatcttctggaactccgatcatccaggcatcgacttcactgtgacatctccagcgggtgataccgttcacaatatgaaaggaacagctggtgacaaatttgagttcaaggcccctaaaagtggaatgtacaaattttgtttccataatccattttccacgccagaaacagtctctttctatatacacgtcggccatattcccaccgaacatgatctcgcaaaggatgaacatttggaccccattaatgtcaaaattgctgaactgagggaggcactcgaatctgttacggcagagcagaattacttgaaagcgcgcgatactcgtcatcggcataccaacgagagcacaagaaagcgcgtcatattttacactgtcgcagaatacattctgctagcactcgtaagtggacttcaggttgcgtacattcgtcgtttgttcagcaaatcggtggcatacaatcgtgtctgattaccactcggaaaatatttttcctctagaaatgcttctaatgtgaagggtaaaaaggtaaaaagagtgaggaggaaagtgaattgtgtggttttgtatactgaaaatggtaatttattttgcagtccttttgattatttatttagggaatctagatatagatgtgaaatactgaactttagttttctcatgggatttattatgagttgccgatagatgattgatcttttctcaaacctttttagaggataattaatattaatcttctgtattaaatattaattactgaacttgaatttttaatatttaatccaactgaattttct

SEQ ID NO: 5663 - DNA, 1060 bp, Ricinus communis
gccgtgataaaatgaggtggtaaataaaaagcgaaacgggtataacgagcgcgccatgtcagcagcagctgctaaaaatcgaagacagcgcctgtcttccctgcccctgattaataaacaaagcttctgtttttcaatctctgaaaaattcacaaattaaaaaacaaaaacgaaagagagagtgaaagacgatgacgagaaggcagatctatgtagtggggattttattattaatgaacctgatagggcgcatatcttcgctatccgtaacagtaaacgacgtcgaatgcgtgtacgaatacgtactatacgaaggcgataccgtttcaggaaacttcgtcgttgtcgaccacgatatcttctggagctccgatcaccccggtattgatctcaccgtgacatctcctgcagataatgtagtgcacactgttaagggaacatcaggggacaagtttgagtttaaggcccccagaagtggaatgtataaattctgttttcacaatccctactcaacaccagagactgtttctttctatattcatgtgggccatattcccaatgcgcatgatcttgcaaaagatgagcatttgaatcccattaatgttaaaattgctgagcttagagaggcattggagtctgttacagcagagcaaaagtatttaaaagcacgcgatgctcgacatcgccgcactaatgagagtacaaggaagcgtgttattggctacacagttggagaatacattttgttgggtcttgtcagcacacttcaggttgtatatattcggcgcctcttcagcaagtcggtggcatacaaccgggtctgagccacccgattgtttgttaattaatgatagggtgaattttttagatgagttcagaggagtgcgtgttgcaaatatagacatgttatgttgttctatactgttcaatttgttcatttcaactatgaattaagttttgaacataaagatctagtgactactttcatcttcatgggctctgctcttatgttattttatgatgattgtcgacattggttgaaagttgcatgtttatgctg

SEQ ID NO: 5664 - DNA, 1067 bp, Ricinus communis
gccgtgataaaatgaggtggtaaataaaaagcgaaacgggtataacgagcgcgccatgtcagcagcagctgctaaaaatcgaagacagcgcctgtcttccctgcccctgattaataaacaaagcttctgtttttcaatctctgaaaaattcacaaattaaaaaacaaaaacgaaagagagagtgaaagacgatgacgagaaggcagatctatgtagtggggattttattattaatgaacctgatagggcgcatatcttcgctatccgtaacagtaaacgacgtcgaatgcgtgtacgaatacgtactatacgaaggcgataccgtttcaggaaacttcgtcgttgtcgaccacgatatcttctggagctccgatcaccccggtattgatctcaccgtgacatctcctgcagataatgtagtgcacactgttaagggaacatcaggggacaagtttgagtttaaggcccccagaagtggaatgtataaattctgttttcacaatccctactcaacaccagagactgtttctttctatattcatgtgggccatattcccaatgcgcatgatcttgcaaaagatgagcatttgaatcccattaatgttaaaattgctgagcttagagaggcattggagtctgttacagcagagcaaaagtatttaaaagcacgcgatgctcgacatcgccgcactaatgagagtacaaggaagcgtgttattggctacacagttggagaatacattttgttgggtcttgtcagcacacttcaggttgtatatattcggcgcctcttcagcaagtcggtggcatacaaccgggtctgagccacccgattgtttgttaattaatgatagggtgaattttttagatgagttcagaggagtgcgtgttgcaaatatagacatgttatgttgttctatactgttcaatttgttcatttcaactatgaattaagttttgaacataaagatctagtgactactttcatcttcatgggctctgctcttatgttattttatgatgattgtcgacattggttgaaagttgcatgtttatgctgcgcttct

SEQ ID NO: 5665 - DNA, 1026 bp, Carica papaya
gcactcgattcgcagaagatagaaaatcaaaataaattgtaacggagggaccggaggagaagaagactatggagatacagcggagacatcggaatacgctagtactttgtttcataggtattctcttgttcagcttcattgagcgtataagctgcctatcggtgacggtaaacgaccaagaatgcgtctacgagtacgtcctctacgaaggagacaccatttcgggaaacttcgttgtcgtcgatcacgacatattctggagctcagatcaccctggcatcgatttcacagtgacatctcccgctggtaataccgtgcatactttgaaggggacatctggagacaagtttgagtttaaagcccccagaagtggaatgtacaaattttgtttccacaatccctacaatacaccagagactgtctcattctacattcatgttggtcacattcccaatgagcatgacctggctaaagacgaacatttagacccaataaatgtcaaaattgcagagcttagagaagcattggaatctgtaactgcagagcagaagtacttgaaagcacgagatgctcggcaccgacacactaatgagagcacaagaaaacgtgttataggatacacagttggtgaatatattttgctggctattgcaagtgctcttcaggttgtttatattcggcgcctcttcagcaagtcagttgcatacaaccgggtttgatcaatctggttaatggtaatctgttcaattagcgacaggatgaatagatggattgcaaaaaggaaagctttagcatatactatttgtttctatttattgcaatccactttaactgcaacttccaagtatatgtaatgggtgaacttcctagggttttgaacaagtttactcaatttaatgccttggccttggaggttttgtggagtctcaattctagaaactgcaattcttggtattattacttctgttctcaaaactggtagactgtaggagaagctggaggttcgagaacaatcaacttaagtga

SEQ ID NO: 5666 - DNA, 917 bp, Quercus alba
aaacccacccacaaaattgaaggaaggagaatcaggaaaatggaggtaaggtctgagaagaagacgtggatggtgatggtaatggtactattgagcttgactggaaaaatatcctctttatcggtgacggtgaacgaggtcgagtgcgtgtacgagtacgttctctacgaaggcgacaccgtttcaggaaatttcgtggtggttgaccacgacatcttctggagctccgatcaccccggcatcgatttcaccgtgacatctcccgcaggtaacgtggtgcaaagtttaaagggtgtttctggggacaagtttgacttcaaggccccacgaagcggaatgtacaaattctgttttcataatccttactcaacaccagagactgtttctttctacattcatgtcggtcatattcccaatgagcatgaccttgccaaagatgaacatttggacccagtaaatgttaaaattgctgagctgagagaggcattggagtctgttacagcagagcagaagtacttaaaagcacgtgatactcggcatcgtcatacaaacgagagcacccgaaatcgtgttatattctacactgttggagagtatcttttgctggctattgcaagtggtctgcaagttatctatatacggcagctcttcagcaaatctgtggggtacaaccgagtttgagctgcctgattaatgtttatgtctgtttagcactagatgaggcttatagatgagtttcttttgtgaaacaaaaatatgttggtttatactttatactattaatttattgcgtctgaactacaatgtgagttttaagcaaaatgactgatttagcttaccttaaattcagattttcgtggttttagaaaatgggtgtggattgtgatgaatagaaacaatagtagttttttttaata

SEQ ID NO: 5667 - DNA, 822 bp, Amsonia hubrichtii
tttttgaggggtgggctctgtatctgagaatcgccacagcaagatggagaagagaagagaaaggatcgggtgcatgaaagtttatgggcttgtcggtctcctgcttttaagctttgtcggaaacctatcggtctccgcactatctgtgactgtaaacgatgttgaatgtgtctatgaatacgtgctatacgaaggtgataccgtttctggaaacttcgtcgtcgtcgatcacgacatcttctggagttccgatcaccccggaatcgacttaattgtgacagctcctggaggtaacacggtgcagactttgaagggaacatctggggataagtttgagtttaaggccccaagaagtgggatgtataagttctgttttcacaatccttactcaacacctgaaacagtctctttctacattcacgttggtcatattcctactgaacacgacctagctaaagatgagcatttggatcccataaatgttaaaattgctgaattgagggaggcattggaatctgttacagcagagcagaagtacttgaaagctcgtgattctcgtcatcgacatactaatgagagtacaaggaagcgcgttatcttttacactgtcggagagtacatcttactagctcttgcaagtgcacttcaagtaatctatattcgacgcttgttcagcaaatcggttgcctacaaccgtgtctaatgaaactccccaagcaggctagttgttttggtcttttttcttggaaaaattggatcaatgtaagttagacaatgagcttagagaaatgattttttgatgtgtaacaaaagatatactgt

SEQ ID NO: 5668 - DNA, 1230 bp, Brassica rapa
tttgtttttctttatttttttatatatctatattcatttttcttcttgtgatctatttttgtgaaacttgaaaatagtttatgtaggagaattgtcccttcaaatatcaaggtaagcccatcataaagtctaatgtttaaagaccagaggcaaatcagttgaccgctcccaaacgtcaccgtttcatcattaacccggtttggtttctggtttactcaactaaacgcaattaaatcgtctcgtcttcttccacgccacgccctacgcattttttatcgagaaacaaacggaaaattttgatccaaaggagagagtaaaagatctagatggagagaagacaagcgcggagctcgaagatccatgtctttgtattggtctgtctgatactgtttagctcgatcgagcgaatctcatcgctctcggttactgttagcgacgatgaatgcgtacaagagtatgtcctctacgaaggagataacgtctccggaaacttcgtcgtcgtcgaccatgatatcttctggggatctgatcatcccggtttggatttcacggtgacgtcacctgctgggaacatagtacatacgttgaagggaacatcaggagataagtttgagttcaaggcaccaagaagtggaatgtacaagttttgtttccacaacccttactctactcctgaaactgtctccttctacattcacgttggtcatatccccaacgagcatgacttagctaaagacgagcatttggacccggtgaatgttaagatagctgagctgagagaggctttggagtctgttgtttctgagcaaaagtatttgaaagcacgtgatacccgtcaccgtcatacaaatgagagcacgagaaagcgagtgatattctacacagtaggagagtatatattcctagcagcagcaagtggtcttcaggttctctacatccgcaagctcttcagcaagtcggttgcatacaacagagtttgaacatataatttcaaggttttatctccttttttattgtcttggaatcggtaaacacaatcataaacaagtgttagttaattaagaccctaatagctaaaagacctcctttattttgtttccagtgtctacaatctttattggcttaagtttacttatgttttaacatgaagaaacttgataagcttactatattcttgcttcttctctctgctatgatcattgttggcttgtttaaagcattcacgctcgc

SEQ ID NO: 5669 - DNA, 776 bp, Gerbera hybrid cultivar
gaacagagagatcgatgaaagtgtatgctgtgttggggcttcttctcctttctactttcgcaggcgatgtatcagcgctctcagtcacggtgaacgacgtcgagtgtgtatatgagtatgtactttacgaaggcgataccgtttcaggcaattttgttgttgttgatcatgatatcttctggagttccgatcaccccggaatcgacttcattgtgtcttctcctggagggaatgtagtgcacacaatgaagggaacatctggggacaaattcgagtttaaggctccacgaagtggaatgtaccaattctgtttccataatccttactcgactccagagactgtctctttctacatacacgttggtcatattcccaatgaacacgaccttgcaaaagatgagcatttggaccctgtcaatgttaaaattgctgaattgagggaagcgctggaatctgtcaatgctgaacagaaatacttgaaagcacgtgatgctcggcatcgccatacaaatgaaagcacgcataaacgggttatattttatacaatcggagaatatatattgctggctcttgcaagcggactccaagtggtttacatacggcggctgtttagtaagtcggttgcatacaaccgcgtgtgagtggctctgtatcgtttttatagactagaattccggaacatgttggttcattgtgatcttgttatttatttttttagagcttttcggtgttttacggttttacccttttacgtacttaaattaatgcagtattac

SEQ ID NO: 5670 - DNA, 812 bp, Vinca minor
gatgagaagagataagatccggtgcctgaaggtttatgggcttatcatgctccttcttctcagcttcgccggagacatctccgtaacggcgttgtccgttacagtaaacgaagtcgaatgcgtgtacgagtacgttctttacgaaggcgataccgtttctggtaacttcgtagtcgttgatcacgatatattttggagttcggatcacctcggcatcgatttagttgtgacagctcctggaggtaacacagtgcaaactttgaagggaacatctggggataagtttgagtttaaggctccaagaagtgggatgtacaagttttgtttccacaatccttacccaacacctgaaaccgtctctttttacattcatgttggtcatattcctagtgagcatgaccttgccaaagatgagcatttggacccgataaatgttaaaattgctgaattgagggaggcattggaatctgttactgcagagcagaagtacttgaaagcccgtgatgctcgtcatcgccacactaatgagagtacccgaaagcgcgttatcttttacacagttggagagtacatattactagctctagcaagttcacttcaagtcgtctacattcgacgcttgttcagcaaatcagttgcctacaaccgtgtctaatctactaatgaactgccctagacttgttaggtcttttggttttctcttctcttcaaagaattggatcaatgtataagttagacaatcaattttttgctttacgtgtaacaaaagggatacaacagattatcatttatgtcaatttttgctcatgttt

SEQ ID NO: 5671 - DNA, 1067 bp, Olea europaea
aaaatggagagtaggaggggcaggttccggtgtagcagcaaggcggcgtacgccttgacgggtttgtttctattgagcttggtgagccgtctatcggctttatcggtaacggtgaacgaagaagaatgcgtatacgaatacgtattgtacgaaggggacaccgtttcggggaatttcgttgttgttgaccacgatattttctggagttcggatcaccccggcattgatctcactgtgacatctcctggaggtaatacggtccatactttgaaaggaacatcaggggacaaatttgagttcaaggcccccagaagtggaatgtacaaattctgtttccataatccttattctacaccagaaacagtctctttctacattcatgttggtcatattccaagtgaacatgaccttgccaaggatgaacatttggaccccatcaacgtcaaaattgctgaattgagggaggcattggagtctgttacagctgagcagaagtacttgaaagcacgtgatggtcgtcatcgtcacacaaatgagagcactcggaggcgagttatattttacacagttgcagaatacattttgttagctgttgcaagtgcactccaagttgtgtatattcgtcgcttgttcagcaagtcagttgcatataaccgtgtttaatggatctggtgaagctggccgtctgtaccccccaaacctgagtcagagacatggagaaaatcacatgcctgtataataaaaagatcttggattgatagtcgtttttcttggaatcagaaagctttggattttgttttccttctgatgattgtgaaatatttattttaggggtaatctttttcccccagagatacggttctgaagtttgaagccttcattactgtttctcatctcattacctggttagccatgccggttttcgactccaaatatccatgtgaaatgcgtcaaggttgaagcacttaatcatcgctggattttcaactgcatgacgaaaaatttctttctacataaatactttatcaggaagtttatatggaataaccattcgacttgcatgacaa

SEQ ID NO: 5672 - DNA, 855 bp, Rhizophora mangle
ggaggtatttctgaaatcgtcgaatcccaaaaagcatcggacgaacacaaacgaagaaagagaaagagagagagaaatggagagaaggcagatctgcgtggtggcagctctgttgctgacattcatatgccggacggcttccctctccgttaccgtacacgacgtcgagtgcgttgaggagtacgtcctctacgaaggcgacaccgtctccggcaacttcgtggtggttgaccacgaaattttctggagctccgatcaccccggcatcgatctcattgtgacatctcctggaggcaacacagtgcacactgtgaagggcacctctggggacaagtttgagtttaaggctccaaagagtggaatgtataaattctgtttccataatccccaatcagcaccggagactgtatctttctatattcatgtgggccatatacccaatgagcatgaccttgccaaagatgagcatttggaccctattaatgtcaaaattgctgagctgagagaggcattggaatctgttacggcagagcagaagtatttgaaggcccgtgatgctcgacatcgtcatacaaatgagagcacgcgtaggcggtcattgcctacactgttggagagtactttttgttggctgccgtcagtgctcttcaagtcatatatattcgacgccttttcagcaagtccgtggcatacaatagggtttaaggcccttgtttaagttatgggccattgactgatgacaagataaaaactctagagacgaatccagaaagatgtgcctttgcataaaatgaaaatctgcttgtttagactgttgagattttgtatttcaattatgctaacgtatccaaaaaa

SEQ ID NO: 5673 - DNA, 934 bp, Olea europaea
gaaaaaatggagagtagaaggggcagcatcaggtgtagcagcaaggcggtgtgcaccctgattggcttgttactattgaactcggcaagccgtctatcggctctatcggtaacggtgaacgacgtggaatgtgtatacgaatacgtattgtacgaaggcgacaccgtttccgggaatttcgtcgttgttgaccacgatattttctggagttcagatcaccctggcattgatttcagtgttacatcccccgacggtaatacggtccatacattgaaaggaacaccgggggataaatttgagtttaaggccctcagaagtggaatgtacaaattctgtttccataatccttattctacaccagaaacagtctctttctacattcacgttggtcatattcccagtgaacatgacctcgccaaggatgaacatttagaccccatcaatgtcaaaattgctgaactgagggaggcattggagtctgttacagcagagcagaagtacttgaaagcacgtgatggtcgtcatcgtcatacaaatgagagcacacggaggcgcgttatattttacacagttgctgaatacattttgctagctcttgctagttcactccaagttgtgtatatacgccgcttgttcagcaagtcagttgcgtacaatcgtgtttaatgaaatcttgtgaagcttgctgtccgttccccacaacctaattcttgaaccgttaaccttgacgtttggagagaatcacatgcttgttaacaaaaagatgatcttggattgatagtcttttttctttggaatcagaaagcaacttcttgatgataatgtatttagtcttccacaggtgattgtgaaatattcattttagtggtagggaggatattaattgctgcacgagtaaaatggaatattcgtttttgtttcaaaaagaaagcct

SEQ ID NO: 5674 - DNA, 818 bp, Cleome spinosa
gggagaaacaaacggagaatttcgggcgaagacgacgaagatggagacaggacaagccagagatccgaagagtttgttggtcggtctgttactactgagtttggtcggaagaatttcgtccctctccgtgacggtgaacaacgtagaatgcgtctatgagtacgttctctacgaaggcgacactgtgtcgggaaatttcgtcgtcgtcgaccatgatatcttctggggttcggatcaccctggtcttgatttcgaggtctcatcccctgcagggaatgtcgtacacagtttaaaaggaacatctggagataagttcgagttcaaggcaccgaaaagtgggatgtacaaattctgcttccacaacccctactctacaccggaaactgtctccttttatatccacgtcggtcatattcccaatgaacacgatgtagccaaagacgaacacttggacccgataaacgttaagatcgcagagctgagagaggctttggaatctgttatttccgagcaaaaatatctgaaagcacgtgatgcccgacaccgtcacaccaacgagagcacgagaaagcgagtgatattctacacggtgggagagtaccttcttctggcagcagccagtgcccttcaggttctctacatccgaaagctcttcagcaagtctgttgcatacaaccgagtctgaaacaaaacaccctaactctggtttgttcttctgcccctttgaaccctagacttagacaaagaaaagcctttttttttcgtttcagtgcagagactggattttgcatacacatctcttctgctttagtgtactt

SEQ ID NO: 5675 - DNA, 693 bp, Cucurbita pepo
aaggcgagaaaatggaaaggaggctgagagagacgggattcggatatctgttggcgggtcttcttctggcgagcctattcgccggaatcgattcgatatcggtcacagtcaacgagcttgaatgcgtttatgagtacgttttgtacgaaggcgacactgtttctggcaattttgtggtggtcgatcatgatattttctggggcgccgatcatcccggcattgatttctctgttacatctcccgcaggtaatgtggttcactctttgaaggagacctctggcgacaagtttgagttcaaggctcctcgtagtggaatgtataaattctgttttcataatccctactcgactccggagactgtttctttctacatccatgtgggtcacattccgaacgaacatgaccttgctaaagatgaacacctagaccctataaatgttaagattgctgagcttagagaggcattggagtcagtcactgctgagcagaaatatttgaaagcacgtgatgctcgccaccgtcacacaaacgaaagcacaagaaagcgcgtaattttctatacagtgggagagtatttgttgcttgctgttgcaagtgggctacaggtcgtttacattcgtcggctgttcagtaagtcagttgcatataaccgggtgtgagcaatcctagtgataaagttgttgcttctgtgtt

SEQ ID NO: 5676 - DNA, 983 bp, Gossypium hirsutum
aaagtaaaagcagacgcggaacgacgtcgaggaaacggcgacgtttcgttcataaatggaagttatatggtaagtgcactactgattcgttgaatggaagctctgataaaagagaagtacagatttttcagaccgttagctgttagatagaaatcagttcaggaaaaaaaatcggaattctaaaacagatggagaagagatggggaaagaagtgggctttgatttgtttgtttctttttaattgggcgagaaacgtttcctccctttcggtgaccgtaagcgacatggaatgcgtttatgaatacgtgctttacgaaggcgacacaatttcgggcaactttgtcgtcgtcgaccacgatattttctggagttctgatcatcctggcattgatttcaccgtaacttcgcctgggggtaatacagttcacagtttgaaggggacatctggggacaagtttgaattcaaggccccgcgaagtggaatgtacaagttttgttttcacaatccatactcaacaccagagaccattgctttctatattcatgtcggccatattcccactgatcatgaccttgccaaagatgaacatttgaacccaattaatgttaaaattgctgagctgagagaggctttggagtctgttacagcagaacaaaagtacttgaaagctcgtgatactcgacatcgtcacacgaatgagagcaccagaaagcgtgttataggttacacagttggagaataccttctgcttgttgttgcaagtgtacttcaagttatctatattcggcgtctcttcagcaaatcagttgcatacaatcgagtttgaacaatttcatcacaaatagaatactaagatcagttaacaaaaaaaacgaatcatgcaatgttacattttggtattttatatgttattcaagtatcatatttcaaacatactgtagctttacatgaatgttttttactcactttttataagctacta

SEQ ID NO: 5677 - DNA, 1060 bp, Catharanthus roseus
gtaaataaatttcgatattcagaaaaaacctttgagggtctttttcttctctgaatctgaaaatctgcaatagcagaagtagattaaaagatggagaagggaagagacaagatcggatgcctgaaggtttatttgcttgtgctactcctacttttaagctttgtcggagacctctccgtatcggcgttgtccgtaacagtaaacgacgtcgaatgcgtgtatgaatacgttctttacgaaggtgatacggtttcagggaacttcgtagtcgtcgatcacgatattttttggagttcggatcaccccggcatcgatttagtcgtgacagctcctgggggtaacactgtgcacaccttgaagggaacatctggggataagtttgagtttaaggctccaagaagtgggatgtataagttttgttttcacaatccttactcaacacccgaaacagtctctttctatattcatgttggtcacattcctagcgagcatgacctcgctaaagatgagcatctggatcccataaatgttaaaattgccgaattgagggaggcattggaatctgttacttcagagcagaagtacttgaaagcacgtgatactcgtcatcgccatactaacgaaagacacaagaaagcgtgtgatcttttactacagttggagagtacattttactagctctagcaagcacacttcaagtaatctatatcagacgcttgttcagcaaatcagttgcatacaaccgtgtctaatgaattcccgttagactgccagactagggccttttgatttgtttcgtttctctttagagaaggatggatcaatgtaagtttagacaatgagtttagggaacttgttttttttttgtgttttgaagcatgacagaagatatatagttgtccattcaattacacattttaatagatcatcatcgatctaattgtttagctcctgttggttgatgatatggacggacttaaaccttactgaaaacaaacaacatagtaaaaaatgattgtcccttttgtctgaatgttatatagtgatcctcttgacttgt

SEQ ID NO: 5678 - DNA, 849 bp, Vinca minor
aaaagttttactaagaaaaaatacactgtataaattgagggatggagatgagaagagataataagatcgggtgcctgaaggtatacgggattgtcgtgatccttcttctaagcttcgccggagacatctccgtctcggcgctgtccgtaacagtaaacgacgttgaatgcgtgtacgagtacgttctttatgaaggcgacaccgtttcaggaaacttcgtcgtcgtcgatcatgatatcttttggagttcagatcaccccggcatcgatttagttgtgacagctcctggaggtaacacagttcaaacattgaagggaacatctggggataagtttgagtttaaggctccaagaagtgggatgtacaagttttgtttccacaatccttactcaacacctgaaacagtttctttctatattcatgttggtcatattcctagtgagcatgaccttgccaaagatgagcatttggatcccattaatgttaaaattgctgaattgagagaggcactggaatctgttacagcagagcagaagtacttgaaagctcgtgatactcgtcatcgccacactaatgagagtacgcgctttcgcgttatcttttacacggttggagagtacatattactagctctagcaagttcacttcaagtcatctacattcgacgcttgttcagcaaatcagttgcctacaaccgtgtctaatgaactgccctagactgttgggtcttttggttacttttctcttcaaagaatttgatcaacgtaatagttagacaatgagcttagagaaacaattttttcttcacgtgtaacaaaagagatgctttttcatgcataaaagtataat

SEQ ID NO: 5679 - DNA, 834 bp, Flaveria ramosissima
aagttattgtgaatctcaagggaattgtagatggagacgacgatgaaagtgtatgcggttttggggcttcttctcctttccactttcgcccgcgatgtatcggctctttcggtcaccgtcaacgacgttgaatgtgtatacgagtatgtactctacgaaggcgatacggtttcaggcaactttgtcgtcgtcgatcatgatattttctggagctccgatcaccccggcattgattttatcgtgtcatctccgggagggaatgttgttcaaacaatgaaaggaacatctggtgaaaaattcgagtttaaagctccacgaagtgggatgtaccaattttgttttcataatccttactcaactcctgaaactgtctcattctacatacatgttggccatattcccaatgagcatgacctggcaaaagatgagcatttggaccctgtcaatgtgaagattgctgaattgagggaggcattggaatctgttacagctgaacaaaaatacttaaaagcacgtgatgcacgacatcgccatacgaatgagagcacacataaacgggtgatcttttacacaattggggaatacattttgctggccctagcaagtggactgcaagtggtttacatacggcgactctttagcaagtcagttgcatacaaccgggtctgagctagccctaactctgtctctgcagttttcttatgaattagaacccaggaaccgtgttctaacatttatgttgcttcattgtgatgtcgttgatcgtctttacagtatttttggtgtttatggatttaaattattctacttattacaaaattacaaattaaagat

SEQ ID NO: 5680 - DNA, 761 bp, Ipomoea batatas
tcacggcgagattcagagcctatccgctgttgttgatgatgctgttcagtttcgtcaccaatctctccgcgctatctgtcaccgtcaacgatgtcgaatgcgtgtacgagtacgttctgtacgaaggcgacaccatttccggcaacttcgtcgttgtcgatcacgacatcttctggaactcggatcaccctggcattgatttcaccgtgacatcacctggagacaatgttgtccactcaatgaagggaacatctggtgacaaatttgagtttaaagccccaagaagtgggatgtacaaattctgttttcacaacccatattcaacaccagaaacagtctccttctacatacatgttggccacattcctaatgagcataaccttgccaaggatgaacacttggatcccattaatgttaaaattgctgaactgagggaggcattggaatccgtcacagctgagcagaagtatttgaaggcacgtgatgctcgccatcgtcatacaaatgagagcacaagaaggcgagtcatattctacacagtcggagagtatattttgctcgctcttgctagttcacttcaagttgtttacatccgccgcttgttcagcaagtcagtagcctacaatcgggtttgaccaagttgcatgcttgtagtttcctcttcctttttgcaggatctatattgctgtttactatcactgtcagttcatttagagaaaagcacacttccctgaaacaaaaataacattataattactttg

SEQ ID NO: 5681 - DNA, 1186 bp, Eutrema parvulum
aaactgaaaatcgaaaatcgatctggaactaaatgtaaattcatatcggaaaatttaggaatgttgactgtatttaattatttctcagaccaaataccgttgaccagaccagctctaaatctcaccgtttcattataaaccggttttggtttctggtttactcagctaagctcaaataaatcctcttgtcttcttacgctcggcgaattttctcgagaaacaaacgaaagaaaatttgggaatcgaaaaaaaaatggagagaagacaagcgatgaactcaaagatccatgtatttgtattggttggttttatactattgagctcgatcgagcgaatctcttcgctctcggttacggttaacgacgatgaatgcgtccaagagtatgtcctttacgaaggagatactgtctctggaaacttcgtcgtcgtcgaccatgatatcttctggggatcagatcatcccggtttggatttcacggtgacatctcctgctgggaacattgtacagactgtgaagggaacatctggagataagtttgagtttaaggcaccaagaagtggaatgtacaagttttgtttccacaacccttactctactcctgaaactgtctccttctacattcatgttggtcatatccccaacgagcatgacttagccaaagacgaacacttggacccagtgaatgttaagatagctgagctgagagaggctttggaatctgttgttgctgagcagaagtatttgaaagcacgtgatactcgtcaccgtcatactaatgagagcacgagaaagcgtgtggtattctacacagtaggagagtacattttcctagcagcagcaagtggtcttcaggttctatacatccgcaagctcttcagcaagtcggttgcatacaacagggtttgaacataactgaaacaccgacaaggttttgtgtccttttatgtttaaattggtgatcacaatcataaaaaaaaagtgttagttaagtaagagctttatagcgaaagacccccctttttgtttttggtgtctacaaatttcattggcttcagtttatttatgtttaacatggagaacttgataagcttatattctgattctttgatcttgtctctctgatacgatcatcattggcttgatttagcagtaaacgctcttccgtaatacgttttatacaagcta

SEQ ID NO: 5682 - DNA, 860 bp, Tragopogon dubius
ggggcgtgaaaacgcgtctcggtgtaaattatttgtcaatcggaaggaaattatggagagaggagagagaacaatgaaagtgtatgcggttttggggcttcttctcttttctacttttgccgccgatgtatcggcgctttcggtcaccgtcaacgacgtcgaatgtgtatacgagtatgtactttacgaaggcgatacggtctcaggcaactttgttgtcgtcgatcatgatatcttctggagctccgatcatcccggcatcgatttcatcgtgtcatctcctggagggaatgtggtgcaaacaatgaaaggaacatctggggaaaaattcgagttcaaggctccaagaagtggaatgtaccagttctgttttcataacccttactcgactccagagaccgtctctttctacatccatgttggtcatattcccaacgagcatgacctagcaaaagatgaacacttggaccctgtgaatgtgaaaattgctgaattgagggaggcgttggaatctgttacagctgaacaaaagtacttgaaagcacgtgatgcgcgacatcgccatacaaacgagagcactcacaaacgggtaatattttacacaattggagaatacatattgctggcacttgcaagcggactccaggtggtttatatacggcggctgtttagcaagtcagttgcatacaacagggtctgactgtatctttcttatagattagaattcgggagtatttatgtgcttcatcctcatgttattaagagctttttctgtgtttttaactaaatttaatgcaatattacaattttcaactttgtttttcttacttgacaatgaggattattttacaaacttcaca

SEQ ID NO: 5683 - DNA, 927 bp, Euphorbia peplus
aaaaaacgacaacgtttgacgtagataaacagaatatcaaacctctagacataccagaaacatcgctctagtttccgtgtcgtgcctttgaatcgatcttctgaaaatcatcagaggacaaaataattttgaatcatcggagatgcagagacggcagatcaatttaacggcggtttttcttttactgtcgctaatagggcgtatatctgctatttccgtcaccgttaacgacattgaatgcgtgtatgaatacgtcctctatgaaggcgactctgtttccggaaacttcgtggtggttgatcacgatattttctggagctccgatcaccctggcatcgatttcagcgtgacttctccttcaaataatttagtgcacactatcaaggggacatctggggacaagtttgagttcaaggccccaagaagtggaatgtacaaattctgttttcacaatccttactcaacaccagagactgtctctttttatattcatgtcggccatattcccaacgagcatgatcttgctaaagatgagcatctgaatccaattaatgttaagattgctgagctgagggaggcattggagtctgttatagcagagcagaagtatttgaaagcacgtgatgtgcgacatcgccgtaccaatgaaagtacacggaagcgtgttgtaggatacacagttggagaataccttttgttggctattgtaagctcacttcaagtagtatatattcgtcgccttttcagcaagtcagtggcgtacaaccgggtctgagcatcgtgttttcagtgatgttgctgatttactggacaaattttgagaaatacatattcgtatttataaaatgtatgtgctggttcatactgtttaattttattttactttcattaaactgtgattaacttagaacatagattataaagtaa

SEQ ID NO: 5684 - DNA, 914 bp, Valeriana officinalis
ctcatcgagaatcctagtccaaaaatggagagaagagagagaatgaggtgttcatatgttatgcttgcactcgtactcttcaatttggtatcagatctatctgctctctccgtcaccgtaaacgacgtcgaatgtgtctatgagtacgtcctctacgaaggggataccgtctccggtaacttcgtcgtcgtcgatcacgatatcttctggggatccgatcaccctggcatcgatttcatcgtgacatcgcctgcgggtaataatgtacagtcattgaaaggaacttctggtgacaaatttgagttcaaggctccacgtggtggaatgtacaagttttgttttcataatcctcaatccactcctgagacggtttctttctacattcatgttggccatattcctaacgagcatgatcttgctaaagatgaacatttggaccccataaatgtgaagatcgccgagctaagagaggcgttggaatcagttactgctgaacagaaatatctgaaagcacgcgatactcgccatcgtcatacgaatgagagcacaagaaagcgagttatcttttacacaatcggagagtacttgttactggctcttgctagtggacttcaagtagtatacatacgccgcttgtttagcaaatcagttgggtacaatcgcgtgtaactttagcaggattcacgagtttagatataaacatttgacattttcttgttttgtaatacaaccaatatgttgtctcatacttttctctttttatgaaatgatgatggattttgtactagggtaattataccattgatctgaaacttaggaaaataaatcccagctagttttacaaatttttattttatttatgaatctttattgttatttataagttgctctatgtgcttgcagtgctcaaaaaa

SEQ ID NO: 5685 - DNA, 967 bp, Antirrhinum majus
ccgctgaataatcaaaaaaccctaaaattcaagacccgaaaactctcaaacggggctccgaatcgaatatggaggggagaggaagaacaatcagctgtttactgttggtgctgctgatattgggaactttgaccagagtaccggcgctttcagtgacggtgaacgacgttgagtgcgtatcggaatacgtgttgtacgaaggcgacacaatctcggggaatttcgtcgtcgtcgatcatgatatcttctggagctccgatcacccaggcattgatttcactgtgacatctcctgcaggcaatactgtgcactctattaaaggaacatctggtgacaaatttgagctcaaggcccctaaaagtggaatgtacaaattttgtttccataattctcactctacaccagaaaccgtctctttccacatccatgttggccacattcccaccgagcatgaccttgcgaaagatgaacatttggaccctattaatgtcaaaattgctgaactaagggaggcactggaatcagtcactgcagagcagaaatacttgaaagcacgcgatgctcgtcatcgtcatacaaatgagagcacaaggaaacgtgttatattttacactgtgggagaatacattttgctagctcttgtgagtgggcttcaggtcgtgtacatacgtcgcctgttcagcaagtcgttcgcatacaaccgagtttgatggaacatctttcctcccatgaatcttggtgaccggatgttttaacagtttaatttgatacaaaaatgcgttgtttgtataagatgtttaattttacagtcgtccttcaggattgataaatggatttagatagaggacaagcggatatataaatttcagatttgttgtcttaagagatagaaagcctttattatcgaaattacctcagcctacttttgctagaatggaattgtgtttgccactgttttctgtatttg

SEQ ID NO: 5686 - DNA, 1229 bp, Sesamum indicum
catactcttacttcaaattttcttagagaaaagaaagggaattctaaaaccatgtgctgcgttgtagcgtccaataatcttccaccacgtcggcaacggaaacgcccgacccaagaagcaaacgacaccgcatcaacacaagcataacttggaacccgattgatccagtagtaattcatttcatttccaataatagttacccagaaactcagacccggggctccgaacagttggatccagttcaatggatgggagcggaagaattaccaggtccggccggttggcgtacgctcttcttggcctcctgcttttgagcttgctgagccgtacatcggcgctctcggtcacggtaaacgacatcgagtgcgtctacgaatacgtattgtatgaaggcgacaccgtctccgggaacttcgttgtcgtggatcacgatatcttctggagcagcgatcatcctggcattgacttcactgtgacatctcctgcaggtaatactgtgcacactttgaaaggaacatctggagacaaatttgagtttaaggcccctagaagtggaatgtacaagttttgcttccacaatccttattctacaccagaaacagtctctttctatattcatgttggccatattccaactgaacacgatcttgccaaggatgaacatttggaccccattaatgtaaaaattgctgaactgagggaggcactggaatctgttaccgcagagcagaaatacttgaaagcacgtgatgctcgccatcgccatacaaatgagagcacaaggaggcgcgtcatattttacactgttgcagaatacattttgctagctcttgtaagcggccttcaggttgtatacatacgtaaattgttcagcaagtcagtggcatacaaccgtgtttgatgaaaatcgccaaactgtcggcttttcctctcctcaatttggttcctcgttgttataacagtactagttaaggaggaaactgtgacatggtttgttataatttatttgagtggtgttcttgttcctcagaactcctcgagataggtggatttaggtagctagataatctggataaatgtgaaatacttcacttttagttgtaataggggatgatgagtttttattggcaggtagatacattaccttcttctcatagagcatttcaatgtttgtgtatacaagtttccttgcatgctatctaaatagattcttgtcaattatccgaccg

SEQ ID NO: 5687 - DNA, 806 bp, Cynara scolymus
cggggagaagagaaatgaaagcgtatgcggttttggggctgcttcttctttcgacttttgccggtgacgtatcggcactttcggtcacggtgaacgatgttgaatgtgtatacgagtatgtactctatgaaggcgatacggtttcaggtaactttgtcgtcgtcgatcatgatatattttggagctccgatcaccccggcatcgacttcatcgtgtcttctcctggagggaatgtagttcaaacgatgaaaggaacatctggggaaaaatttgagtttaaggctccaagaagtggaatgtaccaattttgttttcataatccgtactcgactccagagacggtctctttctacattcatgttggtcatattcccaatgagcacgacctagcaaaagatgagcatttggaccctgttaatgtgaaaattgctgaattgagggaggcattggaatctgttacagctgaacaaaaatacttgaaagcacgcgatgctcgacatcgccatacaaatgaaagcacacataaacgggtgatcttttacacaattggcgaatacatattgctggctctagcaagtggactccaagtggtttacatacggcggctgttcagcaaatcggttgcatacaatcgggtttgaggccctatatgttatagattagaacatgttctaacaagtatgtgttggttcatcgtgatcttatttatcgtcttcagagctctttgttgtttttacccttttacaatgatgcaatattacatttccgagtctctctttcggtttttagacatttggctttttaga

SEQ ID NO: 5688 - DNA, 1248 bp, Orobanche aegyptiaca
aatgaagtccttccacgtgcaaacatcacacctaagacgaacgacagcccataacatgaacatcatcttccacgaagaatcagtaattcaccttaaaaacctgaaactaaaacccgggcctccgaacaatcagatccggttcaatggagaggaagggaggaattatctggtgcggcgcggccgcgtacgctatttcttgcctcctacttttgagcacgactagccgtatctcggcgctgtcggtgactgtgaatgacgtcgagtgcatatacgaatacgtattgtacgaaggcgacaccgtttcgggaaatttcgttgtcgtggatcacgatatcttctggagctccgatcatcccggcatcgacttaactgtgacatctcctgcaggtaatactgtgcacacgttgaaaggaacatctggggacaaatttgagtttaaggctcccaaaagtggaatgtacaaattttgtttccataatcctcattcgacaccagagacagtctctttctacattcatgtcggccatattcccagcgaacatgacctggcgaaggatgaacatttggacccgattaatgtcaaaattgctgaactgaaagaggcgctggaatctgttactgcagagcagaagtacttgaaagcacgtgatgctcgccatcggcatacaaatgaaagcactagaaagcgcgtcatattctacacagttggagaatacctcctgctagcacttgtaagtgggcttcaggttgtgtacatacgtcgattgttcagcaagtcggtcagatacaatcgtgtttgatgagattccatcccaaaaataactgcaatttggtttcagttcgagggaaaatttgaatttgggagagcaaaagtaacaaatatggtagtatttatctggcaggttgtcccctataattttgtagcggaagcttccttaaaatgagagggtctaattaaatgtgatgtacttaaacttgatggtttatgagatttttctgccaccatttacattttacttttttcaggatcttttttagaattcattgttttcgtattatgtatgttttttcgtccgaattagcgccagggttcagtaaaccattttccattttatctttttaattatttttcataagattacattaagcttgatatgtgtagtctagaaagatcgaatacaacaaagtgctttaaatgttgtagtttgtataattgtactaaaaatatggagtttgtcttactgttgc

SEQ ID NO: 5689 - DNA, 938 bp, Lippia dulcis
taataagacaatttcaaaacttggaaaactcagaattgggcttagatccagttcaatggagaagaagggaagaaatatccggtgcggcaaggcatcgtacgctctgttaatcctccttattctgagcatgatcggccgtatctcggcgctgtccgtcacggtcaacgaggttgagtgcatatacgaatacgttctgtacgagggcgacaccgtttctggtaatttcgttgtcgtcgatcacgatatcttttggagctccgatcatcccggcatcgacttcaccgtaacatctcctgctggcaataatgtgcacactttgaaaggaacatccggggacaaattcgaatttaaggctcctagaagtggaatgtacaaattttgtttccacaatccttattctacaccagagactgtctctttctacattcatgtcggccacattccaactgaacatgaccttgcaaaggatgaacacttggaccccattaatgtgaagattgctgaactgagggaggcactggaatctgttactgctgagcaaaagtacttgaaagcacgcgatgcccgccatcgccatacaaacgagagcacaagaagacgtgtgatcttttacacagttggagagtacattttgctagcacttgtaagtgggcttcaggtcgtgtacatacggcgtttgttcagcaagtcggttggatacaaccgtgtttgatcaaacttcagctattttcctcctctcaaaatgtggtctgctctctgttttcaagtcaactgaggagaagaaaaatacagatagcttgcacaaaaggctggtgttacctaatttgactgtcagatattccttagagtcgcagataaaacttcttgatgatacgtggatttaggtagagggtatggataaatctgaagtacttatttcgttagttattgtgatgata

SEQ ID NO: 5690 - DNA, 746 bp, Cleome spinosa
aaacaaacggagaatttggtcgaagacgagggagatggagacgagaattggcagagatccgaagacccatctggttttgttcgttggtttgttactcctgtcttcgatcggacgaatctcttcactgtcggtgactgtgaacgacgttgaatgcgtctacgagtacgttctctacgaaggcgacactgtgtcgggaaacttcgtcgtcgtcgaccatgatatcttctggggtgcagatcatcccggtcttgattttgaggtctcgtctcctgcggggaatgtcgtacacagtttgaaaggaacatctggggataagttcgagttcaaggccccgaaaagcggaatgtacaaattttgtttccacaacccctactcttcaccagaaactgtctccttctatattcatgtcggtcatattcccaatgaacacgacatagccaaagatgaacatttggacccaataaacgttaagattgccgagctgagagaggctttggaatcggttatctctgagcagaagtatctgaaagcacgtgatgcccgacaccgtcatacaaatgagagcacgagaaagcgtgtgatattctacaccgtgggagagtaccttcttctggctgcagcgagtgcccttcaagttctctacatccgcaagctcttcagcaagtctgttgcgtacaaccgagtctgaaccaaaaaacccgaatacggtttgtttcctctttgttgagtgtggaagaagatgaaca

SEQ ID NO: 5691 - DNA, 996 bp, Papaver somniferum
aatccgttctcagtcaacaaagtccttatcaattgtattactctccatatagagatagattcattcatcttcgacaagaagaaacattcaattctgcgtatggagagaagtggaagaaaaatgggatctatgaagatctgtttgatcctagggtttctattaagttttgttagtcatatttcttctctatccgtaactgtcaatgatatggaatgtgtttatgaatatgttctttacgaaggtgatactgtttctggtaattttgttgttgttgatcacgatatcttctggagctctgatcaccctggcatcgattttacggtaacatctcctggaggcaatgtagttaattctttgaaaggaacatcaggggacaagtttgaatttaaggctccacgagcgggaatgtataaattctgcttccacaatccttattcaactccagagactgtatctttctacatccatgttggtcatatccccaatgagcatgaccttgcaaaagatgaacatttggacccaataaatgtcaagattgccgagttgagagaggctttggagtctgtcacagcagagcagaagtacctaaaagcgcgtgattccaggcatcgccacacaaacgagagcacaagaaggcgtgtggttttctacacaatcttagagtacttggtattgtgtttggccagtggccttcaagtgatgttcatccgccgcctgttcagcaagtcagttgcgtacaacagggtctgagtttatctttttcttttcctttctataattcatctgactttctactccatccttaattgtgttcacaatcttgtttttgttttagttgctgactggtgggtcaatatatgtagaattttcatatttgagtaaaagaagaaaagaaacttttattagtttcaataagacatggtttattagttacttttgtgaatggcttctgtaatgttacacttaacgtactgtggtgaattgtcctttaaagtg

SEQ ID NO: 5692 - DNA, 850 bp, Centaurea maculosa
gggggcccccaacctttttgtgatcagaagaattcagaaggaaatcgagatggaggagagaaggatgaaaacgtatgcgattttggggcttcttcttctttcgaccttcgcctgtgacgtatcggcgctctcggtgacggtgaacgacgtcgaatgtgtatacgagtatgtactctatgaaggtgatacggtctcaggtaacttcgttgtcgtcgatcatgatattttctggagctccgatcaccccggaatcgacttcgtcgtgtcttctcccggcgggaatgttgtgcaaacgctgaaaggaacatctggggagaaattcgagttcaaggctccaagaagtggaatgtatcaattctgttttcataatccttattcgactccagagactgtctccttctacatacatgttggtcacattcccaatgagcatgacctggccaaagatgagcatttggacccggtgaatgtgaaaattgctgaattgagggaggcattggaatctgtgacagctgaacaaaaatacttgaaagcacgggatgctcgacatcgccatacaaatgaaagcacacataaacgggtaatcttttacacgattggggaatacattttactggcccttgcaagtggactccaagtggtttacatacggcggctgttcagcaaatcggttgcatacaatcgggtctgaggccctctagtatgtatttttcttctttcttatagattagaacatgtttcaacaattatgttggttcatcgtgatcttatttatcgacttcagagctctttcttattttacagacttcaaatgaatgcaatattattacaaattcccaccaaaaaaaaa

SEQ ID NO: 5693 - DNA, 840 bp, Centaurea maculosa
gcgggggatgcccccaacctttttgtgatcagaagaaattcattcagaaggaaatcaagatggaggagagaagaatgaaaacatatgcaattttagggcttcttcttctttcgaccttcgccggtgacgtatcggcgctctccgtcacggtgaacgacgtcgaatgtgtatacgagtatgtactatacgaaggcgatacggtttccggtaacttcgttgttgtcgatcatgatatcttctggagctccgatcatcccggaatcgacttcatcgtgtcttctcccggcgggaatgttgtgcaaacgatgaaaggaacatctggggagaaattcgagtttaaggctccaagaagtggaatgtaccaattctgttttcataatccttactcaactccagagactgtctccttctacatacatgttggtcacattcccaatgagcatgacctggccaaagatgagcatttggacccggtcaatgtgaaaattgctgaattgagggaggcattggaatctgtgacagctgaacaaaaatacttgaaagcacgggatgctcgacatcgccatacaaatgaaagcacacataaacgggtaatcttttacacaattggggaatacatcttactggcccttgcaagtggactccaagtggtttacatacggcggctgttcagcaaatcggttgcatacaatcgggtctgaggccctctagtatgtattttcttctttcttatagattagaacatgtttcaacaattatgttggttcatcgtgatcttatttatcgactttagagctctttctaattttacagacttcaaatgaatgcaatattattaca

SEQ ID NO: 5694 - DNA, 2040 bp, Cichorium intybus
tttttttaacttaaaattgtaacattgcattaatttaagtttataaagttcgtaaaaacatcgaaaagctctaaacacataaataacatgacaatgaaccaacataaatgttagcacatgttcccgaagagttctaatctatatataaaaaaaaagtacacagccacgtggccggtttagacccggttgtatgcaaccgatttgctaaacaaccgccgtatgtaaaccacttggagtccacttgcaagtgccaacaaaatgtattctccaattgtataaaagatcactcttttatgtgtactctcatttgtatggcgatgtcgagcatcacgtgctttcaagtatttttgttcagctgtcacagattctaatgcttctcttagttcagcaattttcacattcacagggtccaaatgctcatcttttgctaggtcatgttcattgggaatgtgaccaacatgaatgtagaaagagacagtttctggagttgagtaaggattatggaaacaaaattggtacattccacttcttggagctttgaattcgaatttttctccagatgttcctttcattgtttgtactacatttcctccaggagatgacacgatgaaatcgatgccggggtgatcggagctccagaatatatcatgatcgacaacaacaaagttgcccgaaacagtatcgccttcgtaaagtacatactcgtatacacattcgacgtcgttgacggtgactgaaagagccgatacatcgccggcaaaagtagaaaagagaagaagccccaaaatcgcatacactttcattgttctctctcctctctccatctaccaattcctccgattgacgaactgatttacatcgagacgctttttcagggcttctttcggaacaaccgcgtcattttactaatttacccctggttataagcgacgggttggattaaacttgttcattgtagggctgtgaggccataaaccttggagctcaaatggctgccacacccatgttgccaccaaacttagcacctggggatggaaatgctccagcagctccaccaccaccgggaacagacatgaccggaatatgcttcagggatcaattgtggctaaacacctacccacttgaccgcaatcttgtctttgattactttgcactttctcctttctatgattacacttgcaacaatgaacaactcagaatgcgctcaattcatcccttagatatctctcatctttctaaaatgacaggtgtcgagttcatgttgaatgaagttatagaaccccatttattcgtgatccgtaagcagaaaagagatggccctgaaaaggtgactccaatgcttacttactatgtactcgatggttcaatttaccaagcaccacaagtttgcaatgtctttgcagctcgagttggacggactttgtatcatatatcaaaggcttttactaccgcagcctcaaggttggagaagattgggcatgcggactcggagaatgagagtgtctcaaatgaaccgaaggctgccaaggagactattgactttaaggaagtcaaacgagtagatcacattcttgcctcgttgcaacgcaagctaccacctgcaccacaaccaccgccattcccggagggttatgcaccgccatcaaatgcggaaggagagcaagggactgaaacggaacaagcggaccccaaaattcctctggtggaccccatccttgaccaaggtccatctaagcgacaaaaatacacataaatatctgacatggatcacatgttcattttctttcaattgagttcattgtgtaacattaattagaagtgatggtgtagcttttgagacgtcttactggttctatttctagagtcttacatgtggaaagatagacggatgagttttgaggtgagatggatacatatttagggttaattgtaaaacaatgcaacatgtttttactatgcagtcaaaatttccatccatgtaaaaggttgtaaacactaaacacattttttacgactttagtcctgtttaattttaaatta

SEQ ID NO: 5695 - DNA, 891 bp, Cirsium arvense
gagaagagagagaacaatgaaagtgtatgcgattttggggctgcttcttctatcgacttttgccggtgacgtatcggctctttcggtcacggtgaacgacgtcgaatgtgtatacgagtatgtactctatgaaggcgatacggtttcaggtaactttgttgtcgtcgatcatgatattttctggagctccgatcaccctggcatcgacttcatcgtgtcttctcctggagggaatgtggttcaaacgatgaaaggaacatctggtgaaaagtttgaatttaaggctccaagaagtggaatgtatcaattctgttttcataatccttactccactccagagacggtctctttctacattcatgttggtcatattcccaatgagcacgatctagcgaaagatgagcatttggaccctgtgaatgtgaaaattgctgaattgagggaggcattggaatctgttacagctgaacaaaaatacttgaaagcacgtgatgctcgacatcgccatacaaatgaaagcacgcataagcgggtaatcttttacacgattggtgaatacatattgctggcccttgcaagtggactccaagtggtttacatacggcggctgttcagcaaatcagttgcatacaatcgggtctgaatgtatctttcatatatagattagaaacatgttctaacagttatgttggttcatcgtgatcttatttatcgtctttagagctctctttgttatttattttacccttttacagaacttcaaatgaatgcaatattacaatttccaagtcaaaaaagaaaaagtaccttttgtatgcagacatgactaaacataacagaacttgccagattaggacaacccacaaatgacaatactagaatgtttttagg

SEQ ID NO: 5696 - DNA, 823 bp, Carthamus tinctorius
ggcgggggatagaagattcattcgaaggaaaaatcgatggaggagagaagaatgaaagtgtatgcgattttggggcttcttcttctttcgacctttgccggtcacgtatcggcgctttcggtgacggtgaacgacgtcgaatgtgtatacgagtatgtactctatgaaggcgatacggtctcaggtaactttgttgtcgtcgatcatgatattttctggagctccgatcaccccggcatcgacttcatcgtgtcttctcctggtgggaatgttgtgcaaacgctgaaaggaacatctggggagaaatttgagtttaaggctccaagaagtggaatgtaccaattctgttttcataatccttactcgactccagagactgtctccttctacatacatgttggtcatattcccaatgagcatgacctggcaaaagatgagcatttggacccagtcaatgtgaaaattgctgaattgagggaggcattggaatctgtgacagctgaacaaaaatacttgaaagcacgggatgctcgacatcgccatacaaatgaaagcacacataaacgggtaatcttttacacaattggggaatacattttactggcccttgcaagtggactccaagtggtttacatacggcggctgttcagcaaatcggttgcatacaatcgggtctgaggccctctagtatgtatcttcttctttcttatagattagaacatgtttcaacaattatgttggttcatcgtgatcttatttatcgactttagagctctttcttatttaacagacttcaaatgaatgcaatactattacaattttc

SEQ ID NO: 5697 - DNA, 979 bp, Cucumis melo
agagaatatggagaggagggtgagagagaagggtctcggatatctgttggcggctcttcttctgttgagcctaattgccggaatcgattccatttcggtcactgtgaacgagattgaatgcgtctatgaatacgtattgtacgaaggcgactctgtttctgggaattttgtagtcgtcgatcatgacattttctggggtgccgatcatcccggcatcgatttcactgttacatcccccgcaggtaatgtggtacattctttgaaggagacatctggtgacaagtttgagtttaaggctcctcgcagtggaatgtataaattctgttttcataatccctactcgactccagagacagtttctttctacattcatgttggtcacattcccaacgaaaatgaccatgctaaagatgaacatctagaccccataaatgttaaaattgcagagcttagagaggcattggagtcagtcactgctgagcagaaatatctgaaagcacgtgatgcacgccaccgtcacacaaatgagagtacaagaaagcgtgtaattttctatacagtgggagagtatttgttgcttgctgttgcaagtggccttcaggtcatttatattcgtaggctcttcagcaagtcggttgcgtataaccgtgtctgagcttccatcccagtggtaacattattgtctcgttgttaggcttcaggaactttaggaatgaattataaactatcatttgttgaaaaaatttcattggtatgttatacaatcgcttttgactatgctaccatccttaatcataacttgggttcacgtgttagatcttcatgaagttaggagaagccatttaccctataatgcttcaatgagatgatgtggttccaaatagcatcctcattgccccctcttttgttatgaaaagctgaaagtctattatataaaccaaaaactaaataatacactcagcaaattggaactatgtta

SEQ ID NO: 5698 - DNA, 830 bp, Eschscholzia californica
catctcccccaattccccatcttgcgacaccaaccaaaaactgatcttagagagagaaagtgaatatggagaaaagaaatagaactggatctatgaagatctgtatagttctagggtttctattcagcttttttagtcatctatcggctctctctgtaaccgttaatgatatggaatgtgtttatgaatatgtactctatgaaggcgatactatttcaggcaacttcgttgttgttgatcatgatatcttctggggttcggatcatcctggcatagacttcacggtaacctctcctgggggtaacgtggtgcactctttgaagggaacatctggagacaagtttgaatttaaatccccacgtagtgggatgtataagttctgtttccataatccttactcaaccccagagactgtatctttctacattcacatcggtcatatcccaaatgagcatgaccttgccaaagatgaacatttggaccccataaatgtcaagattgctgagctgagggaggcactggaatctgttacctcagagcaaaagtacctaaaagcacgtgatgcccgtcatcgtcacacaaatgaaagcacgagaaagagagtgatattctacacaatcttagagtatatggtgttgtgtttagcaagtggactccaggttatgttcatccgaaggcttttcagcaaatcagttgcatacaaccgtgtctgagtgatccgatcgtcttattttttttaaataaaccctcttcctgacttctttttatttatgcctgtttaatttactttactccttggcagtatctgtagaattttcacattttgagtt

SEQ ID NO: 5699 - DNA, 868 bp, Fraxinus spp
ccagaatcagatggagtagcaaggcggcgtacgccctggtcggcttgttgctgttgagcttggcgagccgtctatcggctctatcggtaacggtgaacgaagaggaatgcgtatacgaatacgtattgtacgatggcgacaccgtttccgggaatttcgtcgttgttgaccacgatattttctggagttcagatcaccccggcattgatttcactgtgacatctcccggaggtaatacggtccatactttgaaaggacatcgggggacaaatttgagtttaaggcccccagaagtggaatgtacaaattctgtttccataatccttattctacaccagaaacagtctctttctacattcacattggtcatattcccagtgaacatgacctggccaaggatgaacatttggatcccatcaacgtcaaaattgctgaactgagggaggcattggagtctgttacagcagagcagaagtacttgaaagcacgcgacggtcgccatcgtcatacaaatgagagcactcggaggcgcgttatattttacacagttgcagaatacattttgctagccgttgcaagtgcactgcaagttgtgtatatacgtcgcttgttcggcaagtcagttgcatacaaccgtgtttagtgaatcttgtgaagctggctgtctgttccccccaaccaaagtcgcacatcgttaatgttgacgttcggagagaatcacatgcttgttaataaaaagatcttggattaatagtcattttctttgggatcagaaagcaacttcttgactataatggatttagttttccacaggtgattgtgaaatatatattttagtggtagggaggttattaaatgttgcaggagt

SEQ ID NO: 5700 - DNA, 849 bp, Rosa hybrid cultivar
gaaactctcaaacccagaaaacccaaaaaaaaaatggagtcttggcagagcacgaaaggcgtgatcttgatggggattctattggtgagctttgtggggcgaatcgcgtcgctatcggtgacggtgaacgacatggaatgcgtgtacgagtatgtgctgtacgaagacgacgtcgtttcggggaacttcgtggtggtcgaccatgatatcttctgggccagcgatcatccgggtctcgatttaattgtgacatctcctgggggtaatacagtgcacacttcaaagggaacatctggagataagtttgagtttaaggctccaaggagtggaatgtacaagttctgttttcacaatccctactcaactccagaaacggtttcattcaatatacatgtcggccatattcctactgagcacaacattgccaaggatgaacatctagaccctattaatgtgaagatagctgagcttagagaggcattggagtcagttacattggaacaaaagtacttgaaagcacgtgatgctcgccatcgtcatacaaatgagagcacaagaaagcgtgttgtgctctacacagtgggagagtacttcatgctagttgctgcaagtgctttacaagttgtatacatccgccgcctctttagcaaatcaattggatataatcgggtttgagttgctaggttcatgtttctgtattctaacaggaatccccttatacatcattatctcagatccgtcttttgtgtaacctttgtataacattatgatagttttatattatttttcttctcaactttcttgtacattgagatttttcacttttgagtgtgttgtttagtttttaaa

SEQ ID NO: 5701 - DNA, 972 bp, Ipomoea nil
tctgctacaattcttcaatctcatttacccaaaaacagccattcagaaagcaatccggcgaagaaaagctgtgaattttttttgaaaatggaaatcaccgcgggaatcagagcctatgcgctgttgttgatgatgctgttcagtttcgtcaccaatctctccgcgctatctgttaccgtcaacgatgtcgaatgcgtgtacgagtacgttctgtacgaaggcgacaccatttccggcaacttcgtcgttgtcgatcacgacatcttctggaactcggatcaccctggcattgatttcactgtgacatcacctggagacaatgttgtccactcaatgaagggaacatctggtgacaaatttgattttaaagccccaagaagtgggatgtacaaattctgttttcacaacccatattcaacaccagaaacagtctccttctacatacatgttggccacattcctaatgagcataaccttgccaaggatgaacacttggatcccattaatgttaaaattgctgaactgagggaggcattggaatccgttacatctgagcagaagtatttgaaggcacgggatgcccgccatcgtcatacaaatgagagcacaagaaagcgagtcattttctacacagttggagagtatattttgcttgctcttgctagttcacttcaagttgtttacatccgccgcttgttcagcaagtcagtagcctacaaccgggtttgaccaagttgcatgcttgtagtttcctcatcctttttacaggaattatattgctgtttactatcactgtcagttcatttagaggaaaaaacaacacttccctgaaacaaaaataacattataattacttgttaaatttatcatcaacattttaggattgtgcatttgtgcatgtaatgtcatcttatgttacttaagactcacctgcatgtagtagcaatttgtgccccagaaggggtgattaag

SEQ ID NO: 5702 - DNA, 788 bp, Cirsium arvense
tggaggagagaagaatgaaaacatatgcaattttagggcttcttcttctttcgaccttcgccggtgacgtatcggcgctctcggtgacggtgaacgacgtcgaatgtgtatacgagtatgtactctatgaaggcgatacggtttccggtaacttcgttgtcgtcgatcatgatatcttctggagctccgatcaccccggaatcgacttcatcgtgtcttctcccggcgggaatgttgtgcaaacgatgaaaggaacatctggggagaaattcgagtttaaggctccaagaagtggaatgtaccaattctgttttcataatccttactcaactccagagactgtctccttctacatacatgttggtcacattcccaatgagcatgacctggccaaagatgagcatttggacccggtcaatgtgaaaattgctgaattgagggaggcattggaatctgtgacagctgaacaaaaatacttgaaagcacgggatgctcgacatcgccatacaaatgaaagcacacataaacgggtaatcttttacacaattggggaatacattttactggcccttgcaagtggactccaagtggtttacatacggcggctgttcagcaagtcggttgcatacaatcgggtctgaggccctcttttcttctttcttatagattagaacatgtttcaacaattatgttggttcatcgtgatcttatttatcgactttagagctctttctaattttacagacttcaaatgaatgcaatattattacacttcccaagtcaaaaaa

SEQ ID NO: 5703 - DNA, 741 bp, Cleome gynandra
ttttctcgagaaacaaacgcagagaaattgatttgaagacgaggaaaatggagacgagacaagccagagatcggacgacccatgtggttttattgatcggtctgttccttctgagttcgatcggacagatctcgtcactgtcggtgacggtgaacaccgttgaatgcgtctacgagtacgtcctctacgaaggcgacactgtctccggaaacttcgtcgtcgtcgatcatgatatcttctggggttcagatcatcccggtcttgattttgaggtcacatctccttcagggaatgtggtacacagtttgaaaggaacatcaggggacaagttcgaattcaaggccccgaaaagcggaatgtacaaattttgcttccataatccgtactctacaccagaaaccgtctcattctatattcacgtcggtcatattcccaatgaacacgacttagccaaagatgaacatttggacccgattaacgtgaagatcgcagaactgagagaggctttagaatctgttatttccgaacagaagtatttgaaagcgcgtgatgctagacaccgtcataccaacgagagtacgagaaagcgggtgatattctatacggtgggagagtatgttcttcttgctgccgcgagtgctcttcaggttctttatattcgtaagctcttcagcaaatctgttgcatacaatcgagtttgagacaaaccctaattagggttttgttgttgaaccaaaacct

SEQ ID NO: 5704 - DNA, 786 bp, Flaveria ramosissima
tagatggagacaacgatgaaagtgtatgcggttttggggcttcttctcctttctactttcgccggcgatgtatcggctctttcggtcaccgtcaacgatgttgaatgtgtatacgagtatgtactctacgaaggcgatacggtttcaggcaactttgttgtcgtcgatcatgatattttctggagctcagatcaccccggcattgattttatcgtgtcatctcctggagggaatgttgttcaaacgatgaaaggaacatctggtgaaaaattcgagtttaaagctccacgaagtgggatgtaccaattttgttttcataatccttactcaactcctgaaaccgtctctttctacatacatgttggccatattcccaatgagcatgacctagcaaaagatgagcatttggaccctgtcaatgtgaagattgctgaattgagggaggcattggaatctgttacagctgaacaaaaatacttaaaagcacgtgatgcacgacatcgccgtacgaatgagagcacacataaacgggtgatcttttacacaattggggaatacattttgctggccctagcaagtggactgcaagtggtttacatacggcgactctttagcaagtcagttgcatacaaccgggtctgagctagccctaactgtctctgcagttttcttatgaattagaacccaggaaccgtgttctaacatttatgttgcttcattgtgatgtcgttgatcatctttacagatttttggtgtttatggatttaaattattcacttattacaa

SEQ ID NO: 5705 - DNA, 824 bp, Carpinus betulus
ctcgtaccttaagctttccatatctgagtccaacccaagaagtctgaaacctaaaagaagaagaaacaaataacaaaattagaggtgaaacaaaaaccatggggaggaggcaaagacagggaagcgaaaggatgtgtgcgtcaatgattgttctggtgctgttgagcttggtcggtagaatctcgtccctctcggtgaccgtaaacgacgtcgaatgcgtgtccgagtacgtgctctacgagggcgacatggtctctgggaatttcgtggtcgttgaccacgacatcttctggacctccgatcaccccggcatcgatttcaccgtgacatctcctgcgggtaatatggtgcataccttgaagggaaaatctggcgacaagtttgagttcaaggccccacgaagtggaatgtacaaattctgttttcataatccttactcaaccccagagacagtttctttctacatacatgttggtcatattcccaatgagcatgacctcgccaaagatgaacatttgaacccaataaatgttaaaattgccgagctgagagaggcactggagtctgttaccgcagagcaaaagtacttgaaggcacgtgattctcggcatcgtcacacaaatgagagcacacgaaagcgagttgtcttctacactgtcggagagtacattctgctggccattgtaagtggtctacaggtcgtctacatacggcagctgttcagcaaatcagtcgcatacaaccgagtttgatgtgcttgatttcttaatttctatatggcaggcaacttgatgaggcttatagatgagttccttttagtaagt

SEQ ID NO: 5706 - DNA, 1099 bp, Sarracenia psittacina
gggggtgttctatattaaaaaacagaacttggtgtgagagcattgacgagtggcggcccccggcggcagtgtctatcatctgacctttttctctcgaagtcgcagaaatccattgaaatcaattctaagagactgcaaagaagatggggagaagagagagaatgagagaacccaagatctacgccgtcgtactggtagggctgcttcttctcagcttcgtcggcgacctcgcggctctatccgttactgtaaacgacgtcgaatgcgtctacgagtacgtcatctacgaaggcgacacaatctccgggaacttcgtcgtcgtcgatcacgaaatcttctggaactccgaccatcccggcatcgatttcatcgtgacgtccccagcaggtaatgtagtgcacagtttgaagggaacatctggggacaagtttgagttcaaagccccacgaagtggaatgtataaattctgtttccataatcctgaaacaacaccagagaccgtctctttctacatacatgttggccacattcccaatgagcataacctcgcaaaagatgaacatttggacccgattaatgttaaaattgctgagctgagagaggcattggaatctgttacggcagagcagaagtacttgaaagcacgtgatactcgtcatcgtcatactaatgagagcacaaggaaacgtgttatattttacacaatgggtgagtacattttcctggctcttctgagtggacttcaggtcgtgtacattcgccggctgtttagcaagtcagtagcgtataatagggtttaaggcatcatgctgaaactgaagcttcctggcttactctcttcacagcaattggggcagtatgtcggctctaacagagtttagaaaaacatgtcatgtgtgtaacaaagcatatatgctggatcatgatttttatttgcaacagaacttttggattttatttagtttttactttattttgctgatgcgaaagatgtggagagcgacaattgtatgaaaaaacaatatatttgatgtaataaagaagcatatcattcgttatattcttggaaatattcagaacctgtttagtgatttgattc

SEQ ID NO: 5707 - DNA, 1114 bp, Eutrema halophilum
atctcaaagtctttaatgtttaaagaccagaagccgttgaccagctccaaaatctcattgtttcgtcataaaccggttttggtttctggtttagtcagctaagcgcaattaaatcctcttgtcttcttctttacttacgctcgacgaattttctcgagaaacaaacggaaaaatttttgatccaaggagagaaagtaagatctaaaaaaagatggagagcagacaagcgaggaactcgaagatccatgtctttgtgctggttggtctgattctattgagctcgatcgagcgaatctcgtcgctctcagtgaccgtgaacgacgatgaatgcgtccaagagtacgtcctttacgaaggagataccgtctccggaaacttcgtcgtcgttgaccatgatatcttctggggatcagatcatcccggtttggatttcacggtgacatctcctgctgggaacattgtacaaacattgaagggaacatctggagataagttcgagtttaaggcaccaagaagtggaatgtacaagttctgtttccacaacccttactctactcctgaaactgtgtccttctatattcatgttggtcatattcccaacgagcacgacttagccaaagacgaacatttggacccagtaaatgtgaagatcgctgagctgagagaggctttggaatctgttgttgctgagcagaagtatttgaaagcacgtgatactcgtcaccgtcacactaatgagagcacgagaaagcgtgtgatattctacacagtaggagagtacattttccttgcggcagcaagtggacttcaggttctctacattcgcaagctcttcagcaagtcggttgcatacaacagggtttgaacataacggaacttcacctaggttttgttttcctttatgtttgaatcggtgaacaaatcataagaaaagtgttagttaattaagagcttaatagcaaaagaccccttttttgttttttggtttctacaaatttttttttcttctagccttctgtttacttatgtttaacatgaagaacttgataagcttattctgattcatggatcttgcctcttctctatgatagtatcatttgttcacttgttttca

SEQ ID NO: 5708 - DNA, 904 bp, Malus domestica
cccacacaaagaccaccttcccatctcctcgtccttcaacttcattcctttgacccgaaaacagaaaagacaaaaaaaaaaaaaaaatggagggaagggcgaggggtttgacgctgattggccttcttttggtgagcttcgtcggaaagatcgcatcgctatcggtgacagtgagcgacgtcgaatgcgtgtacgagtacgtgctttacgaaggcgataccgtttcgggcaacttcgtggtcgtcgatcacgatattttctggggcgccgatcatcccggcctcgatttaatcgtgacatctcctggggataatacggtgcacacttcgaagggaacatctggtgataagtttgagtttaaagccccaagaagcggaatgtacaaattttgttttcacaatccttactcaacgccagagactgtttcttttaacatacatgttggtcatattcccaacgagcacaatattgccaaagatgaacatctagacccaataaatgttaaaattgctgagcttagagaagcattggagtcagttacattagagcagaagtacttgaaagcacgtgatgttcgacatcgtcatacaaacgagagcacaaggaggcgggttgtgttgtatacagtggcagagtatcttgcgctggctgctgcgagtgctttgcaagtcgtttacattcgcaaacttttcagcaaatcggttgcatacaatcgggtttgaactgcttggttcttgttattgtctattttaacacaggatgaacctcatagattatttcaaatccgtcttctgtgtaacaagttatgaaaagtttatactattttggttcttagttttcaagtgcattgacctacactttgaaatgtcatggttttagttggtatatgggagttcttcaaaaa

SEQ ID NO: 5709 - DNA, 1288 bp, Vitis vinifera
aaaataattaaataaataagcgactaaaaaaatcgtaggttttctataggctatattcattcttcttctccttgatccaccgatcgattttcaacccaaaaccctaattcaagatggagaggaggcacacgcacagatgtgcaaccggctttatttttatagctctctttttcagctttatccaccgtatctcagctctctccgtcaccgtcaacgaagtagaatgtgtttatgagtacgttatctacgaaggtgacaccgtttctgggaactttgttgtcgtcgatcacgacattttctggggctctgatcaccctggcatcgatttcactgtgacgtctcccgcaggcaacacggtgcacactctaaagggaacatctggggacaagtttgaatttaaggccccacgaagtggaatgtacaaattttgtttccaaaattcttatgcaacacctgagactgtctctttctatatacatgttggccatattcccaatgagcacaacctcgccaaagatgaacatttggaccccataaatgttaaaattgctgagttgagagaggcactggaatctgttacagcagagcagaagtatttgaaagctcgagatactcgtcatcgtcacacaaatgaaagcacaagaaagcgtgtcatattttacacgctgggtgagtaccttttgttggctcttgcaagtggacttcaagtcgtttatatccgccgattgttcagtaaatcagtggcatacaaccgagtttgaggtagcatgtttgagaggcttgactgatgtaactgttgagtgaagagaattatgtattgtgtaacaaaacatggttatactatttatcccttgcttctatttataatgtgatattcaaagataatgttgtaggtttaccttatttacaagttccactggctgtgaagaatgattctgagtgggaaaagttatggattttaacaaaaataaaactcagaagcatgtgcactgcactgtctacctctggatgacttgattctaatcagaacaggtggggatgctacttgttttggttaaaaggaaatggaagagaagtgggagcaagtgcatgtgaatgtccaaacgtagaaagtcttgactcttttttggtgctgcatagtatcgggtggtggttatgaatgtggttggtgaggtgaaatcatataaaccaaagtagactgctagcttttcagtattcacatgtcttcccgtaatagcagagaaaatgccactgtcatctctctctctctgctgattgagtctctttc

SEQ ID NO: 5710 - DNA, 1089 bp, Lactuca sativa
gggttgttccaacccggaagaagccctgaaaaagcgtctgggtgcaaatcgttttgtcaatcggaaggaaatcggtagatggagagaggagagagaacaatgaaagtatatgcgattttggggcttcttctcttttctgctttcgtcggcgatgtatcggctctttcagtcaccgtgaacgacgtcgaatgtgtatacgagtatgtactttacgaaggcgataccgtttcaggcaactttgttgttgtcgatcatgatatattctggagctccgatcaccccggcatcgactttatcgtgtcatctcccggaggaaatgtagtacaaaccatgaaaggaacatctggagaaaaatttgagttcaaagctccaagaagtggaatgtatcaattctgtttccataatccttactcaactccagaaactgtctctttctacatacatgttggtcatattcccaatgagcatgacctagcaaaagatgagcatttggaccctgtgaatgtgaaaattgctgaattgagggaggcattggaatctgttacagctgaacaaaaatacttgaaagctcgtgatgctcgacatcgccatacaaatgagagcacgcataaaagggtgatcttttacacaattggagaatacattttgttggcacttgcaagtggactccaagtggtttacatacgtcgcctgtttagcaagtcggttgcatacaaccgggtttgagctttgaatcaatcaattgtatcttatctttcttcttatatttattgttatagattagaactcgggaacatttatgttatctatcgtgtttagagcttttcgatgttttacctttttacttaccttcaattaaattaatgcaatcttgcaattttcaacttgatgttttctttgctttcatatggttggtttattcttcaaggctgtgggggattttggtggagatttggagttcgggtttccttttttctcagtaacttgtattattgtgtatatggttaaagtggttaatgggtaatgacgtgtgtttggataaagagttgtaaacataaagttgatttttttagttccaaaaaataggct

SEQ ID NO: 5711 - DNA, 948 bp, Vaccinium corymbosum
ggtttgttctctctctctctctgagctctcgattcgcctttgttcagcggctgggaatcggaattggaatcgaaattgaactatcaaatccaaaaatggagagaggagaaagaaagaaggcgcatgcttgggtaatgctagggcttcttgcgctgagcttcttcgtgggagacgtcttgtctctctccgtaaccgtaaacgacgtcgaatgtgtctccgagtacgtcttctacgaaggcgactccgtctccggtaacttcgtcgtcgtcgatcacgacatcttctggagctcggatcaccccggcatcgacttcatcgtgtcgtcttctgcaggtaatgtggtgcactctttgaagggaacagctggcgacaagttcgagtttaaggccccaagaagtggaatgtacaaattctgtttccataatcctcactcaacaccagagactgtgtccttctacatacatgttggccacatccccaatgaacatgacctcgccaaagacgagcatttggaccctatcaatgttaaaattgctgagctcagggaggcattggaatctgttacagcagaacagaagtacttgaaagcacgcgatgttcgtcatcgtcatacgaacgagagcactcggaagcgtgttatattttacacgctgggagagtacattttgctagctatggccagtggacttcaagttgtgtatatacgccgcctgttcagcaagacagtcggatacaacagggtttgacgcatggcatcaaaactgtctctcttgctgttttatttggtaaccaattggattacagttttgctagtacgtctgtgtgtagaaaaacaatgacggtgactatttttcccttgcatgcaattttcgacagacctcttgacatgatgacaaattctctgcgaaaaacaacacattatgtcttgagatatacagactgattaat

SEQ ID NO: 5712 - DNA, 1080 bp, Vaccinium corymbosum
tctctctctctctgagctctcgattcgccttttgttcagcggctgggaatcggaattggaatcgaaattgaactatcaaatccaaaaatggagagaggagaaagaaagaaggcgcatgcttgggtaatgctagggcttctagcgctgagcttcttcgtgggagacgtctcgtctctctccgtaaccgtaaacgacgtcgaatgtgtctccgagtacgtcttctacgaaggcgactccgtctccggtaacttcgtcgtcgtcgatcacgacatcttctggagctccgatcaccccggcatcgacttcatcgtgtcgtcttctgcaggtaatgtggtgcactctttgaagggaacagctggcgacaagttcgagtttaaggccccaagaagtggaatgtacaaattctgtttccataatcctcactcaacaccagagactgtgtccttctacatacatgttggccacatccccaatgaacatgacctcgccaaagacgagcatttggaccctatcaatgttaaaattgctgagctcagggaggcattggaatctgttacagcagaacagaagtacttgaaagcacgcgatgttcgtcatcgtcatacgaacgagagcactcggaagcgtgttatattttacacgctgggagagtacattttgctagctatggccagtggacttcaagttgtgtatatacgccgcctgttcagcaagacagtcggatacaacagggtttgacgcatggcatcaaaactgtctctcttgctgttttatttggtaaccaattggattacagttttgctagtacgtctgtgtgtagaaaaacaatgacggtgactatttttcccttgcatgcaattttcgacagacctcttgacatgatgacgaattctctgcgaaaaacaacacattatgtcttgagatatacagactgattaataattttacttttgcattttgtccatcagagtagaagttggtttccctctttttcgtagaaatttgggaatgatttcaaaaatgtaccatgttgcaaaaatgtcgaccgctgttattctgcatttgacttcatttgcctgg

SEQ ID NO: 5713 - DNA, 862 bp, Taraxacum officinale
cattaggcttcgtggttttctgtatatccctctcttccatccttcgtctactttgtttcccgttgatccatcaaccactccctgaaaaaagttactttgtgaattgaaaggaattgggaagatagagagaggagagagaagaatgaaagtatacgcgattttggggcttcttctcttttctgctttcaccattgatgtatctgctctttcagtcacagtcaacgatgtcgaatgcgtatacgaatacgtactatacgaaggcgatacagtctctggcaactttgtagttgtcgatcacgatattttctggagctccgatcaccccggcatcgacttcattgtatcatcacctggaggaaatgtagtgcaaacaatgaaaggaacatctggtgaaaagtttgagttcaaggctccaagaagtggaatgtaccaattttgtttccataatccttactccactcccgagactgtctctttctacattcatgttggtcatattcccaatgagcatgacctagcaaaagatgagcatttggaccctgtgaatgtgaaaattgctgaattaagggaggcattggaatcagttacagccgaacaaaaatacttgaaagctcgtgatgctcgacatcgacatacaaacgagagcacacacaaacgggtaatcttttacacgattggagaatacatattgctggcactggcaagtggactccaagtggtctacattcgccggctctttagcaagtctgttgcatacaaccgcgtctgagtttgtatcttttttatattgttattattgttattatatactttagaactcgcgaaaatatgaaaaagaaaacctaccggctaacgagatgcc

SEQ ID NO: 5714 - DNA, 834 bp, Lactuca sativa
gctcggcggggatcggaggaatcggtagatggagagaggagagagaacaatgaaagtatatgcgattttggggcttcttctcttttctgctttcgtcggcgatgtatcggctctttcagtcaccgtgaacgacgtcgaatgtgtatacgagtatgtactttacgaaggcgataccgtttcaggcaactttgttgttgtcgatcatgatatattctggagctccgatcaccccggcatcgactttatcgtgtcatctcccggaggaaatgtagtacaaaccatgaaaggaacatctggagaaaaatttgagttcaaagctccaagaagtggaatgtatcaattctgtttccataatccttactcaactccagaaactgtctctttctacatacatgttggtcatattcccaatgagcatgacctagcaaaagatgagcatttggaccctgtgaatgtgaaaattgctgaattgagggaggcattggaatctgttacagctgaacaaaaatacttgaaagctcgtgatgctcgacatcgccatacaaatgagagcacgcataaaagggtgatcttttacacaattggagaatacattttgttggcacttgcaagtggactccaagtggtttacatacgtcgcctgtttagcaagtcggttgcatacaaccgggtttgagctttgaatcaatcaattgtatcttatctttcttcttatatttattgttatagattagaactcgggaacatttatgttatctatcgtgtttagagcttttcgatgttttacctttttacttaccttcaattaaattaatgcaatcttgcaattttcaa

SEQ ID NO: 5715 - DNA, 648 bp, Cucumis sativus
aaaatggagaggagggtgagagagaagggtctcggatttctgttggcggcttttcttctgttgagcctaatcgccggaatcgattccatttctgtcactgtgaacgaggttgaatgcgtctatgagtacgtattgtacgaaggcgactctgtttctgggaattttgtcgtcgtcgatcatgatattttctggggtgccgatcatcccggcatcgaattcactgttacatcccccgcaggtaatgtggtacattctttgaaggagacatctggtgacaagtttgagtttaaggctcctcgcagtggaatgtataaattctgttttcataatccctactcgactccagagacggtttctttctacatccatgttggtcacattcccaacgaacatgaccatgctaaagatgaacatctagaccccataaatgttaaaattgcagagcttagagaggcattggagtcagtcatttctgagcagaaatatctgaaagcacgtgatgcacgccaccgtcacacaaatgagagtacaagaaagcgtgtaattttctatacagtgggagagtatttgttgcttgctgttgcaagtggccttcaggtcatttatattcgtcggctcttcagcaagtcggttgcgtataaccgtgtc

SEQ ID NO: 5716 - DNA, 715 bp, Euphorbia peplus
ggggaaataattttcaatcaatcggagatgcagagacggcagatcaatttggcggtggtggttcttttatggtgcttaattgggcgtatagccgctatctctgtcaccgtaaacgacattgaatgcgtctatgaatacgtcctctacgaaggcgattccgtttccgggaacttcgtggtggttgatcacgatattttctggagctccgatcaccctgggatcgatttcagcgtgacttctccttcgaataatttagtacacactataaaggggacatctggggacaaatttgagttcaaggccccaagaagtggaatgtacaaattttgttttcacaatccttactcaactccggagacagtttctttctatattcatgtcggccatattcccaatgagcatgatcttgctaaagatgagcatttgaatccaattaatgttaagattgctgagcttagggaggcattagagtcagttatagcagagcaaaagtatttaaaagcacgtgatgtgagacatcgccggaccaatgaaagtacacggaagcgagtgataggatacacagtgggagaataccttttgttggctattgtaagctcacttcaggtagtatatattcgtcgccttttcagcaagtcagtggcatataaccgggtctgagcaccgtgttttcaaattttactggacaaattttgagaaatgaatattcgtattt

SEQ ID NO: 5717 - DNA, 998 bp, Gossypium raimondii
cggcgtcgtataaagtaacgagaaacggtgccgttaacactatcaacgcagagtacatggggtggtgggatgctcaaattctatatcatacaccagagtttttgacttctttgcacaactgttagaaatcaaatcaaaagagagaaaaaagaaatccccaaatctgaaccctaaaagatggcgaagatatggggaaagatgtgggctttgatgggtttgcttctttttaattcggtgtgtaatgtttcctccctttcggtgaatgtaaacaacatcgaatgtgtgtacgaatatgtgctttacgaaggagacacgatttccggcaactttgtcgtcgttgaccatgatattttctggggttccgaccaccctggcattgatttcactgtgacttctcctctgggtaatacagttcacgaattgaaggggacatctggggacaagtttgaagtcaaagccccaagaagcggaatgtacaaattttgttttcacaatccccactctgcaccagagaccgtctctttccatatccacgttggccatattcctactgagcatgatcttgccaaagacgaacatttggacccaattaatgttaaaattgccgaacttagagaagccttggaatccgttacagcagaacaaaagtacttgaaagcacgtgatactcggcatcgtcatacaaatgagagcacaaggaagcgagttataggatacacagttggagagtacattttgctaactctagttagtgcacttcaagttatctatatccgccaactcttcagcaaatcagttgcgtacaaccgagtttgaaccacttgatgtctgattattacttttattatgtattttgtagacgagttcacagaaaaattatgcaatcaaacagttcggtgttttatgtttttattttaaatacagtgtagcttcttgacattaaagttttagactgacttctatcaaattgacattcttttttactttccattggaaac

SEQ ID NO: 5718 - DNA, 906 bp, Liriodendron tulipifera
gtttcctctctctctctctctgtctccatctatctctcccccgttgagatcagatcattccgaaacccccaaacgagaagaagaacaaatccgaccatagatccatggagagaagaaagacattcagatcagcgggcgagatctttctactcctagtcttcttctttggcttctttcgccatctctcggccatctccatcaccgtaaacgacgtggagtgcgtatacgaatacgtactatacgagggcgacaccgtatccgggaacttcgtcgtcgttgatcacgacatcttttggagctccgatcatcccggcatcgatctcaccgtgacatctccaggtggtaatacagtgcaccaattgaagggaacatctggggacaagtttgagttcaaggccccaagaagtggaatgtacaagttctgttttcaaaatccttactcaacaccagagactgtatctttctacatccacgtcggacatattcccaatgagcatgaccttgccaaagacgagcatttggatcctgttaatgtgaagattgcagagcttagagaggcattggagtctgttacagcagagcagcaatacttgaaagcacgtgatgctcgtcatcgtcatacaaatgagagcactaggaggcgtcttatcttctatacacttgcggagtaccttgcgttggcatgtgcaagcgggcttcaggtagtttatatccgacgtctgttcagcaagtcagttgcatacaacagggtgtaatgctgagtacattttgtcttccatgttatttatcagaaggggaaaaacaattgatgttatgccttaatgactcttcagtatttgtagacattttgatgcattagaaatttactttagtataaaattaagtgcttttcacaaaaaaaaaaaa

SEQ ID NO: 5719 - DNA, 725 bp, Olea europaea
agccgtctatcggctctatcggtaacggtgaacgacgtggaatgcgtatacgaatacgtattgtacgaaggcgacaccgtttccgggaatttcgtcgttgttgaccacgatattttctggagttcagatcaccctggcattgatttcagtgttacatctcccggcggtaatacggtccatacattgaaaggaacaccgggggataaatttgagtttaaggccctcagaagtggaatgtacaaattctgtttccataatccttattctacaccagaaacagtctctttctacattcacgttggtcatattcccagtgaacatgacctcgccaaggatgaacatttagaccccatcaatgtcaaaattgctgaactgagggaggcattggagtctgttacagcagagcagaagtacttgaaagcacgtgatggtcgtcatcgtcatacaaatgagagcacacggaggcgcgttatattttacacagttgctgaatacattttgctagctcttgctagttcactccaagttgtgtatatacgccgcttgttcagcaagtcagttgcgtacaatcgtgtttaatgaaatcttgtgaagcttgctgtccgttccccacaacctaattcttgaaccgttaaccttgacgtttggagagaatcacatgcttgttaacaaaagatgatcttggattgacagttctttttttctttggaatcagaaagcaactt

SEQ ID NO: 5720 - DNA, 1128 bp, Platanus occidentalis
ttttcttcgtcgtttcagatcatacaaaagcttcagattctccgaggagaagaagagcgttaatcgaagtcgaaagaacgtggaatcaatggagagaaggagattgggatccgcgaagatgttaataattctagggtttctctttagcttccttcgccatctgtccgctctttcggttactgtaaacgacgtggagtgcgtttacgagtacgttctctatgaaggtgactctgtttctggaaactttgttgttgttgatcacgacgtcttctggagctcggatcatcccggcattgatttcattgtgacatctcccgggggtaatacggtacattccttgaagggaacatcaggggacaagtttgagttcaaggccccacgaagtggaatgtacaaattctgtttccataacccttattcgacaccggagactgtatctttctacatacatgttggccatatccccagtgagcatgatcttgctaaggatgaacatctggaccccataaatgttaaaattgctgagctgagagaggcattggagtccattacagcagagcagaagtacctgaaagcacgtgatactcggcatcgttatacgaacgagagtactagaaagagggtcatcttctatacacttgcagagtaccttctgctggcttgtgcaagtggattgcaagtggtgtacatccgccgcctgtttagcaagtcggttgcttacaacagggtttgattgcatatgcatccgtttatttaataactgcctttttatatttaaaaaaataacattagataactgtacaatctcttatttaagtgatagtgttgtttacaatcttttgtttcgtgactggggcctggtttcaatggaactagcaacctgtaaccaagtgagaagataatttcctgagctgcaatggttattgatgccttgtgaaagtgaaaacagaggttagacatgaagtagtggaagaagctctgctgatttatccaattagcaggaagaaaaagagtatactttgatattttgcattcggctaagattagtctacagtcctttcttctgcttcttcttctctctcaaaagttattggatgtaaatcttctgtgaccaaaatttgtgtgatc

SEQ ID NO: 5721 - DNA, 1101 bp, Triphysaria pusilla
acaacacgactgaatcagtaatttccacattcaaaaacctgaaactaaaaccggggccccgaataatcagatccggttcaatgaagagggagggaggaaatatcaatcgcggcgcagccgcttacgctcttttggcgctcctgcttttgagcacggcgagccatgtatcggcgctgtctgtgacggtcaacgacgtagagtgcatatacgagtacgtattgtacgaaggcgacaccgtttccggtaatttcgtcgtcgtcgatcacgatatcttctggagctcagatcatcccggcatcgaatttattgtgacatcgccggcgggtaatactgtgcacacgttgaaaggaacatctggggataaattcgagtttaagtctcctaaaagtggaatgtacaaattttgtttccataatcctcattctacaccagagacggtctctttccacattcacgttggccatattcccactgaacatgacctggcgaaggatgaacatttggaccctatcaatgtcaaaattgctgagctaagggaggcactggaatctgttacctcggaacagaagtacttgaaagcacgtgattctcgtcatcggcgtacaaatgaaagcacaagaaagcgcgtcatattttacacggttgcagagtaccttttgctagcgcttgtaagtgggcttcaggttgtgtacatacgtcgcttgttcagcaagtcatttggatacaacagagtttgatgaaatttgcctaactgactggaatttgatttgctcgatgcgaggagtgaatttaggagggggacaacaaagagggtatttatttgactgcttgtgccttagaaagaggaaatcatcttttagaataaggaagaaaagaaaattgaacttgagatgttttcacatagttgttggtaatttatggagttttctgccactagatacatttttcatatttacagaaccttttagagtattccagcttttgtatcagttgtgttctttttttgctttcaaaaatcaaaaggcagcacttctaatcaacaatgaaagctaataatcaaataaagcagcaatgttttgatcgaaaaaaaaaaaaaaaaaa

SEQ ID NO: 5722 - DNA, 1096 bp, Vigna unguiculata
gtgatcaaccataaactttactcaccaggtgaaagcaaaaggctcgaagcgaaaccatgatcaaacatgttctttgctttttggtattccttcacgcatttcatcgaacacatggagttgagtacagtgtcactaacaaggctctctcaactcccggtggagtagctttccgtgacaaaataggagcagactacgcgaagcgaacgctcgactctgccacccaattcatatggagggtccttcagctgaacaaccccggggacagaaaaagcgtgcagaaggtaagtttattcgtggatgacatggatggagttgcgtatacgagcaacgaccagatccatctgagtgcaagatacgttggaaactaccaaggggatgtgaagagagaggtttcaggggtgctgtatcatgaaatggtccacgtttggcagtggaatgggaatggtggtgctcctggggggttgattgaaggcatagcagacttcgtgaggctgaaggcaaactatgcacccagtcactgggtgaaagcggggcaaggtcagaaatgggaccagggttatgatgttactgctcgctttttggactattgtaatactctcaaaggtgggtttgtggcacagttgaacaagttgatgaggaatggttacagtgatcaatactttgttcagttactgggaaaaccagtggatcagctgtggcgagattataaggccaagtatggcaatattgcctgagaggactagctgcaaattgaagaataaatgagtatatgactatgttgttcaataaaattgtaccagctctaagattctgctattaattacgtattgaaccatatgtcaaagaaatgatagagaaaaatcgttcacatgttgacatgttgtaaggaggtaatattttgtgttgttgaatctttattccaccaggcttaattgattcaatccaagaaattataaaattaaataaaataatatttacgcagaaaaaaggtggagtaagcttagctataatcgttggattttttttcttttcttaaaataagattgtacagattatattacactatatttagttttgatgtgctttcgaggttggc

SEQ ID NO: 5723 - DNA, 1138 bp, Vigna unguiculata
  misc_feature (38)..(38): n is a, c, g, or t
  misc_feature (963)..(963): n is a, c, g, or t
gttttctataaaaagcaagcaccaaactcaatccttgngcagtgatcaaccataaactttactcaccaggtgaaagcaaaaggctcgaagcgaaaccatgatcaaacatgttctttgctttttggtattccttcacgcatttcatcgaacacatggagttgagtacagtgtcactaacaaggctctctcaactcccggtggagtagctttccgtgacaaaataggagcagactacgcgaagcgaacgctcgactctgccacccaattcatatggagggtccttcagctgaacaaccccggggacagaaaaagcgtgcagaaggtaagtttattcgtggatgacatggatggagttgcgtatacgagcaacgaccagatccatctgagtgcaagatacgttggaaactaccaaggggatgtgaagagagaggtttcaggggtgctgtatcatgaaatggtccacgtttggcagtggaatgggaatggtggtgctcctggggggttgattgaaggcatagcagacttcgtgaggctgaaggcaaactatgcacccagtcactgggtgaaagcggggcaaggtcagaaatgggaccagggttatgatgttactgctcgctttttggactattgtaatactctcaaaggtgggtttgtggcacagttgaacaagttgatgaggaatggttacagtgatcaatactttgttcagttactgggaaaaccagtggatcagctgtggcgagattataaggccaagtatggcaatattgcctgagaggactagctgcaaattgaagaataaatgagtatatgactatgttgttcaataaaattgtaccagctctaagattctgctattaattacgtattgaaccatatgtcaaagaaatgatagagaaaaatcgttcacatgttgacatgttgtaaggaggtaatattttgtgttgttgaatctttattccnccaggcttaattgattcaatccaagaaattataaaattaaataaaataatatttacgcagaaaaaaggtggagtaagcttagctataatcgttggattttttttcttttcttaaaataagattgtacagattatattacactatatttagttttgatgtgctttcgaggttggca

SEQ ID NO: 5724 - DNA, 1117 bp, Vigna unguiculata
ataccttctaccaaatctcttccaaattccacactttcccattcccaaacccaccctttcttcatggcttccctcaaccttcttccccaccctccacccttttctttttcctcttcttcctttcacagattccgatgcaacactcttcttctcgcgccaaaactttcccagcgcaggccttcttttctggtcaaatctgccgtgggcgtggctgaacctgctgcatattcttccggctacgctggggacacttctgattccatctcctctctgaagctgaatctgctgagtgctgtttctgggctgaatagaggtcttgctgctaatgaagatgatctgcgaaaggctgacggtgcggctaaggaacttgaggctgctgcaggacttgtggatctttccgatggtcttgataaattgcaaggaagatggaaactcatatatagcagtgcattctcatctcgaactctaggtggtagtcgccctggacctcccattggaagactccttcccataactcttggacaggtttttcaacgcattgacatcttaagcaaagattttgataacatagtggagcttcagttgggtgctccatggccactaccaccccttgaagtaacagccacattggctcacaaatttgaacttataggatcttcaaagataaagatagtatttgagaaaaccactgtgaagacagctgggaatttagcacagttgccaccattagaggtgcctcgaattccggatgcattgaggccttcttccaatacaggaagtggtgaatttgaagttacatatcttgactcagatacccgcatcacaagaggggacagaggcgagctaagggtctttgtgatttcttgagttttttctcaatgcaaacctcagtttttcatcttcttgtcttctttttttctttattcttgatactatttgttcatagttccccaaaattgtaaacaagaatttatgaacggaagtaaacaccactgtaacatgtatttacggatggaatggaactaaaccttctacgtaaatccaagtttaaatgtaacatatttctttcttaaggaataactgtttacacgtcattcaattaaaaaaaaaaaaaaaa

SEQ ID NO: 5725 - DNA, 1206 bp, Cajanus cajan
tactcgttggttgtgttgttctctctgtctttctcactcaaatctcaatcacacactcaattctccaaaaatctcttccacctttcatggcttcccttacccactctccaccttcgctctctcacttctcttctccttcccttcacaggccccgccgcaacctccatcttctcgcgccaaaaccatctcaaccaaggccttctcttgttatcagttccgtgggtgtcgctgacccttctccttcttccttttcctacgccggggacacctccgattccatctcctctttcaagctcaatctgctgagtgcggtttctgggctgaatagaggtcttgctgcaaatgaagatgatcttcgaaaggcagatgatgcggctaaggaacttgaagctgctggaggagttgtggatctctcggttggtcttgatagattgcaaggaagatggaaactcatatatagcagtgccttctcttctcgtactcttggtgggagtcgccctggacctcccattggaagactgcttcctataactcttggacaggtttttcaacgaattgacatcttaagcaaagattttgataacatagtggagcttcaattgggtgctccatggcccttgccacccctcgaagtaacagccacattagcgcacaaatttgaaatcataggatcttcaaagataaagataatatttgagaaaaccactgtgaagacggctgggaatttgtcacagttgccaccattagaggtacctcgaattccagatgcattgaggcctccatctaataatacaggaagtggtgaatttgaagttacatatcttgatgcggatacccgcgtgacaagaggagatagaggcgagctaagggtctttgtgatttcttgagttcctggtgtatgcactatgcattttctctgttggacttgaaagaaatgttccaacacttgtatctgtcatttttttttcttctttttcctgatagtatttgttataagtgcttcaattttgtaaacatggatttacagatggaactaaaccctactattagcttcaaggaaacaggatactttttgtttaaatgtaacatatttcttttgaaggaataattgcttatagatcattagatatggacacttgaatacactgttgagagagttcctttagttttagaccctgttcacattgatacaatgtttttttcttt

SEQ ID NO: 5726 - DNA, 1173 bp, Phaseolus coccineus
ctcagtcacatgctcatcttctccaaaaatctcttccaaattctacactttcccattccaaaacccactattcatggcctccctcaaccttcttccccacccttcacccttctcttttttctcttcttcccttcacaggtcccgatgcaacacccttcttctcgcaccaaaaccttctcaagccagaccttcttttcttgtcaaatctactgcgggtgtggctgaccctgcttcatattcttctggctacgctggggacacctcagattccatctcctctctgaagctcaatctgctgagtgctgtttctgggctgaatagaggtcttgccgctagtgaagatgatctgcgaaaggctgatggggcggctaaggaacttgaggctgctggaggacttgtggatatttccgttggtcttgataaattgcagggaagatggaaactcatatatagcagtgcattctcatctcgaactctaggtggtagtcgccctggacctcccattggaagactccttcccataactcttgaacaggtttttcagcgaattgacatcctaagcaaagattttgataacatagtggagcttcagttgggtgctccatggccactaccaccccttgaagtaacagccacattagctcacaaatttgaacttataggatcttcaaaggtgaagatagtatttgagaaaaccactgtgaagacgggtgggaatttggcacagttgccaccgttagaggtgcctcaaattccggatgcattgaggccttcttccaatagaggaagtggtgaatttgaaattacatatcttgactcagatacccgcatcacaagaggagatagaggcgagctaagggtctttgtgatttcttgagttcctgcttaatgtaactacgcatttcctctgttggacttcaaaaatattccaacacctcactctttcatcttcttccctttttttttctttattctttatagtatttgtttctagttcctcaacattgtaaacaagaatacagtgtaaacatatatttagggatggaactaaacccttctgtgtagttcaaaggaaacaggctcctttttgtttaagtgtaatatttctttctcaaggaataattgtttacagtccctaaatatggacactcgagagaatttcctttcagtttt

SEQ ID NO: 5727 - DNA, 1211 bp, Phaseolus coccineus
tcactcaaatctcagtcacatgctcatcttctccaaaaatctcttccaaattctacactttcccattccaaaacccactattcatggcctccctcaaccttcttccccacccttcacccttctcttttttctcttcttcccttcacaggtcccgatgcaacacccttcttctcgcaccaaaaccttctcaagccagaccttcttttcttgtcaaatctactgcgggtgtggctgaccctgcttcatattcttctggctacgctggggacacctcagattccatctcctctctgaagctcaatctgctgagtgctgtttctgggctgaatagaggtcttgccgctagtgaagatgatctgcgaaaggctgatggggcggctaaggaacttgaggctgctggaggacttgtggatatttccgttggtcttgataaattgcagggaagatggaaactcatatatagcagtgcattctcatctcgaactctaggtggtagtcgccctggacctcccattggaagactccttcccataactcttgaacaggtttttcagcgaattgacatcctaagcaaagattttgataacatagtggagcttcagttgggtgctccatggccactaccaccccttgaagtaacagccacattagctcacaaatttgaacttataggatcttcaaaggtgaagatagtatttgagaaaaccactgtgaagacgggtgggaatttggcacagttgccaccgttagaggtgcctcaaattccggatgcattgaggccttcttccaatagaggaagtggtgaatttgaaattacatatcttgactcagatacccgcatcacaagaggagatagaggcgagctaagggtctttgtgatttcttgagttcctgcttaatgtaactacgcatttcctctgttggacttcaaaaatattccaacacctcactctttcatcttcttcccttttttttctttattctttatagtatttgtttctagttcctcaacattgtaaacaagaatacagtgtaaacatatatttagggatggaactaaacccttctgtgtagttcaaaggaaacaggctcctttttgtttaagtgtaatatttctttctcaaggaataattgtttacagtccctaaatatggacactcgagagaatttcctttcagttttagactctattcaccttcatataatgtttt

SEQ ID NO: 5728 - DNA, 1106 bp, Vigna unguiculata
ataccttctaccaaatctcttccaaattccacactttcccattcccaaacccaccctttcttcatggcttccctcaaccttcttccccaccctccacccttttctttttcctcttcttcctttcacagattccgatgcaacactcttcttctcgcgccaaaactttcccagcgcaggccttcttttctggtcaaatctgccgtgggcgtggctgaacctgctgcatattcttccggctacgctggggacacttctgattccatctcctctctgaagctgaatctgctgagtgctgtttctgggctgaatagaggtcttgctgctaatgaagatgatctgcgaaaggctgacggtgcggctaaggaacttgaggctgctgcaggacttgtggatctttccgatggtcttgataaattgcaaggaagatggaaactcatatatagcagtgcattctcatctcgaactctaggtggtagtcgccctggacctcccattggaagactccttcccataactcttggacaggtttttcaacgcattgacatcttaagcaaagattttgataacatagtggagcttcagttgggtgctccatggccactaccaccccttgaagtaacagccacattggctcacaaatttgaacttataggatcttcaaagataaagatagtatttgagaaaaccactgtgaagacagctgggaatttagcacagttgccaccattagaggtgcctcgaattccggatgcattgaggccttcttccaatacaggaagtggtgaatttgaagttacatatcttgactcagatacccgcatcacaagaggggacagaggcgagctaagggtctttgtgatttcttgagttttttctcaatgcaaacctcagtttttcatcttcttgtcttctttttttctttattcttgatactatttgttcatagttccccaaaattgtaaacaagaatttatgaacggaagtaaacaccactgtaacatgtatttacggatggaatggaactaaaccttctacgtaaatccaagtttaaatgtaacatatttctttcttaaggaataactgtttacacgtcattcaattatgga

SEQ ID NO: 5729 - DNA, 1303 bp, Phaseolus coccineus
agggtaatttaaaattttgtgccggaatttgagtggtagacaccgaattgcatagcttgaatccaatccgctgggaagaagaaaagaatggcttcagctgcgcttcaattctggtatttgacagctcctatttcccaccgttacccccatcagttggcttccctaacctcactgaaattcgcaactcctgtttctgccaccaataccatttatcttcccaaacctctcactgtgcgttttgctcttactgaatccgactcgcccaaatccattcaacctgaccctcaaactcttctccaagaaattgctggcaatttagatcttcctcctgattactttgcacagtttccccgtgatcttcgattagacctaaacgacgccgcgttcgacctttcaaacggacctgttttagacgagtgtggccaagagttgggagagactttgctaaacctctctcgagcgtgggaacttgctgagacagcaacatctcactctttagctaaaaagattcctttaattgaggccaagttgacaggttctgccaaatcagcacttggaaagcgtttgatatctgctggaagaaggtttcaatcaatgggacagtatggccaaggtgagccacaaaagattgcaaaggcaatgattgcagctggtagagctctatgtgctagttcaatgtcagaagtgacagttgaagaaccgaaagaggagactagggtgctgaaatttggagagttgcaggtcgaaataacaccagataaggccaatatcggggctgtaattggatttgtgtttgggattctttcgtgggaaattgctcagggaattcaaaacattcctgacagttctttggagtatgcaaacgacaatgctttgctgcttgctaagtctttaaagggagcattgcttgctcttttctatttctcaacgttcttgtctgcatttacctcggggggacttgttctacttgggttacagctcaaatcaaagaaaggttgagctttaggtgcgccttccctcgttttgcttgtaaatggtgtatatgcacggtctaagtttattagtaattgtagtatatattcatagtaaagtaccaaactcatcacatggttggaaaacaatgaacatagtagcaatacttttgttcaacttgaatatggaatgatatgtacacttcacgacttctgccttttattctcggtaagaaaacagagtaccatttattacattgtcatattttttgtttttctcactaaaatactttttgttgaggaggtttatgaacttgtccttttgtgtgtca

SEQ ID NO: 5730 - DNA, 1335 bp, Cajanus cajan
atctactaatctactaataatctaaataaaagataagtcgcatgaaaaatgtcggaatttcagtggctgacagcctgacactgagtttcatagcttgaatccaagttgggaagtaaacaatggcttcagcttcagcttcgcttcgattctggtcttctatagcacctatatcccactattacacccatcagttggcttccctgacctcactcaaattcggtactccaatttcttctaccaataccatttatctttccaagcctctcgctgtgcgtttcgcgctaacagagtccgactcccccaaatccatagaacctgaccctcaaactcttctccaacaaattgctgacagttttgatcttcctcctgattacttttcacagctcccccgcgatcttcgattagacctaaacgacgccgcgttcgacctttcaagtggacctgttttagatgagtgtggccaagagttgggagagacattgctgaacctctctcgagcttgggaacttgctgacacatcaacctcccactctttagtgaaaaagcttcctttgattgaggccaagttgacaggttcttccaaatcagcacttggaaagcgtttgatatctgctggtcgaaggtttcaatcaatgggacagtatggccaaggtgagccacaacagatttcaaaagcaatgatagcagctgggagagctctatctgctacttcaacttctgcagtaacagttgaacaaccgaaagatgaaactaggatgctgaaatttggagaattgcaggttgaaataacaccagataaggccaatattggtgctgcaattggaattgtttttgggattctttcttgggaaatagctcagggaattcaaaacgctcctgacagttctttgcagtatgcaaatgacaatgccctgctgcttgctaagtctttaaaaggagcattgctttctcttttttacttctcaacgttcttgtctgcatttacctcagtgggacttgtactacttgggatacagctcaaatcaaagaaagattgagctttaggtgtgcccttgcctcagttttgcttgtaaatggtgtagagatgcatggtctctgtttgtgagtaataatagtatataaccaaactcatcatatggtgattggaaaacaatgcacatagtagcaatactttttgttcaacttggcctttagcatctagatgaggttgattttccttcatctttcctgccaattttctaacgtgagtataccattttgcatgctgttgaaagtccaatctaatttacaattgctcaaaagcaatatatattaatgactttgattcgttaccaa

SEQ ID NO: 5731 - DNA, 601 bp, Flaveria ramosissima
tgcctataaatcaaccgcaagtccttcgtccccaaattccgcagatctccacaacagttgaatcaacattcaaaaccaccgtcgttgtcggaaaatggccaccatttcttccgttttcatcctcttgttaaccatcaccgccgtcttcatatgtaacgccgaagcatcctctgtcaaattcgtcaagaagactgtttcttctcaccccatagtcatcttctccaaatcttactgcccatactgtagaagggctaagggtgtgttcaaggagttgaacaagaaaccttatgttgttgagcttgatgagagagaggatggctcagacattcaggatgccctgagcgagatggtcggtaggcgtaccgttccccaagtgtttatcaacgggaaacaccttggaggttcagatgatactgttgaagcttatcaaagtggagaactggctaagcttcttggcattgattcgagtcataagacggacctctgagctttaagcctataagagcgtttaacaatgccatttgtcgtgtagtatgtgaccaagtggttagtttcagttgacttgattctttaggattatgtacaaaatatcgtaaccaaa

SEQ ID NO: 5732 - DNA, 766 bp, Arnica chamissonis
actacagacggcttccttgacggggtaatagggttttggcctttaaatcaagcggaagtcgttcccaaattcagtagatctggttttgacacccacagttggccagcaacacccaaatcgccgccaccgttgtcgaaaaatgaccaagcctgccaccatttcttccattttcatcgtcctgttaacgatcgccgccgtcttcgtatgtaatgccgaagcatcgtccgtcgatttcgtcaagaagacggtctcttctcatccaatcgtcatcttctccaaatcttactgcccatactgtaaaagggctaaaggtgtattcaaggagttgaacaagaaaccttatgttattgagctcgatcagagagaggatggctcgaatattcaggatgcactgagtgagattgtcgggaggcgtacggtgccacaggtgtttatcaatgggaaacaccttggaggctcagatgatactgttgaagcttatcaaagtggacaactggctaagcttcttggcatcaattcgagtcgtaaaacggacctttgagtttgaagccttcaactgcttagtaatgcaatgccattcgtcatgtaatatctaccaatggtagtttcagttgacttgattttctgattatgtcaaaatatgtaccaataaagttaggtcataccgtttgtattacatattcgacttattacctctgtacctatagcgttaaagtagtctcgaggagcattggtgtgtctttagggcatgtatcagattgagacc

SEQ ID NO: 5733 - DNA, 608 bp, Flaveria ramosissima
gtccttcgtccccaaagtctgcagatctccacagcagttgaatcaacattcaaaaccaccatcgctgtcggaaaatggccacaatttcttcccttttcatcctcttgttaaccatcaccgccctcttcatatgtaacgccgaagcatcctccgtcaaattcgtcaagaagactgtttcttctcaccccatagtcatcttctccaaatcttactgcccatactgtagaagggctaagggtgtgttcaaggagttgaacaagaaaccttatgttgttgagcttgatgagagagaggatggttcggacattcaggatgccctgagcgagatggttgggaggcgtaccgttccccaagtgtttatcaatgggaaacaccttggaggttcagatgatactgttgaagcttatcaaagtggagaactggctaagcttcttggcattgattcgagtcataagacggacctctgagctttaagccttcaacagcgtaacaatgccatttgtcgtgtcgtatgtaccaatgcccaatgctagtttcagttgacttgatcttttatgattatgtcaaaaatatgtaccaattaaattagtagcttgtcatatcgtttt

SEQ ID NO: 5734 - DNA, 798 bp, Flaveria ramosissima
aaccttcctatgacttgtgaatgtgaatgaaaacgggctccttgacagagtcatagggttttgcctataaatcaaccgtaaagtccttcgtccccaaattctgcagatctccacagcagttgaatcaacattcaaaaccaccatcgttgtcggaaaatggccacaatttcttcccttttcatcctcttgttaaccatcaccgccctcttcatatgtaacgccgaagcatcctccgtcaaattcgtcaagaagactgtttcttctcaccccatagtcatcttctccaaatcttactgcccatattgtagaagggctaaaggtgtattcaaggagttgaacaagaaaccttatgttgttgagcttgatgagagagacgatggctcggacattcaggatgccctgagtgagatagtcgggaggcgtaccgttccccaagtgtttattaatgggaaacaccttggaggttcagatgatactgttgaagcttatcaaagtggagaactggctaagcttcttggcattgattcgagtcataagacggacctttgagcttcaagcgttcaacagcgtaacaatgccatttgtcgtgtagtatgtaccaatggtagtttcagttgacttgatctttcatgattatgtcaaaatatgtaccaataaagttagtagcttgtcatatcgtttttacagttttatcaatttgggtgtatttaggctcttctatttggtttgatgattgcacatgtgtaatgggtagtgcttttctttggtttttacgagagttttatgtaaaaaaatatt

SEQ ID NO: 5735 - DNA, 740 bp, Cynara scolymus
gggagagttgtccgtaattaagtggaagtcggtccatttctgcagatctggttttgacgtccaagttgaaccaacgacatccaaatcgccgcaagatcagtgccgaaaaatggccagatccgccgccgtatcttccattttcatcatcctgttgatgatcaccgccatctttatgtgtaatgccgaagcatcatccgtcgattttgtcaagaagaccgtttcttctcactccatagtcatcttctccaaatcttactgcccgtactgtaaaagggctaaaggtgtattcaaggagttgaataagaagccttatgtcattgagctggatgagagagaggatgggtggaaaatccaggatgctctgagcgagctggttggaaggcgtacggttccacaagtgttcattaatggaaagcaccttggaggctcggatgatactattgaagcttatgaaagcggacaactggctaagcttcttggcattgattcggggcataaaaccgacctttgagcttcaacaacttcaaaatgacgtccatcgtccaatattttgtgttatactacaaatcgagatgtcttcagtttggtctttttaattgatagagacattagaaagccatggatagcttcggtttatgataatgtcaaaatgtgtacaacgagaatagcgattgatattctgttataaacgatcgtcttcttccctatatttacgcctacacctacgagtatccgttaaa

SEQ ID NO: 5736 - DNA, 645 bp, Gerbera hybrid cultivar
gctgaggtcggtctatttatttccttgacaaatccaagtagatctggttttgacgaaagttcaaccaacaacattcaaatcgctgctgaaaaatggctagatccgccgccatttcttcaattttcatcatcctgttagcaatcatcgccgtctttctatgtaatgccgaagcatcatccgtcgatttcgtcaagaagaccgtctcttctcactccatagtcatcttctccaaatcttactgtccatactgtaaaagggctaaaggcgtgttcaaggagttgaagcaaaaaccttatgttattgagctggatgaaagagaggatggctggaaaattcaggatgccctgagcgagatcgtcgggaggcgtaccgttccacaagtatttatcaacgggaaacacctaggaggttcagatgatactgtcgaagcttatgaaagcggacacttggctaagcttcttggggttgctttgagggataaggccgatctataagactcgataacttaaaatttcctttcatgtaatctttgtgttttcctataagtcaacgatgatggtcaatttgtgctttataaatgaccatttatgtccaaatttttaaaaaatagatagattgaccttaaataaaaaaaaaaaaaaaaaa

SEQ ID NO: 5737 - DNA, 869 bp, Ambrosia trifida
acgggggtaacctacttttactaatttactaaactaaaggttttaattaaacaaattcttgttgttggatattgtatccaaattcatcgctttcattgcaaccaaatcgttagtcaatcagttatttgatggataattgatgcgatttttattcataaacaacgtttgttcatacatttgattcactaatcataaaaactttaaagtaaatcgatggcggatgtgtcaagacgatctggattacgaggaattggtacctggtttaacaagcatatcgttgacccctttgttgaaattcttagcaggggagcgcagcctaaggagttggcattctctgcagctcttggaattacgttaggagtgttcccaattgtcggagtgacttttttcctgtgtgtgttggctgtaacaatgcttgggacttccgtcaatgctccaaccatcatgctagccaatttcgtggccactccgatagagctgagtttgataatagtgttcctacggtttggtgagtttcttacgggtggagctcattttcctttaaccgcttctgctttgaaggacgtattgactggcaaagcttcgaaggagatcttgctaagcattgttcacgcgttattggggtggttggttttggccccgtttatcctcggccttctgtacattgtatttgtaccgtgtttcaccatgttggttcgtaaattcacctcttcagtttctagcttggagagtgatgatgaaccgtcgtacacagaagtgatgcttaaagtaagggatgcttgatgtgtgacaatgtagggaaatatgactgctatgttgtttggttacatgtatatatgtatctctagtgggttgctgttatttcctag

SEQ ID NO: 5738 - DNA, 864 bp, Ambrosia trifida
tattgtatccaaattcatcgctttcattgcaaccaaatcgttagtcaatcagttatttgatggataattgatgcgatttttattcataaacaacgtttgttcatacatttgattcactaatcataaaaactttaagtaaatcgatggcggatgtgtcaagacgatctggattacgaggaattggtacctggtttaacaagcatatcgttgacccctttgttgaaattcttagcaggggagcacagcctaaggagttggcattctctgcagctcttggaattacgttaggagtgttcccaattgtcggagtgactttctttctgtgtgtgctggctgtaacaatgcttgggacctccgtcaatgctccaaccatcatgctagccaatttcgtggccactccgatagagctgagtttgataatagtgttcctacggtttggtgagtttcttacgggtggagctcattttcctttaaccgcttctgctttgaaggacgtattgactggcaaagcttcgaaggagatcttgctaagcattgttcacgcgttattggggtggttggttttggccccgtttatcctcggccttctgtacattgtatttgtaccgtgtttcaccatgttggttcgtaaattcacctcttcagtttctagcctggagagtgatgatgaaccgtcgtacacagaggtgatgcttaaagtaagggatgcttgatgtgtgtcaatgtagggaaatatgactactatgttgtttggttacatgtgtacatgtatatatgtatctttagtgggttgctgttatttcctagcaattccaaagaatttaaaaaagtaacaatcccctaacgaaatacaaacaatgctaa

SEQ ID NO: 5739 - DNA, 977 bp, Flaveria ramosissima
aaatattcaaagaaatcgacccactttacgaaagaggtttataataataatcaaagattcctgttggttgaatttgaagcaacttcatcgattatgaatcgaatttcatcgttttcatttcaatcaaatcgttagtcaatcagtcctttgacggggaatcagcggttttgattcagaaacaagatttgttcatcaatcgtaacaacttcaaagtaaacgagcagaaagaaacaggatcattctgcgtgtaacaatggcggatttgtcgagacgatgccgattacaaggaattggtacctgggttaacaagcaggtggttgagccatttgtggaaatcattagcaggggagcagagcctaaggagttggctctctctgcagctcttggccttactttaggagtgttcccaattgttggagtgactttttttctgtgtgtgctggctataacaatgcttgggacttctgtcaatgctccaactgtcatgctggccaattttgtggctactccaatagagctgagtttgataatagtgttcttacgatttggtgagtttcttactggtggggctcattttcctctaaccgctgatgctttaaagaaggtattgaccggcaaagcttcgaaggagatcttgttaagcattgttcacgcgttgttggggtggatggttttggccccgttgatcctgggcctactgtacgtagtatttgtaccatgtttcaccaagttggtccgtaaattcggttcttcagttacgagcccagggagggatgatgaaccatcttacactgaagttatgcttaaagtaagagatgcttgatgtgtgtattaatagggaaacttgaatactgtgtatatttgtctctttagtggtttgctattatgcctgtcaatgtctgaacaaaaagaaaactacttcccaagaatactaatgctaacttctgctaaacataatgatggtcaaaactttgttc

SEQ ID NO: 5740 - DNA, 743 bp, Flaveria ramosissima
aatttgaagcaacttcatccattatgaatccaatttcatcgttctcatctcaatcaaatcgttagtcaatcagtcgtttgacggagaattagcggttttgattcggaaacaacatttgttcatcaatcgtaagaacttcaaagtaacacgagcagaaaccggatcattgtgcgtgtaacaatggcggatttgtcgagacgatgccgattacaaggaattggtacctgggttaataagcaggtggttgagccatttgtggaaatcattagcaggggagctgagcctaaggagttggctctctctgcagctcttggcattactttaggagtgttcccagttgttggagtgactttttttctgtgtgtgttggctataacaatgctcgggacttctgtcaatgctccaactgtcatgctggccaattttgtggctactccaatagagctgagtttgataatagtgttcttacggtttggtgagtttcttactggtggagctcattttcctctaaccgctgatgctttaaagaaggtattgaccggcaaagcttcgaaggagatcttgttaagcattgctcacgcgttgttgggttggatggttttggccccgttgatcctgggcctactatacgtagtatttgtaccatgtttcaccaagttggtccgtaaattcggttcttcagttacgaacccagggagggatgatgaaccatcttacactgaagttatgcttaaagtaagaga

SEQ ID NO: 5741 - DNA, 744 bp, Parthenium argentatum
ttcttgatcaacaaaataataattgaataaagtttttatttttgcaacaaaaatgaagcagccaatgatgcccaatcccatgttgtcttcatcctttcctcctacaaacatcaccactgatcagatccaaaagttccttgacgagaacaagcaattaattttagcaataatgacaaaccaaaaccttggaaagcttgctgaatgtgcccagtatcaggctctactccagaagaatttgatgtatctagcagccattgctgatgctcaaccacccacaccgtcaccagcaccaacaatttcatctcagatgggcccgctttcacacgcgggtatcccacaaggaggatttttcatgccgcagcatcctcaggcggctgtcatggctcaacaatctcctagctttccgcaacaaatgccagccatgccgtttaatagcccacaagttatgcaacaacctcagatgggcgttaggcccggtgggccaagtgggccaagcagtgtgccgccaagctcagccgctagtgatatctggagaggaagtatgcaagatggtggtggtgctgatgctagtggtgctggtaaagatggtcatggtgctgcagccggtggaccagaagaagcaaaataataaaaacgagtggattgttagtcggatggatgtggataaggtggtctgttacggtagagctagaagcttaatgtgtgacctttacccaagttcacgagcgtcgaactttatgtgtg

SEQ ID NO: 5742 - DNA, 1023 bp, Guizotia abyssinica
aacaggtgagttcaacggtttcaggattcattacaccgcctccttgataagtgactatgtagcttctacttctaggtttcttgagcgacaaaatcattcttgattttcaaagaggaatgaagcagccgatgatgccgaatcccatgatcccttcttcatttcccccttaaaacatcaccaccgatcagatccaaaagttccttgacgagaacaagcaattaattttagcaataatgaccaatcaaaacctcggaaagcttgctgaatgtgcccagtatcaggctctactccagaagaatttgatgtatctagcagccattgctgatgctcaaccacctacgccatcaccaacaccaacaatttcatctcagatgggccccctttcacacgcgggtatcccacaacaaggaggatttttcatgcagcagcatcctcaaggtgctgtcatggctcaacaatctcctggttttccacaacaaatgccagccatgcagtttaatatcccacaagttatccaacctcagatgggtgttaggtctggtgggccaagtgtggtgccgccaagctcagccgctagtgatatctggagaggaagtatgcaagatggtggtgctgctgaaagcagtggtgctggtaaagatggtcatggtgcagcagccggtgggacagatgaagcaaaatagcacaaacgggtgagttattagtcggatggatgtggatagttgatcttttacagtagaactagaagcttgatatgtgatcccccccccagttcacaagcgttgaacgttgtgtgtgtctgtccccgcgcgcgtgtgtgtgtgtaccgtcttatgtaggaatgactagttttgtctgtgtttgttttacagaattagtgaggtttaaatgaaagagtgctgaatccatgatactttcataggggttgccttttaagttaatctctgtgaatgtgattcaaatgaaatttcagcatctctaagacactagcattttaatgcactttaatttgatgttttctat

SEQ ID NO: 5743 - DNA, 1079 bp, Flaveria ramosissima
aagtagagtcaatttcaacgttgagaggccacccaactccttcactgttcatacacatacatcttcaatatttctaggtttttctatcaacaaataattgcaaaagttattgattctgactgtagtaaaaagagcaatgaagcagccgatgatgccaaatccgatgatgtcttcctcgtttcctccgacaaacatcaccaccgatcagatccaaaagttccttgacgagaacaagcaattaattttagcaataatgaccaaccaaaaccttggaaagcttgctgaatgtgcccagtaccaggctctactccaaaagaatttgatgtatctagcagccattgctgatgctcaaccacccacaccgacaccagcaccagcatcaacaatctcatctcagatgggcccacttccacacgcgggtatcccacaacaaggaggatttttcatgcagcagcatcctcaggcggctgtcatggctcaacaaatgccagccatgcagtttaatagcccacaagttatccaacctcagatgggcgttaggcccggtgggccaagtgtggcgccaccaagctcaaccgctggtgatgtctggagaggaagtatgcaagatggtggtccagctgaaagcagtggtgctggtaaagatggtcatggtgctgcaaccggtggatcagatgaagcaaaataacacaaacaagtgagttgttagtcggatggatgtggatagttggtctcgtatggtagaactagaagcttgatatgtgacttttgcccgtgttcaccagcattaaactttgtgtgcgtgtgtgtaccgtcttttttaggaatggctagttttgtgtttggcttaaaattagtgtaggttttagtggaacagtgctgaatccgtgatatcttcatatgggttaccttttaagttagtttctataaatgcggttaaaaagaaatttcagtatctctaaaataataaaaacttcaaaaacatcagcatatcatcaacacacttgtgcagaaagctagaaactaacccattgatttaagggattattctaaggatgatagttgacatcctagaggtt

SEQ ID NO: 5744 - DNA, 779 bp, Ambrosia trifida
aagcagccgatgatgcccaatcccatgatgtcttcttcctttcctcctactaatatcaccaccgatcagatccaaaagttccttgatgagaacaagcaattaatattagcaataatgaccaaccaaaaccttggaaagcttgctgaatgtgcccagtatcaggcgctacttcagaagaatttgatgtatctagcagccattgctgatgctcaaccaccaacaccatcaccagcaccaacaatttcatctcagatgggcccacttgcacacgcgggtatcccacaacaaggaggatttttcatgcagcatcctcaggcggctgtcatggctcaacaatctcctagctttccacaacaaatgccagcaatgccgtttaacagcccacaagttatgcaacctcagatgggcgttaggcccggtgggccaagtggaccaagcagtgtgccgccaagctcagccgctggtgatatctggagaggtagtatgcaagatggtggtggcgccgatggtagtggttctggtaaagagggtcatggtgctgcagccggtggaccagacgaaggaaataatgaaaacgagtggattgttagtcagatggatgtggataggtgtggtctgttacgatagaactagaagcttaatatgtgaaccttttccaagttcacgcgtgttgaactttgtgtgtgtgctgtctgctttaggaacgactagttttgtgtctgttttacagaattagtgaggttttaattaaaagagtgcatgatacttcttactgtttt

SEQ ID NO: 5745 - DNA, 1962 bp, Ambrosia trifida
gtggcaaccaattgaccattgtttgtccgaacataaatgattttaagactcaagatcgttagcattagcatgcctcgaaagattaattaataatttgacacggtacgcagtcggtgcataaccacacaagtcaagttcaacttaaccatggttagccagccactaaacaattcatttttacgcgttcaactccagatctcaccgtcactgacttcccttacacacagcaagatccgcgtcttctagatctaagctgtgtacgcataagcagcaatgccgttactggattcattgacggcgatatctctattactgctcgttagggttttatgcgtgcatgcttcagtccataattacgctggagttaagttcgctagaaaggggaatgcgtatgtagtccatggaggcagtgagggaatctattattctcatcctaatctcaatgattccaaagcattttctaatggcgatgcctatattaagtttgaaaagatcgtatttagaaggccacaagaggcttcaaacttcagcacggggatgatatatgccattcttttcgaggtggatgacagagaaaccataggtgggtcagcttatggaggccaaagagccgtctgttgcactgcagatctcgcaaaattgggtgcgtgtaaagaaggtgaagttattcaccgcctatcaacaacaaatcccgggtggcctgaagtttttggtgtctcgtttgatgtcaatgatgaaacttccactatgcaaccaagatcggtacaaattacaagaacagggatgtataatttgtacttcatgcattgtgagccaaggctcgttgatctggttgtagaaggtgaaaccatatggaaaaatccaaatggttatctccctggtagaatggcaccactgttaaacttctatgggttcatgtcacttgcattcttagttcttggaatcttctggttctctcagtatgcaagattctggaaagaggttctacatttgcaaaactgtataactttagttataacattgggtatgttagagatggcattatggtattttgattatgccgaatttaatgaaagtggggtgcggccaacgggaattaccatttgggcggtaacgtttggcaccataaagcgcactgtttcacgattaatcattttaactgtttctatgggatatggtgttgtaagaccaactttgggtggtcttacttcaaaggttgtcatgcttgggggaacattttttgttgcttctgaagtgcttgaattggtagaacatgttggcgctgttagtgatctctcgggaaaggcaatgctatttttatctctacctgtggcagtcctggatgcattttttgttttatggatattcacctcgctttcttcaactttaaataagctccaggctaaaagaatgatggcaaagttagatatatacaggaaattcaccaatgctttggctgtagctgttatagtctcagtgggctggatatgctatgagctttatttcaagtcaactgatatatacaatgaacaatggcaaaatgcttggattatacctgctttctggcatgttctatcattctctcttctctgtgtcatatgtgctctttgggccccatctcagaattcaatgagatatgcatattctgatgatggaagtgaagagtttgacaaggatgatacattgacactcataaagccatcccctgtttctgtccctgtttctaaaaaagatgtagctgaattaagatctgatgatgaggttgatttggaagaagataaaacagagtaatatatcatctctctcttttgtatgcttatcaactttaaatttctattgttatatttttatagaatttagactacgttattagatgtatattttacaaggagtttaaattattgaagttgaaagtcagtctgcaattcgatattcgaagttgaggttgatgtcaaaaaagaa

SEQ ID NO: 5746 - DNA, 1896 bp, Ambrosia trifida
ggttagccagccactaaacaattcatttttacgcgttcaactccagatctcaccgtcactgacttccctcacacacagcaagatccgcgtcttctagatctaagctgtgtacgcataagcagcaatgccgttactggattcattgacggcgatatctctattactgctcgttagggttttatgcgtgcatgcttcagtccataattacgctggagttaagttcgctagaaaggggaatgcgtatgtagtccatggaggaagtgagggaatctattattctcatcctaatctcaatgattccaaagcattttctaatggcgatgcctatattaagtttgaaaagatcgtatttagaaggccacaagaggcttcaaacttcagcacggggatgatttatgccattctttttgaggtggatgacagagaaaccataggtgggtcagcttatggaggccaaagagccgtctgttgcactgcagatctcgcaaaattgggtgcgtgtaaagaaggtgaagttattcaccgcctatcaacaacaaatcccgggtggcctgaagtttttggtgtctcgtttgatgtcaatgatgaaacttccactatgcaaccaagatcggtacaaattacaagaacagggatgtataatttgtacttcatgcattgtgaaccaaggctcgttgatctggttgtagaaggtgaaaccatatggaaaaatccaaatggttatctcccgggtagaatggcaccacttttaaacttctatgggttcatgtcacttgcattcttagttcttggaatcttttggttctctcagtatgcaagattctggaaagaggttatacatttgcagaactgtataactttagttataacattgggtatgttagagatggcattatggtattttgattatgccgaatttaatgaaagtggggtgcggccaacgggaattaccatttgggcggtaacttttggcaccataaagcgcactgtttcacgtttaatcattttaactgtttctatgggatatggtgttgtaagaccaactttgggtggtcttacttcaaaggttgtcatgcttgggggaacgttttttgttgcttctgaagtgcttgaattggtagaacatgttggcgctgttagtgatctatcgggaaaggcaatgctatttttatctctacctgtggcagtcctggatgcattttttgttttatggatattcacctcgctttcttcaactttaaataagctccaggctaaaagaatgatggcaaagttagatatatacaggaaattcaccaatgctttggctgtagctgttattgtctcagtgggctggatatgctatgagctttatttcaagtcaactgatatatacaatgaacaatggcaaaatgcttggattatacctgctttctggcatgttctatcattctctcttctctgtgtcatatgtgctctttgggccccatctcagaattcaatgagatatgcatattctgatgatggaagtgaagagtttgacaaggatgatacattgacactcataaagccatcccctgtctctgttcctgtttctaaaaaggatgtaggtgaactaagatttgatgatgaggttgatttggaagaagataaaacagagtaatttatcatgtctctcttttgtatgcttatcaactttaaatttttttgttatatttttatagaatttagactacgttattagatgtatatttttacaaggagtttaaattattgaagttgaaagtcagtctgcaattcgatattcgaagttgaggttgatgtctcttgtgtaccaaaatgtagtcaactttgatatttttgttgttttcctataaccgagaaatgtgatggtaacattcgtcgttcaaaaaagaa

SEQ ID NO: 5747 - DNA, 1572 bp, Arnica chamissonis
attctacacacgaccgtaaaacagatctgcgtgtagatctgaattccggaagcagaagcaatgccgttcctggattccctgacggcgatatccttgttactctttgctagggttatatgcatccaggcttcggtgcataattacgccggagataagttctccagaaaggggaacgcatttgtagtccatggaggaagtgagggaatctattactctcatcccaacctcaatgattcttccgaatcttctaatggcgacgcgtatattcggtttgaaaagatcatatttagaaggccacaagaggcttcaaatttcagcacaggaacgatttatgccattctttttgaagtggatgacagagaaactataggtgggtcagcctatggaggccaaagagccatttgttgcactgcagatctagcaaaattgggtgcgtgtaaagaaggtgaagttattcaccgcctatctacaacaaatcccgggtggcctgaagtttttggtgtctcgtttgatgtcaatgaagaaacttccactatgcaaccaagatctgtacaaattacaagaaccgggatgtataatctgtacttcatgcattgtgaaccaagacttgttgatctggttgtagaaggaaaaactatatggaaaaatccaaacggttatctcccaggcagaatggcaccgcttttaaacttctatgggttcatgtcacttgcatttttagttcttggaatcttttggttctctcagtatgcaagattctggaaagaggttttacatttgcagaattgtataactttagttataacattgggtatgttcgagatggcattatggtattttgattatgcagaatttaatgaaagtggggtgcgacctacggggattaccatatgggcgataacttttggcactataaagcgcactgtttcacgattaattatcttaactgtttctatgggatatggtgttgtcagaccaactttgggtggtcttacttcaaaagttgtcatgcttgggggaacattttttcttgcttctgaagtgcttgagttggtagaacatgttggtgctgttagcgatctatcaggaaaggcgatgttatttttatccctccctgtggcggtcttggatgcattttttgttttatggatattcacctcactttcatcaactttaaataagctccaggctaaaagaatgatggccaaattagatatatacaggaaatttacaaatgctttggctgtagctgttattgtgtcggtgggctggatatgctacgagctctatttcaagtcaactgatatatacaatgagcaatggcaaaatgcttggattatacctgccttctggcatgttctgtccttttctcttctctgtgtcatatgtgctctgtgggccccttctcagaactcaatgcgatatgcatattcagatgatggaggtgaagagtttgacaaggaggatacactgactctcataaaaccatcccctctttctacaaaagatgccactgaactgaaatcagaagatgttgatttggaagaagataaaacagagtaattcatcaag

SEQ ID NO: 5748 - DNA, 1702 bp, Flaveria ramosissima
gagctccagatctctctcttagtgctccacacacactatcgtaagtcgtaacgcagatctgtgtgtagatctgatctccgaaccagaagcaatgccgttactggattcattgacggtgatatcgctgctgttgctgcttgttagggttgtacacattcaggcgtcggtgcacaattacgccggtgataagttcgtgagaaaggggaatgcgtttgtagtccatggaggaagtgaggggatctattactcacatcccaacctcaatggctcttccgcatcttctaatggcgatgcgtatattcggtttgagaagatcacatttagaaggccacaagaggcttctaatttcagcacagggatggtttatgccatactttttgaggtggatgacagagaaactataggtgggtcagcctatggagggcagagagccatctgttgcactgctgatcttgcaaaattgggtgcatgtaaagaaggtgaagttattcaccgcctatcaacgacaaatcctgggtggcctgaagtttttggtgtctcatttgatgtcaatgaagaaacttccactatgcaaccaagatctgtacagattacaagaactgggatgtataatttgtacttcatgcattgtgaaccaaggctcgtgaggtctaggttgtagaaggaaaaccatatggaaaaatccaaatgggtatctcccgggtagaatggcaccgcttttaaacttctatgggttcatgtcacttgcatttttagttcttggaatcttttggttctctcagtatgcaagattctggaaagtaggttttacatttacagaattgtataactttggttataacattgggtatgttcgagatggcattatggtactttgattatgcagaattcaatgaaactggggtgcgaccaacagggattaccatatgggcggaacttttggcactataaagcgcactgtttcacgtttaattattttaactgtttctatgggatatggtgttgtaaggccaactttgggcggtcttacttcaaaagttgtcatgcttggggggacatttttccttgcttctgaagtgcttgagttggtagaacatgttggtgctgttagtgatctctctggaaaggcgatgttatttttgtctctccctgtggcagtcttggatgcgttttttgttttatggatattcacctcactttcttcaactttaaataagctccaggctaaaagaatgatggccaaattagatatatacaggaaattcacaaatgctttggctgtagctgttattgtgtctgtgggctggatatgctatgagctttatttcaagtcaactgatatatacaacgagcaatggcaaaatgcttggattatacctgccttctggcatgttctgtctttctctcttctctgtgtcatatgtgctctgtgggctccttctcaaaactcaatgcgatatgcatattcagacgatggaagtgaagagtttgacaaggaagatacattgactctcataaaaccctcccctgtctctgtttctacaaaagatgtacctgaacttaggtctgaagatgttgatttggaagaagacaaaacagagtaatgtatcaagggttttaggtgagctttgcctcttttttgtatgcttatcaactctatatttcttttgttaattttatagtatttagactatgttactag

SEQ ID NO: 5749 - DNA, 1597 bp, Flaveria ramosissima
tctctctctcttagtgctccacacacacacacactcacgtaacgcagatctgcgtgtagatctgatctcggaagcagaagcaatgccgttgctggattcattgacggtgatatcgctgctactgcttgttagggttacacacattcaggcgtcggtgcacaattacgccggtgataagttcgtgagaaagggaaatgcgtttgtagtccatggaggaagtgagggaatctattactctcatctgaacctcaatggttcctccgcatcctctaacggcgatgcgtatattcggtttgagaagatcacatttagaaggccacaagaggcttctaatttcagcacagggatgatttatgccatactttttgaggtggatgacagagaaactataggtgggtcagcctatggagggcagagagccatctgttgcactgctgatcttgcaaaattgggtgcatgtaaagaaggtgaagttattcaccgcctatcaacgacaaatcctgggtggcctgaagtttttggtgtctcatttgatgtcaatgaagaaacttccactatgcaaccaagatctgtacagattacaagaaccgggatgtataatttgtacttcatgcattgtgaaccaaggctcgtagatctagccgtagaaggaaaaaccatatggaaaaatccaaatgggtatctcccgggtagaatggcaccacttttaaacttctatgggttcatgtcacttgcatttttagttcttggaatcttttggttctctcagtatgcaagattctggaaagaggttttacatttacagaattgtataactttggttataacattgggtatgtttgagatggcattatggtactttgattatgcggaattcaatgaaactggggtgcgaccaacagggattaccatatgggcggtaacttttggcactataaagcgcactgtttcacgtttaattattttaactgtttctatgggatatggtgttgtaagaccaactttgggcggtcttacttcaaaggttgtcatgcttgggggaacttttttccttgcttctgaagtgcttgagttggtagaacatgttggtgctgttagtgatctctctggaaaggcgatgttatttttgtctctccctgtggcagtcttggatgcgttttttgttttgtggatattcacctcactatcttcaactttaaataagctccaggctaaaagaatgatggccaaactagatatatataggaaattcacaaatgctttggctgtagctgttattgtgtctgtgggctggatatgctatgagctttatttcaagtcaactgatatatacaacgagcaatggcaaaatgcttggattatacctgccttctggcatgttctgtctttctctcttctctgtgtcatatgtgctctgtgggccccttctcagaactcaatgcgatatgcatattcagacgatggaagtgaagagtttgacaaggaggatacattgactctcactaaaccgtcccctgtctctgtttctacaaaagatgtacctgaactaaggtctgaagatgtgattggaagaagataaacagagtatgtatcaagg

SEQ ID NO: 5750 - DNA, 1550 bp, Flaveria ramosissima
agctccagatctctctcttagtgctccacacacactatcgtaagtcgtaacgcagatctgtgtgtagatctgatctccgaaccagaagcaatgccgttactggattcattgacggtgatatcgctgctgctgcttgttagggttgtacacattcaggcgtcggtgcacaattacgccggtgataagttcgtgagaaaggggaatgcgtttgtagtccatggaggaagtgagggaatctattactctcatcccaatctcaatggctcttccgcgtcttctaatggcgatgcgtatattcggtttgagaagatcacatttagaaggccacaagaggcttctaatttcagcacagggatgatttatgccatactttttgaggtggatgatagagaaactataggtgggtcagcctatggagggcagagagccatctgttgcactgctgatcttgcaaaattgggtgcatgtaaagaaggtgaagttattcaccgcctatcaacgacaaatcctgggtggcctgaagtttttggtgtctcatttgatgtcaatgaagaaacttccactatgcaaccaagatctgtacagattacaagaactgggatgtataatttgtacttcatgcattgtgaaccaaggctcgttgatctagccgtagaaggaaaaaccgtatggaaaaatccaaatgggtatctcccgggtagaatggcaccacttttaaacttctatgggttcatgtcacttgcatttttagttcttggaatcttttggttctctcagtatgcaagattctggaaagaggttttacatttacagaattgtataactttggttataacattgggtatgttcgagatggcgttatggtacttcgattatgcagaattcaatgaaactggggtgcgaccaacagggattaccatatgggcggtaacttttggcactataaagcgcactgtttcacgtttaattattttaactgtttctatgggatatggtgttgtaagaccaactttgggcggtcttacttcaaaagttgtcatgcttgggggaacatttttccttgcttctgaagtgctggagttggtagaacatgttggtgctgttagtgatctctctggaaaggcgatgttatttttgtctctccctgtggcagtcttggatgcgttttttgttttatggatattcacctcactttcttcaactttaaataagctccaggctaaaagaatgatggccaaattagatatatacaggaaattcacaaatgctttggctgtagctgttattgtgtctgtgggctggatatgctatgagctttatttcaagtcaactgatatatacaacgagcaatggcaaaatgcttggattatacctgccttctggcatgttctgtctttctctcttctctgtgtcatatgtgctttgtgggccccttctcagaactcaatgagatatgcatattcagacgatggaagtgaagagtttgacaaggaggatacattgactctcataaaaccgtcccctgtctctgtttctacaaagatgtacct

SEQ ID NO: 5751 - DNA, 1781 bp, Cynara scolymus
  misc_feature (1206)..(1206): n is a, c, g, or t
  misc_feature (1271)..(1271): n is a, c, g, or t
  misc_feature (1295)..(1295): n is a, c, g, or t
  misc_feature (1332)..(1332): n is a, c, g, or t
  misc_feature (1350)..(1350): n is a, c, g, or t
  misc_feature (1360)..(1360): n is a, c, g, or t
  misc_feature (1371)..(1371): n is a, c, g, or t
cacttaccatggtttgaactcttcttgtgttgtgggagatcagctctctctctcataaacccagatctgcctctagatctgatttctctaaccacagcaatgccgttgccggattctttgaccctcatatccttcctactgcttcttagccttatatgcattcacgcttccgtccataattacgccggactcaagttctccagaaaaggaaatgcatatgtagtccatggaggaagtgaaggaatctattactctcatcctaacctcaatcaatcctccgcctcctccaatggcgatgcctatattcgttttgaaaagatcatattccgaagacctcaggaagcttcgaacttcagcaccgggttgatttatgccattctttttgaggtggatgaccgagagactattggtggctctgcctatggaggccaaagagctatctgttgcacctcagatctagcgaaattgggtgcatgtaaggaaggggaagttattcatcgtctatcagcaataaatcctggttggcctgaagtgtttggtgtctcatttgatgtcaatgaggaaatttccactatgcaaccgaggtctgtgcagattacaagaaccgggatgtataatttgtacttcatgcactgtgaaccaagacttggtgatatgattgtagaggggaaaactatatggaaaaatcccagcggttacctgccaggtagaatggcaccgcttttgaacttctatgggttcatgtctcttgcatttctagttcttgggatcttctggttctcccagtatgcaagatactggaaggaggttcttcaattgcagaattgtataacattagttataacattgggtatgttcgagatggcattatggtatttgattatgcagaatttaacgagagtggggtgcgaccaacggggattaccatatgggcagtaacctttggcactgtcaaacgcactgtttcacgcttaatcatccttactgtttctatgggatatggtgttgtaagaccgaccctgggtggtcttacttcaaaagttgtcatgcttggaggaacctttttccttgcatctgaagtgcttgaactggtagagcatgttggtgctgtcagtgatctttcaggaaaggcaatgttattcttgtctctccctgtggcagtcttggatgcattctttgtactatggatattcacctccctttctncaactctgaataaactccaggctaagcgaatgatggccaaactagatatatacagaaaattcacnaatgctttggctgttgctgttatngtgtcggtgggctggatatgctatgagctttatttcnagtcaactgatatatacnacgaacaatngcaaaatgctnggatcatccctgccttctggcaagttttgtcgttttctcttctctgtgtcatctgtgctctttgggcaccatctcagaattcaatgcgatacgcgtattcagatgacggaagtgaagagtttgacaaggaggatagtttgacactcataaaaccatctgctgctgtttcaacaaaagacgagaatgaactagggtcggttcagatagagagggaggatggagaagaagataaaagagagtaagggtgtattttggttgcatctttgtatgcttaattaagtcctaaatttgttttgttaaattatatagagagtttagactcctagctactgctactgctactgtatatttgaaaaggattttaaaatattccttttaaatgagatgtgaatgttatgttgattgaatac

SEQ ID NO: 5752 - DNA, 2105 bp, Lactuca sativa
gccgagctcggcacatgcggtgtgctccacgtccatcttggcaagcaacagtcctacttattttacggaaacaacatgagtcttggaaatgtggccctacagccaaatacgtacaaaatcaggaaatacgacctcattaatgggcacagtcggtgcaagactattgagagccgtgacacagaatacaagagctccctaacaccatgagtcaactacaacttaaccatggttaaccacttaaaaaattcctcatcgggacttttgaggtattcaactggagatctatcactcacaccccagtacacacctccataacacagatctgcgtgtttttctccttccttagatctgaattccttcaacagaagaagcaatgccgttgctggattccttgacggcaatatcgttgctactgcttgttagggttttatgcattcaggcttcggtgcatagttacgctggagaaaagttctccagaaagggaaatgcatttgtagtccatggaggaagtgagggaatctattactctcatcctaacctcaacgaatcttccgcatcttccaatggcgatgcgtatatacgttttgaaaagatcacatttcaaaggactgaagaggctgcaaacattagcacaggcttcatctacgccattctttttgaagtagatgatcgcgaaaccattggtggatctgcatatggaggccaaagagctatctgctgcacatcagatctagcaaaactaggcgcatgtaaggaaggagaagtcattcatcgcctttcaaccacaaaccccggttggcccgaagtgttctatgtcccatttgattccactgacaaaagtttcatcatgcaaccaagatctgtacaaatcacaagaacaggaatgtataatctatactttatgcactgtgaaccacaactcagtgacatggttgtacaaggtaaaaccatatggaaaaacccctctggttaccttccaggaagaatggccccacttttgaacttttacgggttcatgtctcttgcatttttactcctgggaatcttctggttctctcaatatgcaagattctggaaggaggttcttcagttacaaaactgtataacattagttataactctgggtatgtttgaaatggcattatggtattttgattatgcggagtttaacgagagtggggtccggccaactgggattactatatgggcagtaacttttggcactgttaaacggactgtttcacggttgatcattcttactgtttccatggggtatggtgttgttagacctacccttggtgggcttacttcaaaagttgtaatgcttggagctactttttttgttgcttctgaagttcttgaattggtggaacatgttggtgctgttagtgatctttcaggaaaagccatgttgtttttatctcttcctgttgctgttttggatgctttttttgttttatggattttcacctccctttcttcaactctgaataaactccaggctaaaagaatgatggggaaactagatatatacaggaaatttacaaacgcattggctgtagctgttattgtgtctgtagggtggatatgctatgagctttattttaagtcgactgatatatacaatgagcaatggcaaaatgcttggatcattcctgctttctggcatgttctctctttctctcttctgtgtgtcatttgtgctctttgggcaccatctcagaactctatgcggtatgcgtattctgatgatggaagtgaggaatttgataaggaggatagtttgatgcttataaaaccatctcctgttgctacaaaagaagtaagtgaaatgagatctgtgcttcagagtgaagatggagatttggaagaagataaaactgagtaattatgaagatatgaatgggtttaggtgaggtgagagcattttcttgtatcttttggtctttgtatgcttattaagtaactcttaaatttcttttgctaaatattatagaatttttactaatagttactgtatattgcacgaggattttagtactcttttttttaatatataattgattttgaaatttaataccccaaaaggaggggctttacataag

SEQ ID NO: 5753 - DNA, 1778 bp, Centaurea maculosa
  misc_feature (673)..(673): n is a, c, g, or t
  misc_feature (1000)..(1000): n is a, c, g, or t
  misc_feature (1015)..(1015): n is a, c, g, or t
  misc_feature (1465)..(1465): n is a, c, g, or t
  misc_feature (1480)..(1480): n is a, c, g, or t
  misc_feature (1489)..(1489): n is a, c, g, or t
  misc_feature (1525)..(1525): n is a, c, g, or t
  misc_feature (1567)..(1567): n is a, c, g, or t
  misc_feature (1591)..(1591): n is a, c, g, or t
  misc_feature (1594)..(1594): n is a, c, g, or t
  misc_feature (1634)..(1634): n is a, c, g, or t
  misc_feature (1649)..(1649): n is a, c, g, or t
  misc_feature (1669)..(1669): n is a, c, g, or t
  misc_feature (1723)..(1723): n is a, c, g, or t
  misc_feature (1738)..(1738): n is a, c, g, or t
gcggggacttctcctccataagtcataaacccccacccagatctgtgtgtgtgtgtgtttagatctcgtcaatttctctcaccggaaacaagcaatgccgttgccggattctttcacggcaatatccttccttctgcttcttcttagcttcatatcgtctattcaggcttccgttcatgattacgccggagataagttctccagaaagggaaacgcatatgttgtccatggaggaagtgaaggaatctattactctcatcctaacctcaatcaatcttcagcctcctccaatggcgatgcctatattcgttttgacaagatcgaattccgaagacctcaggaagcttcaaacttcagcacgggcttgatttatgccattctttttgaggtggatgacagagagactattggtggctctgcctacggaggccaaagagctgtctgttgcacttcagatctggcgaaattgggtgcatgtaaggaaggggaagttattcaccgcctatccgcaaggaatcctggttggcctcaagtgtttggtgtctcatttgatgtcaatgaggaaatttccaccatggaaccgaggtctgtgcagattacaagaaccgggatgtataatttatacttcatgcattgtgaaccaagactcggtgatatggttgtagaagggaanaccatatggaaaaaccccagcggttacctgccaggtagaatggcaccgcttttgaacttttatgggttcatgtctcttgcatttctagttcttggaatcttctggttctcccagtatgcaagatactggaaggaggttcttcaattgcagaattgtataacgttagttataacgttgggtatgttcgagatggcattatggtactttgattatgcagaatttagtgagagtggggtgcgaccaacgggaattaccgtatgggcagtaacctttggcactgtcaagcgcactgtttcacgcttaatcattcttactgtttctatgggntatggtgttgtaagnccaaccctgggtggtcttacttcaaaggttgtcatgcttggagcaacctttttccttgcatctgaagtgcttgaactggtagagcatgttggtgctgtcagtgatctttcagggaaggcaatgttattcttgtctctccctgtggcagtcttggatgcattctttgtactgtggatattcacctccctttctgcaactctgaataaactacaggctaaacgaatgatggccaaactagatatatacagaaaattcacaaatgctttggctgttgctgttattgtatcagtcggctggatatgctatgagctctatttcaagtcaactgatatatacaacgagcagtggcaaaatgcttggatcatccctgccttttggcaagttttatcgttctctcttctctgcgtcatctgcgctctttgggcaccatctcagaattcaatgcgatangcgtattcagatganggaagtgangagtttgacaaggaggatactttgacactcataaanccatctgctgctgctgctgctgtttcaacaaaagacgtaagngaactaaggtcggttcagattganagngaggatggagaagaagataaaagagagtaaggacttattncattatatgcttatnaagtcctaaatttgttttgnttaattttatatagtttagactactagctactgtatatttcaaaaggattatanctactccttttaaantatatgtgaatcttacgtttattgaatacaaaccactttg

SEQ ID NO: 5754 - DNA, 1482 bp, Cirsium arvense
cttcttagtcttagtcgcattcacgcctccgtccataattacgccggagacaagttctccagaaaaggaaatgcatatgtagtccatggaggaagtgaaggaatctattactctcatcctaacctcaatcaatcttcagcctcctcttcctctaatggagatgcgtatattcgttttgaaaagatcatattccgaagacctcaggaagcttcaaacttcagcacagggttgatttatgccattctttttgaggtggatgaccgagagactattggtggctctgcctatggaggccaaagagctatctgttgcacctcagatctagcaaaattgggtgcatgtaaggaaggggaagttattcatcgcctatcagcagtgaatcctggttggcccgaagtgtttggtgtctcatttgatgtcaatgaggaaatttccactatgcaaccgaggtctgtgcagattacaagaaccgggatgtataatttgtacttcatgcactgtgaaccaagacttggtgatatggttatagaagggaaaactatatggaaaaatcccagcggttacctgccaggtagaatggcaccgcttttgaacttctatgggttcatgtctcttgcatttctacttcttgggatcttctggttctcccagtatgcaagatactggaaggaggttcttcagttgcagaattgtataacgttagttataacgttgggtatgttcgagatggcattatggtattttgattatgcagaatttaacgagagtggggtgcgaccaacaggaattaccatatgggcagtaacctttggcactgtcaaacgcactatttcacgcttaatcatccttactgtttctatgggatatggtgttgtaagaccaaccctgggtggtcttacttcaaaagttgtcatgcttggaggaaccttttttcttgcatctgaagtgcttgaactggtagagcatgttggtgctgtcagtgatctttcaggaaaggcaatgttattcttgtctctccctgtggctgtcttggatgcattctttgtactatggatatttacctccctttctgcaactctgaataaactccaggctaaacgaatgatggccaaactagatatatacagaaaattcacaaatgctttggctgttgctgttattgtgtcggtgggctggatatgctatgagctttatttcaagtcaactgatatatacaacgagcaatggcaaaatgcttggatcatccctgccttctggcaagttttgtcattctctcttctgtgtgtcatctgtgctctttgggcaccatctcagaattcaatgcgatacgcttattcagacgacggaagtgaagagtttgacaaggaggatacattgacactcataaaaccatctgctgcttttccaccaaaagatgcaagtgaactacattcggttcagattgagagtgaggatggagaagaaggtaaaaagagagtaagg

SEQ ID NO: 5755 - DNA, 1426 bp, Cirsium arvense
ccggattctttgacggcgatatccttcctactgcttatatcatccatccatgcttccgttcatgattacgccggagttaagttctccagaaaggggaatgcatatgttgtccatggaggaagtgaaggaatctattactctcatcctaataacctcctcaatcactcttcaacctcctcctcttccaatggcgatgcctatattcgttttgacaagatcgaattccgaagacctcaggaagcttcaaacttcagcacgggcttgatttatgccattctttttgaggtggatgacagagagacgattggtggctctgcctacggaggacaaagagctatctgttgcacttcagatctagcgaaattaggtgcatgtaaggaaggggaagttattcaccgcctatccgcaaggaatcctggttggcctcaagtgtttggtgtctcgtttgatgtcagtgaggaaatttccactatgcaacctaggtctgtgcagattacaagaaccgggatgtataacttatactttatgcattgtgaaccaagactcggtgatatggttgtagaagggaaaaccatatggaaaaaccccggcggttacctgccaggtagaatggcaccgcttttgaacttttatgggttcatgtctcttgcatttctagttcttggaatcttctggttctcccagtatgcaagatactggaaggaggttcttcaattgcagaattgtataacgttagtaataacgttgggtatgttcgagatggcattatggtactttgattatgcagaatttaatgagagtggggtgcgaccaacgggaattaccgtatgggcagtaacctttggcactgtcaagcgcactgtttcacgcttaatcattcttactgtttctatggggtatggtgttgtaagaccaaccctgggtggtcttacttcaaaggttgtcatgcttggagcaacctttttccttgcatctgaagtgcttgaactggtagagcatgttggtgctgtcagtgatctttcagggaaggcaatgttattcttgtctctccctgtggcagtcttggatgcattctttgtactgtggatattcacctccctttctgcaactctgaataaactacaggctaaacgaatgatggccaaactagatatatacagaaaattcacaaatgctttggctgttgctgttattgtatcagtcggctggatatgctatgagctctatttcaagtcaactgatatatacaacgagcagtggcaaaatgcttggatcatccctgccttttggcaagttttatcgttttctcttctctgcgtcatctgcgctctttgggcaccatctcagaattcaatgcgatatgcgtattcagatgacggaagtgaagagtttgacaaggaggatactttgacactcataaaaccat

SEQ ID NO: 5756 - DNA, 1795 bp, Conyza canadensis
tggtccattacgccggagataaattcattaaaaaaggaaatgcgtttgttatccatggcggcagtgaaggcatctatttctctcattcttccactaattctaattcttcttctaatggcgatgcttacattcgatttgagaagattgtatttcgaaggcctcgagaggcttcaaattttagctcagggttggtatatgccattctttttgaggtggatgaccgagagactattggtggctcagcctatggaggccaaagagctatctgttgcactgcagatctagcgaaattgggtgcatgcaaggaaggggaggttattcaccgcttatccacaacaaatcctgggtggcctgaagtatttggtgtctcgttcgaggtcaatgaagaaacttctactttggaaccgaggtctattcagattacaagaaccgggatgtataatttgtattttatgcattgtgaaccaagactctctgatgtggttgtggaaggggaaacgatatggaaaaatcccagtggttaccttccggggagaatggcacctcttttgaacttctatgggttcatgtctcttggatttctagtccttgggatcttctggttctcccagtatgcaagattctggaaggaggttcttcacttgcagaattgtataacattagttataacactgggaatgtttgagatggcattatggtattttgattatgcagagttcaatgagagtggagtgcgaccgacagggattacagtatgggcagtaacctttggcaccgttaaacgcactgtctcacgcttgatcattcttactgttgctatgggatatggagttgttaggccaaccttgggtggtcttacttcaaaagttgtcatgcttgggggaacattttttgttgcttctgaggtacttgaattggtggagcatgttggtgctgtcagtgatctgtctggaaaggcaatgttatttttatctctccccgtggcagtcttggatgcattctttgttctatggatattcacatccctttctgccactctgaataagctccaggccaagcgaatgatggccaaactagatatatacaggaaattcacaaatgctttggctgtagctgttattgtgtcagtgggctggatatgctatgagctttattttaagtcaactgatatatacaatgagcaatggcaaaatgcttggatcatccctgccttctggcacgttctgtcgttctctcttctctgtgtcatctgtgctctttgggctccgtctcagaattcaatgagatatgcatactctgatgatggaagtgaagaatttgataaggaggatactctaacgcttataaaaccatcccctgtctcaactaaagacgtaactgaactaagatcagttcacagtgatgatggtgatttggaagaagataaaacagagtaattatgaaaagtatccacaaggttttggttagcatccatggtatcctatgctcttttgtatgcttatcgattataaatttcttttgttaaatttatataatacggagtagtactattttactagctgtatattttacaaggtctttaataatccattgtgaattttgagtaattttagctgccactcctatagttctatagaatggtggctgatgatgtcccctatgtttctagcagtagtttacggaatgattattagtttgtgttagatcattttgaaaaggaaatgtaatgatgggtatatttacgttatgcttgggtgactttaaccctttataaattgttctttgtgatttcatg

SEQ ID NO: 5757 - DNA, 1864 bp, Artemisia annua
tactccgacgggggacgccgttttcttcattcatccagcttgactttttaaacacaattctcactccagatctctctcactcactaaacactcctttagatctgactgaattcagttaaatcagcacaatgccgttagttaacaacagctactactactctttaacggcgttaacagttataattgtattaggtggtagatttatatacaagattgagggatcggtgcatatatatgaaggagatagcaagttttccaaaaaaaggaaatgcgtttgtggttcacggaggcagcgaaggaatttattactctcatttaaatcctgattctaattctactaaatcctccaatggcgatgcctttattcggtttgaagagatcaaatttcaaaggcctcaagaggcttcaaattttagcacagggatgatttatgccattctttttgaggtggatgaccgagagactattggtggctcagcctacggaggccaaagagctatctgctgcactgcagatttagctaaattgggtgcgtgtaaggaaggggaaattattcaccgcctatctacaacaaatcccggctggcctcaagtatttggtgtctcatttgatgtcaatgaggaaactaccactatgcaaccacggtctgtgcagatcacaagaaccggaatgtataacttgtatttcatgcattgtgaaccaaggctcgatgatatgattatatcagggaaaactatatggaaaaatcccagtggttatcttccgggtagaatgtcgccacttctgaacttttatgggttcatgtctcttgcatttttagttctcggaatattttggttctctcagtatgcaagacactggaaagaggttcttcacttgcaaaactgtataacgttagttataacattgggaatgttcgagatggcattatggtattttgattatgcagaatttaacgaaagtggtgtgcgaccaacagggactaccatatgggcagtaacttttggcactgttaaacgcaccgtttcacgtttgattattcttactgtttcgatgggatatggtgttgtgagaccaaccttgggtggtcttacttcaaaagttgtcatgctcggaggaacattttttcttgcatctgaagtgcttgagctggtagagcatgttggggctgttagtgatctttcaggaaaggcgatgttattcttatcgctccctgtggcagtcttggatgcattcttcattctgtggatatttacgtccctttcttcgactctgaataagctccaggctaaaagaatgatgggcaaactagacatataccggaaatttacaaacgctttggctgtagctgttattgtgtcggtgggctggatatgctacgagctttatttcaagtcaactgatatatacaacgagcgatggcaaaatgcttggattattcctgccttctggcacgttctgtctttctctcttctttgtgtcatctgcgctctttgggcaccatctcagaattcgatgcgatacgcgtactctgatgatggaagtgaagactttgacaaggaagatactttgacgctcataaaaccatctcctgtttttacaaacgacgtaactgaactaagatcagttcacagtgatgatggtgaattggaagaagataaaaccgagtaatattaagaaaaatctagagggcggaagggtttaggtcagcgtttctcgtatctttggctctattttgtatgtttatcaactctaaatttaattgttaaattatatagatattagactatgttaccagatgtatattttacaaagatcttcaatactattgattatgaattttgagattctaaaacgcactcgt

SEQ ID NO: 5758 - DNA, 1753 bp, Carthamus tinctorius
cttaccatggttagccattgatgaatgcttctctctcactcataaacccccagatctgtgtgtggttttcctcttagatctcatcaatttctctcaccagaaagaagcaatgccgttgccggattctttgacggcgatatccttcctgctgcttctgagctttatatcgtctattcacgcttccgtccacgattacgccggagataagttctccagaaagggaaatgcatatgttgtccatggaggaagtgaaggaatctattactctcatcctaacctcaatcaatcttccgcctcctccaatggcgatgcctatattcgttttgaaaagatcgtattccgaagacctcaggaagcttcaaacttcagcacgggcttgatttatgccattctttttgaggtggatgacagagagactattggtggttctgcctatggaggacaaagagctatctgttgcacttcagatctagcgaaattgggtgcatgtaaggaaggggaagttattcaccgcctatcggcaaggaatcctggttggcctgaagtgtttggtgtctcatttgatgtcaatgaggaaatttccactatgcaacccaggtctgttcagattacaagaaccgggatgtataatttatacttcatgcattgtgaaccaagactaagtgatatgattgtagaagggaaaaccatatggaaaaaccccagcggttacctgccaggtagaatggcaccgcttttgaacttttatgggttcatgtctcttgcatttctagttcttggaatcttctggttctcccagtatgcaagatactggaaggaggttcttcaattgcagaattgtataacgttagttataacgttgggtatgttcgagatggcattatggtactttgattatgcagaatttaatgagagtggggtgcgaccaacgggaattaccatatgggcagtaacctttggcactgtcaagcgcactgtttcacgcttaatcattcttactgtttctatggggtatggtgttgtaagaccaaccctgggtggtcttacttcaaaggttgtcatgcttggagccacctttttccttgcatctgaagtgcttgaactggtagagcatgttggtgctgtcagtgatctttcaggaaaggcgatgttattcttgtctctccctgtggcagtcttggatgcattctttgtactgtggatattcacctccctttctgcaactctgaataaactacaggctaaacgaatgatggccaaactagatatatacagaaaattcacaaatgctttggctgttgctgttattgtatctgtgggctggatatgctatgagctttatttcaagtcaactgatatatacaacgagcagtggcaaaatgcttggatcatccctgccttctggcatgttttgtcgttctctcttctctgtgtcatctgtgctctttgggcaccatctcagaattcaatgcgatacgcatattcagatgacggaagtgaagagtttgacaaggaggatactttgacactcataaaaccatctgccgctgctgctgctgtttcaacaaaagacgtaagcgaactgaggtcggttcagattgagaatgaggatggagaagaagataaaagagagtaaggacctatttccttatatgcttatcaatgtcctaaatttgttttatttaattttatagagtttagactactagctactgtatatttcaaaaggatttataaatactcctttttaatt

SEQ ID NO: 5759 - DNA, 1796 bp, Cirsium arvense
attcatacaccaccattgccgtcgatggattccttcacggcggcgatattattgctactaattcttagggttttatgtattgaagcttcggttcatgagtacgccggagacaaattcaccagtaagggaaatgcatttgtacttcatggaggtagtgaaggaatttatcattctcgtcctaaactccatcaatcttccgccaccgccaatggcgatgcttatattcgtattgagagaatcatattccgaaggcctcaggcagtctcaaacttcagcacaggcttgatttacgctgttatttttgaggtagatgatcgagagacaattggtggctcagcctatggaggccaaagagctatctgctgtactgcagatctagcaaaattgggtgcatgtaaggaaggggaaattattcaccgccaatctataaagaatcctggttggcctgaagtgtttggtgtctcatttgatgtcaatgaggaaacttccactatgcaaccaaggtctattcagatcacaagaactgggatgtataatctgtatttcatgcattgtgagccaagattaagtgatgtgatcatagaggggaaaactatatggaaaaatcctactggttacttgccgggtagaatggcaccacttttgaaattctatgggttcatgtcaattgcatttctaatacttgggagcttttggttttatcagtatgcaagattctggaaagaggttcttcaactgcagaattgtatcacattagttataacactgggcatgtttgagatggctttatggtattttgattatgcagaatttaataagattggagtacgaccaacagggattactgtatgggcagtcacctttggcacagtgaaacgcacagtttcacgcatgatcattcttacagtttctatgggatatggtgttgtaagaccaacccttggtggtcttacttcaaaggttatcatgcttggagcaaccttctttactgcatcggaagtgcttgaagtagcagaacatgttggtgccatcagtgacctttcaggaaaggcaatgttgtttctatctcttcctgtggcaatcttggatgctttctttcttctttggatcttcacctccctttcttcaactttgaataaacttcaggctaaacgaatgatggcaaagctagatatttacaggaagttcacgaatgctttggctgttgctgttttcgtgtctgtaggatggatatgctacgagctttatttcaaggcaactgatatatacaatgagcagtggcgaaatgcttgggtcatccctgcattctggcaagttttatcgttctctcttctctgtgtcatctgtgctctttgggcgccttctcaaaactcaatgagatatgcgtattctgatgacggaagtgaaggatttgaggatgacgatattttgatgccgatgaaaccgtcccctcttcccacaaaagacgttagcagtccgactgaagtacgatcatcagttagcgatgatggagatttggaagaggataaaacagagtaaactacaaaccaggtatatttgtcttcttttttcacttgcaaatttccttatcctgaatctgaatggaatcagctgtcccttcagaccctttaggagacactggcatcaagtagatgttttatataaatatggatgtttttagtatttgcatcctggatcttttattcaacttgtagattttaggctataaagattgttcccaatttaattaaaatatataaatttagataaaaaagaaaaaagtaaccgaactagcg

SEQ ID NO: 5760 - DNA, 916 bp, Solanum tuberosum
tcaccatgagaaccagtaatcacttaataggtttactaaacttcttcactttcttagcatcaatcccaattttaggcggtggaatctggttaagcagcagagcaaacaacacagattgcttaaaattccttcaatggccattaataataattggggtctcaataatggttgtttctttagctggatttgttggtgcttgttacagaaacactttcttaatgtacatttatctatgggcaatgttctttatcattgctgctttaattggatttgttatttttgcttatgctgttactgataaagggtcgggtcgacccgttatgaatcgggaatattcggaatattatttacaagattattccggttggttggaagaaagagtttcgagccaaagctactgggagaagattagttcgtgtctaagggattcgcgtggttgtggtaagatgaggaggatttataatgggattccagagagtgttgagatgttttatcgaaggaaacttagtcctatcgagtctggttgctgcaagcctcctacagaatgtggctacgtttatcagaacgagacggtttggagccctggaggaggactagttggagctgatccagattgtgttaaatggagcaatgatcaagaacaactctgttacaattgtgactcttgcaaagctggtgtacttgctagccttaaaaagagttggagaaaggtgtctgttatcaacattgtcatattgatcctccttgttatcatgtatatggttgccatcgcggcgtttaggcacaacaaacggatcgataacgatgagccttatggagaaaccaggatggagaagactcaacctagcaggatacacttctaaaagagtcacaacagagtaaagcttgaaatgtattcgcatgtttcggtaagttt

SEQ ID NO: 5761 - DNA, 1166 bp, Solanum phureja
cttcttcataatcacttcatttcctctgttttcccctgttttcaagaacccaaaaaaaaccatcaaaaccccccccaaaaccctcaaaaaatcaccatgagaaccagtaatcacttaataggtttactaaacttcttcactttcttagcatcaatcccaattttaggcggtggaatctggttaagcagcagagcaaacaacacagattgcttaaaattccttcaatggccattaattataattggggtctcaataatggttgtttctttagctggatttgttggtgcttgtttcagaaacactttcttaatgtacatttatctatgggcaatgttctttatcattgctgctttaattggatttgttatttttgcttatgctgttactgataaagggtcaggtcgacccgttatgaatcgggcatattcggaatattatttacaagattattccggttggttggaagaaagagtttcgagccaaagctactgggagaagattagttcgtgtctaagggattcgcgtggttgtggcaagatgaggaggatttataatgggattccggagagtgttgagatgttttatcaaaggaaacttagtcctatcgagtctggttgctgcaagcctcctacagaatgtggctacgtttatcagaacgagacggaatggattcccggaggaggactagttggagctgatccagattgtgttaaatggagcaatgatcaagaacaactctgttacaattgtgactcttgcaaagctggtgtacttgctagccttaaaaagagttggagaaaggtgtctgttatcaacattgtcatattgatcctccttgttatcatgtatatggttgccatcgcggcgtttaggcacaacaaacggatcgataacgatgagccttatggagaaaccaggatggagaagactcaacctagcaggatacacttctaaaagagtcacaacagagtaaagcttgaaatgtatttttatgttttggtaagttttagtagtctttgtttatactttctaaataaaacacagattgtaaatcttgtattcattgtggtgtattttcatttattaaattccaaaactatctaagtttggttttgaggctgttttggttactttagtgtagcaagcttgctatgagatttaagtaa

SEQ ID NO: 5762 - DNA, 1137 bp, Nicotiana tabacum
  misc_feature (980)..(980): n is a, c, g, or t
  misc_feature (986)..(986): n is a, c, g, or t
ctttgctctgctttccccaacccaaaaattgttacaaaaaagtccatttcaggaagattgcattattagccacagaaaaaaaaaaatgagaactagcaaccatttaataggtttactaaacttcttcactttcttggcctcaatcccaatattaggtggtggaatatggctaagcagcagagcaaacaacacagactgcttgaaattccttcaatggccattaatagtaattggagtttcaattatggttgtttctttagctggatttgctggtgcttgttatagaaacactttccttatgtacctttatctatgggctatgttctttatcatagctgctttgattggatttgtcatctttgcttatgctgtcactgataaagggtcgggtcgacccgtcttgaaccgggtttacttggagtatcacttgcaggattattcgggttggcttgaggaaagggttacaagtcagagttattggatgaagatcagttcttgtattagagattcacatgtttgtgctaagacaagaaggacttacaatagtattcctgagagtgctgagatgttttacctcagaaaacttagtcctgttgagtctggttgctgcaagcctcctacagaatgtggctatgtttatcagaatgagacagtttggattccaggaggagggctagttggagctgatccagattgtgttaattggaacaatgatcaagggcagctttgctacaattgtaactcttgcaaagctggcgtactggctagcattagaaagagttggagaaaggtgtctgtcatcaatattgtgatattgatcattctcgtgatcatgtatatggtcgctatcgctgcgtttaggcacaacaaacggatcgataacgatgagccttacggagaaactaggatggagaagtctcaacctagcaggatacacttctaagatcagtttccacacaacatcagagtaaagcttgaantgtatnttttatgttgtggtaagtctagtagtcttgttagaacaaaatgctttgtttatacttctacattcaattttcttcccaagaaaacttgactgtaaatcttgtattaagtgtggtatcttttcctttaattaaattccaaaactatcttagg

SEQ ID NO: 5763 - DNA, 1131 bp, Nicotiana benthamiana
acacttgtctacaatttaagaaaatagagagacccctctctttccttactcttacattaacccccatcttcaccttcttaagaaacactctttgctctgctttctccaatccaaaaattgttacaaaaatgttcatttcagaaagattgcattattagccacaaaatgagaactagcaaccatttaataggtttactaaacttcttcactttcttggcctcaattccaatattaggtggtggaatatggctaagtagtagagcaaacaacacagactgcttgaaatttcttcaatggccattaatagtaattggagtttcaattatggttgtttctttagctggatttgctggtgcttgttataggaatactttccttatgtacctttatctatgggctatgttctttatcatagctgctttaattggatttgttatctttgcttatgctgtcactgataaagggtcgggtcgacccgtattgaaccgggtttacttggagtatcacttacaggattattcgggttggcttgaggaaagggttacaagtcagagttattggatgaagattagttcttgtattagagattcacatgtctgtgctaaaacaagaaggacttacaatagtactcctgagagtgctgagatgttttatctcagaaaacttagtcctgtcgagtctggttgctgcaagcctcctacagaatgtggctatgtttatcagaatgagacagtttggattccaggaggaggggtagtcggaactgatccagattgtgttaattggaacaatgatcaagggcagctctgctacaattgtaactcttgcaaagccggcgtactggctagcattagaaagagttggagaaaggtgtctgtgatcaacattgtcatattgatcattctcgtgatcatgtatatggtcgctatcgctgcgtttaggcacaacaaacgaatcgataacgatgagccttacggagaaactaggatggagaagtctcaacctagcaggatacacttctaagatcagtttctacacaacagcagagtatagcttgaagtgtaattttatgttgtggtaagtctagtagtcttgttagaacaaaatgctttgtttatacttctacattca

SEQ ID NO: 5764 - DNA, 1213 bp, Nicotiana benthamiana
acttgtctacaatttaagaaaatagagagacccctctctttccttactcttacattaacccccatcttcaccttcttaagaaacactctttgctctgctttctccaatccaaaaattgttacaaaaatgttcatttcagaaagattgcattattagccacaaaatgagaactagcaaccatttaataggtttactaaacttcttcactttcttggcctcaattccaatattaggtggtggaatatggctaagtagcagagcaaacaacacagactgcttaaaattccttcaatggccattaatagtaattggagtttcaattatcgttgtttctttagctggatttgctggtgcttgttataggaatactttccttatgtacctttatctatgggctatgttctttatcatagctgctttgattggatttgttatctttgcttatgctgtcactgataaagggtcgggtcgacccgtattgaaccgggtttacttggagtatcatttacaggattattcgggctggcttgaggaaagggttacaagtcagagttattggatgaagattagttcttgtattagagattcacatgtttgtgctaagacaagaaggacttacaatagtattcctgagagcgccgacatgttttacctcagaaaacttagtcctgttgagtctggttgctgcaagcctcctacagaatgtggctatgtttatcagaatgagacagtttggattccaggaggagggctagtcggaactgatccagattgtgttaattggaccaatgatcaagggctgctctgctacaattgtaactcttgcaaagccggcgtactggctagcattagaaagagttggagaaaggtctctgtgatcaacattgtcatattgatcattctcgtgatcatgtatatggttgcaatcgctgcgtttaggcacaacaaacggatcgataacgatgagccttacggagaaactaggatggagaagtctcaacctagcaggatacacttctaagaccagtttctacacaacagcagagtaaagcttgaagtgtaattttatgttgtggtaagtctagtagtcttgttagaacaaaatgctttgtttatacttctacattcaattttcttcccaagaaaacttgactgtaaatcttgtattaagtgtggtatcttttcctttaattaaattctaaaactatcttag

SEQ ID NO: 5765 - DNA, 1270 bp, Solanum lycopersicum
aaactaacaagtgacgatacaatacaacgcaaacaaccatccaaacaaggtgttaacaggaaagaccctcttctttttctctgttctttccacaatactcataaagaaagacactttccttttcttcattcaaaaatactctcatatcaaaaaaaaaaaaaaaaaaaagtttcaagaaagtccatatacaagaacaccccaaaaaaattaaaaaacagagctttttcagtatgagaaccagcaaccatttaataggtctagttaatttcttaacatttcttgcatcaatcccaatcctgggtggtggaatatggctaagtagcagagccaacaacacagattgcttaaaatttcttcaatggcccttaatagttattggggtttctattatggttgtttctttagcaggttttgctggtgcttgttatagaaacactttccttatgtatctttacctttgggctatgttctttatcattgctgctttgattggatttgtcatttttgcttatgctgtcactgacaaagggtcgggtcgacccgttatgaaccgggtctactcagagtaccatttgcaagattattctgggtggttggaagaaagagttacaagtcagagttattggtcaaaaatcagttcttgtattagggattctcatgtttgtggtaagatgagaaggacctataatagaggaattccagagcctgttgagatgtttaatcttagaaagcttagtcctcttgagtctggttgttgcaagccccctacagaatgtgggtacacttacctgaatgagacggtgtggaacccaggaagcggaatcgtaggaagtgatcctgattgtggtagatggagcaattatcaacaacaactctgttataactgcaactcttgcaaagctggtgttctggcaagtctgaaaaagagttggaggaaagtgtctgtcattaacattgtcatattgatcattcttgtgattatatatatggttgcaatagcggcctttaggcacaacaaacgaatcgataatgacgagccttatggagaaaccaggatggagaaatctcaaccaagcaggatacacttctaagagctttcacatgacaacaagacagtaaagattgtaatgaattttcctatgtttgtcatgttatcttattcgaagaaaatgctttcttcatacttcacttcttccccctaagaaatttgactatatatcttgtatgagttgttctgtatattttttcaattaattctccgaaacttttt

SEQ ID NO: 5766 - DNA, 1385 bp, Capsicum annuum
gtagtaagagaagacttctccagattaaaacaataaacatagattgccttgtttctttagtgctctttcgtagtagctggagagtattctcacgctcaacaatctttacaattttattatttctcagattttgagattttggagaagggggagtcccccgaaaacttaagcattgcggatgtcttttttgctagaatagatgatgctaagcatttcactttatacgaaactccctcctcttttctctgctctttcaactaacaatcctcaccttcaccttctcaaacttatatacaaacactcttcctttttcttcttacacacacacacacacacacaaaaaaaaaaggaaggtttacactatgaggacaagcaaccatttaataggtctaataaatttcttcacttttctagcatcaatcccaatattaggtggtggaatatggctaagtagtagagcaaacaacacagactgtttaaagttccttcaatggccattaatagttattggtgtttccattatggttgtttctttagctggttttgctggtgcttgttataggaacactttcctcatgtacctttatctatggtctatgttctttatcattgctgctctaattggttttgttatctttgcttatgctgttactgataaagggtcgggtcgacccgttatgaaccgggtttacttggagtaccacttgcaagattattctggttggttacaagaaagggtgacaagtcagagttattggtcaaaaattagctcatgtattagggattcacatgtttgtggtaagatgagaaggacttataatggtggaattccagagactgttgagatgtttaatgttagaaggcttagtccacttgagtctggttgctgcaagcctcctacagaatgtgggtacacttacctgaatgagacagtgtggaacccaggaggtgggatagtaggaggtgatcctgattgtgctagatggagcaattatcaacagcagctctgctataactgcaactcttgcaaagctggtgtcctggcaagtctgaaaaagagttggaggaaagtgtctgtcatcaacattgtcatattgattattcttgtgattatgtatatggttgcaatagcagcctttaggcacaacaaacgaatagataacgacgagccttatggagaaactaggatggagaaaactcaacctagcaggatacacttctaagagttttccctaggacaagacagcaaaacttgaaatgtatttttcctatgtttgttatttttatcttattagaacaaagttgtttcctcacatacttcatgtacccggttttccctcccaagaaaattcactatcgaaatcctgtatgagttgtttcgtata

SEQ ID NO: 5767 - DNA, 1066 bp, Capsicum annuum
aaaaaaaaaaggaaggtttacactatgagaacaagcaaccatttaataggtctaataaatttcttcacttttctagcatcaatcccaatattaggtggtggaatatggctaagtggtagagcaaacaacacagactgtttaaagttccttcaatggccattaatagttattggtgtttccataatggttgtctctttagccggttttgctggtgcttgttataggaacactttcctcatgtacctttatctatgggctatgttctttatcattgctgctttaattggttttgttatctttgcttatgctgttactgataaagggtcgggtcgacccgttatgaaccgggtttacttggagtaccacttgcaagattattctggttggttacaagaaagggtgacaagtcagagttattggtcaaaaattagctcatgtattagggattcacatgtttgtggtaagatgagaaggacttataatggtggaattccagagactgttgagatgtttaatgttagaaggcttagtccacttgagtctggttgctgcaagcctcctacagaatgtgggtacacttacctgaatgagacagtgtggaacccaggaggtgggatagtaggaggtgatcctgattgtgctagatggagcaattatcaacagcagctctgctataactgcaactcttgcaaagctggtgtcctggcaagtctgaaaaagagttggaggaaagtgtctgtcatcaacattgtcatattgattattcttgtgattatgtatatggttgcaatagcagcctttaggcacaacaaacgaatagataacgacgagccttatggagaaactaggatggagaaaactcaacctagcaggatacacttctaagagttttccctaggacaagacagcaaaacttgaaatgtatttttcctatgtttgttatttttatcttattagaacaaagttgtttcctcacatacttcatgtacccggttttccctcccaagaaaattcactatcgaaatcctgtatgagttgtttcgtatatttttaagttagttctccg

SEQ ID NO: 5768 - DNA, 1083 bp, Solanum phureja
caagacacccaaaaaaacaaaaaaacagagctttttcactatgagaaccagtaaccatttaataggtctagtaaatttcttaacatttcttgcatcaatcccaatcttgggtggtggaatatggctaagtagcagagcaaacaacacagattgcttaaaatttcttcaatggcccttaatagttattggggtttctattatggttgtttctttagcaggttttgctggtgcttgttatagaaacactttccttatgtacctttacctttgggctatgttttttatcattgctgctttgattggatttgtcatatttgcttatgctgtcactgataaagggtcgggtcgacccgttatgaaccgggtctactcagagtaccatttggaagattactctgggtggttggaagaaagagttgcaagtcagagttattggtcaaaaatcagttcttgtattagggattctcatgtttgtggtaagatgagaaggacttataatagaggaattccagagcctgttcaggtgtttaatcttagaaggcttagtcctcttgagtctggttgttgcaaaccccctacagaatgtgggtacacttacctgaatgagacggtgtggaacccaggaagcgggatcgtaggaagtgatcctgattgtggtagatggagcaattatcaacagcaactctgctacaactgcaactcttgcaaagctggtgttctggcaagtctgaaaaagagttggaggaaagtgtctgtcatcaacattgtcatattgatcattcttgtgattatgtatatggttgcaatagcagcctttaggcacaacaaacggatcgataatgacgagccttatggagaaaccaggatggagaaatctcaaccaagcaggatacacttctaagagcttccacatgataagacagtaaagattgtaatgtatttttcctatgtttgtcatgttgtctttgttagaacaaaatgctttcttcatacttcacttgccccttttgttcccccaagaaaattgactatacatcttgtatgagttctgtatatttttcaattaattctccaaaacttttt

SEQ ID NO: 5769 - DNA, 1057 bp, Catharanthus roseus
ctctctgagctagaaagatgagaaccagtaatcacttaataggattactaaatttcttgacctttttagcctcaataccaatattaggaggtgggatttggcttagcagcagagcaaacaacacagattgtatgaaatttcttcagtggccattaattgttattggggtagcaattatggttgtttctttagctggatttgcaggcgcgtgttacagaaacaccttccttatgtacctttatttgtgggctatgttctttatcattgctgcccttattgggtttgttatatttgcttatgctgttactgatagagggcaaggaagaccagttttgaacagagtctatttagaatatcatttgcaggattattctggatggcttgaagagcgcgtgactagtcagaattattggcagaaaatcagttcctgtataagggattctcatgtttgtggcaagatgagaaaaaccattaatggaattcctgaacctgctgaaatgttttaccttagaaaactcagtcctgttgagtcgggatgttgcaaaccccctacagaatgtggctacgtttaccagaacgaaacagtttggattcctggtgccggcctaatgggaaccgatccagattgtgcgagatggagcaacgatcaagaactactatgcttcaactgtgattcttgcaaagccggtgttttaggaagcttgaaaaagagctggagaaaggtgtcagtgatcaacattgtgatattgatcattctggtaattgtttatgtggttgcctgtgcagcttttagacacaataaacggatcgataacgatgaaccttatggtgaaactagaatggagaaggcacaacctagcaggatacacttttgagattgtttcaaattataaaaagagtaaatttaggcatctatcattttgattggtgcttttttcttcaattagttaagatgaaaaaaaggattatagctaatatatgtggttttggaaatatgcagtagacctctgaaattgtatattttgtgttagtgatggaatgtttctttcattttatc

SEQ ID NO: 5770 - DNA, 890 bp, Nicotiana benthamiana
aggaggtttacaccatgagaacaagcaaccatttgataggtctagtaaacttcttcacatttcttgcatcaattccaatcttgggtggtgggatatggctaagtagcagagcaaacaacacagactgcttaaaattccttcaatggccattaataattattggggttgcaattatggtggtttctttggctggttttgctggtgcttgctataggaacactttcctcatgtacctttatctatgggctatgttcttcatcatagctgctttgattggctttatcatctttgcttatgctgtcactgataaagggtcgggtcgacccgttatgtatcgggggtacttggagtattatttgcaagattactctgggtggctagaggaaagggtcaaaagtcagagctattggatgaaaatcagttcttgtattagaggttctcatgtttgtggtaagatgagaagaacatataataacggaattccagagcctgctgaaatgttttaccgtagaaaccttagccctcttgagtctggttgctgcaagccccctacagaatgtggctatacttacatgaatgagacagtgtggaattccggaggagggctagtaggaggtgatccagattgtgttagatggaacaatgatcaacaacagctctgctataactgcaattcttgcaaagctggtgttcttgcaagtctgaaaaagagttggcggaaagtatctgtcatcaacattgtcatagtgatcattctagtcatcatgtatattgttgccatagcagcctttagacacaacaagcagatcgataacgacgagccttacggagaaaccaggatggagaaatctcgacctagcagcatacacttctaagagcttccccatgac

SEQ ID NO: 5771 - DNA, 1162 bp, Sesamum indicum
atacacacacatacatatctcctcccaagaaacatacatcagtacattacagtaaacttgcacaaacagaaacaagaaattcaaaaacttcctcaacccccccgcagcaccatgagaaccagcaaccacctaatcggcttccttaacttcctcactttcctcctttcaatccccatcctaggcggcggcatatggctgagcagccgtgccaacaacaccgactgcatgaagttcctccagtggccagtcatcatcatcggcgttgccataatggtcgtctcccttgccggcttcgccggcgcttgctaccgcaacaacttcctcatgtacctctacctgtgggccatgttctttatcgtcgccgccctcataggcttcgtcatctttgcctacgccgttaccgacaagggctcaggccagcccgtcctgaaccgggtttacctcgactactcgctccgggattactcaggtacttggctcgcggatcgggtggcgagtgagagctactggagtaagatcagttcttgcataagggactctcatgtgtgtcggaagatgggcaggacttttgcgggtgttcctgagtccgccgagatgttctacctcagaaaactcagtcctattgagtccggatgttgcaaaccccccacatcatgtggcttcacgtacataaacgagacagtctggaaccccggaggtggactcgtgggaagcgaccccgattgcttgcggtggagcaacgaccaagaacaactatgctacaactgcgactcttgtaaagccggcgtgttagccagcttgaagaagagctggaggaaagtctcagtcatcaatatcgtcatactgatcctcctcgttatactgtacgtcgttgcctgcgcagctttcaggcacaacaaacggatcgacaatgacgagccttacggcgagacccggatggagaaggcacagcccagcaggatacatttttagaagctttcaccagaggaatgaattattgaaattttaagatcattttcaagcacagtgtgggaattgcagtttgtttagtttttagtagatggaaaagggacttgtaattgctgtggttctcttgactctcttttaaagaaaaatttgccttttgtatattttgtaattgcttcttgcatcttatttcggt

SEQ ID NO: 5772 - DNA, 1402 bp, Mimulus guttatus
aaacatattttcttatctcgtctctccatcttcccccacccaccgcctcttttccctttttcacttcttctcttctacagatccggcaccgaccaccggggttttccactggttccgggttttaccaataaatacagcaagcagtactctctctctctctctctctctctctctctctctctctctcttgtaaagacaattaaatttcaaaaaaaatcacaaccaccgccgccgccatgagaacgagcaaccacctaataggcgccctgaacttcctcaccttcgtcctttcgatccccatcctcggcggcggaatatggctgagcagccgcgcgaacaacaccgactgcctgaagttcctccaatggccgctcataataatcggcgtctccatcatggtcgtctccctcgccggattcgccggcgcctgctaccggaacaacttcctcatgtacctctacctgtgggccatgttcatcatcatcgccaccctactcggcttcgtcatcttcgcctacgccgtcaccggcaagggttccggccagcccgtgatgaaccgggcctacctcgactactcgctccaggactactcgggttggctctcggatcgggtcgcgagtgatagttactgggccaaaatcgggtcctgcattagggattcacgcgcgtgcagaaagatgggcagaaatattgggggcgttcctgaatctgccgagatgttttacctcagaaaactcagccctattcagtctggatgttgcaaaccgcctacatcatgcggctacgtgtacataaacgagacggtgtggacgccaggtggcggcctcgtggggcccgacacagattgcacaaaatggagcaacgaccaggagcaattatgctacgggtgcgattcttgcaaagctggggtagtggctagcttgaagaagagctggagaaaagtgtcggttattaacatagttgtcttgataatcctcgtcatactctatgtggttgcttgtgctgcttttaggcacaacaaaaggatcgataatgacgagccttatggagagacaagaatggagaagtcgcagcctagtaggatacatttctagaggtgcgtttggattttaaagatttttacgagcaacgcgcgtgtgtggaattatttcgcagtttatttggtgttttcggaaaaaaaaaaaagaaaagaaaaaaaacactgtctgtatattttgtattaatgtgatgacgtgtcttgtaatggaactgtttaagaactatgctgcacatggaaactacgtaagggtttataagcaactgcatgtgcacaatgcatcattgagtagacatggatggatccatgaaaggtgtttaattaagaatgttaattaatattttgctgtttaatcacttcaaattc

SEQ ID NO: 5773 - DNA, 1443 bp, Mimulus guttatus
taaattggtacccaaacatattttcttatctcgtctctccatcttcccccacccaccgcctcttttccctttttcacttcttctcttctacagatccggcaccgaccaccggggttttccactggttccgggttttaccaataaatacagcaagcagtactctctctctctctctctctctctctctctctctctctctcttgtaaagacaattaaatttcaaaaaaaatcacaaccaccgccgccgccatgagaacgagcaaccacctaataggcgccctgaacttcctcaccttcgtcctttcgatccccatcctcggcggcggaatatggctgagcagccgcgcgaacaacaccgactgcctgaagttcctccaatggccgctcataataatcggcgtctccatcatggtcgtctccctcgccggattcgccggcgcctgctaccggaacaacttcctcatgtacctctacctgtgggccatgttcatcatcatcgccaccctactcggcttcgtcatcttcgcctacgccgtcaccggcaagggttccggccagcccgtgatgaaccgggcctacctcgactactcgctccaggactactcgggttggctctcggatcgggtcgcgagtgatagttactgggccaaaatcgggtcctgcattagggattcacgcgcgtgcagaaagatgggcagaaatattgggggcgttcctgaatctgccgagatgttttacctcagaaaactcagccctattcagtctggatgttgcaaaccgcctacatcatgcggctacgtgtacataaacgagacggtgtggacgccaggtggcggcctcgtggggcccgacacagattgcacaaaatggagcaacgaccaggagcaattatgctacgggtgcgattcttgcaaagctggggtagtggctagcttgaagaagagctggagaaaagtgtcggttattaacatagttgtcttgataatcctcgtcatactctatgtggttgcttgtgctgcttttaggcacaacaaaaggatcgataatgacgagccttatggagagacaagaatggagaagtcgcagcctagtaggatacatttctagaggtgcgtttggattttaaagatttttacgagcaacgcgcgtgtgtggaattatttcgcagtttatttggtgttttcggaaaaaaaaaaaagaaaagaaaaaaaacactgtctgtatattttgtattaatgtgatgacgtgtcttgtaatggaactgtttaagaactatgctgcacatggaaactacgtaagggtttataagcaactgcatgtgcacaatgcatcattgagtagacatggatggatccatgaaaggtgtttaattaagaatgttaattaatattttgctgtttaatcacttcaaattcaatttatttttggagagtatttaatctt

SEQ ID NO: 5774 - DNA, 1276 bp, Mimulus guttatus
attaatatatctgctccccaataaatacagcagtactctctctctctctctctcttgtaagacaaaattaaatttcaaaaaaatcacaaccaccgccaccaccgcaaccgccgccgccatgagaacgggcaaccacctaataggcgccctgaacttcctcaccttcgtcctgtcgatccccatcctcggcggcggaatatggctgagcagccgcgcgaacaacaccgactgcctgaagttcctccagtggccgctcataataatcggcgtctccatcatggtcgtctccctcgccggaatcgccggcgcctgctaccggaacaacttcctcatgtacctctacctgtgggccatgttcatcatcatcgccaccctcctcggcttcgtcatcttcgcctacgccgtcaccggcaagggttccggccagcccgtcatgaaccgggcctacctagactactcgctccaggactactcgggttggctctcggatcgggtcgccagtgatagttactggagcaaaatcgggtcctgcattagggattcacgcgcgtgtagaaagatgggcagaaatattgggggcgttcctgaatctgccgagatgttttacctcagaaaactcagccctattcagtctggatgttgcaaaccgcccacatcatgcggatacgtgtacataaacgagacggtgtggacgccaggtggcggcctcgtggggcccgacatagattgcacaaaatggagcaacgaccaggagcaattatgctacgggtgcgattcttgcaaagctggagtagtggctagcttgaagaagagctggagaaaagtgtcggttattaacatagttgttttgataatcctcgttatactctatgtggttgcttgtgctgcttttaggcacaacaaaaggatcgacaacgacgagccttatggagagacaagaatggagaagtcgcagcctagtaggatacatttctagagatgcgtttggattttaaagatttttacgagcaacgcgcgtgtgtggaattattttgcggtttatttggcgttttcgggaagaaaaaaaaaaaaagaaaaaaagaaaaaaatgctgtctgtatatttgtattgatgtgatgacgtgtcttgtaatggaagtatttaagaactatgctgcacatggaaactacgtaagggtgttgtttattctgttacatgtttaaaataggtttataagcaactgcatgtgcacaatgcatgattgagtagacatggatccatgaaaggtgtttaatta

SEQ ID NO: 5775 - DNA, 1276 bp, Mimulus guttatus
attaatatatctgctccccaataaatacagcagtactctctctctctctctctcttgtaagacaaaattaaatttcaaaaaaatcacaaccaccgccaccaccgcaaccgccgccgccatgagaacgggcaaccacctaataggcgccctgaacttcctcaccttcgtcctgtcgatccccatcctcggcggcggaatatggctgagcagccgcgcgaacaacaccgactgcctgaagttcctccagtggccgctcataataatcggcgtctccatcatggtcgtctccctcgccggaatcgccggcgcctgctaccggaacaacttcctcatgtacctctacctgtgggccatgttcatcatcatcgccaccctactcggcttcgtaatcttcgcctacgccgtcaccggcaagggttccggccagcccgtcatgaaccgggcctacctcgactactcgctccaggactactcgggttggctctcggatcgggtcgcgagtgatagttactggagcaaaatcgggtcctgcattagggattcacacgcgtgtagaaagatgggcagaaatattgggggcgttcctgaatctgccgagatgttttacctcagaaaactcagccctattcagtctggatgttgcaaaccgcccacatcatgcggctacgtgtacataaacgagacggtgtggacgccaggtggcggcctcgtggggcccgacatagattgcacaaaatggagcaacgaccaggagcaattatgctacgggtgcgattcttgcaaagctggagtagtggctagcttgaagaagagctggagaaaagtgtcggttattaacatagttgttttgataatcctcgttatactctatgtggttgcttgtgctgcttttaggcacaacaaaaggatcgacaacgacgagccttatggagagacaagaatggagaagtcgcagcctagtaggatacatttctagaggtgcgtttggattttaaagatttttacgagcaacgcgcgtgtgtggaattattttgcggtttatttggcgttttcgggaagaaaaaaaaaaaaagaaaaaaagaaaaaaatgctgtctgtatatttgtattgatgtgatgacgtgtcttgtaatggaagtatttaagaactatgctgcacatggaaactacgtaagggtgttgtttattctgttacatgtttaaaataggtttataagcaactgcatgtgcacaatgcatgattgagtagacatggatccatgaaaggtgtttaatta

SEQ ID NO: 5776 - DNA, 1235 bp, Plantago ovata
tcactctccaatcaacaccaacattcgttaaaatttcattcaactccatcactactactcaactcaactcacctcaccatgagaacaagcaaccacctcatcggaatcctcaacttcctcagcttcctcctctccatccccatcctcggcggcggcatatggctcagcagccgcgccaacaacaccgactgtctccgcttcctccaatggccactcatcatcatcggcatctcaatcatggtcgtctcactcgccggtttcgccggcgcgtgttaccgtaacaccttcctcatgtatctctacctatgggtcatgttcttcatcatcgccacgcttatcggattcgtcatatttgcttacgctgtcacggataaaggggaaggacagcctgttataaaccgggtttattcggattaccggctgcaggagtactccggttggttggcggatcgggtgtcgagcccgagttactggtccaggatcagctcgtgtattagggattcgcatacttgtaggaagctggggagagagattgatggatttccggaaactgctgagattttttaccggaggaagctttctccaatcgagtctggatgctgcaaacctcccacatcgtgtggctacacgtacatcaacgagacagtctggagccctggaggtgggctcataggaagtgacccagattgtggtaggtggactaatgatcaaaatcaactatgttacaactgtgattcttgcaaagctggtgtattggccagcttgaagaagagctggaggaaagtctctgttatcaacattgttatactcatcctcctggttatactgtatgttgttgcaatagcagcctttaggcacaacaaaaggattgacaacgatgaaccttatggcgagactcgaatggagaaagcacaacctagtaggatacacttctaaaaggtaactaatcatagaaatggaatttgggcttgttttctcaagcacagtgtggagatggaatttctgtagtttgtaaaagatgtaaccagattttgtaatttgtttgtttttgtattttctgtttgctttttctttttctttttttgggttggcctatgtcaaaaggaaagattgcctgtacttcgatagccaatcttcttcagtaaagaaaacggtagcgcttcctttttgtgagtttttgtcctgaatttatatttatacagttcctatatatttaggaaattgaagttaaagta

SEQ ID NO: 5777 - DNA, 973 bp, Fraxinus spp
aagaacaatgagaaccagcaaccacctaataggttttctcaacttcctcaccttcctcctctctatccccatcctcggcggcggaatatggctgagcagccgtgcaaacaacaccgactgcttgaaattcctccagtggcctctcatagtgataggggtctccattatgatcgtgtcactcgcgggctttgccggagcgtgctaccgtaacaccttcctcatgtacctctacttgtgggctatgttcttcataatagcggcccttattgggttcgtcatctttgcttatgctgtgaccgataaagggtccggccggcccgtcatgaaccgggcttaccaggagtactatcttcaggattattcaggttggctggaagagcgcgtgagaagtcagagttactggagtaagatcagttcttgtattagagactcccatatctgtaataaaatgggaagaactgttagcggagttcctgagacggccgatatatttaaccacagaaaactcaatcctattgagtccggatgttgcaagccgcctacagcatgtgggtttgtgtacgagaatgagacatattggggccagcagggaggaggactaggcggagctgatccagattgtgtccgatggaacaacgatcaagagcaactatgttacagttgtaactcatgtaaagccggtgtgttggctagcctcaagaagagttggaggaaagtatctgtggttaacatcgtcatattaatcctgctagttatcatatatgttatagcctgcgcggcatttaggcacgacaaacggatggacaatgatgaagcctttggcgagacccgaatggaaaaggaacagcctagtaggatacatttttaacactccatttcattatatatattttcgtaagacaaaaacattccctactttatatgcttttggttgtgtgtatttagtagtcttaattgctggatcctttcattt

SEQ ID NO: 5778 - DNA, 1136 bp, Tabernaemontana elegans
cttcaggatcagtctttgaaagagaagtcttggatacttggtagaaagatgagaaccagcaatcatttaataggtttactgaacttcctaaccttcttagcgtcaattcctattctgggtggtgggatatggcttagcagcagagccaacaacacagactgcatgaagtttctgcagtggcctttgatagttattggagtggcaatcatggtggtttctttagctggctttgccggcgcgtgttatcgaaacactttcctcatgtacctttatttgtgggctatgttcttcatcatagctgcccttattggctttgttatctttgcttatgctgtgactgatagaggccaaggcagacctgtcttgaatcgagcctacacagagtattacttgcaggacttctctggatggttggaggagcgtgtcacaagtcagacttattggcagaaaatcagttcttgtatcagagattctcatgcttgtgccaggatgggaagaacctacaatggaattcctgagactgctgacatgttttacctcaggaagctcaatcctattgagtcgggatgttgcaaaccacctacagaatgtggttatatttatcaaaacgagacggtttggactcccggggctggtctaacggcaaacaatctagattgcatgagatggagcaatgatcaacaatcactgtgctataattgtaattcttgcaaggctggtgttttagcaagcttgaagaagagttggaggaaggtctctgttatcaatattgttatattgataatcctggtcattgtttatgtggttgcctgcgtagcatttagacacgataaacggattgacaatgatgagccttatggtgaaactcgaatggagaaggcacgacctgctaggatacaattgtgagactctctcaagttgaaaagtaaactttggtgtccatcttagaattggttctttttgaatcactttagatgaaaaaggattggtagctaatatgatatggttttcagagataaagtagacggataagttgtatatttgttgctggtgaagggtagctctttcatcttattatcgatattttgttatgaaatcattattcatgtaatgaagacagatgcagttatagaaaa

SEQ ID NO: 5779 - DNA, 1214 bp, Amsonia hubrichtii
caatatctttcaacttttgaaaacctcaacaaacttcggagtcagtcactgaaaaaatctcgtcttgagctagaaggagaagggttcttggatactagctagaaagatgagaaccagcaatcacttagtaggtttactgaacttcttgaccttcttagcatccattcctatattgggtggtgggatatggctgagcagcagagccaacaacaccgactgcatgacgtttttgcagtggcctttgattgttatcggtgcagctatcatggtggtctctttagctggttttgccggcgcgtgttaccgaaacaccttcctcatgtacctttatttgtgggctatgttcttcatcatagctgctcttattggctttgtcatctttgcttatgctgtaactgatagagggcaaggcagaccagtcttgaaccgagtctactcggagtatcacttgcaggactattctggatggctggaggagcgtgtcacaagtcggagttattggcagaaaatcagttcttgtatcagggattctcatgtttgtgccaagatgggaagaacctataatggaattcctgagactgctgatacgttttacctcagaaagctcaatcctgttgagtcgggatgttgcaaaccccctacacaatgtggcaatgattatcagaatgaaacgttttggactgctggggctagcctaatgggaaccgatcttgattgcacgaaatggagcaatgatcaacaacaactgtgctataattgtgattcttgtaaggctggtgttttggcaagcctgaagaagagttggaggaaggtctctgtgatcaacattgttatattggtcatcctggtcattgtttatgtggttgcttgtgcagcatttagacacaataaacggattgacaacgatgagccttatggtgaaactcgaatggagaagtcacagcccagcaggatacacttttgagattgttcaaagtaaaggagtaaactatggtatctatcttagaattggtgctttttgaatctctttagatgaagaaggattgtagctataatatggtttttgggaatacagtagaccgatgaaatgtatatttggtgctgatgatggacatcttgtcatttactgatattttctttgatgaaatcattattcatgtaatacagacagatgcagttatcaaagatatgttatgaattggaagcttcactag

SEQ ID NO: 5780 - DNA, 1147 bp, Ipomoea nil
ggtcaccactagtcttgtcactcactcagcattaccgcctgtccattaacccacttccccctctctctccccagtccccactcctttcccttcaaccctcaccgccctcagcctctacccgccgccgtcttcacctccggcaacagtgagaaactaaaaacaagggcaaaaagccatgagaaccagcaaccatttgataggtctgatgaacttcttgaccttcctggcgtcaatcccgatactgggcggcgggatatggctgagcagcagagcaaacagtacggactgcataaagtttctgcagtggcccatcatagtcataggggtggccatcatggtggtttccctcgccggcttcgccggcgcctgctacagaaacaccttcctcatgtacctttatctctgggctatgttcttcatcatagccgcccttattggcttcgtcatcttcgcctatgccgtcacggataaggggtcgggtcgacccgtcatgaaccgggcttacatggagtattatctccaggattactccgggtggctggaggagagggtcaccactcagagctactggtcaaagatcggttcttgcgtcagggactcccatgtctgtgggaagacgagaaggttcgttaatggcgcccctgaaaccgcagatatgttttaccgcagacaccttagtcctattgagtcgggatgttgcaaaccccccacggcatgtaactatgtttacatgaacgagacgttatggagcacagacgggggattaccggcagctgaccaggactgtgttcgatggagcaacgatcaacagctactctgttacaactgcaactcttgcaaagcgggtgtactgggcagcctgaaaaagagctggaggaaggtgtctgtgatcaacattgtcgtcctaatcttcctggtaataatgtatgtcgtggcctgtgcagcgtttaggcacaacaagcgcatggacaacgacgagtcttatggcgaaaccaggatggagaaggaacaccctagcaggatacagttttaagagtttgctcaaaatgtgtgggattattattatgtatttgcttattcaactctttttagatgaaagctatgtctatatgccttatccttcttctttttttgaaaaaccttatcc

SEQ ID NO: 5781 - DNA, 957 bp, Mimulus guttatus
ccaccgccaccgccgccgctatgagaacgagcaaccacctaataggcgccctgaacttcctcaccttcgtcctgtcgatacccatccttggcggcggaatatggctgagcagccgcgcgaacaacaccaactgcctgaagttcctccagtggccgctcataataatcggcgtctccatcatggtcgtctcgctcgccggattcgccggcgcctgctaccggaacaacttcctcatgtacctctacctgtgggccatgttcatcatcatcgccacccttctcggcttcgtcatcttcgcctacgccgccaccggcaagggttccggccagtccgtgatgaaccgggcctacctcgactactcactctaggactactcgggttggctctcggatcgggtcgcgagtgatagttactggggcaaaatcaggtcctgcattagggattcacgcgcgtgcagaaagatgggcagaaatattgggggcgttcctgaatctgccgagatgttttacctcagaaaactcaaccctattcagtctggatgttgcaagccgcctacatcatgcggctacgtgtacataaacgagacggtgtggacgccaggtggcggcctcgtgtggcccgacgcagattgcacaaaatggagcaacgaccaggagcaactatgctacgggtgcgattcttgcaaagctggggtagtggctagcttgaagaagagctggagaaaagtgtcggttattaacatagttgtcttgataatcctcgtcatactctatgtggttgcttgtgctgcttttaggcacaacaaaaggatcgataaagacgagccttatggagagacaagaatggagaagtcgcagcctagtaggatacatttctagaggtgcgtttggattttaaagatttttacgagcaacgcgcatgtgtggaattatttcgcagtttatttggtgttttcgg

SEQ ID NO: 5782 - DNA, 1097 bp, Lippia dulcis
gccatgagaacaagcaaccacctcatcggtttcctcaacttcctgagcttcctcctatcgatccccatccttggcggcggaatatggctcagcagccgcgcgaacaacaccgactgcatgaagttcctccaatggccgatcataatcatcggggtcgcaatcatggtcgtctcgctcgccggtttcgccggcgcgtgttaccggaaccagttcctcatgtacctctacctctgggcgatgttcttcatcgtcgccgcgctaatcggcttcgtcattttcgcctacgccgtcaccgataagggctccggccgcccagtcatgaaccgagtctacctcgactactcgctccatgattactccggcaactggctcgccgaccgagtgtccagtccgagttactggcgtaagatcgcgtcctgtgtgagggattcgcatacctgtagaaagattggcaggactgttgggggcgttcccgagtcggccgagttgttctacctcaggagactcagccctatcgagtccgggtgttgcaaacctcccacatcatgtggctttgtgtacataaacgagacggtctggagcccaggcgccggtctcgtgggaagcgaccccgattgtcaaagatggagcaatgatcaagaccaactatgctacaactgtgactcgtgcaaagccggtgttttagcaagcttgaagaagagttggagaaaagtctcggtcattaatatagtcatattgatcatcctcgttatcctctatgtggtcgcctgcgctgcttttaggcacaacaaaaggatcgacaacgatgagccttacggcgagacgaggatggagaagacacatccaagcaggatacaacttttaaaggaaaagttagaattaagtttaaagttttcaagaacaggcgtgaaattttatgcagttctcttattaagtagatggaacatgacttcgtagtttataaggttcttttttactttgtgttggaaacgattaaagatttaaaatattgcagcctgtatatttggtagtgcttgttgtttcaggtaatggatattgcacatggaatgtaatggaaaatacgtggggtgttgtgt

SEQ ID NO: 5783 - DNA, 1209 bp, Triphysaria pusilla
gcttccaaaagcccacacgcaacctcctcttcaaacgaggaagaaaaaagcctttttttgaagctcaacactttaagaatttactctcacgcgccacaaccatgagaaccagcaaccacctaatcggcttcctcaatttcctcaccttcctcctttccatccccatcctaagcggcggcatatggctgagcagccgtgccaacaacaccgactgcatgaagtttctccagtggccgctcatcgtcatcggcgtcgctatcatggttgtctcactcgccggcttcgccggcgcgtgctaccgcaacaacttcctcatgtacatctacttgtgggccatgttcctcatcatcgccgcccttatcggcttcgtcatcttcgcctacgccgtcaccgacagaggctccggccgccccgtcttgaaccgggcataccaggactactcgctccaagactactcgggctggctcgcagatcgtgtcgcaagaaatagttactggtacaaaatcggttcttgcattagggattctcatgtgtgtcggagaatcggcaggaacattgggggcgtccctgaacctgctgaaatgttctaccgcagacgactctcccccatcgagtcgggatgctgcaaacccccaacatcatgcggtctaatgtacatcaacgagacggtttggagtccaggtggcggcctcatggggagcgatcctgattgttcacgttggagcaacgatcaagagcagctctgctatgggtgcaactcgtgtaaggctggcgtgttggcgagcctgaagaagagctggagaaaagtgtcggttatcaacatagtcatactcatcatcctcgtcatagtctacgtggtagcttgtgcagctttcaggcacaacaagcgggctgataacgacgagccttatggtgaaacaaggatggaaaagtcacggcctagcaggatacacttttagattttaaaaagaagaaggataagaaacaaaaggaaatgttttatgattaattaaatcaggatttgattgttgcagtcttgtttagtgttcagaggatgtgaaatagaaaaaactggaatttgatattggctctttgggttgatttcttttgaagaaaaaatatatgtgaatgtgtgtgtttttgtgtaattgttgcattttcttatgcttccctaaacatttttcactattgagatcatattagtgttcc

SEQ ID NO: 5784 - DNA, 1027 bp, Fraxinus spp
aacacccactaccagaaacaaaagaataatgagaaccagcaaccacctaataggttttctcaacttcctcaccttcctcctctctatccccatcctgggcggcggaatatggctgagcagccgtgcaaacaacacagactgcttgaaattcctccagtggcctctcatagtgataggggtctccatcatgatcgtgtccctcgcgggcttcgccggcgcgtgctaccgtaacaccttcctcatgtacctctacttgtgggctatgttcatcatcatagcggcccttattggattcgtcatctttgcttatgctgtgaccgataaagggtccggccggcccgtcatgaaccgggcttaccaggagtacaatcttcaggattattcaggttggctggaagagcgcgtgaaaagtcagagttactggagtaagatcagttcttgtattagagactcccatatctgtaataaaatgggaagaactgttagcggagttcctgagacggccgatatatttatccgcagaaaactcaatcctattcagtccggatgttgcaagccgcctacagcatgtggttttacgtacgagaatgagacatattggggccagcagggaggaggactaggcggagttgattcagattgtgtccgatggaacaacgatcaagagcaactatgttacagttgtgactcatgtaaagccggtgtgttggctagcctcaagaagagttggaggaaagtatctgtggtcaacatcgtcatattaatcctgctagttatcatatatgttatagcttgtgcggcatttaggcatgacaaacggatggacaatgatgaagactttggcgagacccgaatggaaaaggaacggcccagtaggatacatttttaacacactcattacatattttggacttgcatttctttgttttcgcaagacagaaagactcgtaatttatatgcttttggttgtgtgtatttagtagtcttaattgttggatcctttcattttatgtgaactttctcatat

SEQ ID NO: 5785 - DNA, 1156 bp, Vaccinium corymbosum
cttagagagagaaaagaagcgaaacgaattagcaaagagagagaaaatcatgaggggaagcaaccacctgatcggcctcctaaacttcctaaccttcctcctctccatacccatcctgggcggcggcatctggctcagcggccgcgcaaacaacaccgactgcctcaagttcctccagtggccgctcatcatcatcggagtctccatcatggtcgtctccctcgccggtttcgccggcgcctgctaccgcaacaccttcctcatgtacgcctacctctgggccatgttcgtcataatcgccgtcctcatcggcttcatcatcttcgcctacgccgtcaccgacaagggatccggtcatcccgtggcgaaccgggcttacttggagtaccacttggacgattactccggctggttgaaggagcgcgtggcgagccagacctactgggagaagatcagctcgtgtattagggattccaaggtgtgctggaagatggggaggaagattgggggtgtcactgagtctgctgatttgttctatctcagaaagctcactccaattcagtctggctgctgcaaacccccaacagagtgcggtttcacttatgtgaacgagactttgtggaataccggaggggtgctggcgggaaccgatgctgattgtacgaactggagcaacgaccaaactcagctgtgctacagctgtaactcgtgcaaagctggggtgctgggaagcttgaaaaagagttggaggaaggtttctgtggttaacattatcatcttgatcatcttggtgattgtttacatggtcgcctgcgcggcgtttaggcacaaccgccggatcgacaacgatgaaccctatggtgagacccgaatggagaaggcgcggcctagtaggatacatttctaagtatgttttcttttaaggaatgattttcgaatcagtaggatggatttgtatgttgtctaggtggtgcattttgctttcatgaattttccactggaaaaattggagttaaaatcgtattgtatacatcagaggcttgggtaattgtcagctttcaggtgttgcattcattctgtttgattaacaatgatagaagcaggtgaatggtgcactttggttttcctgtgatatgaactaccactgaattttgag

SEQ ID NO: 5786 - DNA, 1416 bp, Solanum phureja
gccactcttagcagctttcgcagttgttctcaggctcagctccccttacaacccacctctttccctcctcaattcttcaaaaagtcccaattcttgaaatcaaagcctttgaactcagcacagtgttatccacgcttggtgattgcgaaggcgttggggacgggcgataatggtgactttgaagattttacagctacacctaacaagatttttatggaagaggcaattggtgccgaatacggagaaggtttcgagacatttagacccaatggactgctcaaagttgatgtggattttttaaatgatagactgcaagagggtttcctgcgaagaatccgttatgcaatgaagcctgatgaagcttatggcctcattttctcttgggataatgtggtggcagattctcgagctctgaagttggatgcctggaatcaacttgcctctgaagaaggattagagcttcctgaagatgatagtgtgcagcggctgttacttaatgcaactgctgatcatattctgcataaggcgctgccaaaggagaagaatgaagctgatcaggatcgattgaagatgaggctttcccaactctatcatgacaagcttctcaaaatttcagagccaattgaagggttgaaagaatggctggatgctgtatcaactgctcgtatcccttgcgctgttgtgtcaagttttgatcgcagaaatatggttgaaaccttagagcgcatgggactcatgaagtacttccaggcaattgtgacagaggaggacggaatggagtctatagcacatagatttctttctgcagctgtaaagctggacagaaagccatcaaagtgtgtggtgtttgaggacaaccctaggggtataactgctgctcacaactgtacaatgatggctgtggcacttattggtgctcacccagcgtacgatttagggcaagctgaccttgctgtaggtaccttcagtgagctttctgtgataaatctcaggagattatttgcacataaaggctccaactttatggacctagagaaacaaatagcagaaaaagcaccgcgcagaaggaagctcacaattgacaccattttctgaaccagtttggtacaacagtctagcacctcattttcctacttgtaaatgctctcttagtgttagaatctgtaggtcttgccgtcccttgccttcattcattctttagataaatagagctggtagaagatgatttcccttgaggtaatctgaaactcagaaatccgtttctcgtcttcttttctctcttttttcttttggggtttctgtttgttcgtgtgatcaagccgttaattcaaactgatatctaccagcagtggtggtggaattacgatccatgtcacaactgcaatattgtaatttctgccaagtatatatatatat

SEQ ID NO: 5787 - DNA, 1653 bp, Capsicum annuum
gcacgaggctcttgctacagctcccttttcaacccacgtctttccctcctcaattgcccaaaaagtttcaattcttcaaatcgaagcatttgaactcagcgcggtgttatcaccgcttgggggttgcgaaggcgctggggacgggcgataatgagcactttggagattttccagctacacctaacaagatttttatggaagaggcaattggtgccgaatacggagaaggttttgagacatttagacccaatggtctgctcaaagttgatgtggattttttaaatgatagactgcaagagggtttcctgcgaagaatccgttatgcgatgaagcctgatgaagcttatggtctcattttctcttgggataatgtggtggcagattctcgagctctgaagttggatgcctggaaacaacttgcctctgaagaaggactagagattcctgaagatgctagtgtgcagcggtttttactttatgcagctgctgatcatgttctgcataaggtgctgccaagggagaacaatgaagatgatcgggatcgtttgaagatgaggctttcccaactctattatgacaatcttctcaaaatttcagaaccaattgatgggttgaaagaatggttggatgctctatcaactgctcgtatcccgtgtgctgttgtgtcaagtcttgatcgcagaaatatggttgaaaccctagaacgcatggggctcatgaagtacttccgggcaattgtgacggaggaggatggaatggagtctatagcacatagatttctttctgcagctgtgaagctggacaggaagccatcaaagtgtgtggtgtttgaggacgatcctaggggcataactgctgctcacaactgtacaatgatggctgtggcacttattggtgctcacccagcgtatgatttagggcaagctgaccttgctgtaggtagcttcagtgagctttctgtgataaatctcaggagattatttgcacataaaggctccaattttatggacctagagaagaaaatagcggaaaaggcaccgcgcagaaggaagcttacaattgacaccattttctgaaccagttcggtacaacagtcaacctcctttccctatttgtaaatgcccttgtagtgttagaatctgtaggtcttcccgtccttaccttcattcattctttagataaatacagctggtagatggggaaaatctcgaaacttagaaatacttgtcttctttttctctatttttattccttttttttcttttggggtttttgtctgttcgtgtgatcgagctgtttaattcaaacagatatctaccagcagtggcagtggaattacgatccatgtaactcagttgcatgcaatattgtgacttcttctaagtatactagatgtagaagcccgcgctagcacgggcccaacagtagtaatctagttatataacctctgtttggaaaaactcaagctaagaaaatgttcagtttcaattcagttgaatttctcgaaacccatcagttgtagcttttctaaattgcaatttgttaattacaaattacaatcgatactaaaacaatattatctcccagttcctgattctcataactggatgttcctaattcaaagcatcttgtattctctctcaaaaaaaaaaa

SEQ ID NO: 5788 - DNA, 1471 bp, Nicotiana benthamiana
cgaccatcttctcctcctccgttttaatctcgaaagcttttctctcaaattaattacccgtactaaaaatggatggtactctcagcttcaggagttgctgtcaggctcagctccccttacaaccaacgtctttccctcctcaattccccagcaggatccaattcttgagagtacagaaaacgaagcctttgagctcgccgcagtgttatcagagccgccgtatggtgattaggaaggcgttgtggacgggcgataatgggcactttgaagattttccagttacacctaacaagatttttatggaagaggccattggtgccgaatacggagaaggttttgagacatttagacccaatggaatgctcaaagttgatgtggatttcttaaatgatagactgcaagcaggtttcctccaaagaatccgttatgcgatgaagcctgatgaagcttatggcctcattttctcttgggataatgtggtggcagattctggagctctgaagttggatgcatggaatcaacttgcctctgaagaaggattagagattcctgaagattataacgtgcagcggctgttactttatgcagatgctgatcatgttctagataaggtgctgccgagggagaagaaggaagctgatcgagatcgattgaagacgaggctttcacaactctattgtgacaatcttctcaaaatttcagaaccaattgaagggttgaaagaatggttggatgctgtatcaactgcccgtatcccttgcgctgttgtgtcaagtcttgatcgcagaaatatggttgaagccttggagcgcatggggctcgtgaagtacttccaggcaattgtgacagaggaggatggaatggagtccatagcacatagatttctttctgcagctgtaaagctggacagaaagccatcaaagtgtgtggtgtttgaggatgatcctaggggcataactgctgctcataactgtacaatgatggctgtagcacttattggtgcccacccagcgtatgatttagggcaagctgaccttgctgtaggtagctttagtgagctttctgtgatcaatctcaggaggctatatgcacataaaggctccaactttatggacctacagaagcaaatagtggaaaaaacacctcgcagaaggaagcttacaattgacaccattttctgatcaagttcgacacaacgttttcctccttttcctacttgtaaatggcctttttagtgtagaatctttagatcatgccgtctcttgccttcattcattctttaggtaaaatgtagctggcagaagatgatttaccttgggggtaatcggaaattcagaaatcctatttgttgtcttcttggtttcccttcctgtggggggggtggggtggggggtttctgtttgtgtgatcaagccgttaccagcagttgtattggaaatccgatccatctcccgaagaatatttacttgta

SEQ ID NO: 5789 - DNA, 1623 bp, Capsicum annuum
aacccacgtctttccctcctcaattgcccaaaaagtttcaattcttcaaatcgaagcatttgaactcagcgcggtgttatcaccgcttgggggttgcgaaggcgctggggacgggcgataatgagcactttggagattttccagctacacctaacaagatttttatggaagaggcaattggtgccgaatacggagaaggttttgagacatttagacccaatggtctgctcaaagttgatgtggattttttaaatgatagactgcaagagggtttcctgcgaagaatccgttatgcgatgaagcctgatgaagcttatggtctcattttctcttgggataatgtggtggcagattctcgagctctgaagttggatgcctggaaacaacttgcctctgaagaaggactagagattcctgaagatgctagtgtgcagcggtttttactttatgcagctgctgatcatgttctgcataaggtgctgccaagggagaacaatgaagatgatcgggatcgtttgaagatgaggctttcccaactctattatgacaatcttctcaaaatttcagaaccaattgatgggttgaaagaatggttggatgctctatcaactgctcgtatcccgtgtgctgttgtgtcaagtcttgatcgcagaaatatggttgaaaccctagaacgcatggggctcatgaagtacttccgggcaattgtgacggaggaggatggaatggagtctatagcacatagatttctttctgcagctgtgaagctggacaggaagccatcaaagtgtgtggtgtttgaggacgatcctaggggcataactgctgctcacaactgtacaatgatggctgtggcacttattggtgctcacccagcgtatgatttagggcaagctgaccttgctgtaggtagcttcagtgagctttctgtgataaatctcaggagattatttgcacataaaggctccaattttatggacctagagaagaaaatagcggaaaaggcaccgcgcagaaggaagcttacaattgacaccattttctgaaccagttcggtacaacagtcaacctcctttccctatttgtaaatgcccttgtagtgttagaatctgtaggtcttcccgtccttaccttcattcattctttagataaatacagctggtagatggggaaaatctcgaaacttagaaatccttgtcttctttttctctatttttattccttttttttcttttggggtttttgtctgttcgtgtgatcgagctgtttaattcaaacagatatctaccagcagtggcagtggaattacgatccatgtaactcagttgcatgcaatattgtgacttcttccaagtatactagatgtagaagcccgcgctagcacgggcccaacagtagtaatctagttatataacctctgtttggaaaaactcaagctaagaaaatgttcagtttcaattcagttgaatttctcgaaacccatcagttgtagcttttctaaattgcaatttgttaattacaaattacaatcgatactaaaacaatattatctcccagttcctgattctcataactggatgttcctaattcaaagcatcttgtattctctctcaaaaaaaaaaa

SEQ ID NO: 5790 - DNA, 1163 bp, Solanum tuberosum
gatgcagaggggacaatttcaacagtccatttgaaagatttggaggcataatgtcaagtatatttggatttggaggaagagacccattcgatgatccattcttctctcgcccgtctcagacctccatgttacatccaacaactccttctgatgatgaatctaataggccagtcattcaagagattgatacggacgaagatgcaccgctagaaccagatgaggagaacggggacgtgaatggctctaagaagaaaagagatagggcttatgctaacagaaatccacttgttgaacatcctgaagacctaactgatgaccatagcaagagcagcaagatcataagcaaagatgtgactcgtggaatgaaagacatgaaattggaaggaacgcaatcgaagcctcagagcatgagctatagaagagttacatatggtggaatagacgggacatattacactgcgaccacctcacggagggctggaaatgatggaagggtgttagaggagagcaagcaagcagatagcacaactggtcaagcaacacatagaatttccagaggaattcaggataaggggcattcgttgacaaggaaacttgcctcagatggtaaggtggatacaatgcagacgttgcataatctagaagaagatgaattagctggctttgaacagacatggaatggcaatgctaataacgaaatccctggctggaatagtggatttgatttccacgcgaatgcaggaacaagcagtaattggctgacgaattgggaagctggattccgagatccatttagtggtgtgagaccaagtaacaacagtgctcagtcagggacgcaaagtggaagaccaaagaaggtcgttcggatcaatatagagtgaatgtacatagagtgaatgtacgtgttcaccggattgatatcgagccatggaatggagaacctcctgggtagaggactatactatatttggtagttgctttagggtcttggtgagaggtaataaaagcagtcgtaggtctataaagaagggatcgatgtatctggggttgttgtaatattaatgctttatccagagatgtttttgttcgacttcacataatacaattgattaaatagtactctttcaagcaatatagaagaaaaaaacaagtatatttagtca

SEQ ID NO: 5791 - DNA, 1175 bp, Solanum phureja
atgcagaggggacaatttcaacagtccatttgaaagatttggaggcataatgtcaagtatatttggatttggaggaagagacccattcgatgatccattcttctctcgcccgtctcagacctccatgttacatccaacaactccttctgatgatgaatctaataggccagtcattcaagagattgatacggacgaagatgcaccgctagaaccagatgaggagaacggggacgtgaatggctctaagaagaaaagagatagggcttatgctaacagaaatccacttgttgaacatcctgaagacctaactgatgaccatagcaagagcagcaagatcataagcaaagatgtgactcgtggaatgaaagacatgaaattggaaggaacgcaatcgaagcctcagagcatgagctatagaagagttacatatggtggaatagacgggacatattacactgcgaccacctcacggagggctggaaatgatggaagggtgttagaggagagcaagcaagcagatagcacaactggtcaagcaacacatagaatttccagaggaattcaggataaggggcattcgttgacaaggaaacttgcctcagatggtaaggtggatacaatgcagacgttgcataatctagaagaagatgaattagctggctttgaacagacatggaatggcaatgctaataacgaaatccctggctggaatagtggatttgatttccacgcgaatgcaggaacaagcagtaattggctgacgaattgggaagctggattccgagatccatttagtggtgtgagaccaagtaacaacagtgctcagtcagggacgcaaagtggaagaccaaagaaggtcgttcggatcaatatagaagtgaatgtacgtgttcaccggattgatatcgagccatggaatggagaacctcctgggtagaggactatactatatttggtagttgctttagggtcttggtgagaggtaataaaagcagtcgtaggtctataaagaagggatcgatgtatctggggttgttgtaatattaatgctttatccagagatgttcttgttcgacttgacataatacaattgattaaatagtactctttcaagcaatatagaagaaaaaaacaagtatatttagtcaaagtatccgttatggaatgtcgaaaac

SEQ ID NO: 5792 - DNA, 2306 bp, Solanum phureja
cttgaaacctaaaaatagctcaataacatcaacatctccaactacacgacagctcaccatttcaatggcaatttctcctcaaaaaaaccattatttaggctgactgtcaactaatcctattgatctttttggccttccctttcccccttttttcgcaaatcttcaaacgaccctttcgatattttaccccttttttgcaaattttgaattacccatctgatattttggctttttgatcgcaatttggaagcacccttttgataaagtttggttcttttaggaaaaaaattcaactatacatattttttgttaaaagtttgcagaatccatggccggcatcgctaccgccggcgacaccagcaccagtaccagcagcaacctagcgccgacgaggagtttgagcaagaaggaaaatcaggggcttctgttgggcaggtatgaaattgggaaattactagggcatggtacttttgctaaggtgtaccatgctagaaatgtgaagacgaatgagagcgtagcgattaaggtgattgataaagaaaagatcttgaaagtgggtcttattgatcacataaaacgtgagatctcaattctcaagagagtaaggcatccaaatatagttgaattgtacgaagttatggctaccaaagccaaaatcttctttgtcatggagtatgtcaaaggcggtgagctcttcaataaggttgccaaaggcaggcttaaggaagaagttgctcggaaatatttccagcagttaatctctgctatcgctttttgtcatgcccggggtgtttaccatagggacctaaagccagaaaatatactgttagatgaagatgggaatgtcaaagtttctgattttggccttagtgccatttcagagcagataaagcaagatgggctctttcatactttctgtggtactccggcttatgtggcgccggaggtgttaggaagaaagggttatgatgcagccaaagtagacatttggtcatgtggggtgatactctttgtgctaatggcagggtatttaccatttcatgatcagaatgttatggctatgtacaagaagatttataggggtgaatttagatgtcccaggtggttttcacctgaattaactcggtttttaaagcaccttcttgatattaatcccgaaaccaggattactgttcaggagattatgaataataggtggttcaagaagggttttaaacatgttaaattttatattgaggatgataagttgtgtagtataaatgatgatgagtatggtgggattgattattcgtctgatagatcagagtctgagtctgaaatagagatcagaaggaggtcagctactttgcctaggccagctagcttgaatgcatttgatattatttcattttcccgtggctttgatttgtccggtttgtttgaggagggaggagatggggcaaggtttgtatccggggctcctgtgcccaagatcataaataagttggaggaaattgctaaagttgtgagctttgcagtaaggaagaaggattgtaaagtgagtatggaggggtctaaggaaggtgcaaaggggccgttgacagttgcagctgagatatttgagttgacgccatcgttgagagttgttgaagtgaagaagaaaggaggagacagcttggagtatgaggagttttacaacagggaattgaagccaggattacagaatttagcacatgaagttggataccctgttgattcatcatatttgccatcagatactgaataaagagagagaaggggaaagggtaactgtggacttcctagggacaggtggaggctgcttgcactcgaacggggacttcctgaataccaaaaagcagaaacacatgccaagctagactgatggagcgccacgctagtgaacccttgacctagcactatgtcatgagttgatgttcgcgatcaaggtttcaccatttcaattctggccagtgaaaaacgtggttcgtagtctaattgtatattagtagtctcatcaacaaggccatccagttcgcgttagttagttgatgtagtacttattcagagaagtttgataccaaagcccagatttaaattttaaaagaataaaaatctttgtaatagtgtttttgggccatagaaagaggagaagaataaatctggaccactgtgtagtgaatgattgaaatttgaaagctttatttattgtcgttagacggcagtttcactagctgttgctatcaaacttttgtcctcttacgagacttgttagattaaaagaatctatttctggtctatttatttta

SEQ ID NO: 5793 - DNA, 2071 bp, Nicotiana tabacum
ccccttttgatcttttccctatttttcgcaaatcttgaactaccctttggttgcaaatttggaaacccctatttgataatattttgggcataatttgaagtataccatttttggttaaagtttggagaatccatggccggtaccactaccgccggcgacaccagcaccagcagtagaagcaacctagcgccgacaaaaagtctgagcaaaaaggaaaatcaaggacttttatcgggtaggtacgaaattgggaaattacttgggcatggtacgtttgctaaggtgtaccacgctaggaatgtgaagacaaatgagagcgttgccataaaagttattgataaagaaaagatcttgaaagttggtcttattgatcacataaaacgcgagatctcaattttaaggagagttaggcacccaaacatagtccaattgtacgaagttatggccacaaaggccaaaatctactttgtcatggagtatgttaaaggcggtgagctttttaacaaagttgctaaaggcaggcttaaggaggaagttgctagaaaatatttccagcagttaatctctgctgtagccttttgtcatgctcgtggtgtttaccatagggacctaaagcctgaaaatatactgttagatgaagatgggaatgttaaagtttctgactttggccttagtgccatttcagagcagataaaacaagatggtttgtttcataccttttgtggtaccccggcttacgtggcgccggaggtgttagctagaaagggttatgatgcagccaaagttgatatttggccatgtggggtgatactctttgtgctaatggcagggtatttgccatttcatgatcagaatattatggctatgtataagaagatatacaagggtgaatttagatgtcctagatggttttcacccgaattgactaagtttttaaggcaacttcttgatactaatcctgaaactaggatcactattcaggaggttatgaacaataggtggtttaagaagggttttaaacatgtcaagttttatattgaggatgacaagttgcgtagtgttaatgatgatgattatgatggcggggttgattattcgtctgatagatcggagtctgaatctgaaatggagatgagaaggaagcctgctactttgcctaggccagctagcttgaatgcatttgatatcatatcgttttctcgtggttttgatttatctggtttgtttgaagaaggaggagatggggcaaggtttgtatccggggctcctgtgcccaagatcattagtaagttggaggaaattgctaaagttgtgagctttgcagtgaggaagaaggattgtagagtgagtttggaggggtctaaggagggtgaaaagggaccattgacaattgcagctgagatattcgagttgacaccatctttgagagttgttgaggtgaagaagaaagcgggagacagagtggagtacgaggagttttaccataaggaattgaagcctgggttacaaaatctgacgcttgaagttgatggccctgtcgattcatcgcatttgccttcagatactgagtagaaagaaaaagaagggaaaaagggttgttagttgtgaacctttaacaactggccaggcagaactcctaaattccaaaaaatgaccattggcaacctggatcgcaaagccaacaagccgtaggcctctagcacttcatcaccattgatattctgggatcaagatttaccaggttcaactctggccactgagattctggttccttgtctaattgtatgtagtccatgtactggtagttgttgcataagcttgttttgttctctgttcatgatctagttacttgattttttacttgtagacgaggaaagaaataaaagcgaaaaatgaatagttctcaaaataatgttattggttacaaaagccattctcagtaatccgacggcagtctgtgagtaaattagtaattgtgaggtgatttacttcttcttgctgaaactgtcttctaacatagtttctcatgcatgtcagatttaatagaatcaatttctggttaatttttcca

SEQ ID NO: 5794 - DNA, 2196 bp, Nicotiana benthamiana
atacctacagctctatacacaaatcatttttcacaaacctcctaaatatagctcaaaaacacaaacaacaacatcaacatctcccaactccacgacagcccaccatttcaatggcataaactcctctaaaaacccatttttaaggctgactttcaactaccccttttgatcttttgcctatttttcgcaaatcttgaactacccttttgttgcaaatttggaaaccaccatttgataatattttgggcaaaatttaaagtacccatttttggttgaagtttggagaatccatggccggcaccactatcgccggcgacaccagcaccagcagtagaagcaatctagcgccgacaaaaagtctcagcaaaaaggaaaatcaaggacttttattgggtaggtatgaaattgggaaattactagggcacggtacgtttgctaaggtgtaccatgctaggaatgtgaagacaaatgagagcgttgctataaaagttattgataaagaaaagatcttgaaagttggtcttattgatcatataaaacgcgagatctcaattttaaggagagttaggcacccaaacatagtccaattgtatgaagttatggccacaaaggccaaaatctactttgtcatggagtatgttaaaggtggtgagctctttaataaggttgctaaaggcaggcttaaggaagaagttgctagaaaatatttccagcagttaatatctgctgtagctttttgtcatgctcgtggtgtttaccatagggacctaaagcctgaaaatatactgttagatgaagatgggaatgttaaagtttctgactttggccttagtgctatttcagagcagataaagcaagatggtttgtttcataccttttgtggtaccccggcttatgtggcgccagaggtgttagctagaaagggttatgatgcagctaaagttgatatttggtcatgtggggtgatactctttgtgctaatggcagggtatttgccatttcatgatcagaatattatggctatgtataagaagatatataagggtgaatttagatgtcctagatggttttcgcccgaattgactaggttcttaaggcaacttcttgatactaatcctgaaactaggatcactattcaggaggttatgaacaataggtggtttaagaagggttttaaacatgtcaagttttatattgaggatgacaagttgtgtagtgtttatgatgatgattatgatggcggggttgattattcgtctgatagatcggagtctgaatctgaaatggagatgagaaggaagccggctactttgcctaggccagctagcttgaatgcatttgatatcatttcattttctcggggttttgatttgtccggtttgtttgaggagggaggagatggggcgaggtttgtatccggggctcctgtacccaagatcataagccgaggttttgatttgtctggtttgtttgaggagggaggagacggggcaaggtttgtatccggggctcccgtgcccaagatcataagtaagttggaggaaattgctaaagttgtgagctttgcagtgaggaagaaggattgtagagtgagtttggaggggtctaaggagggtgaaaaaggtccattgacaattgcagctgagatatttgagttgacgccgtcgctgagagttgttgaggtgaagaagaaaggaggagatagagtggagtatgaggagttttacaacagggaattgaagccagggttacagaatttaacgcttgaagttggagaccctatccattcatcttatttgccatcagatactgaatagagagagaaagagaagggaaaagggtaagtgtggacttctaacaactggtgaaggctacttccactggaacggagaactcctgaataccaaaaaacagaaccaaatgccaagctggatggatcaagcgctaaccctcgccaactagcccttttgcattgcacttcgttgcaagttgatgttcaagatcaagatttaaccatttcaactcaggccagtgcataacatggttcatagtctaattgtatattagtagtctgtctatggaactagtagttgtagccaaaatgataaaggtcttctgatttgcacttcacgccaagttagtggatgtaatacttatgcagagaaataaaaaagaaaattggaaatggcataagga

SEQ ID NO: 5795 - DNA, 1763 bp, Lippia dulcis
gtcatcccttccggagtcccaccaccacctatattaagaggtatagagattctgcttcggatttccactctgtaagattcggctgtaatccatggccgccgccgccgcagccccacgggcagccacgtcgacgagcggttcgaagcagaaggagatgaaaggccttctgttggggcgatacgaaatcgggaagcttttaggtcatggaacgtttgcgaaggtttatcacgcgaaaaacgtgaagacaggggagagcgttgcgattaaggtgattgataaggagaagatcttgaaggtagggctgatagggcacatcaagcgcgagatctcgattttgaggagggttcgtcatccgaacattgttcaattgtttgaggttatggcgacgaaggcgaagatctttttcgttatggagtacgtgaggggcggggagttgttcaacaaagttgctaagggcaggcttaaggaggaagttgcgaggaagtatatgcagcaattgatttccgcggtggcgttctgccacgcgcgcggggtctaccaccgtgatttgaagccggaaaatatattgctggatgaagatgggaatctcaaagtgtcggattttgggttgagtgctatatcggagcagattaagcaggatggcctttttcataccttttgcggcactccggcgtatgttgcccccgaggtgttagctagaaaggggtatgatgcggccaaggttgatatttggagctgtggcgtaattctctttgttttgatggcaggctatttgcctttccatgatccgaatattatggctatgtataagaagatttataaaggtgaattcaggtgtccccgatggttttctcctgaattgactcgatttctaacacggttgctcgacacgaatcctgagaccaggatcacggttacagagatcatgaacaacaaatggttcaagaaggggtttaagcatgtgaaattttacattgaagatgacaaattgtgtagtgttaatgatgacgtgaaagatgatattgattccctatctgatcagtcgttgtctgaatcggaagctgagcttgagacaagaaggaaattaactagccttcccagacctgctagtttgaatgcatttgatataatttcattttcgcgttggttttaatttgtcgggattgtttgaagaaggagaagatggaggggaaagatatgtttcaggggcaccagtacccagcattatctcaaagttggaggaaattgctaaagttgtgagctttacagtgaggaaaaaggattgccgagttagtcttgagggatcaagggaaggtgtaaaggggccattgactattgcagccgagatattcgaattaacaccttcgttgagagtggttgaagtgaagaagaaaggaggtgatagattagagtatgaagaattctgtcaccgtgaattgaagccgggattgcaaagccttgtgccgggacgtagcgctgattcttcttacttgccttcggacacagaatagataataagaggagggaaaatgagtatgcccctaaattttctcattttttttctcaacactcggtggcatctgtatgataaattgctatgtgtttcttgactttcttgttttgaggatacctactcattctgctagtgagatgaagttaaaatgtaacctcatcctttgtcgttaatacctccttatgttggagtagattttgtaaaactctctagagaatgaatacacatctgtgttaagagttgttggtag

SEQ ID NO: 5796 - DNA, 1997 bp, Mimulus guttatus
aatgaattgtgaatgaaatgaaagggcaaaataacacacacacacgcggaaaaacacagctcgaacccgatgggagaagagccaccctttccaccgccgcaccaccaccgcctgtgttaagaggggattgatatcgaaaatttccataccggaatacatggccggagccaccggaaccgcctctacgtccacctctggatcgcatattccgacgcagaaggagatgaaggggctgttattagggcgatacgaaattgggaagctcctagggcacgggacattcgccaaggtttatcacgccaggaacgtgaaaaccggagacagcgtggcgattaaggtgatcgacaaggagaagatcctgaaggtggggctaatcgcgcacatcaagcgcgagatctcgattctgaggagggtgcgccacccgaacatcgtgcaattgttcgaggttatggcgaccaagactaaaatcttcttcgtaatggaatacgtcaggggcggcgagctgttcaacaaggtcgccaagggcaggctcaaggaggaggtcgccagaaagtatttccagcagctgatttccgccgtgtcgttctgccacgcgcgcggcgtataccaccgcgatttgaagccggagaacatactgctcgacgaagatgggaacctcaaagtttccgatttcggcctcagtgctatatccgagcagattaagcaagacggccttttccacaccttttgcggcacgccggcctacgtggcaccggaggtgttggctcggaagggatacgatgcggctaaggtcgatatctggagttgtggtgtgatactgtttgttttaatggcagggtacttgccgtttcacgatcaaaatgtcatggctatgtataagaagatctacaaaggtgaattcaggtgcccgaggtggttttcgcctgaattgagccggttattgacgcgtttgctcggcacaaatcccgaaacgaggatgacaattccggaaatcatggataataaatggttcaagaaggggttcaagcatgtgaaattctacatcgaagacgacaaactgtgtaacattaacgacgatgtgaattacgacatcggttctttatccgaccagtctttgtctgaatccgattccgaattggagacgaggaggaagatcactactagtcttcctcggcctgctagcttgaacgcgttcgatattatctcgttttcgcgtggttttgatttgtcggggttgttcgaggaaggaacagatggaggggcaagattcgtttcaggggaaccggtgtcgaatataatttcgaagctggaagaaattgccaaagttgtgagctttacagtgaggaaaaaggattgcagagtaagtcttgagggatcgagaaatggtgtgaaggggccgttgactattgcagctgagatattcgaattgacaccgtctttgagagtggttgaggtgaagaagaaaggaggtgatagaatagaatacgaggaatttcgtgaccgtgaattgaagcctgccatgcaaagtcttatgatgggaaacgttgccggttcttcgtatttgccctcggacaccgaataaagagatgaaagaaagagggagaagagtacgcccgtaatttcctacttaacactcggtggcttcttgatgataatcgttatgtttttctttttcgtttttttctctgtttttctacctcgtgttctgctagttagatgaatgttaaatgaaaaattattcttttttgttaaattactctttgctttgaagttgatcctataaaacctcgtgttgcctccttgatggccgtttgctcccgagggtttataactcggtacgttttaccctattagtcacaattacttggtccgaggctccattaccagacgagtaatctgattttcgacttcctaccctttgttgtccttttattgcataatgaataagagcaatttttcgttgtaaatctatataatgccattaaagttctggatga

SEQ ID NO: 5797 - DNA, 1791 bp, Amsonia hubrichtii
ttccttcctttcctttctagacctcagaaacaaggccaaaagaaaaggcccagcatagagacaagaaggcaaaaccacacagctcaaaccaagtcacgagaaatcctcctccagtagcaccgcttccgaagttcaagccatcggatttgaatttgataccctttggtttggttgctggattcataaattgaatttgggtttgaagttcttggatttcaaactcaaattcatggatacgacaacaccttcagcaacgtttacgaagaagagcattagcatcaagaagaaggagacgcaaggtctcctgttgggacgatatgaaatcggaaaattgctgggacacgggacgtttgccaaggtttatcatgctaaaaacatcaagacaaacgagagcgtagctatcaaaattattgacaaggaaaaggtcctcaaaattgggatgatagcccacataaagcgggagatctcgatattgaggagagtaaggcatcctaacattgttcagttgtttgaggtaatggctaccaagactaagatctattttgttatggagtatgttaaaggtggggagctcttcagtaaggtcgccaaaggccggctcaaagaggaggcagcgaggaaatatttccaacaattgatttctgcagttgctttttgtcacgcccgtggtgtgtaccatagagatcttaaaccagaaaatatattgttagatgaagatggcaatcttaaagtgtcagattttggcctcagtgcaatatctgagcaaataaagcaagatggtctttttcatacattttgtggtactccagcttatgttgccccagaggtattggcaaggagagggtatgatgctgcgaaggtggatatttggtcatgtggggtgatattattcgtgttaatggcagggtatttgccatttcacgatcagaacattatggctatgtataagaaaatttataaaggtgaatttaggtgtccgagatggttttcacctgaattagctcggcttttaactcgtcttcttgacactaatcctgaaactcggatcaccattccggagataatggaaaacaggtggttcaagaaggggtttaagcatgtcaagttttatatcgaggatgatatgttatgcagtgtaaatgacgatgacggcatcgagtctgatcagtccttgtctgaatgtgaatctgagcctgaaatggagagtaggaggagattggctagtcttcctaggcctgctagcttgaatgcatttgatcttatttcgttttcgcggggttttgatctgtctgggttgtttgaagaaggaggtgatggtgcaaggtttgtctccggggcacctgtgcccaagattatatctaaattggaggagattgctaaagtagtcagctttacagtgaggaagaaagactgtagagtgagcatggagggttcaagggagggtgttaagggtcctttgtcgattgcagcagagatatttgaactgacaccgtctttgagagttctggaggtgaagaagaaaggtggggatagggtagagtatgaggatttttgtaatcaggaattaaaacctggtttgcagaatctaatgtcggaatttgctgctgatgctttgccttctgattctgaataggaacaaaaagaagagaaaagggtatgctcttttctctctctcttttttctatttgtagtagcttttgtatcataggtgaagctctggtatttcctgatcttgtattttcttctcttgttctattaggccatagaagtatctagagaatgaaatgctcg

SEQ ID NO: 5798 - DNA, 1938 bp, Orobanche aegyptiaca
aacatacaaacacacacacggcaaatcagctcaaacccaaatgggcgagccgccctttccacagcctcaccgcctctattaagacaaaaagcttgaaattttgcatcgaaatttcaattatctatatccacgacgattaatggccgccgccgccgccaccaccaccaccaccacatcaacgaatcctccgaaacagaaggaagtgaaaggcctgatattaggccgatacgaaattgggaaaatcctagggcacgggacattcgccaaggtgtaccaagcgaggaacgtgaagaccggcgactgcgtggcgattaaagtgatcgataaggagaagatcttgaaagtggggctaatcgcacacatcaagcgcgagatctcgatcctgaggagggtccgccacccgaacatcgtgcaattgttcgaggtgatggcgaccaaatctaaaatcttcttcgtcatggagtacgtgagaggcggtgagctgttcagcaaggttgccaagggcaggcttaaggaggaggttgctaggaaatatttccagcagctgatttccgcggttgcgttctgccacgcgcgcggggtctaccaccgcgatttgaaaccggaaaacatattgctcgatgatgatgggaacctgaaggtgtcggatttcggtttgagtgctatatctgagcagattaagcaggatggactttttcataccttttgtggcacgccggcttatgtggcgccggaggtgttggcgaggaaagggtatgacgccgccaaggttgatatttggagctgtggtgtgattttgtttgttttgatggcaggttacttgccctttcatgatcaaaacgttatggctatgtataagaagatatataaaggcgagtttaggtgtcccaggtggttttcgccggaattggttcgacttctgacacgttcgttggacacgaatcccgagacaaggatcacaattccagagatcatgaataataaatggttcaaaaaggggtttaagcatgtgaaattttacatcgaggatgacaaattatgtagtgttaatgatggtcttggcgacgacgatgttgattctatatccggccaatcgttgtctgaatcagaagccgagctggagacaagaaggaagatcattggcttacctaggcctgctagtttgaatgcgtttgatatcatttcgttttcgcgtggttttgatttgtcaggtctttttgaggaaggatcagatggtggagcaagatttgtttcaggggcacccgtgtcgaatatcatatcgaaattggaggaaattgctaaagttgtgagttttacagtgaggaaaaaagattgcagagtgaatttagagggtacgaggaatggtgtgaagggacccttgacgattgcagctgagatatttgaactgacaccatctttaagagttgttgaggtgaagaagaaggcaggtgatagattagaatacgaagaattccgtgaccaggaattgaagcctggattgcaaagccttgtgataggaaatgttactgatactacctcttacttgccttcagatactgaatagagagaaaaaagtaaaggagaaaaaagagtatgaactaaatatccttctcattaacacctgatggcttttgttctgtatgataattcctgtgttttgttttttcgtttattttcagtgaactgtctgtatgtacctcttattctgctagttaggtgaagctcaaatgtaacctcatccttcgtggttaatttctgtgtcgaaatagatccttttggtaactgagtatatagttgttctatgtcggctcgttcatgaattatgtcatattgatttctgttggggtaagtaaatagatttgttgatcatcactagtgtgaggactttattgttgtcagatgaaccaactatgcatttcaatgataatcttatcatac

SEQ ID NO: 5799 - DNA, 1563 bp, Tabernaemontana elegans
tttctagacctcacaaagaagaccaaaataataataagggccaggagacagagccacacagctcaaaccaattcacgagaagtcctcctcaagcagctgtagccaccgccttcagagttcaaactatcgggttcgaatttgaaactgaatttgggtttgaaattcttgttggatttcaaactcaaattcatggctacagcgcagcctattacgaagagcattagcagcaagaagaaggagatgcaaggtctcctgctgggacgatatgaaatcggaaaattgctgggccacgggacgtttgccaaggtttatcatgctaaaaacatcaagacgaacgagagcgtagctatcaagattattgacaaggaaaaggtcctcaagattgggatgacagcccacataaagcgggagatctccatattgaggagagtgaggcatcccaacattgttcagttgtttgaggtaatggctaccaagactaggatctattttgttatggagtatgtaaaaggtggggagcttttcaacaaggttgcaaaaggccggctcaaggaagaggcggcgaggaaatattttcagcaattgatttctgcagttgctttttgtcatgcccgcggtgtgtaccatagagatcttaaaccagaaaatatattattggatgaagatggcaatcttaaagtgtcagattttggcctcagtgcgatatctgagcaaataaagcaagatggcctttttcatacgttttgtggtactccagcgtatgttgccccggaggtattggccagaagagggtatgatgctgctaaggtggatatttggtcatgtggggtgatattattcgtgttaatggcagggtatttgccgtttaacgatcagaacgttatggctatgtataagaagatatataaaggcgagtttaggtgtcctagatggttctctcctgaattgactcggtttttaactcggcttcttgacacaaatccggaaactcggatcaccattccagatataatggaaaataggtggttcaagaaggggtttaagcatatcaagttttatattgaggatgatttgctatgtagtgtgaatgatcatgaggatatcgagtctgatcactccttgtctgaatgtgaatctgagcctgagatggagagtaggaggagattggctagtttgcctaggcctgctagcttgaatgcttttgatattatttcattttcgcgtggttttgatctgtctgggttgtttgaagaaggaggtgatggggcaaggtttgtctctggggcacctgtgtccaagattatatctaaattggaggagattgctaaagttgttagctttacagtgaggaagaaagactgtagagtgagtttggagggttcgaggcagggtgttaagggtcctttgacgattgcagctgagatatttgaacttacaccgtcattgagagttttggaggtgaagaagaaaggtggagacagggtagagtatgaggatttttgtaatcgggagttaaaacctgggttgcagaatctagtgtcggaagatgttgctgatgctttg

SEQ ID NO: 5800 - DNA, 1601 bp, Solanum phureja
aaagaacaagaacctaccttcactacacaaagttcccaactttctttgatctttcacctcaaatcttgaaatggatatcaaatttttcatgttttcattcattctaacctcacttttcctcattcttatctacatgcctacccaattttcccactcacccatcaccattttcaagccaaaaaaaactttcataatctcaaataccacaactaacccttaccctgtaaaatttgcttacttgatctctgcttctaaaggagatgtaccaaagctaaaaagacttcttttttcactttaccatcctggtaatttttacttgattcacttagatttagatgcaccagaaaatgaacaccaagaaatttcaagatttgtgagtgacaactctgtttttggagaaattaataatgtttgggttgttggaaagccaaatttagtgacatatagaggaccaactatgttagctacaacactacatgcaatggctatgcttttgaagattgctaaatgggattggtttattaatctaagtgcctctgattatcctttagttactcaagatgatctgatccatgccttctctgacttaccaagggatcttaattttgtacaacacactagccacatggggtggaaactgaataagagaggaaagccaattattatagatcctggtcttcatactctaaacaaatcagagatttggtgggttatcaagcaaagaagtcttccaactgctttcaagctttatacaggttcagcttggacaatattgtctagatcctttgctgaatactgcataataggctgggaaaatcttccaagaactctacttctttactacacaaattttgtgtcatctccagagggttatttccaaacagtcatatgtaactctgaggaatacaagaacaccacagtgaaccatgatcttcactacattgcatgggacattcccccgaaacaacatccgagatccctcggtccgaaggatttcaggagaatggtcttgagtaacaggccattcgctcggaagttcaagaacaacaacgttgtccttaataaaattgatcgcgatcttcttagaagacaaaatggacagtacttctcagccggaggatggtgctccaatgacaatgatcgaggttgtttgaatctacaggttgagaaatatggcgttttaaagcctggaacaggtgcgagaaggttgagaacattattgaagaaattggtatctgcaccacattttgctaagaggcagtgtagataagttggaaatgaaagtacttttgttggaaatatataaaataaattgtggaagaggatgtaatcatcctaagtcaattcttgataattgtcacagttcattagtttgtatgagaaaaggaaagtattattttaggtgtgtacatccatcctacgttccctagaccccacttgtgggattatactgcgtatgttgtgttgtgtgtaggtctgtagtccagttttattggtcttctttcttcacacagtatgaatcataattcatgctatatgtttgaagattagaagtgttgtatgatcattgctggtattatttctgcgatctgttgttatct

SEQ ID NO: 5801 - DNA, 1589 bp, Nicotiana benthamiana
agaacaagaactacttacttcacaaagttcttgattttttagctaaatctttgttatgggcatcaaactttttatgttttctttcattctaacctcagttctattcattcttgtttacatacctacccaattatctcaatcaccaatcactattttcaagccaactaaaagcttcattatctctaatactagtaaaccttaccctgtaaaatttgcttacttgatctctacttctaaaggagatgtagcaaagttgaaaaggctgttgttttctctataccatcctgggaatttttacttgattcatttggatttagatgcaccagaagctgagcacaaagagatttcaagatttgtgggtggaaatactgtttttggagaaattaataatgtttggattgtgggaaagcctaatttggtaacatatagaggaccaactatgcttgctactacacttcatgcaatgtctatgcttttaaggattgctaagtgggattggtttattaatctcagtgcctctgattatcctttagttactcaagatgatctgatccatgccttctctgacataccaagggatctaaattttgtacaacacaccagccacatgggttggaaactgaataagagaggaaagccaattataatagaccctggtctacatagtttaaacaaatcagagatctggtgggttatcaagcaaagaagtcttccaactgctttcaagctttatacaggttcagcttggacaatattgtccagatcctttgcagaatactgcataatgggctgggaaaatcttccaagaactcttcttctctactacaccaattttgtgtcatcacccgagggttatttccaaacagtcatatgcaactccgaggaatacaagaacactacagtgaaccatgatcttcattacataacttgggacaaccccccgagacaacatccacgatccctcggtccaaaggattacagaagaatggtcttaagcaacaggccatttgcccggaagttcaagaacaacaatcctgtccttaataaaattgatcgtgacattctcagaagacgaaatggacagttctcagccggaggatggtgcactaacgacgatgagcgaggttgttttagtctccaaggtgagaaatatggcgttctaaggcctggaattggcgccagaagattgaaaacattgttaaagaaattggtatatgcaccaaattttgctaagcggcagtgtagataatttggaaatgagacttactttttgttggaaatatagaaaaatatattttatggaagacatgaaataatgttaggtcaattcttgataattgtcatagttcatcagtttgtacgagaaaaagaaaaatatgtctcaggaatgttacgtcaggtgtttaggtcattggagtccagttttattggtcttctttttacattgttatctttgggttctttctatttgtgggggtgttcccattcattccaaagtgtagcctacacacagtatggatcattatacatgctggatggtctaagatcagaagtactgtactattatcattaatactacttttttcctg

SEQ ID NO: 5802 - DNA, 1221 bp, Nicotiana benthamiana
taaatctttgtaatgggtatcaaactttttatgttttctttcattctaacctcagttctattcattcttgtctacatacccacccaattaactcaatcacctatcactattttcaagccaactaaaagcttcataatttctaatactagtgaaccttaccctgtaaaatttgcttacttgatctctgcttctaaaggagatgtagcaaagttaaaaaggctggtgttttctctataccatcctgggaatttttacttgattcatttggatttagatgcaccagaagctgagctcaaagagatttcaagatttgtgggtggaaatactgtttttggagaaattaataatgtttggattgtgggaaagcctaatttggtaacatatagaggaccaactatgcttgctactacacttcatgcaatgtctatgcttttaaggattgctaaatgggattggtttattaatctcagtgcctctgattatcctttagttactcaagatgatctgatccatgccttctctgacataccaagggatctaaattttgtacaacacaccagccacatgggttggaaactgaataagagaggaaagctaattataatagactctggtctacatagtctaaacaaatcagagatctggtgggttatcaagcaaagaagtcttccaactgctttcaagctttatacaggttcagcttggacaatattgtcccgatcctttgcagaatactgcataataggctgggaaaaccttccgagaactcttcttctctactacaccaatttcgtgtcatcacctgagggttatttccaaacagtcatatgcaactctgaggaatacaaaagcaccacagtgaaccatggtcttcactacattacttgggacaaccctccgagacagcaccccagatccctcggtccgaaggattacagaagaattgtcttaagcaacaggccatttgcccggaagttcaagaacaacaatcatgtccttaataaaattgatcgtgacattctcagaagacgaaatggacagttctcggccggaggatggtgcagcaatgatgatgagcgaggttgttttagtctccaaggtgagaaatatggcgttctaaggcctggaactggcgccagaagattgaaaacattgttaaagaaattggtatctgcaccaaattttgctaagcggcagtgtagataatttggaaatcagact

SEQ ID NO: 5803 - DNA, 802 bp, Solanum tuberosum
aaaaatgtttaaattcctctttctcttggctatcttaatcttgagcagcgatgccgctgttcaagatttctgcgtggcagactttaaagcacccgaatcaccttctggctattcttgcaaaagtgttacaaatgtaacagttgacgatttcgtgttttctgggcttagtgctgctggaaacacagcaagcattataaaggccgcagttacaccagcatttgcggcccaatttccaggtcttaatgggcttgggctttctgcggcccgtttagatttggccgcaggtggtgtgatcccatttcacactcaccctggtgcttctgaaattttacttgtggtgcaaggatcaattactgctggatttgtttcatcagcaaattctgtttatttaaaaacacttaaaaaaggtgatttaatggtttttccacaaggattattgcattttcaagtgagtgatgctggatatacttctgtgggttatgtattttttagcagctctaatcctggacttcagattactgattttgcattatttgctaatgatttgccaactaagttggttggggcaacaacattccttgatgaagcaacaattaagaaacttaagggtgtgcttggaggcactaattaagcaacaattgcattgtgttagctgttaatctttctttttttcattctgtttttgggtattttccttgtcttcttcttgttgacaaattgggtctgttgtattttttattctaagggtgttttgtttctttaaagtgtgtttgtttggaatgaacacattttttttccgagt

SEQ ID NO: 5804 - DNA, 858 bp, Solanum phureja
gctcacaaacttcacataacaaatttttactaatcctagccaagattattattatttttttaaaaatgtttaaattcctctttctcttggctatcttaatcttgagcagcgatgccgctgttcaagatttctgcgtggcagacctaaaagcacccgaatcaccttctggctattcttgcaaaagtgttacaaatgtaacagttgacgatttcgtgttttctgggcttagtgctgctggaaacacagcaagcattatcaaggccgcagtcaccccagcatttgcggcccaatttccaggtgttaatgggcttgggatttctgcggcccgtttagatttggccgcaggtggcgtgatcccatttcacactcaccctggtgcttctgaaattttacttgtggtgcaaggatcaattactgctggatttgtttcatcagcaaattctgtttatttaaaaacacttaaaaaaggtgatttaatggtttttccacaaggattattgcattttcaagtgagtgatgctggatatacttctgtgggttatgtattttttagcagctctaatcctggacttcagattactgattttgcattatttgctaatgatttgccaactaagttggttggggcaacaacattccttgatgaagcaacaattaagaaacttaagggtgtgcttggaggcactaattaagcaacaattgcattgtgttagctgttaatctttctttttttcattctgtttttgggtattttccttgtcttcttcttgttgacaaattgtatttttttctctaaggttgttttgtttctttaaagttctgtttgtttggaaatgaacaacattatttttcctgagt

SEQ ID NO: 5805 - DNA, 812 bp, Nicotiana benthamiana
tttcatacacaaactaactattcctagctaggaaataaaaatgtttaaacttctgtttctcctggctatcttcatcttgggcagcaatgctgctgtccaagatttctgcgtggcagacctaaaaggcccagaatcacctgctggctattcttgcaaaagtgtagccaatgtaacagtcgacgatttcgtgttttctgggcttagtgcagctggaaacacagcgagcattatcaaagctgcagttacaccagcatttgcagcccaatttccaggtcttaatgggcttgggctttctgcagcccgtttagacttagccccaggtggtgtaattccatttcacactcaccctggtgcttctgaagttttacttgtagttcaaggttcaattacagctggttttgtttcttcagcaaacgctgtttacttaaaaacacttaaaaaaggtgatcttatgatatttccacaaggtttattgcattttcaagtgagtgatgctggttacacttctgttggttttgtgttttttagtagttcaaatcctggacttcagattacagattttgcattatttgctaatgatttgcccactaagttggtagaggctactactttccttgatgaagctacaatcaagaagctcaagggtgttcttggaggaactaactaagaatctaccaatgaagtagaagctgtttatccttttctttttcagtaatttccttaattgtttgtacttcttgttgacaattggatattgtaatttgtgtttgttgatgattctttctgtaagtgccatgtttttctgaagttaa

SEQ ID NO: 5806 - DNA, 846 bp, Nicotiana benthamiana
cttgcaaatttcatatacacataaaattattcctagctatcaaggaaattaaaaatgtttaaacttctttttctcttggctatcttcatcttgggcagcaatgctgctgtccaagatttctgcgtcgcagacttaaaaggcccagaatcacctgctggctattcttgcaaaagtgtagccaatgtaacagtcgatgatttcgtgttttctgggcttagtgcagctggaaacacagcaagcataatcaaagctgcagttacaccagcatttgcagcccaatttccaggccttaatgggcttgggctttctgcagcccgtttggacttagccccaggtggtgtgattccatttcacactcaccctggtgcttctgaagttttacttgtagttcaaggttcaattacagctggttttgtttcttcagcaaatgctgtttacttaaagacacttaaaaaaggtgatcttatgatatttccacaaggtttattgcattttcaagtgagtgatgctggttacacttctgtcggttttgtattctttagcagctctagtcctggacttcagattacagattttgcattatttgctaatgatttgcctactaagttggtagaggctactactttccttgatgaagctacaattaagaagctcaagggtgttcttggaggaactaactaagaatctaccaatgaagtagaacctgttgagtttatccttttcttttcttctgttttttcagtaatttccttgtctgtatttcttgttcacaattggattttgtaatttgtgctttgttgatgattctctctgtaagtgccatgtttttctcaagttagttccttt

SEQ ID NO: 5807 - DNA, 854 bp, Nicotiana tabacum
ggccattacggccgggggcaaatttcatatacaaataaaattattcctagctagcaaggaaattaaaaatgtttaaacttctttttctcttggctatcttcatcttgggcagcaatgctgctgtccaagatttctgcgtcgcagacttaaaaggcccagaatcacctgctggctattcttgcaaaagtgtagccaatgtaacagtcgatgatttcgtgttttctgggcttagtgcagctggaaacacagcaagcataatcaaagctgcagttacaccagcatttgcagcccaatttccaggccttaatgggcttgggctttctgcagcccgtttggacttagccccaggtggtgtgattccatttcacactcaccctggtgcttctgaagttttacttgtagttcaaggttcaattacagctggttttgtttcttcagcaaatgctgtttacttaaagacacttaagaaaggtgatcttatgatatttccacaaggtttattgcattttcaagtgagtgatgctggttatacttctgttggttttgtattctttagcagctctagtcctggacttcagattacagattttgcattatttgctaatgatttgccaactaagttggtagaagctaccactttccttgacgaggctacaattaagaagctcaagggtgttcttggaggaactaactaagaatctacctatgaagtacaagctgtttatccttttcttttcttctgtttttcagtaatttccttgtctgtacttcttgttggcaattggattttgtaatttgtgttgttgatgattctttctgtaagtgccatgtttttctcaagttagttcctttta

SEQ ID NO: 5808 - DNA, 914 bp, Solanum melongena
cttgtctttctgttggctgtggtaatcttgaacagcgatgccgctgttcaagatttctgtgtaggggacttaaaagctccagaatctccttctggctattcatgcaaaagtgttgcaaatgtaacagttgacgatttcgtgttttctgggcttggtgctgctggaaacacaaacagcattatcaaggccgcagtcaccccagcatttgcggcccaatttccagctgttaatgggcttgggatttctgcgggccgtttggacttggccgcaggtggggtaatcccaatgcacacccatcctggtgcttctgaaattttgcttgttacacaaggacaaattactgctggatttgtctcatcagcaaattctgtttacttaaaaacacttaaaaaaggtgatttaatggttttcccacaaggattattgcattttcaagtgagtgctgcagggtacacttctgtggggtttgtgttttttagcagctctaatcctggacttcagataactgattttgcattatttgctaatgatttgccgactaagttagtggccgcaacaacattccttgatgaagccacaattaagaagctcaaaggtgtgcttggaggcacaaattaagcaacaattgcattgttccttctgttttttgagtattttggtcgtcttcctcttgttgacaattggattttgtaatttgggtctgttgattttttttttgtaagtgatgtgttttttctctaaagtttgttttgtttcttaaaagttctgttgtttggaaatgaacttctctttttttcaattacgactacactagacatggtacgctatgaccatacttgccttgtttggaagaagactagaccaaatgttaaaatacagttgcgaaaaaacgcatgaaaatataatttacttag

SEQ ID NO: 5809 - DNA, 612 bp, Capsicum annuum
aaaatgtctaaacttataatctttctcttggctaccctaatcttgagcagcaatgccgctgttcaagatttctgcgtcgcagacttaaaggcaccagaatcaccttgtggctattcttgcaaaagtgttactaatgtaacagtagacgatttcgttttttctgggcttagtgctgctggaaacacagcaagcattatcaaggctgcagtaaccccagcatttgcggcccaatttcctggccttaatgggcttgggctttctgcggcccgtttagatttggccccaggtggtgttatcccattccacacacatcctggtgcttctgaagttttacttgtaacacaaggctcaattactgctggatttgtttcatcagcaaattctgtacttaaaaaaacacttaaaaaaggtgatataatgattttcccacaaggattattgcattttcaaatgagtcatgctggatatacttctgtgggttttgtgttttttagtagctctaatcctggacttcagataactgattttgcattatttgctaatgatttgccaactaagttggtgggggccaccacattccttgatgaagctacgattaagaaactcaagggt

SEQ ID NO: 5810 - DNA, 913 bp, Nicotiana tabacum
agattttcacatacaactcattcctagctagtgaaaatgttcaaactcctctttctttttgctctcctgatatcaagcagcaatgctgctgtacaagatttctgtgtagcagacctaaaaggaccagaatcccctgcaggctattcttgcaaaactgctacaaaagtcacagtaaacgatttcgttttctctggcctaagtgcagcaggaaacacatcaaatataatcaaagcatcagtaacaccagcatttgcagctcaattccccggcttaaatggtctcggtctctctgcagcacgtctcgacttagcctctggtggtgtagtcccatttcacactcaccctggtgcttctgaagtcttgctcgtcgtccagggatcgattactgcggcttttgtttcctcagcaaacactgtttacttaaagacactaaagaaaggtgaacttatggtatttccacaaggtttgttgcattttcaagtgaatgcagctggttatacttctgtagcttatgtgttctttagcagctccagtcctggccttcagataaccgatttcgcgttgtttgccaacgatttgtctactaagttggttgaggctacaacatttcttgacgaagctcaaatcaagaaactcaagggtgttcttggaggcactggctaacaatgtgctagcatgtaatgtgtttgtttctttttattcaaagttgttatttttgtttctttgttttggaaattcttggcaactactttgctattgtcttttgatgattctttctgtcaatgccatgttattgcgagcttaattagttctttaactttttcagctatggaatttaactttagtaatggctgtctaattaagtcataggagtactatgtatgtccatcagtagtagaaagtgttgttcttt

SEQ ID NO: 5811 - DNA, 835 bp, Solanum tuberosum
agcaagtgaaaatgttcaaacttctatttgtctttgctgtcctcatcttgagcagcaatgcttctgtacaagacttttgtgtagcagacttgaaaggaccagagtcccctgcaggctactcttgcaagtctgttaccaaagtcacggtgaacgactttgtattctccggtctaagtgcagcaggaaacacctcaaacatcatcaaagcatcagtgtcaccagcatttgcagctcaatttcctggcctaaatggtctaggtctctctgcagcacgtctcgacttagcacctggtggtgtggtaccatttcacactcatcctggtgcttctgaagtcctgcttgtcgtgcaagggtcgatcacagctgcttttgtttcttcagcaaacactgtttacttgaagacaatcaagaaaggtgaactaatggtattcccacaaggtttgttgcattttcaagtgaatgcagttggtttcaactctgtagcgtatgtcttctttagtagctccaatcctggccttcaaatcacggatttcgcgttgtttgccaacgacttgtcaactaagttggttgaggctacaacattccttgatgaagcacaaatcaagaagctcaagggtgtgcttggaggcactggctagaacttgtactgtttctcttttttcagagttgttattttttttgacaattcttggtagctacttgcaattgccttgcttttgattattctttctagcaatgccatgttattttgagcttaattcttattaataacttgcatgcaacctaaacaaagtagtgtctaattttaatgtgtggcaatgatacctactatact

SEQ ID NO: 5812 - DNA, 835 bp, Solanum phureja
agcaagtgaaaatgttcaaacttctatttgtctttgctgtcctcatcttgagcagcaatgcttctgtacaagacttttgtgtagcagacttgaaaggaccagagtcccctgcaggctactcttgcaagtctgttaccaaagtcacggtgaacgactttgtgttctccggtctaagtgcagcaggagacacctcaaacatcatcaaagcatcagtgtcaccagcatttgcagctcaattccctggcctaaatggtttaggtctctctgcagcacgtctcgacttagcacctggtggtgtggtaccatttcacactcatcctggtgcttctgaagtcctgcttgtcgtgcaagggtcgatcacagctgcttttgtttcttcagcaaacactgtttacttgaagacaatcaagaaaggtgaactaatggtattcccacaaggtttgttgcattttcaagtgaatgcagttggtttcaactctgtagcttatgtcttctttagtagctccaatcctggccttcaaatcacggatttcgcgttgtttgccaacgacttgtcaactaagttggttgaggctacaacattccttgatgaagcacaaatcaagaagctcaagggtgtgcttggaggcactggctagaacttgtactgtttctcttttttcagagttgttattttttttgacaattattggtagctacttgcaattgttttgcttttgatgattctttctagcaatgccatgttattttgagcttaattcttattaataacttgcatgcaacctaaacaaagtagtgtctaattttaatgtgtggcaatgatacctactatact

SEQ ID NO: 5813 - DNA, 1057 bp, Solanum tuberosum
tttcttctcttccatcaaaatgaggtgtttcactattctcttctttttttcagctatagtagttgtggcattggcctctaatgtcgaagaggtcattagccaagtagtagaaattcaccgtctaaggccacaaactggttccgctggttataccgtcccacaattggactgtcttagctggcgccttgccgtggagacgaacaactccaaaactggaaattggtgcctaaagaatgtacaaactatgtaggtcactacatgttaggcaaacaatatcgacgtgactgtgagtatgttgccaaacaggctattgaatatgccaaagccctcaaacttggcggagatggaaaggacgtttgggtatttgatattgatgagaccactctctcaaattctccttactacgctcgatccgacgttgcttttggggctatagcgtacaacaacacaaagtttagtgcgtggctagcggagggaaaagcaccagccattccttcgatactgggtgtatacaagactgtgttgtctttggggatcaagcccgttttcattacagggacgagagaaaatttcaaacaagtgaggattgtcaatctcaagaaagttggttataccaactgggcagcgcttatactaaagggagaaaatgattcgggatcagcagtgcaatttaaatcaagcaagagaacagaattggttaaagctggatatagaattgttggtaatattggagatcaatggactgatttaatcggagaaaacgttggagctcgtacattcaaagtccctgaccctatgtattacattagttgattctcagcaaattttaatcaaattaacaaaggggggtagcttttttatttcatgttttatgtctttcgacttttcctattcaccctcactttgctataataacgacttgcttcaacattttaattgttttcttcttggcaattttgttcctttatattaaaagacgcacatctctattaattaatttctcagttacagcctcaacaaaaaaattcaacactgtagggggccccgtacccactgc

SEQ ID NO: 5814 - DNA, 1081 bp, Solanum phureja
atgttgtgaaaaacgtgatgacctagctgtttgattgatttttaggaagttgagattgaggctcttatttaagacaccctatcctaggtatatggtcacaacatcttctttcttctcttccatcaaaatgaggtcatgtttcactattctctagttattttcagcgatagtagctgtggcattggcctctaatgttgaagaggtgataagccaagtagtagaaattcaccgtctaaggccacaaactggttctgctggttataccgtcccacaattggactgtcttagctggcgactcgcggtggagacgaacaacctccaaaactggaaattggtgcctaaagaatgtacaaactatgtaggtcattacatgttaggcaaacaatatcgccacgactgtgaatatgtagccaagcaggctattgagtatgccaaaagcctcaaacttagtggagatggaatggacgtttgggtatttgatattgatgaaaccactctctcaaattctccttactacgctcgatctgacgttgcttttggagctatagcgtacaacgctacaaagtttaatgagtggaccgcggagggaaaattgccagccattccatcgatactgggtctatacaagattgtgttgtctttggggatcaagcccgttttcattacagggaccagagacaatttcaaacaagtgaggattgctaatctcaagaaagctggttataccaactgggcagcgctcatactaaagggagaaaatgattcgggatcagcagtggaatttaaatcgagaaagagaacagcattggtgaaggctggatatagaattgttggtaatattggagatcaatggagtgatcttattggaaaaaacgttggagctcgtacttttaaactccctgacccaatgtactacataggttgactctaaccaaattttaatcaacaaaggtggggtaccttttttattttgacatttgagatattataagctcactgttcctaatcctcatcactttgctataaataacgacttccttcaatattttaattatgttccttttttttattaattttaaat

SEQ ID NO: 5815 - DNA, 943 bp, Solanum tuberosum
tttcttctcttccatcaaaatgaggtcatgtttcactattctcttgttattttcagctatagtagctgtggcattggcctctaatgaggaagatcatcaggtgataagccaagtagtagaaattcaccgtctaaggccacaaactggttctgctggttataccgtcccacaattggactgtcttagctggcgactcgcggtggagacgaacaactccaaaactggaaattggtgcctaaagaatgtacaaactatgtaggtcattacatgttaggcaaacaatatcgccacgactgtgaatatgtagccaagcaggctattgagtatgccaaaagcctcaaacttagtggagatggaatggacgtttgggtatttgatattgatgaaaccactctctcaaattctccttactacgctcgatctgacgttgcttttggagctatagcgtacaacgctacaaagtttaatgagtggaccgcggagggaaaattgccagccattccatcgatactgggtctatacaagattgtgttgtctttggggatcaagcccgttttcattacagggaccagagacaatttcaaacaagtgaggattgctaatctcaagaaagctggttataccaactgggcagcgctcatactaaagggagaaaatgattcgggatcagcagtgaaatttaaatcgagcaagagaacagcattggtgaaggctggatatagaattgttggtaatattggagatcaatggagtgatcttattggaaaaaacgttggagctcgtacttttaaactccctgaccctatgtactacattggttgactctaaccaaattttaatcaacaaaggtggggtaccttttttattttgacatgtgagatattataagctcactgttcctaatccccatcactttgctataaataacgacttccttcaatat

SEQ ID NO: 5816 - DNA, 969 bp, Solanum tuberosum
gtgcgcgggacaacatcttctttaatttcttctcttccatcaaaatgaggtcatgtttcactattctcttgttattttcagctatagtagctgtggcattggcctctaatgttgaagaggtgataagccaagtagtagaaattcaccgtctaaggccacaaactggttctgctggttataccgtcccacaattggactgtcttagctggcgactcgccgtggagacaaacaactccaatactggaaattggtgcctaaagaatgtacaaactatgtaggtcattacatgttaggcaaacaatatcgccacgactgtgaatatgtagccaagcaggctattgagtatgccaaaagcctcaaacttggtggagatggaatggacgtttgggtatttgatattgatgagaccactctctcaaatcttccttactacgctcggtctgacgttgcttttggggctatagcgtacaactctacaaagtttcatgagtggatcgcggagggaaaagcgccagccattccatcggtactgggtctatacaagattgtgttgtctttggggatcaagcccgttttcattacagggacgagagaaaatttcgaacaagtgaggattgctaatctcaagaaagttggttataccaactgggcagcgctcatactaaagggagaaaattattcagggtcagcagtgaaatttaaatcgagcaagagaacagcattggtgaaggctggatatagaattgttggtaatattggagatcaatggactgatttaatcggagaaaacgttggagctcgtacttttaaactccctgaccctatgtactacgtaggttgactctaaccaaattttaatcaacaaaggtggtggggtagcttttttattttggcatgtgagatattataagctcagtactgttcctaatcccccatcactttgctataaataatgacttccttcaatat

SEQ ID NO: 5817 - DNA, 1209 bp, Solanum phureja
gggttggacaagtgtcaaggaagtagaagcttcaaaatctcatctgagcgtcacatgttcccataatcacgccaacaaattccaaccaaagaaattttcaaagaaaaccccctttccctttctctctttctgcaacacatgaactcatttttgtgctaatcaatgaagggttttaggtcctctgattgtacaagttctggtggctgaagttgcgtatcggcagtggcttccatcatctagcaatggatttttcatttttcggtaatttcccgttgttcaaaccccattctgcaaatgatatggcatcaacagttgcatctgctagcaccctaatgcaaacacctaaacaaaatgctcagttttggaaatggactgtgttttcagttcttccttgggctaaaggagctgagggtaatattcaaatgccaacaactgtcaacaagaaactgaaaaggcgtcggccgtttcgtgaaggtgtagactctctagctcggacgtcaactatacgctttagaccatatgtttctaaagttccatggcatacaggtccaagagcttttctttctcaatttttccctcgatatggtcattactgtggaccaaactggtcaagtggaaaagatggagggtcaccaatttgggacagaagacccactgattggttggatttttgctgctattgtcacgacatcggctatgattcacatgatcaggctgaacttctcaaggcagaccttgcattcctcgagtgcttggagaagccaaacatgagtacgcgaggagatcctcatgcagctctactttacaagactatgtgcacatcaggcctcaggaacatattgataccttacagacaacaactaattaccttacaatctaagcagctatcttttggatttggatggctcggcggtatcatggaacctgcaaaatgcttgaaagatcgcttcgtatggttacagaagtaggcatgtgaacaatcccgcgctttcgttattgtgatgcagaacaagacatttctggcaagtctattccataatgtcttgagataagatagctgtatagatgatattggaaatcaatgaaactgtagaactccattatgatataattagttgtgtagctattccactgcttgtatattattctcaattaactttgcatcaagtgtaaattatttgctattttatagtaaagaatgtttggatc

SEQ ID NO: 5818 - DNA, 1148 bp, Nicotiana benthamiana
ggatataggtacaccaatcatacaagttctagtggctgaagttgtgtattggtagcgtcttccactatctggcaatggatttttcatttctcagtaatttcctgtcgttcaaaccccactctgcgaaggatatggcgtcaactgttgtatctactagtaccctaatagaagcacctaaccaaaaggctcagtttgatgctaagttttggaaatggaccctgtttttatttgttccttgggccaaaggatccgagggtaatattcagatgccaacaactgtcaacaagaagctgaaaaggcgcaggcaatctcgtgaaagtgtagacactctagctcggacgtcaaccatacgctttagaccatatgtttcgaaagttccttggcatacaggtccaagagcttttctttcacagtttttccctcggtatggtcattattgtggaccaaactggtcaagtgggaaagacggagggtctttagtttgggacagaagaccgattgattggttggatttttgctgttattgtcatgacatgggttatgatactcacgatcaagctgagcttctcaaggcagaccttgcattcctcgagtgtttggagaaacctcacatgagtacgcgaggggatcctcatacagctctgctttacaagactatgtgcatttcaggcctcaggaacatattgataccttacagacaacgcctcattagcttgcaagcgaatcaattatctttcggatttggatggctcagcggtatcatggaacctgcaaaatgcttgaaagaccgtttcatatggttacagaagtagcaatgtgaataaatcgtgggatcctatattagtcatggaaccgaagtagctgcagtttgacagttgaaagttgaagattgcgcttggtggacaagacatttctgcaaattccatttcatcaatgcctgagataatatagctgtatatgactttggaaatgaaggaaactgttaaaaactccataatgatgtaattagttgttttgctattccagtgcttgtacattatccttaatttactgcgcatcaagtgtaagtattttctatgttattgttatggatgtttggagctagtttattgtgagaaaagatgtttggaaatagtgtagggtttgaa

SEQ ID NO: 5819 - DNA, 899 bp, Capsicum annuum
agtaatttcctgtggttcaaacccagtctggaaatgatatggcatccacagttgtatctactagtaccataatgaaaacgcctaaagaaaaggctcagtttgatgctaagttttggaagtggaccgtgttttcatttgttccttgggctaaaggagctgagggtaatattcagatgccaacaactgtcaacaagaagctgaaaagtcgcaggccatctcgtgaaagtgtagattctctagctcggacatcaaccatacgctttaggccatatgtttctaaagttccatggcatacaggtccaagagcttttctttctcattttttcccccgatatggtcattactgtggaccaaactggtcaagtgggaaagatggaggctcaccaatttgggacagaagaccgattgattggttagatttttgctgctattgtcacgacatgggctatgatactcatgatcaggctgaacttctcaaggcagatcttgcattcctcgagtgcttggagaagccaaacatgagcacgcgaggagatcctcatgtagctctgctctacaaaactatgtgcatttcaggcctcaggaacatattgataccttacagacagcaacttgttagcttacaatctcagcagttatcttttggatttggatggctcagcggtatcatggaacctgctaaatgcttgaaagaccgtttcatatggttacagaagtagccatgggaacaatcacacgtgctcctaattcattatggaagcagaagcagctgcaatctgcatttttgtaaggtgaagattctgtattctattccataatgtcatggataagatagctgtatatgacattggaaatgaaagaactcgagaactctattatgatataattagttaggtagc

SEQ ID NO: 5820 - DNA, 786 bp, Solanum phureja
tttcctaaccttataacttggataaaaggaatagaggaacccaaaataactatcccaaactcaaatcatctgcagaatgagcttcacagtcaccaaaccctctattcctagtcctacattggaattgcaccctttcactaaatcacagcttaggcattgttcaacctcaccttttggaaatgcaagcaggaggcaccagattcaaagaaattgtggtattagagtgaaggcactcccagattggccattaatggcagtattagttgagcatatggaaggtcaaagagacctcataactcataaatctgtttggcatcttagtgatgaagccatgaagaatgtttacacattttacatcatgttcactgtttggggatgctgtttcttcggttctaccaaagatccttactatgattcagaacaatacagaggagatggaggtgatggtactggacactgggtctatgagaagcaagaagacattgaagaggaagcgagagcagagctgtggcgcgatgaactgatagaggagattgaacaaaaggttgggagtcttcgagagcttgaagaagctgggaagaaggaacagttggtcaaatgatcatctctatatgtgctaagaacaaactttataatgcttcccagttatgtatatacaatatgctttccataatacagatgcagagtaatacaacatggctattttgccttaattcagtgttatgatgcaagactcttctttaagatttccccttcaaaatgttttcttaatgaactgtcacgaat

SEQ ID NO: 5821 - DNA, 612 bp, Solanum tuberosum
ggaatagaggaacccaaaataactatcccaaactcaaatcatctgcagaatgagcttcacagtcaccaaaccctccattcctagtcctacattggaattgcaccctttcactaaatcacagattaggcattgttcaacctcaccttttggaaatgcaagcaggaggcaccagattcaaagaaattgtggtattagagtgaaggcactcccagattggccattaatggcagtattagttgagcatatggaaggtcaaagagacctcataactcataaatctgtttggcatcttagtgatgaagccatgaagaatgtttacacattccacatcatgttcactgtttggggatgctgtttcctcggttctaccaaagatccttactatgattcagaacaatacagaggagatggaggtgatggtactggacattgggtttatgagaagcaagaagacattgaagaagaagcaagagcagcactgtggcgcgatgaactgatagaggagatttgaacaaaaggttggggaatcctcgagaagcttgcagaagcctggggaaagaagggaacaagttaggtcaaatgatcatctctatatgtggctaaggaacaaac

SEQ ID NO: 5822 - DNA, 670 bp, Solanum melongena
aggataaaaaggaaggcaaaataattatcccatatcagatcatttgcaatgagcttcacagttgttaaaccctttattcctagtcctagattggagttgcatcctttcactaaatcacagcttaggcattctttaactcaccagattcaagttcaaagaaattcttgttttagagtgaaagcactccctgattggccattaatggctgtattagttgagcatatggaaggtcaaagagacctcataactcacaaatctatttggcaccttagtgatgaagccatgaagaatgtttatacattttacatcatgttcactgtttgggggtgctgtttctttggttctaccaaggatccctactatgattcagaacaatacagaggagatggaggtgatgtactggacattgggtctatgagaagcaagaagacattgaagaaagagcgagagcagagctatggcgtgaggaactgatagaggagattgaacagaaggttgggggtcttcgagagctcgaagaagctgggaagaaggaacagctggtcaaatgatcatatcaatatagtatatagcttcatgtgctaagaacaaactttacgatatgtatatacaatatgatttccagttccataatacagatgctgagatgcagataaaatatccaagaagg

SEQ ID NO: 5823 - DNA, 855 bp, Solanum tuberosum
acgtttactcagctccagccagcgttgacaactctgattttcctttaaatacacacaaaaaaagatcaacagatctgcagaattatcatttttcttctctattgaactaatcttccaaaagggtagtcgttgaaagcttggaggtccaatggcgattggtatgaaacagatgtctatgataatagccacccttggtgttttatcctttatatttggagttatcgctgaaaacaagaagcctgcagctgggactgcaatatcaggaaaaggcgttgttatttgtaaatacaagtctgatcctactgttgccttgggctatttgtcttttgtttttcttgctgcatcttctgtggccggttttctgtctttgttttatccgtatcaaggaaagtcagttccacaagctgctttgctgagaaacactagtttcgtcgtgttcttaaatattgcattgggcacaactggtttagcagcaacattgttgttgtggcctacaatcaccgagcaacttcatatcacacgcaacattcatcacaacttgcagaccgattgcccaactgccaagaccggtcttctaggtggaggtgccttcttgtctcttgattccgcgctcttctggttggtggctttgatgttagctgataacgctcgtgaggattatttccaagaaacgaatgtcaagggcgagccgaaagcaagttatgcagatgatgaaattatcaagagcagtgcttaaagttaaatacactactactattattctactttctctgtgtatttctgttgttgcaaaatgaactttcagcacaaactgtaaaaaaacaacatgatttcctgcctttctaagtataataa

SEQ ID NO: 5824 - DNA, 876 bp, Solanum phureja
ctcatttttacgtttactcagctccagccagcgttgacaactctgattttcctttaaatacacacaaaaaaagatcaacagatctgcagaattatcatttttcttctctattgaactaatcttccaaaagggtagtcgctgaaagcttggaggtccaatggcgattggtatgaaacagatgtctatgataatagccacccttggtgttttatcctttatatttggagttatcgctgaaaacaagaagcctgcagctgggactgcaatatcaggaaaaggcgttgttatttgtaaatacaagtctgatcctactgttgccttgggctatttgtcttttgtttttcttgctgcatcttctgtggccggttttctgtctttgttttatccgtatcaaggaaagtcagttccacaagctgctttgctgagaaacactagtttcgtcgtgttcttaaatattgcattgggcacaactggtttagcagcaacattgttgttgtggcctacaatcaccgagcaacttcatatcacacgcaacattcatcacaacttgcagaccgattgcccaactgccaaaaccggtcttctaggtggaggtgccttcttgtctcttgattccgcgctcttctggttggtggctttgatgttagctgataacgctcgtgaggattatttccaagaaacgaatgtcaagggcgagccgaaagcaagttatgcagatgatgaaattatcaagagcagtgcttaaatattctactttctctgtgttatttctgttgttgcaaaatgaactttcagcacaaactgtaaaaaaaaaaacaacatgatttcctgcctttctaagtataataataaaatatcattgtagattcttcatta

SEQ ID NO: 5825 - DNA, 929 bp, Solanum melongena
actagtcacttttctggagaaagttcatccatgttagaatggataaaatcttaaaatgaatctgataaaaaaggaagaagaaatactacttaaagaatctgttatcatcctcatacgttttgtcagctccagcattgacaactctggtcttcccatatatatacacacacaaaaaaacaaaagaaaaatcaacagatctgcagaattatcctttttgtattctctattcaagcaatctttcaaaagggtagtcaccgaatctttggaggtccaatggcgattggtatgaaacagatgtctatgataatagcaactcttggtgttttatcctttatatttggagttatcgctgaaaacaagaagcctgcagctgggactgctatatcaggaaaaggcgttgttatctgtaaatacaagtctgatcctactgttgccttgggctatttgtcttttgtttttcttgctgcatctgctgcggccggtttcctatctttgttttatccttatcaaggaaagaaaattccacaagcagctttgctaagaaacactagtttcgtagtgttcctaaatattgcattgggcacaactggtttagcagcagcgttgttgttgtggcctacaatctctgagcaacttcacatcacgcacaacattcaccacaacctgcagaccgattgcccaactgccaagaccggtcttctaggtggaggtgccttcttatctcttgattctgccttcttctggttggttgctctgatgttagctgataacgctcgcgaggattatttccaagaaacggatgtcaaggacgagctgaaagcatgttatgcagatgatgaaactatcaagactagtgcttaaagttaaatatacactattatcctactctctttgttatttctgctgttgcgaaatgaacttccatctgt

SEQ ID NO: 5826 - DNA, 916 bp, Nicotiana tabacum
cattacggccggggggtaaaagaaaaagaatcctaaacaaatagatactaccttcacactatcaaaatagtgcgttgacaatctgctctatccatatatacacacaaaaatcaaacagatctcagcagaattatccttccttttctcttttcaattatttttcgtaagggtagttgctgatagtttggaggtccaatggcgattggcatgaagcagatgtccataataatagcaacccttggtgttttatcctttgtatttggagttattgctgaaaacaagaagcctgcagctgggactgcaataccaggaaaaggcgttgttatttgtaaatacaagtctgaccctactgttgccttgggctatttgtcttttgctcttcttgttgcatcttctgtggccggtttcctgtcgttattttatccgtatcaagggaagtcaatcccacaagctgctttgctcaaaaacactagttttgttgtgttcctcaacatcgcattgggcacaactggtttagcagcagcattaatattgtggcctacaatctccgagcaacttcatatcacgcgcaacatccatcacaacttgcaaactgattgcccaacagccaagaccggtcttcttggtggaggcgcctttttgtctcttgattctgcactcttttggttggtggctttgatgttagctgataacgctcgcgaggattatttccaagacgcagatgttaagggcgagctgaaagcaagttatgcagatgatgaagttatcaagagcagtgcttaataagattgttctactttctatttgtcattctgatgttgccaatatggaattgttagtacaaacttatgtaaaaaacatgatttcctgtctttctaattataaatatcattatggattcctttatgaaaaaaaa

SEQ ID NO: 5827 - DNA, 853 bp, Nicotiana benthamiana
tacgttttgccaactcgcgttgacaatctactctatccatatatacacacaaaaatcaaacagatctcagcacaattatccttccttttctcttttcaattatttttcgcaagggtagttgctgatagtttggaggtataatggcgattggtatgaagcagatgcccataataatagcaacccttggtgttttatcctttgtatttggagttattgctgaaaacaagaagcctgcagctgggactccaataccaggaaaaggcgttgttatttgtaaatacaagtctgatcctactgttgcattgggctatttgtcatttgcgtttcttgctgtatcttctatggctggttttctgtcattattttatccgtatcaagggaagtcaattccacaagctgctttgctcaaaaacactagctttgttgtgtttctcaacatcgcattgggtacaactggtttagcagcagcattaatattgtggcctacaatctccgagcaacttcatatcacgcgcaacatccatcacaacttgcaaaccgattgcccaacagctaagaccggtcttcttggtggaggtgcctttttgtctcttgattctgcactcttttggttggtggctttgatgttagctgataatgctcgcgaggattatttccaagacgcagatgttaagggcgaactgaaagcaagttatgcagatgatgaaattatcaagagcagtgcttaagaagattgttctactttctattgtcattctgatgttgccattatggaactgttagtacaaccctatgtaaaaaacatgatttcctgtctttctaaatataaatatcattctggattcctttatta

SEQ ID NO: 5828 - DNA, 707 bp, Petunia hybrida
ctatatacttattataccacaattcaacagatctcagcaaacttatccttccaattatatcttccataaaggtagttggtgaaagtttgtaaggtacaatggctattggtatgaaacatatgtctatgattatagcaacccttggcgttatatcctttataattggagttattgctgaaaacaagaagcctgcagctgggactgcgataccaggaaaaggtgttgttatttgtaaatacgggtccgatcccactgttgccttgggttatttgtcttttgcttttcttgttgcatcttccgtggccggatttctgtctttaatttatccgtatcaagggaagtcaatcccacaagctgctttgctgagaaactctagttttctcgtgttcttcaatgttgctttgggcacaactggtttaacagctgcattcttgttgtggcctacaataaccgagcaacttcatattacacgcaacattcatcacgacttgcaaaccgactgcccaacagccaagactggtcttcttggtggaggtgcctttttgtctcttgattctgcccttttctggttggtggctttgatgttagctgactatgctcgccaagaatatttccaagaagtggatgacaagcgcgagctgacagtgagttatgcagctgatgaagttatccagaccagtgcttaaagtaatactagaacgactttt

SEQ ID NO: 5829 - DNA, 696 bp, Solanum tuberosum
cgggtggcggcgtctaactagtgatccccgggctggaggatcggatcaacgtttcaatcttcatttttcttgttaatcaagagatcttaattatggatggtgaaattaagaacatcaagaagtggaacatactgtatccagtttatataaattcaaaaaagacgatagcggaaggaagaagaatttgtgtgacgaaagcttgtgaaaaccctacttgtactgagattagtgattgctgcaacttcctcaaaattccttgtgcaattgagcttgataaggcatatccacgggatttcatgcaaagaggaagagtgagagttttgctaaagcgggaagatggaaccccttacaatcctgtcattccttcacggaaacagctgatgatcaatgtcgcagagttggttcgaagacatcctaataggactaagaagcaggagcctgcagcctcttctgcagctggttcttcaaagtctggcaagggaggtagaaagaagagatagtttcacgaggcaacatttcaatttcttcaaactgtttagagatcttagatctatttatctcggaatattttagtcctttcttttttacttgatttgagagatgttgcaaagaagagaaaggatgtatgagctatcgaagaatgtcccatatttgtatcatcgatctagacattactgtattgtttcggcctaaaaa

SEQ ID NO: 5830 - DNA, 658 bp, Solanum phureja
gatcggatcaaccgtttcaatcttcatttttctcgttaatcaagagatcttaattatggatggtgaaattaagaacatcaagaagtggaacatactgtatccagtttatataaattcaaaaaagacgatagcggaaggaagaagaatttgtgtgacgaaagcttgtgaaaaccctacttgtactgagattagtgattgctgcaatttcctcaaaattccttgtgcaattgagcttgataaggcatatccacgggatttcatgcaaagaggaagagtgagagttttgctgaagcgggaagatggaaccccttacaatcctgtcattccttcacggaaacagctgatgatcaatgtcgcagagttggttcgaagacatcctaataggactaagaagcaggagcctgcagcctcttctgcagctggttcttcaaagtctggcaagggaggtagaaagaagagatagtttcaggaggcaacatttcaatttcttcaaactgtttagagatcttagatctatttatctcggaatattttagtcctttcttttttacttgatttgagagatgctgcaaagaagagagaggttgtatgaggtatcgaagaatgtcccatatttgtatcatcgatctagacatttttgttattttttcggcctaaa

SEQ ID NO: 5831 - DNA, 662 bp, Solanum melongena
aattatggatggtgaaattaagaacatcaagaagtggaacatactgtatccagtttatataaattcaaaaaagacgatagcggaaggaagaagaatttgtgtgacaaaagcttgtgaaaaccctacttgtactgagattagtgattgctgcaacttcctcaaaattccttgtgcaattgagcttgataaggcatatccgcgggatttcatgcaaagaggaagagtgagatttttgctgaagcgggaagatggaaccccttacaatcctgtgatttcctcacggaaacagctgatgatcaatgttgcagagttggttcgaagacatcctaataggactaagaagcaggagtccgcagcctcctctgcagctggttcttcaaagtccggcaagggtggtaaaaagaagagatagtgtcaggaggcaacatttcaatttcttcaaactgttttagagatcttagatccatttatctcgtaatattgtagtcctttcttttctcactttattttgggagatgttgcgaaggacttgcaaagaagagaaaggatgtatgagctatcgaagaatctgccatatttgtatcatcgatccagacatttttgttctttttttggccttaacttagatggtgatagttaatattttttttggttatggtgat

SEQ ID NO: 5832 - DNA, 742 bp, Capsicum annuum
gcacgaggcaaatcaattttactgcagtaattaattccaatttacttgtttttgtgagaatttttaattttctgttcgtaattttgatatgtttggatcgattggccccccccccccccccccccccccccccggttttgaagggtttataaatatggatagtgaaattaagaatatcaagaagtggaatatattgtatccagtttatataaattcgaagaagacgatagctgaaggaagaagaatttgtgtgacgaaagcttgtgaaaaccctaccgttactgagattagtgattgctgcaacttcctcaaaattccttgtgctatcgagcttgataaggcatatccacgggatttcatgcaaagaggaagagtgagagttttgctgaagcgggaagacggaaccccgtacaatcctgtcatttcttcacggaaacagctgatggtcagtgttgcagagttggttcgaagacatcctaataggactaagaagcaggagcctgcagcctcttccgcagctggttcgtcaaagtctggcaagggaggtaaaaagaagagatagtttcaggcgccgacatctcaatttcttcagactgttcggagatcttagatctatttctctcggaatatttcagtccttccctttttacttgattttgggagttgacgttgcaagggacttgcaaagaagagaaaggatgtatgagctatacaagaatgtgccatatttgtatcattgatc

SEQ ID NO: 5833 - DNA, 566 bp, Capsicum annuum
caatttcaatcttcatttctctgggtttataatatggatagtgaaattaagaatatcaagaagtggaatatattgtatccagtttatataaattcgaagaagacgatagctgaaggaagaagaatttgtgtgacgaaagcttgtgaaaaccctaccgttactgagattagtgattgctgcaacttcctcaaaattccttgtgctatcgagcttgataaggcatatccacgggatttcatgcaaagaggaagagtgagagttttgctgaagcgggaagacggaaccccgtacaatcctgtcatttcttcacggaaacagctgatggtcagtgttgcagagttggttcgaagacatcctaataggactaagaagcaggagcctgcagcctcttccgcagctggttcgtcaaagtctggcaagggaggtaaaaagaagagatagtttcaggcgccgacatctcaatttcttcagactgttcggagatcttagatctatttctctcggaatattttagtccttccctttttacttgattttgggagttgacgttgcaagggacttgcaaa

SEQ ID NO: 5834 - DNA, 736 bp, Nicotiana benthamiana
aaaccaaaaccgaattctgtaaatccccattctcattcgatccgatcaacagtttcaatcttcaattctctcctttatcaaagagatcagaaaaatggatagtgaaattaagaatatcaagaagtggaacataatgtatccaatttatataaattcaaagaagacaatagctgaaggaaggagaatttgtgtgacaaaagcttgtgaaaaccctactgttactgagattagtgattgctgcaattacctcaaaatcccttgtgctatcgagctcgataaggcatatccgcgagatttcatgcaaagaggaagggtgagagttttgttgaagaaggaagatggaaccccttacaatcctgccatttcttcccggaaacagctgatgatccatgtcgcagagttggtccggagacatcctaataggactaagaagcaggagcctgcatcctcttctgcagctggttcttcaaaatctgggaaggggggtaaaaagaagagatagtttcaggagggcaatgtttcgatttcttcaaaccgtttggagatcttagatttgttttttctcggaataatgttgttctttcttctcgacttgattttgcgagatgttgcaaagtaagaagaagggatgaatgaactatccaagaatgtatcaaatgtacttttaccatcgattgagaatttgagacatttcgtttttttgccgaacttagccatctgatgattgctaatattt

SEQ ID NO: 5835 - DNA, 796 bp, Nicotiana tabacum
  misc_feature (287)..(287): n is a, c, g, or t
  misc_feature (303)..(303): n is a, c, g, or t
  misc_feature (334)..(334): n is a, c, g, or t
caacagtttcaatcttcaattctctccttttatcaaagagatcagaaagatggatagtgaaattaagaatatcaagaagtggaacataatgtatccaatttatataaattcaaagaagacaatagctgaaggaaggagaatttgcgtgacaaaagcttgtgaaaaccctactgttactgagattagtgattgctgcaattacctcaaaatcccttgtgctatcgagctcgataaggcatatcctcgagatttcatgcaaagaggaagagtgagagttttgttgaagnaggaagatggaacccnttacaatcctgccatttcttcccggaaacanctgatgatccatgttgcagagttggtccggagacatcctaataggactaagaagcaggagcctgcatcctcttctgcagctggttcttcaaaatctgggaaggggggtaaaaagaagagatagtttcaggaggcaatgtttcaatttcttcggaccgtttggagatcttagatttgttttttctcggaatagtgttgttctttcttctcgacttgattttgcgagatgttgcaaagtaagaagaagggacggatgagctatccaagaatgtatcaaatgtacttgtaccatcgattgagaatttgggacatttttgttgtttttttggccgaacttagccttttggtgattgttaatatttgcgctagattacaactacggtatcatcccaaattagttggggaagacgatatgcgtcaatctgatgatttgagtgttcattatccagcggccgcatgaggg

SEQ ID NO: 5836 - DNA, 856 bp, Nicotiana benthamiana
atccgatcaacagtttcaatcttcaattctctcctttatcaagaaatcagaaagatggatagtgaaattaagaatatcaagaagtggaacataatgtatccaatttatataaattcaaagaagacaatagctgaaggaaggagaatttgcgtgacaaaagcttgtgaaaaccctactgttactgagattagtgattgctgcaattacctcaaaatcccttgtgctatcgagctcgataaggcatatccgcgagatttcatgcaaagaggaagagtgagagttttgttgaagaaggaagatggaaccacttacaatcctgccatttcttcccggaaacagctgatgatccatgttgccgagttggtccggaaacatcctaataggactaagaagcaggagcctgcatcctcttctgcagctggttcttcaaaatctgggaagggaggtaaaaagaagagatagtttcaggagggtaatgtttcgatttcttcaaaccgtttggagatcttagatctgtttttcttggaatattgttgttctttcttctcgacttgattttgcgagatgttgcatagtaagaagggatgaacgaactatccaagaatgtatcaaatgtacttgtaccatcgattgagaatttgagccatttttgttgtttttttggctgaacttagccatatggtgattgttactatttacggtagattacaactatgctataatcccaaattagttggggaagacgataggcatcaatctcagactatatggaatagtactagtatgtaaagctcattatccattatctgtcttggcctcgtggtttaagcaacaatgttatctctcactttatcga

SEQ ID NO: 5837 - DNA, 597 bp, Petunia hybrida
tcgatcgggtcaacattttttcaaatttctccccttaatcaaagagatctgaaaatgatggatggtgaaatatagaatataaagaaatggaatgtaatatatccaatatatataaattcaaagaagacaatagctgaaggaaggagaatttgtgttactaaagcttgtgaaaatcctactgttaccgagattagtgattgttgcaatcacctcaaaattccttgtgctatcgagcttgacaaggcatatccacgggatttcatgcaaagaggaagagtgagagttttgctgaagcgggaagatggaaccccttacaatcctgcgatttcttcccggaaacagctgatggtccaggttgcagagttagttcgaagacatcctagtaggactaggaagcaggagcctgcatccacctcttctgcagctggttcttcaaaatctgggaaggggggtaaaaagaagagataggttcaggacaacatttcaatttttttaaactggttggagagatatccttagattgtatctgtttttctcagaatattctagtcctttcttttcgacttgattttgtgtgatgttgcaaagactgccaag

SEQ ID NO: 5838 - DNA, 721 bp, Ipomoea nil
ctagtgattcaaataggaaaaatggatgggaatatacagaacatcaaaaaatggattgtgttttacccgatatatataaattcgaagaagacgatagcagagggaaggcgaatcagtgtcagcaaagcttgtgaaaaccctacttgtgctgagattcaagattgttgcaatcaccttaaaatacccagcgctattgagattgataaggcatatccacgtgactttatgcaaagagggagagtgagagttttgctgaaaaaggaagatggaactttgtataatccagccatttcttccaggaaacagctaatgatccatgttgcagagttggtacctagacatcctaataggaccaagaagcaggagccagcatcctcctcggcagctggtccttccaaatctggaaagggtgggaaaaagaggagatagttcttccaatggtgaatatacaactgaagcaaaagggtgtgaaaaagaaggggttgttccagtagttaaatatgcaacggaagagagtttctattaattacttttagacttggatatatagacctgacaagacctgtaccattttcaagctcaagcagaatatttctttgttaacatggtttgactgtgactttgccttttctatttgctctagcgagggctgcgaggtatacatttttggaccaatataactgagttttccgaacttctttgcttggttggttttaacatt

SEQ ID NO: 5839 - DNA, 620 bp, Amsonia hubrichtii
gaaccaaaatcgctggcttgctccagctccgctgcgaagcacttcacgccgtcgaccacattttagcggtgttttgtagtaacatggatggtgatataaagaatataaagaagtggattgtgatataccctgtgtatattaattcaaagaagactatagctgagggtaggcggattaacgtaaacaaagcgtgtgagaatcctacatgtgctgagattcatgattgctgtaattacctcaaacttccatgtgctattgagatcgataaggcatatccacgtgattttatgcaaagaggaagagtgagggttcagttgaagaaggaagatggaagcttttgcaatccagccatttcttctaggaaacaactgatgatgcaggtcgcagagttagttccccgacatccgggtaggactaagaagcaggaaccagcttcttcctctgctgccggtccttcaaaatctggaaaaggcgggaaaaagaaaagatagtttggttctttcacagtagtcgtgtcagcagtttgagtcaatttaaggattattgatgatattgattgtcctttttgttaagaaacattagaagatcatatagtattgataaaagatcccaacttcttt

SEQ ID NO: 5840 - DNA, 670 bp, Ipomoea batatas
gccgggggcgttttagaattccagcttcagatcagcatttttgttgtcgtcaaactcatctaggaaaaatggatgggagtgcacagaacatcaaaaaatggattgtgttttacccgatatatataaattcgaagaagacgatagcagagggaaggcgaatctgtgtcagcaaagcttgtgaaaaccctacttgtgctgagattcaagattgttgcaatcaccttaaagtacccagcgctattgagattgataaggcatatccacgtgactttatgcaaagagggagagtgagagttttgctgaaaaaggaagatggaactttgtataatccagccatttcttccaggaaacagctaatgatccatgttgccgagttggtacctagacatcctaataggaccaagaagcaagagccagcatcctcctcgacagctggtccttccaaatctggaaagggtgggaaaaagaggagatagttccaatggtgaatatacaactgaaggaagcaaaagggtgtgaaaaagaaggggtgggttgttccagtagttaaatatgcaacggaagagagtttctattcattactttagacttggatatatagacctgacaagacctgtaccattttcaagctcaagctgaatatttctatcttaacatggttttggctgtg

SEQ ID NO: 5841 - DNA, 572 bp, Catharanthus roseus
ccccagggccacctttatcttccgtttcaattgttctttgattggaattcgggcacccactttgatccaaggtgaagcagtaacaatggatggtgatataaagaatattaagaaatggattgtgatataccctgtgtacattaattcaaagaagacgatagctgagggtaggaggattaacgtaagcaaagcatgtgaaaatccgacatgtgctgagattcatgactgttgtcttcacctcaaacttccatctgcaattgagctcgataaggcatatccacgtgattttatgcaaagaggaagagtgagggtgcagttagaaaaatgaagatggaacctttttcaacccaaccatctcttctaggaaacaactgatgatgcaggttgcggaattggtccccaggcatccgggcagaactaggaagcaagagccggcagcatcttcctctgcagctggtccatcaaaatctggaaagggtggaaaaagaaaagataatttggttttgcatcagacaaagggcttgttaatgacattgacacattgatttgtcattgttacaaaagatcactta

SEQ ID NO: 5842 - DNA, 5227 bp, Ricinus communis
tgactgactgtgataggtacaccgagttcttcacttgtaccaatcagcagaacagaagcaacagcagctgaactcttatgaggagcaatatacagatttgatataactaaaggatgtattgtttccaaatatgcttgtttacccatgagattccaaatctcttgcacaaacgaaccttggagaagcaatacctttaaatgtgaataacctgtggcctgaattaaatgtctcaattagttagaagtaaaagaaatgataattatatacagtaatgatggaattcgcaactagcctgtagaatcttctggatggctggcaagaccaatttcttcactgcctttggtgtcaaacattttataaattctttcagcagaacataagcccattcagcttcagtatcaaactgagtgtttactacaagaggtaaacaaaagggggcacacatttcagctgcaaatgcacccattgctttcagggctccttgttttgcaaaatttgcagcatattgaagacgagatccatcatttgctagaagctgcagcggtgcaataaacaaataggacgatctgactgttgcgggaaaataaggtgattccagaacacatttggccgacggtctcctaattatttagaaggatgaagaaaacattcaggcacactcagacacaaaagctgataaaacaagacaaatgaaatgaaatccattaacaatttaagaataaatatcttcaactgtatagattagaatattatgataaaaaacgaaaaaaataaaaacaaagacctatcccattccttctggatgcaggcttcaactagaactttagcatggggaggaagttccagcatggattcaggtaaaacaccactttcagtatatgtagctaatgaggttgaattgaagagtggcttcttcaaataaagttccgccaagacacaaccaacagaaaacatgtccttcgcaaaatcttcagaaaatttacttgaatatgatggtttttgtctccaaagcaagaactcttggtatcctatggaaccttcaatatccacctcaatatgctcaagaagataactcaaattaacatcagatggcaatccatggcttttaatagtttcgggtggcttatagatgcttttatcactactctcaactgctgattcttcagcaaaacagataaccttcttaatgctttttggatcatagcaatactgaggactcaaatgagtagcatgttcagaaaaagcagatgcttcttctaatttttctaaataagaagcttgaaaaagaggaggtgtcttaccctctacttcatttatcaccccataatgtttcttccttgcagaacctagacgtgcaggatgtggtcgagtaaagagctgacgacgtcctactgaccttggcatcatgggttctgatgaaggcagcataacgttctttgcagccacagctgcctgtccagacattttgtagccaaaggtaatgtcaatccagtgatgaatttggcttgaaacatgctcactttctaaggcatctcgatgcagtttaatgaactcctctggactacctgcccatgatggtactgccagatcggtcatgccagaatgcagagaataaaaaatttgaggatcacaatagaactctgggatgcactcatcaggcgtccactggtacaatcttaacatattagaaggatattcattaggttcatagactgaacgaacagccagacgtagaacactcaagggtaacctcctagctttataactgcagacagctaactcagaaaggcattcatctgatacatgatgtggcatctcagaagttaaataggtgaagtccaactgttcatcaccttttgccaaccgccatttgcttttgctcaagtccctccatcctaaatcagaattgtcatctggttttgtgctaaagtctattacccatggcactaccgtatgaaatgcatgatctccccatcttctaccagccaatttgtttaagataagtagatactcaaaattactcagctctcccttccaccatagatcaaattgtgaatgccagtccagagataaagaaagctttaaatctgcatagagtccttgagaggaacagtcatccatgcagcaacatattcttgctgaggcagcacgttcatttaaacttaaagtatatcctgattttggcttattacaaatgcgtagccaaaaccagcataaatcagttagcattagattagatggatgtatcttaccatgatgaacccctaaaccatgtaagcaaacaagggcagaaagcagctgatacaccaaaaatcttatatgccactcagactttaaggcacttgggcagaaatataaaatattttccaaggtataaggagtttttggcatcacagagtaaacattcctggctgttttaaggtagccaagaataggaactatatttggatgcctgaggcagccagggatgctactgtcatcaaaagatggtatcccaagtagacgaagaaaattcacacagtctcgccctgaagcttttccttcaatcaagagattaagtgagtgcatcacatggtcttccacatcgccagacaaaaaattagaagcaatcctctcaaagacactgttggagcaagtagcaatatgagctactggggccaacgcactgattatacgggagcatgaaaagctcttggaatgcgtacaggtagaattttcagatccaactgtatctatagatgcttttctatcaccattcagcaaaaatgaagattggtctaatggagaatctgacatagtttgattattgagcttagcaggatcttggcttacttgagataaagacatatcaccaatcccatgactgtcactgtcttcattatcttgtgcgataagttcaccactgccaaagagataatgacattcagaaaagcaaacattcataaacctaaccatactcggaggttttataaaaaagaaaagaaaagaaaagaaaggttagtagaaatatgtgagataaaatcaagcttatactcgggaatgccattaagcattagcataatattaatcatgcattactaaaagaatcacttacacgtatttagctaagcaatggtatcggtgactcggtaactgctccaatatgaagtaagaagatgaagtggaggcctccccattagaatttggaatctgctccaatttcagcgcaaaattactaaaagtaaaattcatacataatcagaggtagggagggaaaggaggaatatatagaaacctggacaacagcagaggagccgagagggagaggagaatcagataggccataagagaagaggaggtggtccgagaaatcggatttgattcggtgttgaaggcaatcgaagcatgcgtgttgctccatcatcaaattcgtgttgtttgttactcacgctatatacacgataagagcaaataagcgtaataatattatccatctaattcatctccattttttaagctagcagtcttttctaatagattgatcgttaggtgaattgaaattctgcaacttcaacaagtttctctctcttttctttttttgctgttttcgtttcttcctccactgtcagtcttcaaaacacaccgtttcatgccctgactatatcttactttatttttatttttatttttatttttatttttattttgtgtactatatccttttcgatttaaatagtcactaactccttcagaaaaaaaaaaaaaaaaaaaaaaaagaagaagaaatagtcactaacagccgtagatcggagtttataatttcaaccccaagaacaaccaaaaatacgtcagtcatcgtctcctcgagcaagtctttttttttcttcttctcttctgatatccattcttttgagaattcaagagttaagaattcaatcgtagatatggcggatggaagtatccccaatataaagaaatgggtagttttgtatcctgtttacatcaactccaagaaaacgattgctcaaggcaggcgaatttgcactactaaagcttgcgaaaatcctacttgtgttgagattggtgattgctgcagccatctcaaactcccttttgccattgagattgacaaagcatatccccgtgatttcatgcaaatagggagggtgagagtgttgctgaaaagggaagatggaactttgtataatccagccattcctaccagaaaacagctaatgctccatgttgctgagttggtgcccaggcaccctgggaggactaagaagcaggagtctgcttctacgtcaaatgctggaacatccaagtctgggaagggtgggaagaagaagagatagtagctccaacattgcaaatgcggagaccattatctctctggcaacttagcatagcatcacgggctcagggaagacagaccatgacaataggcttctttgtaataggtttaaactctcaacgagttcaattctgcagataatgcaatgtctttagtttacatgcgggtgttggaactccattactccttttcacacccatttgaggaatttttattcaagttttttaacacatcagattcttcaaaagaagcaaatgtactctgcgagtttggccaacaatagacaaatttgacttccttcaggataatacagctcctaccctcctatcaataagccaaaattagtcctatcatttaatcttctgataagccaagtcttctaataagtcatgttagccctcacaatacagtgcgttccaaggctttactgcctacactagaaggcacacatatctcaagacaaatggttagcatattgtgctcaatagaaagtaattataaaaaaagataaataaataaacaaaaaggggaggaacaaacaagagagattcagagaggaaccaataagaaaaggttcccagaagagaagtaagatataatagcaaaagctgaatcttttgactcatatatgatatatcaactggtctaaacataaacctatgtgatctaacatgattctgcaatacacagactactttgatgcccaaaaatagatccatctccaggaccagcctacttctgcaataatcgaaatttatccagctgtgccaattgtttgattgccaaatacccgacaatgagaaatgtgatgcgccatcattaatctggcttcttcaagttcaagcaattatctgttgcttggctaaacagctcctggacctgcttcaattcctt

SEQ ID NO: 5843 - DNA, 1517 bp, Solanum tuberosum
gtcgtttttaactcctacctatagtggacaggttgagttgtaacagagaaagaggaagaaatgggaggaggagaagaagatcaacagaaattgaagaacacagcagcagcagcgtatgactacgagaatgatccaagatgggcagattattggtccaatatactcattcctcctcacatggcttcccgttctgatgtcgtcgaccatttcaagcgcaagttttatcaacgatacatagaccctggtctagtggttgagccaatgactaccagcagttcgtcccaatcagcaagaccatcagctgcacaaccatcatcatcatcatcgtccacaccttctaataaccagccaagacagcgtaactctggtcaagctagtagaacttcgggcacgtcaacaaacccaacttcaaatccgacatcacttcgatgggaccgaaaaactatacaattttcagtgaatgcttgggtttttgttgttgcagttctctcaatatttccgcttacacctgcaaatctgtcaaacagagcataccgactgtccttcttgggaactgcatgttcttcgctatattcattatactcagtatatgggaaaccgagggcttggaatttacaagcagtgcaagtttggttgcagtcagttattgtgacgaaggatttcatctccttcatttactgtctcacttttgtcacttcccatctttacctgaaattttctttgattcctgttatatgccgatcacttgaccatgttggtaaatttcttcgacgtaacttcagcagatcttctttgtacaggaagtacttggaagaggcttgcgtatgggtcgagtcaaacgtaactactctcaacatactgtcttcacaggctgaaattggactgggatttcttctggttgtctctctattatcgtggcagcgtaatattatacaaacattcatgtattggcagatattgaagcttatgtatcatgctcctgctactgctggttaccatcagagtgtgtgggctaagatcggagggtttgtaaatccagttgttcaacgttatgtcccgttcctgaatactcctatttcaactattcagagatggtggttcaggtagaagacttgctgaaagatatacaagagttttaggggcagaaaatacttttttgggataatactttgtcctgaagggtgactataaaactagaattgtctagttaatattcctaataattgcctgtgggagttacttccaagttttcccctttttgggatgtgatttttcctctgttttaactgctttattttgtaaaccaaaattgtccaagaactgttgttttagtatcaactaatcacacttctattcctcttgcatgtttcgatttttgatccctattcctatgttgtcccatgaatggtgatcctttgattcgtcgataaagttatgctgggattataatccatgtattgtctaaatgtatatgaactgcatatacttctttagtgtctaaaaaaaaaaaaaaaaaa

SEQ ID NO: 5844 - DNA, 1414 bp, Solanum phureja
tttagtgaaaagtcaaaaccccaaaattttccttgaaaacccttagcgtcgtcgtttttaactcctatctatagtggacaggttgagttgtaacagagaaagaggaagaaatgggaggaggagaagaagatcaacagaaattgaagaacacagcagcagcagcgtatgactacgagaatgatccaagatgggcagattattggtccaatatactcattcctcctcacatggcttcccgttctgatgtcgtcgaccatttcaagcgcaagttttatcaacgatacatagaccctggtctagtggttgagccaatgactaccagcagttcgtcccaatcagcaagaccatcagctgcacaaccatcatcatcatcatcgtccacaccttctaataaccagccaagacagcgtaactctggtcaagctagtagaacttcgggcacgtcaacaaacccaacttcaaatccgacatcacttcgatgggaccgaaaaactatacaattttcagtgaatgcttgggtttttgttgttgcagttctctcaatatttccgcttacacctgcaaatctgtcaaacagagcataccgactgtccttcttgggaactgcatgttcttcgctatattcattatactcagtatatgggaaaccgagggcttggaatttacaagcagtgcaagtttggttgcagtcagttattgtgacgaaggatttcatctccttcatttactgtctcacttttgtcacttcccatctttacctgaaattttctttgattcctgttatatgccgatcacttgaccatgttggtaaatttcttcgacgtaacttcagcagatcttctttgtacaggaagtacttggaagaggcttgcgtatgggtcgagtcaaacgtaactactctcaacatactgtcttcacaggctgaaattggactgggatttcttctggttgtctctctattatcgtggcagcgtaatattatacaaacattcatgtattggcagatattgaagcttatgtatcatgctcctgctactgctggttaccatcagagtgtgtgggctaagatcggagggtttgtaaatccagttgttcaacgttatgtcccgttcctgaatactcctatttcaactattcagagatggtggttcaggtagaagacttgctgaaagatatacaagagttttaggggcagaaaatacttttttgggataatactttgtcctgaagggtgactataaaactagaattgtctagttaatattcctaataattgcctgtgggagttacttccaagttttcccctttttgggatgtgatttttcctctgttttaactgctttattttgtaaaccaaaattgtccaagaactgttgttttagtatcaactaatcacacttctattcctcttgca

SEQ ID NO: 5845 - DNA, 1554 bp, Capsicum annuum
tactttgtttagtgtgcaaaacacggatactaaactagttggtcgcgtgcttagcatagcctatcgccactagttgtccaataatctaaatgaaatatcttgtcaacgccatattacttctcatctgaaccctcgtctcttgaaccctatccgacgggagtgagtatagttgtgacaagttaagagtgttaaaagagagagagatgggaggaggagatgaagatcaacagaaattgaagagcgtagcagcagcggcgtatgactatgagaatgatccaagatgggctgattattggtccaacatactcattcctcctcacatggcttctcgtcccgacgtcgttgaccatttcaagcgcaaattctaccaacgctacatcgaccctggcctagtggttgagccaatgactaccagcagttcatcccaatcagcaagaccatcagctgcacaaccctcatcatcatcatcatcttccacaacttctagtaaccagccaagacagcgtaactctggtcaagctagtagaacttcgggtacatcaacaaccccagcttcaaatccgacatcacttcgatgggaccgaaaaactatacaattttcagtgaatgcttgggtttttgttgtggcagttctatcaatatttccgcttacacctacaaatctgtcaaacagagcatatcgactgtccttcttgggaaccgcatgttcttcgctgtatgcattatactcagtatatgggaaaccgagggcttggaatttacaagcagtgcaagcttggttacagaccgttattgtgacgaacgatttcatttacttcatttactgtcttacttttgtcacttcccatctttacctgaaattttctttgattcctgttttatgccgagcacttgatcatgttgcgaaatttcttcgacgtaacttcagcagatcttctttgtacaggaagtacttggaagaggcttgcgtatgggtcgagtcaaatgtaactactcttaacatactatcttcacaggctgagattggagtgggcttccttctggttgtctctctattatcgtggcagcgtaatattatacaaacattcatgtattggcagatattgaagcttatgtatcatgctcctgcgaccgctagttaccatcagagtgcatggtctaagattgggatgcttgtaaatcctcttgttcaacgttatgccccgttcttgaatactcctatttctactattcagagatggtggttcaggtagaagactttctgaaagtatacaagagttatggggcaggaaaaacttctttgggacttagtcctgaagggtgaatatataaactagaattgtctagttaactattcctaataattgcctttgggagtacttccaagttttccccttttgatgtgacagagatgtgatttttccaacgttttactctcttcttttgtaaacatgaccacccaaaattgtttaaattgtgcaagtactgtagttttaatatcaactaatcacttctattcctcttgcctgttcgatttttgatatatgatatatt

SEQ ID NO: 5846 - DNA, 1555 bp, Capsicum annuum
tactttgtttagtgtgcaaaacacggatactaaactagttggtcgcgtgcttagcatagcctatcgccactagttgtccaataatctaaatgaaatatcttgtcaacgccatattacttctcatctgaaccctcgtctcttgaaccctatccgacgggagtgagtatagttgtgacaagttaagagtgttaaaagagagagagatgggaggaggagatgaagatcaacagaaattgaagagcgtagcagcagcggcgtatgactatgagaatgatccaagatgggctgattattggtccaacatactcattcctcctcacatggcttctcgtcccgacgtcgttgaccatttcaagcgcaaattctaccaacgctacatcgaccctggcctagtggttgagccaatgactaccagcagttcatcccaatcagcaagaccatcagctgcacaaccctcatcatcatcatcatcttccacaacttctagtaaccagccaagacagcgtaactctggtcaagctagtagaacttcgggtacatcaacaaccccagcttcaaatccgacatcacttcgatgggaccgaaaaactatacaattttcagtgaatgcttgggtttttgttgtggcagttctatcaatatttccgcttacacctacaaatctgtcaaacagagcatatcgactgtccttcttgggaaccgcatgttcttcgctgtatgcattatactcagtatatgggaaaccgagggcttggaatttacaagcagtgcaagcttggttacagaccgttattgtgacgaacgatttcatttacttcatttactgtcttacttttgtcacttcccatctttacctgaaattttctttgattcctgttttatgccgagcacttgatcatgttgcgaaatttcttcgacgtaacttcagcagatcttctttgtacaggaagtacttggaagaggcttgcgtatgggtcgagtcaaatgtaactactcttaacatactatcttcacaggctgagattggagtgggcttccttctggttgtctctctattatcgtggcagcgtaatattatacaaacattcatgtattggcagatattgaagcttatgtatcatgctcctgcgaccgctagttaccatcagagtgcatggtctaagattgggatgcttgtaaatcctcttgttcaacgttatgccccgttcttgaatactcctatttctactattcagagatggtggttcaggtagaagactttctgaaagtatacaagagttatggggcaggaaaaacttctttgggacttagtcctgaagggtgaatatataaactagaattgtctagttaactattcctaataattgcctttgggagtacttccaagttttccccttttgatgtgacagagatgtgatttttccaacgttttactctcttcttttgtaaacatgaccacccaaaaattgtttaaattgtgcaagtactgtagttttaatatcaactaatcacttctattcctcttgcctgttcgatttttgatatatgatatatt

SEQ ID NO: 5847 - DNA, 1310 bp, Nicotiana benthamiana
ggcgacgtcgttttgtcttcgatcgcattttcagaaataaaccctgagagatagaagacgattctactttcataaattcttcgctgctagcagagacaaacagaagtagaagaaatgggagaaggaggagaagatccacagaaactgaagaaagtagcggcggcagcatacgactacgagaacgatccgagatgggcagattattggtccaacatcctcattcctcctcacatggcttcccgttccgacgtcgtcgaccacttcaagcgcaaattctaccaaaaatacatcgatcctggtctagtggttgagccaatgactaccagcaattcatcccaaccagcaagaccatcacccgcacaaccttcatcatcgtcgtccacaacttctaataaccagccaagacaacgtaattctggaccagctagtagaacttctgggacgtcatcaaccccagcttcaaatccaacatcacttcgatgggaccgacatactatacaattttcagtgaatgcttgggtttttgtagtggcagttcttgcagtatttccgcttacacctacaattctgtcaaacagagcatatcgtttgtcctttttgggaactgcatgttcttccttatattcattatactcattatatgggaagccaagggcttggaatttgcaagcagtgcaagtttggttgcagtcagtgattgtgacaaaagatttcatctacttcatttactgccttacttttgtaacttcccatctttacctgaaatttgctttgattcctgtttcatgccgagcacttgaacatgtcgtgaaattcctgcgacgtaacttcagcacatcttctttgtacaggaagtacttggaagaggcttgcgtatgggtagagtcaaacgtaactactcttagcatactgtcttcacaggctgagattgggctgggatttcttctagttgtctcattattatcgtggcagcgtaatattattcaaacattcatgtactggcagctattgaagcttatgtatcatgctcctgccactgctggttaccatcagagtgcgtgggctaagattgggaggcttgtaaatcctcttgttcaacgatatgccccgttcatgaatactccaatttcaacaattcagagatggtggttcaggtagaagacttgatatacaagagttgtaggggcagaaaatactttgggactttactttgtcctgaaggatgaatatataaactagaattatctagtttctaataattgcttttgggggtacttccaagttttccattttaacccagagggatgtga

SEQ ID NO: 5848 - DNA, 1456 bp, Nicotiana benthamiana
tagacgacgacaacgactctacttcacaaattcttcagagagaagtagaagaaatgggagaaggaggagaagatccacagaaactgaagaaaatagcggcggcagcatacgactacgagaacgatccaagatgggcagattactggtccaacatcctcattcctcctcacatggcttcccgttccgacgtcgtcgaccacttcaagcgcaaattctaccaaaaatacatcgaccctggtctagtggttgagccaatgaccaccagcaattcatcccaacaagcaagaccatcaccttcgcaaccttcatcatcgtcgtccacaacttctaataaccagccaacacaacataactctggaccagctagtagaacttctgggacgtcatcaaccccagcttcaaatccaacatcacttcgatgggaccgacatactatacaattttcagtgaatgcttgggtttttgttgtggcagttctcgcagtatttccgcttacacctacaattctgtcaaacagagcatatcgattgtcctttttgggaaccgcatgttcttccttatattcattatactcattatatgggaagccaagggcttggaatttgcaagcagtgcaagtttggttgcagtcagtgattgtgacaaaagatttcatctacttcatttactgccttacttttgtaacttcccatctttacctgaaatttgctttgattcctgtttcatgccgagcacttgaacatgttgcgaaattcctgcgacgtaacttcagcacatcttctttgtacaggaagtatttggaagaggcttgcgtatgggtcgagtcaaacgtaactactcttagcatactgtcttcacaggctgagattgggctgggatttcttctagttgtctctctattatcgtggcaacgtaatattatccaaacattcatgtactggcagctattgaagcttatgtatcatgctcctgccactgctggttaccatcagagtgcgtgggctaagattgggaggcttgtaaatcctcttgttcaacgatatgccccgttcatgaatactccaatttcaacaattcagagatggtggttcaggtagaagacttgatatacaagagttgtagggcagaaaatacttactttgggattttactttgtcctgaaggatgaatatataaactagaattatctagttcctaataattgcttttggggttacttccaagttttccattttcacccagaaggatgtgacaataattgattttcctctgctcaactcttgtgttttcttgaacatcagtgaaaaaactggtttaattgtaaaagaactgaatgtaagtttttctagccttaatctcgtccatcgaggtatgtagtgatactatgatttacttatgatgtaggttcttttttactatctgtttctcttgcatgtttcgagtttaaacatctatt

SEQ ID NO: 5849 - DNA, 1379 bp, Solanum phureja
cgactgtgaagaattgtagaagagacgacgacaacgactccactgatttagcagagagagagagagatgggagaagaggcagaggatccacagaaattgaagaagatagcggcggcggcatatgactatgagaatgatccaagatgggcagattactggtctaacattctcattcctccacacatgggctcccgctccgatgttgtcgaccatttcaagcgcaagttctaccatcgttacattgatcctggtcttgttgttgaaccaatgactaccagcagttcatcccaatcagcaagatcatcagccccacaatcttcttcttcatcaacttctaacaaccagccaagacaacgtaactctggggcagctaatagaacttctgggacatccccaactccaactccaacttcaagtgcaacgtcactgcgatggaaccgtcaaactatacaattttcagtgaatgcttgggtccttgttgtagcagttcttgcaatctttcctcttatacctacaaatctgtcaaacagagcatatcgattggcctttgcaggcactgcatgttcttccctgtattcattatacgcattatatgggaagcctagcgcttggaatttgcaggcactgcaagtttggcttcagtcagttattatggcgaaagattttctctacttcatttactgccttacttttgtcacttcacatctctccttgaaatttgctttgattcccgtgatatgccgaggacttgaacatgttgcgaagtttcttcgacgcaacttcaacacatcttctttatacaggaaattcttggaagaggcttgtgtatgggtcgagtcaaacacaactactcttagcatattgtcttcacaggctgagattgggctgggacttcttttagttgtttccctattttcgtggcagcgtaacatactacaaacttttatgtactggcagctattgaagcttatgtatcatgctcctgctactgctggttaccatcagagcatgtgggctactattgggaggcatgtaaatcctctggttcaacgatatgctccattcatgcatactccgatctccagtattcaacgatggtggttaaggtagaactgtagacgacagcagcaagacatagaacaggattcatgacagctaggttggaagtgctttttcatatttgtactttgtcccagatgacgaatattggctagacttctacttttctttttataaacagattaattataattgtgtactgaaactaaacctagtaataaccttggggctacttccaattcttaacatttttacccaaggtgacttgtccccttggttataaattagttcaccttcccataatgtaatctactgtgttg

SEQ ID NO: 5850 - DNA, 1401 bp, Solanum phureja
ctccctttaattctagtggcttgacctccatcatttccccctccccttctttctaccactaatcccttctctccctatgtctttttcttacaggtctcaaatattgctagcggctaagtaaaactcattggaaatgaaagaggattattagctagttaatactaatggataaagaagctggaaatcatcatcatcatcaaaatcaaaatcatggaatttctaacaaagatgaattctcaccaaggattaagccgccgcaaaattaccatgttgccactggaaacagtgatagactgaagagggatgaatggagtgaaggagcagtttcgtgtcttctcgaagcttatgaagctaaatggatactccgtaacagagctaagctcaagggacaagattgggaggatgtggccaagcacgtgtcggcgcgtgtcaattcaacaaaatccccaaaaactcagacgcagtgtaagaacaaaattgaatctatgaagaagaggtaccgatcggaatccgcaaccgccgccgatgcttcttcctggccgctctatcctcgccttgaccttttgttacgtggaaataatgcgtccgcggcttcctcttcgctaattccgccgccgcttccgccagctgcgccgcctaatactaattgtgtgattgatgccgtggaaccaacgcagccgccaatagtactacctccacctccacctccgctcccgccgtcgccggctttgcctattgggaatggtgatcagaattcgcatggttctaatggtcttgacagaggaataaaggaagacatattaatggacgccaaattatcggacaatgcagcagcagcagatcacaaaaacgcaacggctacaaatagcagcagcacgccagcactgtacagcgacaacaagagcaagtcaaaattgagatcaaagaataagcgaaagagggccgtggaagggtgggagatcggagagagcatacgtttgctagctgaagtagtggtaaggtcagagcaagcacgaatggagacgatgagagacatcgagagaatgagagcagaagctgaggccaaaagaggagaaatggatcttaagagaactgagatcattgccaacactcagcttgagattgctaagctctttgctagtattaccaaaggatcagttgactcttcattgagaattggaagaagttcatcatgagctagaaaataataatactactctagctagctgtggaaatagaaataaccttgttatcatcttttaatttgatgatatccttcttgacccagccactacctggacattttatttagattactaataataattaacttctatttccattttctggctgattgtatgttgaaggactttactatatcacttctccctttatcaatca

SEQ ID NO: 5851 - DNA, 1336 bp, Solanum tuberosum
ctccctttaattctagtggcttgacctccatcatttccccctccccttctttctaccactaatcccttctctccctatgtctttttcttacaggtctcaaatattgctagcggctaagtaaaactcattggaaatgaaagaggattattagctagttaatactaatggataaagaagctggaaatcatcatcatcatcaaaatcaaaatcatggaatttctaacaaagatgaattctcaccaaggattaagccgccgcaaaattaccatgttgccactggaaacagtgatagactgaagagggatgaatggagtgaaggagcagtttcgtgtcttctcgaagcttatgaagctaaatggatactccgtaacagagctaagctcaagggacaagattgggaggatgtggccaagcacgtgtcggcgcgtgtcaattcaacaaaatccccaaaaactcagacgcagtgtaagaacaaaattgaatctatgaagaagaggtaccgatcggaatccgcaaccgccgccgatgcttcttcctggccgctctatcctcgccttgaccttttgttacgtggaaataatgcgtccgcggcttcctcttcgctaattccgccgccgcttccgccagctgcgccgcctaatactaattgtgtgattgatgccgtggaaccaacgcagccgccaatagtactacctccacctccacctccgctcccgccgtcgccggctttgcctattgggaatggtgatcagaattcgcatggttctaatggtcttgacagaggaataaaggaagacatattaatggacgccaaattatcggacaatgcagcagcagcagatcacaaaaacgcaacggctacaaatagcagcagcacgccagcactgtacagcgacaacaagagcaagtcaaaattgagatcaaagaataagcgaaagagggccatggaagggtgggagatcggagagagcatacgtttgctagctgaagtagtggtaaggtcagagcaagcacgaatggagacgatgagagacatcgagagaatgagagcagaagctgaggccaaaagaggagaaatggatcttaagagaactgagatcattgccaacactcagcttgagattgctaagctctttgctagtattaccaaaggatcagttgactcttcattgagaattggaagaagttcatcatgagctagaaaataataatactactctagctagctgtggaaatagaaataaccttgttatcatcttttaatttgatgatatccttcttgacccaaccactacctggacattttatttagattactaataataattaacttcta

SEQ ID NO: 5852 - DNA, 992 bp, Solanum phureja
ggggtttaagggaggtttttgcagcagaaaaaactcacagaagcaaaatgttggggagaagatttatctccttcttgcgtcgcactccatcatcttcgggaaaagtggtggcggaggaagggaaggcaaagacatgggggcgaaggatagtgtcagggaccttgatttgcttaactggaggcgttgctctaagtgctcttgatgatctctccatatatcatagctgtagcagcaaggccttggaaagagccagtaagaacaagccgattatagatgccattggggagcccattgttagaggtccttggtataatgcatcactagcagtagctcaccaaaggcaatctgtatcatgcacatttcctgtctctggaccccaaggcaccggaatttttcagctgaaggcagttcgtaatggagaggacaaatggtcatttttacgggcaagcgactgggagatactcattatggaagctctcgtccatgtcccggggaatgaagagaagcagcaaacttttcggattaaggtttcagatgacctacctccaccagctagtaatgcatgcacggattgcatacctcaggaaccatctggtaatgtggataagaaatgaccaagattcgttctgccatggctccgaggggattttttctttctccatacaaatcattcacatcacaagaggtttgtatttaggaccctttgaaattttccagttccaaggtaccaaatctatatatttccacagtagatcgcgtaattggtgattcttttaattgttgaagctatgttattgtcaaagttggagaggaagaagaacgccatcgtagagggatcaacgtgtaaacttgatctatatttgatttactggaataagttcatcatcaaagtgtagattttggcaagaaaaggcaaacgtttctgtgggttttacctatacaataaatggtttcaatgttgttcacttgaagatgagaaaagttcatttgca

SEQ ID NO: 5853 - DNA, 862 bp, Solanum tuberosum
atcagcttcgggaaaagtggtggcagaggaaaggaaggcaaagacatggggccgaaggatagtgtcagggaccttgatttgcttaactggaggtgttgctctaagtgctcttgatgatctctccatatatcatagctgtagcagcaaggccttggaaagagccagtaagaacaagccgattatagatgccattggggagcccattgttagaggtccttggtataatgcatcactagcagtagctcaccaaaggcaatctgtatcatgtacatttcctgtctctggaccccaaggcaccggaatttttcagctgaaggcagttcgtaatggagaggacaaatggtcatcatttttacgggcaagcgactgggagatactcattatggaagctctcgtccatgtcccggggaatgaagagaagcagcaaacttttcggattaaggtttcagatgacctacctccaccagctagtaatgcatgcacggattgcatacctcaggaaccatctggtaatgtggataagaaatgaccaagattcgttctgccatggcttcgaggggattttttttctttctccatacaaatcattcacatcataagaggtttgtatttagaaccctttgaaattttccagttccaaggaaccaaatctatatatttccacagtagatcgcgtaattggtgattcttttaattgttgaagctatgttattgtcaaagtcggagaggaagaagaacaccatcgtagagggatcaacgtgtaaacttgatctgtatttgatttactggaataaagtcatcatcaaagtgtagattttggcagaaaaggcaaacgtttctgtggggtttacctatacaataa

SEQ ID NO: 5854 - DNA, 995 bp, Nicotiana benthamiana
acatttgatttggggtttaagggaggtttcgtgctgaagaaactcgcagaagccatgttggggcgaagatttatctccttcttgcgtcgcaacccatcaccttcggagaaagttgtggcagaggaagggaaggctaagacgtggggaagaaggatagtgtcggggacactgatttgcttaacaggaggagttgctctaagtgctcttgatgatctctctatatatcatagctgtagcagcaaggccttggagaaagccagtaagaataagacgattctacatgctatcggggagcccattgttagaggtccttggtataatgcatcattagcagtagctcaccaaaggcattctgtatcatgcacattccccgtctctggaccacgaggcactggaatttttcagttaaaggcagttcgtaatggagaggacaactggtcgtcatttttacgaccgagcgactgggagatcctcattatggaagctctcgtacatgttccagggagcgaagagaaacagcaaacgtttcggatcaggatttcagatgacctacctccaccagctagtaatgcatgcacggatggcacatctcaggaatcgtgtagtgtggagaagaaataatctacatctactctgccatgccgcgtccccaaccttacatctccgggtggggcgtatgttcttttttcttcatacacgttcacatgataagtaagtttgtatttaggacactttgattctagttacatggcaccaaatttatgcctgcaggaaaaaggggttttattgaggcaattaccagatcaactagtgttggtcagttgatgtacaattctttgtgggcatgtgttattgattcttttatatttagaagcatgccaacagtgtcattgcctgtatttgatttatggtttgagaatgaataagttcctcattaaactgtagattttggcaaggaaagtacaatctttctgtgtcttttgccaatacaataa

SEQ ID NO: 5855 - DNA, 906 bp, Nicotiana tabacum
ggagaaagtggtggcggaggaagggaaagcgaagacgtgggggagaaggatagtgtcagggaccttgatttgcttaacaggaggagttgctctaagtgctcttgatgatctctctatatatcatagctgcagcagcaaggccttggagaaagccagtaagaacaagacgattatagatgctattggggagcccattgttagaggtccttggtataatgcatcattagcagtagctcaccaaaggcattctgtatcatgcacattccctgtctctggaccacaaggcactggaatttttcagttaaaggcagttcgtaatggagaggagaaatggtcatcatttttacgaccaagcgactgggagatactcattatggaagctcttgtacatgtcccggggaatgaagagaagcagcaaacgtttcggataagggtttcagatgacctgcctccaccagctagtaactcgtccacggattgcacatctcaggaatcgtgtagtgtggagaagaaatgacctacatctattctgccatgcttgctgctcccaacctcacatcctccagtggggctcttctaatttttttcatacaaatgataagaggtttgcacatttagcattgtgaaattccagttccaagcaccaaatctatgcttgcaggaaagatcggatcttgttgaggcaattacagaattaacaagtgttgctatatacttctttttttaaatcgcgtagtctgtgattcttttaaattttaaaacactgtgattagtgtgattgtgtgcatttgattactggtataagaataaataagttcatcatcaaaagtgttgattttggcaaggaaagtgaaaccttgctgtattatttccaaaaaaaaaaaaccccacaaaaaagaacaaaac

SEQ ID NO: 5856 - DNA, 1922 bp, Solanum phureja
aaaaacccacacacttaaatccaatctctctctctctctctgtgcgtgtattttagagggagatcaaagacggaataatttgaagaaacggtggaaattagaagagatggctaacaatgcggcggcttgtgcagaaagggcaactagtgatatgctgattgggccagactgggctataaacattgagctttgtgatatcatcaacatgaatcctggacaagcaaaggacgctcttaagattatcaagaaacgcttggggagtaaaaatccgaaaatacagctccttacactatttgttcttgagactctgagcaaaaattgtggagagaatgtatttcagcaaattgtggagcgtgagattttacgagacatggtcaaaattgtgaagaagaagcctgatttaaatgtgagggagaagattttgattttgatagattcatggcaagaagctttgggagggccaggggggagatttccccagtattacgctgcatataatgagctgaaggccgcaggtgtagagtttccacctcgagaggaaaacagtgtacctttatttacaccaccacaaactcatccaatagtccacatgccttcagcttatgaagaggctgcagttgaggcctctcttgagtctgatccctctggactcagtgttgcagagattcaaagtgctgaggggttatcagatgtcttgacagagatgcttggtgccttggatccaaagaatcctcagtccgtgaaggaggaggtgatagttgatcttgttgaacagtgtcgttcttaccaaaagcgtgtgatgattcttgtgaacaacactgtagacgaggatctgctttgtaaaggattggcactcaatgacactctgcagcgagttcttcgtagacatgacgatattgccaaaggaacctcaacaattactgtaccgcccagagaaactcctgttgcaccccttatgaatgtgaatcatgaggatgatgagtcagaagatgatttctctcacttatcacggagaacttcaagagatccatcacagggacaggggcggaagactattgatgtgaagagtgagcctatgcgaattactccaactcttcctcccccaccttcatcaaggagaccagtttttacagatggtaaaatggttgattatctcagtggtgacaggtttgaatcagaaagatcactgggaacagaaggatcttcacctattgctgcttcaactaattcaaacaatgcgagttccatcccatggtcaagtcccaagccatcttcatctgcaccccctccggatgatttgctaaatccaactgctgatgaggacttcttgaaccccactgcatctatgtttactggaaaaaacaaccacaatgaatccaattcaaaagccaaatctgccgataacttgcctccagcaccttgggatgctcctcctcctaccgcactccctccaccaccggccagatatgatcagagacagcagtactttgagaaacatgtttctggtggctcccctcccgcaaaaactggatcgacttcctatgacaacatagttggacaaacaaagaatctctctattaattcttcttcaccatccaaaccagagaaacccgaggacgcactcttcaaagatcttgttgattttgcaaaagccaagtcttcctcatcttcaaaccaatccaatagatcattttaagtgatttcaatgaatatgaataatgtgtggtggggtgtatatctactttttcttcttgtagcaataaatattagagaggactgagtttatggattactggagctgcttcttctgctttattttctgttcggctttcagcctttaggtgagtgatagtgtagctgacatgccatttataacttgaatcatataaggtggttaatatttctgtttttttttttttttt

SEQ ID NO: 5857 - DNA, 2797 bp, Capsicum annuum
ttttggtatcttttgtgaaatcgcatatttgttttattcttgagagatcaaaggtggaacaacttgaagaaaaggtggaaactagaaaagatggctaacaatgcagcggcatgtgcagaaagggcaactagtgatatgctgattggtcctgattgggctataaacattgagctttgtgatattatcaacatgaatcctggacaagcaaaggatgctcttaaaattatcaagaaacgcttagggagtaaaaatccgaaaatacagctccttacactattcgttcttgagaccctgagcaaaaattgtggagagaatgtttttcagcaaattgtggagcgtgacattttaaaagacatggtcaaaattgtgaagaagaggcctgatttaaatgtaagggagaagattttgattttgatagattcatggcaagaagctttgggagggccaggggaaagatttccccagtattacgctgcatataatgagctgaaggctgcaggtgtagagtttccacctcgagaagaaaatagtgtacctttatttacaccaccacaaacccatccgatagtccacgctccttcagcttatgaggaggctgcagttgaggcctctcttgagtccgatccttctggactcagtgttgcggagattcaaaatgctgaggggctagcagatgtcctgacggagatgcttggtgccttggatccaaagaatctgcagtctgtgaaggaggaggtgatagttgatcttgttgaacagtgtcgttcttatcagaagcgcgtgatgattcttgtgaacaacactgtagatgaagatctgctatgtaaaggattggcactcaatgacaatcttcagcgcgttctacttagacatgacgatattgctaaaggaacctcaacaagtattgtaccgcccagagaaactcatgttgcaccccttatgaatgtgaatcatgaggatgacgagtcagaagatgatttctctcatttagcgcggagatcttcaagagatccatcacagggacaggggcggagggctattgatgtgaagaacgagcctatgcgaattactcctactcttcctcccccaccttcatcaaggagaccagtttttacagaagggaaaatggttgattatctcagtggtgacaggtttgaatctgaaagatcattgggaacagaaggatcctcatctattgctgcttcaactaattcaaacagtgcgaactccatcccgcattcaagtcccaagtcatctttatctgcaccccctccggatgatttgctaaatccaactgctgatgatgacttcctgaaccccactgcatctatgtttactggaaaaagtaaccacaacgaatctgataaaaaagccaaatctgccgatcacttgcctccagtaccttgggatgctcctcctgccacacttcctccaccaccagcaagatatgatcagagacaacagtactttgagaaacatgtttctggtggttctcctccccaaagaactggttcgagttcttatgatggcttagttggacaaacaaagaatctctcgattaattcttcttcaccatccaaaccagagaaacctgaggatgcactcttcaaagatcttgttgattttgcaaaagccaagtcttcgccatcttcaaaccaatctaatagatcattttaagtgacttaaatgaatatgaataatttgtggtggtgtatatcaactttgacatctagtagcaataaatactaaagaggactgagtttatggattactggagttgttccctctggtttattccagttgggcttacagcccttaggtgagtgatagtgtagctgatttgacatttatattttgaatcatataaggttgtcaaaatttctggtttttttatttttttgtttcaactgatttgtaatcctaacaatacttggggttctagtatctctcaattgcagggaaaaattcatctatgtttaggggttttggtaagtgatcgtatcttttgcaggttaaataccaaaaccaattcttgatttgactttaaaactaatttttatttcaactccatgagtaaaaactagtacctactagattgataagataatagtatccttccaaaagagctaagacaataaaaagcatatgcttcaggctccagttccgtgggattctgaatatacaaattgacttaccctaattccaaaatgaccataatttcatactgaactcacttctacaaccccacaatttacagtcgaatttaaaaagaagagataagtttcttcaaattgaactcaccgtaaccatattcttcagaattcacacaatcaaatccacatccacactgtggtgactcatagaaattttcaaccccaaaatcagcagaagcaattccaacagagaaatcaatatcatcaccatcacgagtaacttcaacaatattaatccaaaacaacagcagcttcacttgtacacctttcaagttcgaaagccgattctttgaaattttaccagtaactttactcatgtacttgagagtgtaaccacttatactgaaactgcatgatttgttcaagtaaacagcgaaattgcctgtagttctgtcgaattcgtaccttgttacgctttttgggagaagtcctacaggaaaattgtattcctgtaggatttcgtagactgttggagaatcggagtcggattccaggctagtgatggatggagaggaggtggagaggatgaggaggaagaggcataaggggagagttatagaagacatgtttggtgtactagttgg

SEQ ID NO: 5858 - DNA, 2880 bp, Capsicum annuum
tttgttgcctgctgtttttcttctttgtaggatattgagaattttgttgcttaggaattgggaattttgatgatctggtgactttttggtatcttttgtgaaatcgcatatttgttttattcttgagagatcaaaggtggaacaacttgaagaaaaggtggaaactagaaaagatggctaacaatgcagcggcatgtgcagaaagggcaactagtgatatgctgattggtcctgattgggctataaacattgagctttgtgatattatcaacatgaatcctggacaagcaaaggatgctcttaaaattatcaagaaacgcttagggagtaaaaatccgaaaatacagctccttacactattcgttcttgagaccctgagcaaaaattgtggagagaatgtttttcagcaaattgtggagcgtgacattttaaaagacatggtcaaaattgtgaagaagaggcctgatttaaatgtaagggagaagattttgattttgatagattcatggcaagaagctttgggagggccaggggaaagatttccccagtattacgctgcatataatgagctgaaggctgcaggtgtagagtttccacctcgagaagaaaatagtgtacctttatttacaccaccacaaacccatccgatagtccacgctccttcagcttatgaggaggctgcagttgaggcctctcttgagtccgatccttctggactcagtgttgcggagattcaaaatgctgaggggctagcagatgtcctgacggagatgcttggtgccttggatccaaagaatctgcagtctgtgaaggaggaggtgatagttgatcttgttgaacagtgtcgttcttatcagaagcgcgtgatgattcttgtgaacaacactgtagatgaagatctgctatgtaaaggattggcactcaatgacaatcttcagcgcgttctacttagacatgacgatattgctaaaggaacctcaacaagtattgtaccgcccagagaaactcatgttgcaccccttatgaatgtgaatcatgaggatgacgagtcagaagatgatttctctcatttagcgcggagatcttcaagagatccatcacagggacaggggcggagggctattgatgtgaagaacgagcctatgcgaattactcctactcttcctcccccaccttcatcaaggagaccagtttttacagaagggaaaatggttgattatctcagtggtgacaggtttgaatctgaaagatcattgggaacagaaggatcctcatctattgctgcttcaactaattcaaacagtgcgaactccatcccgcattcaagtcccaagtcatctttatctgcaccccctccggatgatttgctaaatccaactgctgatgatgacttcctgaaccccactgcatctatgtttactggaaaaagtaaccacaacgaatctgataaaaaagccaaatctgccgatcacttgcctccagtaccttgggatgctcctcctgccacacttcctccaccaccagcaagatatgatcagagacaacagtactttgagaaacatgtttctggtggttctcctccccaaagaactggttcgagttcttatgatggcttagttggacaaacaaagaatctctcgattaattcttcttcaccatccaaaccagagaaacctgaggatgcactcttcaaagatcttgttgattttgcaaaagccaagtcttcgccatcttcaaaccaatctaatagatcattttaagtgacttaaatgaatatgaataatttgtggtggtgtatatcaactttgacatctagtagcaataaatactaaagaggactgagtttatggattactggagttgttccctctggtttattccagttgggcttacagcccttaggtgagtgatagtgtagctgatttgacatttatattttgaatcatataaggttgtcaaaatttctggtttttttatttttttgtttcaactgatttgtaatcctaacaatacttggggttctagtatctctcaattgcagggaaaaattcatctatgtttaggggttttggtaagtgatcgtatcttttgcaggttaaataccaaaaccaattcttgatttgactttaaaactaatttttatttcaactccatgagtaaaaactagtacctactagattgataagataatagtatccttccaaaagagctaagacaataaaaagcatatgcttcaggctccagttccgtgggattctgaatatacaaattgacttaccctaattccaaaatgaccataatttcatactgaactcacttctacaaccccacaatttacagtcgaatttaaaaagaagagataagtttcttcaaattgaactcaccgtaaccatattcttcagaattcacacaatcaaatccacatccacactgtggtgactcatagaaattttcaaccccaaaatcagcagaagcaattccaacagagaaatcaatatcatcaccatcacgagtaacttcaacaatattaatccaaaacaacagcagcttcacttgtacacctttcaagttcgaaagccgattctttgaaattttaccagtaactttactcatgtacttgagagtgtaaccacttatactgaaactgcatgatttgttcaagtaaacagcgaaattgcctgtagttctgtcgaattcgtaccttgttacgctttttgggagaagtcctacaggaaaattgtattcctgtaggatttcgtagactgttggagaatcggagtcggattccaggctagtgatggatggagaggaggtggagaggatgaggaggaagaggcataaggggagagttatagaagacatgtttggtgtactagttgg

SEQ ID NO: 5859 - DNA, 2319 bp, Nicotiana benthamiana
tcttgactgcttcatatcttatttgtctataagattttgatatcttttactttgatctttctttgagactgtgttttcatcattattgtattaagtcatgatcttgaaattactcctagttgggtttgcttcaattttgttgttctcttttttggaccttcaagctttcatttgtattggatgtttttgctgtgcattctagaaactagagatttgttaggtaggaaattgggaattctaatgatctatttcctctttgattttggtgaactttgatatcatttgttgaattgcaggttggttaaagtttgattctcggtgaggttctactttgatttatttactgtttttgtgtgtttgaggggtgtgtttatgttcttacctttgaatttatcaattttttttgacagaaaagttttttgtttttatttttaggagatcaaaggtggaacaatttgaagaaaagggtgggaagtagaaaaagatggctaataatgcagcagcttgtgcagaaagggcaacaagcgatatgctaattggtccagactgggctataaacattgagctttgtgatattatcaacatgaatcctggacaagcaaaggatgctcttaagattatcaagaaacgtttagggagtaaaaatccgaaaatacagctccttaccctatttgttctcgagaccctgagcaaaaattgtggagagaatgtgtttcagcaaattgtggagcgggacattttaaaggacatggtcaaaattgtgaagaagaagcctgatttaaatgtgagggagaagattttgattttgatagattcatggcaagaagctttgggagggccagggggaagatttccccagtattatgctgcatataatgagctgaaggcatatggtgtagagtttccacctcgagaggaaaatagtgtacctttatttacaccaccacaaacccagccaatagtccacatgccttcagcttatgaggaggctgcagttgaggcctctcttgaatcagatccttctggactcagtgtttcggagattcaaactgctgagggactagcagatgttctaacggagatgcttggtgcactggatccaaaaaatcctcaggccgtaaaggaggaggtgattgtcgatcttgtcgaacagtgtcgtgcttaccaaaagcgtgttatgattcttgtgaacaacacagtagacgaggatctgctgtgtaaaggattggcactcaatgatggtttgcagcgagttcttcggagacatgatgatattgccaatggaacctcaacaattacagtacagcccagagaaactcctattgcacccctcatgaatgtgaatcatgaggatgatgagtcagaagatgatttctctcatttagcacggagatcttcaaaggatccatcgcaggcacaggggcggaagactgttgatgtaaagagtgaacctatgcgaattacccctactcttgctcccccaccttcatcaaggagaccagtttctactgatgcgggaatggttgattatctcagtggtgaaaggtttgaatctgaaagatcttttggaacagcaggatcctcacctattgctgtctcaactaattcaaacaatgtgagctccatcccgcgatcaagtcccccttcggatgatttgctaaacccaacagctgatgatgatttcgtgaaccccactgcatccttgtttactggaaaaagcaacaacggcgaatctgatacaaaagccaaatctgctgatcacttgcctccagcaccttgggatgctcctcctaccacactccctccaccaccagccagatataatcagagacagcagtactttgagaaaaatgtttttggtggtggatcgagttcttatgatagcgtagttggacaaacaaagaatctctccattaactcttcatcgccatccaaacaagagaaacctgaggacgcactgttcaaagatcttgttgattttgcaaaagccaagtcttcgtcatcgtcaaatcaatccaatagatcattttaagtgattgtaatggatatgaataatttgtggtggtatatatcagcttttacatcttgtagacaataaacattaaacagaacagggttcatggattactggagctgctccctctgctttgttttagttgtgaaccttgggctttcaggtccaaggtgagtgatagtgtagccgacatgagatttacagtttggttattatgtattcttttcttccttttcaattggtttgtaatcataacaatacttgggttctactatctctcaattagtagggatgatagtcgacga

SEQ ID NO: 5860 - DNA, 702 bp, Solanum tuberosum
acaaagatatttgtactcattttcgatattcagaagcccggaaaacttccaatcaaaactattattcagattccggcggctttccggctgttcgccgaccataaaccagtcgtcgtaaaacccagctcgggtcacatggacatgccaaaaggagacaaacttgtgctgaggggtttaaagtttcatggataccatggggtgaagcaagaggaaaggaagcttggtcagaagttcctggtagatgttgatgcttggatggatcttcgacctgctggtgaatctgactgcttgtccgatactctaagttatactgatatataccgaatagtgaaagaggttatggaggggccacctaaaaatctgctagaatctgtggctcagcttatagcatcgacaaccctcaccaagtatccacaggtatctgctgttcgcgttcaagttggaaagcctcatgtggccgtccaagggcctgttgactacttgggtgtcgagatcattagatacagagatcttgatgttcaaaactagtacatgatgcttgtattattaacaacttcaattttctgctgtttgacaatcattttcaagccaatacaatttgatcaattgtctcaaactcttgatacttaattgaataatgcctttactacacacttctgcaggggcacaaagttcccaaaaataaaagggcagttccggtgc

SEQ ID NO: 5861 - DNA, 824 bp, Solanum phureja
ttgaaagtaaatgagtaaatttatttattttctttctatattttgatacaatattttaaagatagtgatttgaaaaatttattattaaaagataacactacaaaatatgcaaaataaaacacacaaaagatatttgtactcattttcgatattcagaagcccggaaaacttccaatcaaaattattattcagattccggcggctttccggctgttcgccgaccattaaccagtcgtcgtaaaacccagctccggtcacatggacatgccaaaaggagacaaacttgtgctgaggggtttaaagtttcatggataccatggggtgaagcaagaggaaaggaagcttggtcagaagttcctggtagatgttgatgcttggatggatcttcgacctgctggtgaatctgactgcttgtccgatactctaagttatactgatatataccgaatagtgaaagaggttatggaggggtcacctaaaaatctgctagaatctgtggctcagcttatagcatcgacaaccctcaccaagtatccacaggtatctgctgttcgcgttcaagttggaaagcctcatgtggccgtccaagggcctgttgactacttgggcgtcgagatcattagatacagagatcttggtgttcaaaactagtacatgatgcttgtattattagcaacttcaaatttctgctgtttgacaatcattttcaagccagtacaatttgatcaattgtctcaaactcttgatacttaattgaataatgccttcactacacacttctgcaggggcacaaagttcccaaaaataaaaggacagtccggtgc

SEQ ID NO: 5862 - DNA, 569 bp, Solanum melongena
gggggggaaattccctatcaaaactatacagatttcggcaactttccggcagttggccgaccataagctactagtagcaaaacccagctccggtcacatggacatgccaacaggagacaagcttgtgctgaggggtttaaagtttcatggataccatggggtgaagcaagaggaaaggaaacttggtcagaagttcctggtagatgtcgatgcttggatggatcttcgacctgctggtgcatctgactgtttgtgcgatactctaagttatactgatatataccgaatagttaaagaggttatggaggggccacctaaaaacctgctagaatctgtagctcaactcattgcatcgacaaccctcaccaagtatccctgggtatctgctgttcgcgttcaagttggaaagcctcatgtagctgtccaagggcctgttgactacttgggtgtcgagatcatcagatacagagatcgttgatgttcaaaactaaggacataatgtttatattattagcaacttcaaatttctgttgtttgacaatcattttcaagccaataccattttgatc

SEQ ID NO: 5863 - DNA, 660 bp, Capsicum annuum
tccccaccttttcccactcagccaccaagatatttttctgtcaaatttctgactctaaacgtccatggcatcacctaccaccagtcacatggatataccaaaaggagacaagcttgtgctaaggggtttaaagttccatggatatcacggggtgaagcccgaagaaacgaagctggggcagaagttcttggtggatgttgatgcttggatggatcttcgaccagctggtaaatccgactgcttgtcagatacgctgagttacaccgatatatacagaatagtgaaagagattgtagaaggtccacctagaaaacttctagagaatgtcgcggagctcatagcatctacaacgctgaacaagtacccgcaggtatctgctgttcgcgttcaagttggaaagccgcatgtggctgttcaaggacctgttgactacttgggcgtcgagataatcagacacagagatctttgatgttcaaatccatgtcttattgctcttttgtaatttgaagtcctgttgttaaacaacacagtttttcatcctttccatctgcatttgctattgtttttcgtataaaaactcttcgaattcgtgctccatgaatatgttacttcatcacatgaacacgggaaatttggctattaagcctcttcaagtttcta

SEQ ID NO: 5864 - DNA, 732 bp, Nicotiana benthamiana
ttctctctctctccgattgtcaacaatttcagtggtgtaaaattaataggaatatgagaaaacttaagaagggataaccgcacttgatgaatgtgttttaagaagaaaatacgattataattcgtgttttatgctttttctgtcaaatttcacaagttcgtgttttatgttttttctatcagattttccggtagagcaattttcttgcttcttttctgacttaaccattcattgcatcacccagcaccatgaaaggtcacatggatataccaaaaggagacaagcttgtgcttaggggtttaaagttccatggatatcatggggtgaagccagaagagacgaagctggggcagaagttcctggttgatgttgatgcttggatggatcttcggccagctggtaaatctgactgtttgtcagatactctaagttacactgatatatacaaaatagtgaaagagattgtggagggtccacctagaaaacttctagagaaggtggctgagctcatagcatctacaacgctcgacaagtatccacaggtatctgctgttcgtgttcaagttgggaagccgcacgtggctgttcaaggatctgttgactacttaggcgtcgagatcatcagacacagagatcttgatggttaaaaccacgtcttattacctgtattagttattttatttctaaatcctgttgttcaataaccgctttggttgaaagatagtttctttt

SEQ ID NO: 5865 - DNA, 600 bp, Nicotiana benthamiana
aggaccagtgacaggtcacatggatatcccaaaaggagataagcttgtcctgaggggtgtaaagttccatggatatcatggggtgaagccagaagagacgaagctggggcagaagttcctggtggatgttgatgcttggatggatcttcggccagctggtaaatctgactgtttgtcagatactctaagttacactgatatatacaaaatagtgaaagagattgtggagggtccacctagaaaacttctagagaaggtggctgagctcatagcatctacaacgctcgacaagtatccacaggtatctgctgttcgtgttcaagttggaagccgcatgtggctgttcaaggatctgttgactacttaggtgtcgagatcatcagacacagaggtcttgatggttaaaaccacgtcttattgcttgtattaatttttgtaattctaaatcctgttgttcaataaccattttgattgaagctagttcctttttcacgtttagtgtttaaaatcttttccttctgcatttgcttttggttataaaatactctttggattcctgattcaatagaggcctgcaacttcaccacaaacctttgttgg

SEQ ID NO: 5866 - DNA, 505 bp, Nicotiana tabacum
  misc_feature (208)..(208): n is a, c, g, or t
  misc_feature (228)..(228): n is a, c, g, or t
  misc_feature (259)..(259): n is a, c, g, or t
tacatggcattacccagcaccaaggatcagtgacaggtcacatggatataccaaaaggagacaagcttgtcctgaggggtttaaagttccatggatatcatggggtgaagccagaagagacgaagctggggcagaagttcctggtggatgttgatgcttggatggatcttcggccagctggtaaatctgactgcttgtcagatactcnaagttacacagatatatacnaaatagtgaaagagattgtggagggtccacntagaaaacttctagagaaggtggctgagctcatagcatctataacgctcgacaagtatccacaggtatctgctgttcgtgttcaagttgggaagccgcatgtggctgttcaaggatctgttgactacttaggtgtcgagatcatcagacacagaggtcttgatggttaaaaccccgtcttattgcttgtattaatttttgtaattctaaatcctgttgttcaataaccgttgttgaaagctagttc

SEQ ID NO: 5867 - DNA, 567 bp, Capsicum annuum
gcacgaggaaggagacaagcttgtgctaaggggtttaaagttccatggatatcacggggtgaagcccgaagaaacgaagctggggcagaagttcttggtggatgttgatgcttggatggatcttcgaccagctggtaaatccgactgcttgtcagatacgctgagttacaccgatatatacagaatagtgaaagagattgtagaaggtccacctagaaaacttctagagaatgtcgcggagctcatagcatctacaacgctgaacaagtacccgcaggtatctgctgttcgcgttcaagttggaaagccgcatgtggctgttcaaggacctgttgactacttgggcgtcgagataatcagacacagagatctttgatgttcaaatccatgtcttattgctcttttgtaatttgaagtcctgttgttaaacaacacagtttttcatcctttccatctgcatttgctattgtttttcgtataaaaactcttcgaattcgtgctccatgaatatgttacttcatcacatgaacacgggaaatttggctattaagcctcttcaagtttcta

SEQ ID NO: 5868 - DNA, 644 bp, Olea europaea
agggtaaatctctgcactctccggcaccggcaattactttactgatgtcgtcatccggcaccgtccaagtaacagatcatcaggagatgctaaacggagacaaacttgtattaaggggattaaagtttcatgggtaccatggggtgaagccagaagaaaggaagttgggacagaaattcttgatagatgtagatgcctggatggatcttcgagttgcaggaaattccgacaacttgtctgataccatcagttatactgccatataccgcatagttaaagaggttgttgaaggagcctcacaaaatcttcttgaatctgtggctcaacttattgcgtcaacaatcttaagcaactaccaccaggtgtctgctgtccgggtgcaagtcggaaagcctcatgtggcagtgcaaggtccagtggactatttgggcgttgagatcactaggtaccgtagcgttgacatgcaaagctgaggtttccgtggatcagtgtcgtacttcacacttccatttgtaactttgagtcaagcttgataaatttgtcatactttttccttcggtttctggggttgggatacgatcacattactgtgtaacttattgtatctctggtacattattgatggtggattataattttatttc

SEQ ID NO: 5869 - DNA, 3051 bp, Vitis vinifera
atggctttgaacatagagtcattcacaggttgtgatcagatttgtacggagcctcttgcagcaactccatttggttccccttgtggttgtgtgtttcctatgaaagttagacttcttctggatgtagccctttatgctgtctttcctgtggttgctgagctagcaattgaggttgcagcaggcacatatctggagcagagtcaagtgaagatagtgggcgccagtgctgacagtcaaaatcagggaaagacagtagtagatattaacttggttccactgggagagaagtttgataacaccactgctatgctgacatgtgagagattttggcagaagaaagtgcctctaaataggactctttttggtaactatgatgtgttgtacattaattatccagggattccttcttcaccgccatctggaagttacatgggcagtggtccaagtggaagtgctggaggtctccccataactgcagattttgtcaacaagagccagaagttgaatcctagaaccattgccatcatcgctttatctggttttgtgcttgtattggtgtgcattggagcaatttccattgttttaaaatggagaaagattggaagaccatcaagtgctgttggtcctgtatttacatcatccatcaataagagatctggcattggttctatgttatcaagtagcatagcaagttcaacatcagcatccctcatttccaccatggctacatgtgttctctctgttaaaacatttccacttgctgaacttgagaaggcaacacataagttcagttcaaagaggattttaggtgaaggaggatttggacgtgtttaccatgggactatggaagatggaactgaagttgcagttaagctgcttacaagagatcaccagagcggagatcgtgagttcattgctgaagttgagatgctcagccgattacatcaccgcaatcttgtgaaactgattggtatatgcattgaaggacacacacgctgcctggtgtatgagcttgttcacaatggcagtgttgagtctcacttgcatggtgctgacaagggaaagggacctctcgactgggatgcacggatgaagattgcccttggtgcagcaagaggattggcttatcttcatgaagattctaatcctcgtgtaattcaccgagattttaaggccagcaatgtcctactagaagatgatttcaccccaaaggtttcggattttgggttggcaagggaagcaacagaaggaagtcatcatatatctactagggtcatgggaacttttgggtatgttgctcctgaatatgcaatgacggggcatctacttgtcaaaagtgatgtatacagttatggggtcgtgttgcttgagcttctctctggaagaaaaccagttgacatgtcccaaccaccaggacaggagaacctagtaacctgggcacggcctctgttgactgttagagaaggtttggagcagttggtggatccttctttggctggaaactacgactttgacaacgtggctaaggttgcagccattgcttccatgtgtgttcaccctgaggtgactcacagacccttcatgggtgaagtagtgcaggcactaaaactgatttacaacgacaaagacgagacttgtggggattgttgtagtcagaaggaatcttcaggtccggactcagatttgagaggtgatcttgacccttctgatagcagttggtggaatgctggagggatcaccccacgcttgacatacgggcatgccacgccgttcataaccatggagtacagctccggtccccttgaggagacggaaaacagaccgttttcagcttcaagcctggtgggggaaggggcatccttacaaatcacacatgggaacagatcagggccattgagaacaatccgaagcaagccagggttctatagattaaaagggagtatgagtgaacatggggtgctttcaaagcgagtttggaatgatggtgcttgggtttgaggttttcttttgtagcattttccaaaatgtacatacagtttgtagaaggacaggggccttcaaggaagcagttgatttgatgtagctggttttaggaatttggatggtgggcggtttccatatcgagtgagaaagaagataacggagagaaaagagagatgatggcttctaattttggaaatcttgattcaattacaatacaaagttggagatgtaagttggatactccctgtagcttggtgggtaaggtagaaaacatcaggagagagcacacagagctcctgagccttttcccttctcctgtgtctgcctctgccgccagggtcctccggcggaacttcccatctctccggcacggccacagcttttatctagcgagaattggagtcataaccatggaaacatcccttggtggagcaatggtggacagtggagagataatgaagggagacaaactcatattaaggggcttgaggttccatggatttcatggggtgaagccagaagagaggaagctaggtcagaagttcttggtagacgttgatgcttggatggatctccgagcagctggtagatcagactgcttgtcagatacaatcagctatacagatatttatcgcattgttaaggaaattgtggagggaccacctcaaaatcttctagagtcagtggctcaactcattgcctctaccactctaaccaaacactcacgcatatctgccatccgtgtgaaagttggaaagcctcatgttgctgtccaaggccctgttgattatctgggcgtcgagattttgagatatagaagtgttgatgcacaaatttgagcttttatatgcaacttccatacatgatgcactttgaggcctaatgtcatttttgtgttgcacatttctgtattcctgtaagtttgttttgtgagtttgagcatgattaaatttaatttgtcttgagtgaatggttctttatgcgaagtgattttactttggttgtttacatcaactagtttatctgtatgctggtgttcttttatatgcttgggaacagggatatatg

SEQ ID NO: 5870 - DNA, 650 bp, Olea europaea
atttttcagggtaaatctctgcactctccggcaccggcaattactttactgatgtcgtcatccggcaccgtccaagtaacagatcatcaggagatgctaaacggagacaaacttgtattaaggggattaaagtttcatgggtaccatggggtgaagccagaagaaaggaagttgggacagaaattcttgatagatgtagatgcctggatggatcttcgagttgcaggaaattccgacaacttgtctgataccatcagttatactgccatataccgcatagttaaagaggttgttgaaggagcctcacaaaatcttcttgaatctgtggctcaacttattgcgtcaacaatcttaagcaactaccaccaggtgtctgctgtccgggtgcaagtcggaaagcctcatgtggcagtgcaaggtccagtggactatttgggcgttgagatcactaggtaccgtagcattgacttgcaaagctgaggtttccgtggatcagtgttgtacttcacacttctatttgtaactttgagtcaagcttgataaatttgtcatacttttccttcgttcttggttgggtgtacgatcacatactgtgtatattgtgtgtctgtgatattgggtgggtatattattctatggttcttaaacgt

SEQ ID NO: 5871 - DNA, 535 bp, Antirrhinum majus
gttgtggagaaatgattaagggagacaagcttgtattaaggggtctcaagttccatggttatcatggtgtgaagccagaagagaggacattgggtcagaagttcttgattgatgtagatgcttggatggatcttcggcccgccggtgattcggacctattaacggataccatcagctatactgctatttatggcatagtcaaagaagtagtcgaggggactccacgtaaccttctggagtctgttgcccaactgatagcatcaacagtcttaagcaagtacacgcaggtatctgctgtccgggttcaggtaggaaagccgcatgtggccgtggttggtcctgttgactatctgggcgtcgagatcatcagatatcgtacagtcgatgcacaagcctaactttccaggttctgctgttgtagttataccaccctttgttaacctgaagttgtgaaaaagcctagtttattgttcattagttgctgaattggatgaggatatacagttttctgataaacttatttcatcataaaccc

SEQ ID NO: 5872 - DNA, 648 bp, Quercus alba
tggctcactttttcagtactgcaagattgcatagtattttcttccgggagaaaatttacaatctttggaaacattcagtagtggagtatcaatggagaatgttgcaatagtgaagggagacaaactcatattaaggggtttgaagttccatggatatcatggggtgaagccagaagaaaggaagctgggtcagaagttcttggtggatgttgatgcctggttggaccttcagccagctggtaaatctgattgcttgtcagatactgttagttatactgatatttaccgaatagttaaagaagttgtggaagggcctgcacacaatcttctagagtcagtggctcaactcattgcatctaccactttcacaaagcacccccagatatctgctgttcgtgtagtagtcggaaagcctcatgttgcagttcctggttctgttgactacttgggcgttgagattctcagatacagaagtgtagatgcatcaaactgaacttattatttgtacttttttcttttttcacccagctgaacagctatgttttttaagcaaatacattggttgctatacatctataatggttctttgactgatctgcatttcaccaatttaaacaatcaagatactaagaaattagagtttaccat

SEQ ID NO: 5873 - DNA, 2126 bp, Solanum phureja
gtatgaagagtcttcccggagctccattcaaaggcatttcagaggatattcgaggacgagtatcttgctacaagcaggattggattgctggaattagatccggaatagggatattagctccaactacctacatattttttgcatctgctcttccagtgattgcttttggagaacaattgagcagagaaacagatgggagccttagcactgtggaaactttagcttctacagcaatttgtggcatcattcactcgatactcggggggcaaccacttatgatactaggagttgcagaacctactattattatgtacagttacttgtacaagtttgctaaagggagagaagaattaggacagaccctttacttggcttgggccggatgggtttgtgtctggacagctctcatgttatttcttctagcaatattcaatgcatgttctatcataagtaaatttacaaggattgctggggaaacttttggaatgcttatcgcggtacttttcattcaagaggcaattaagggattggtaagtgagttcagcattcctaaagctgaggacccaagttcggagaaatatcaattccattggctttacacgaacggactacttggaatcatattcacctttggtcttctctacacagccttaaagagcaggaaagcaaggtcatggtggtacggcacaggctggattagaagcttcatcgccgactatggagttcctttaatggttctcatgtggtcagctctctcatttatcgtgccaagcaatgttccatctggagttcctagaactctctatagtccccttccttgggaatctgcatctttatatcactggactgtaattaaggacatggtgaaggttcctccagtatacatatttgctgccataataccagctgtgatgatagccggactctatttcttcgatcacagtgttgcttcgcaaatggcacaacaaaaagagttcaatttaaagaatccttctgcttatcattacgatatattactcttgggatttatgactttgctatgtggtttactaggattgcctccttcaaatggtgtcctgccacagtccccaatgcatactaaaagtttggctattcttaagaaacagcttatccggaagaagatggttgaaagtgcgaaggagagtatcaggcgaaaagctagcaattctgaaatctatggcaatatgcaagctgtatttatagagatagatagttctcctattagtgcagtagctaaagagttggaacatttgaaagaggcaataatgaaaggtgaaagtgaaaatgcaaatggcgaaaagtctaatggtatatttgatcctgagaagtacattgatgcttacttgccggttcgagtaaatgaacaaagagtcagcaatctattgcagtcactactggtagcagcatcagtaggtgctatgccagtgataaaaaagataccaacttcagttctttggggatatttcgcctacatggctattgacagccttccaggaaatcaactgtgggaaagaacactgcttctattcgtcgcccctggcaggagatttaaggtccttgaaggggttcatgcatcttttgtggaatcagtaccattcagatacattgcaatcttcacaatattccaatttatgtacctacttcttgtctttggagttacttggattcctatagctggcattctattccccttgccattttttctcctcataagcataagacaacatttgcttcccaaattgttacaccctcgtcatttacaagagcttgatgcagccgaatatgaggaaatagctggtgctccacaacgcgcacttagcatctctttcagggaaacggagacaactcttcctagaactgaaggcgcaatagaaatttgtgatgctgagattttggatgaacttacaacaagcagaggagagttcaaagtccggactgtcagctttagtgaggataagcgcccacaggttattcatccaactgcagacacagaatctgaatgaacaaattacatggctctagagtgtattgaatcttgaattggtaccatttgtatgtgtccatacatgtagagtgtataatactacaaattgtaggtgtagtta

SEQ ID NO: 5874 - DNA, 2198 bp, Solanum phureja
gggatgaagagttttttcacatctccattcagaggcattaccgatgattttcgaggaagagcttcatgttacaagcacgattggattgctggattcgcgatattggctccaactacgtatatattttttgcatctgctcttccagtaattgcctttggagaacaattgagcagagatacagatgggagcgtgagcacagtagaaacattggcctcaacagctatttgtggtattatacactccatattcggcggtcagcctcttttaatattaggagttgctgaaccaactattattatgtacacttacatgtacaaatttgctaaagggagacaagaattgggacagagtctttacttggcgtgggctggatgggtttgtgtatggacagcactcttgttggttcttctagcaatatttaacgcgtgctacattattaatcgatttacaaggatagctggggagacatttgggatgctcatttctctgctttttattcaagaggcaattaaggggttagtgagtgagttcaaagttccgaaagctgaggactcaagtttagagaaatatcaattccagtggctctatataaacgggttacttggagttatattttcctttggccttctttacacatcattgaaaagcagaaaagctaggtcatggtggtatggaacaggctggttcagaagctttgttgctgattatggtgttcctttaatggttcttgtgtggtcagcactctcatatggagtgccaagtgaagttccatctggagttcccagaaggctctttagtccacttccttgggaatctgcatcttcacatcactggactgtaatcaaggatatggggaaggttcctccgacatacatcgttgctgccttaattccagctctaatgattgctggactttatttctttgatcacactgttgcttcacagatggcacaacaaagtgaattcaatcttaagaatccttctgcttatcatcatgacatcttgctcttgggatttatgactttgctttgtggtttgattggtgtgcctccttcaaatggcgtcctgcctcagtcacctatgcatacgaagagcttggctgttctcaagagacagctgattcggaggaagatggttaaaagtgccaaggagagtataaagcgaaaggctagcaactctgaaatctatggaaatatgcaagcagttctcatagagattgatagttcttctgataccacagtagctaaagagttggaacacctaaaagaggcagtaatgaaaagtactgaaaacaaaaatggaggtacaacagaggtcacatttgatccagagaaacacatagatgtttacttgcctgtccgagtgaatgaacaaagagtgagcaatctattacagtcgctactagtagcagcatcagtttttgctatgccagtgataaagaagataccaacttcagttctttggggatattttgcttatatggctattgacagcctgcctggaaatcaactttgggaaagattattgcttcttttcatcaccactggaaggagattcaaggtacttgaaggggtgcatgcatcttttgtggagtcagtgccattcagatacattgcaattttcacaattttccagtttgtatacttattgttgtgctttggagtcacatggatccccatagttggaattctcttccccttgccattttttcttctcttaagcataagacaacatatactccccaagctgttccagcctcatcatttgagagagctagatgcagctgagtatgaggaaattgttggtgcctctcaacgtttacgcagcttctcttctaaggaaaaggaagtacctactaatggaactcatgaggaaggtgaagtagacatttgtaatgctgagatactagacgaacttacaaccagtagaggggaatttaaggtcaggagcaagagctttagcgaggataaacgtccgcaggttcatgcaacaagagacacaatttgagtagttaatcagctgggtgtcttgaatttttgctcatgcacattctttccaaatggaaattatcgagacaattcacaacaccaaaaaagatctttagtggcaattaattaacaataatagcttaattgccgctaaatatgtatttttagtggcatttagtactctgtaaatgtccctaaagtgacattgga

SEQ ID NO: 5875 - DNA, 821 bp, Avena sativa
acaaaatgaagcttcaggtagccgcagtcgcctccctcctcctggtgaccctggccgcgacggccggagccgtcacgttcgacgcgtctaacactgcgtcggcacgcgggcggccagcggttcaaccgggacgtcggcctcgcatactcgaagcaggtcctctccgacgcatccaccttcatctggaacaccttcaaccagcgcgccgcctccgaccgcaagcccgtgagcgccgtcaccctcatcgttgaggacatcgacggcgtcgccttcaccagcgccaatggcatccacctcagcgcccagtacgtcgccggctacaccggcgacgtcaagacggaggtgaccggggtgctgtaccacgaggccacgcacgtgtggcagtgggacgggcagggcaacgccaatggagggctcatcgaggggatcgccgactacgtgcgcctcaaggccgggctcgcgccggggcactgggtgaagcccgggcagggggaccggtgggatcaggggtacgacgtcacggccaggttcctcgactactgcgactccctcaagcccggcttcgtcgcgcagctcaactccaagatgaagggtggctacaccgacgacttcttcgcgcagattctgggcaagaacgtgcagcagctgtggcaggactacaaggccaaattcggaggctgaatacttcacatattgatgggctttagtcattgctccttccatggtgtgatggcataacagactgaataagctatgcatgtgcttcatatgtagatccaaaaaacaatcgtgaaacatgaataaacgaatttaatagtcct

SEQ ID NO: 5876 - DNA, 932 bp, Secale cereale
ttcaaatttaaactaaaccaacgacaaatactccccaccgatttacacggagtagtactatatatagccactgtcacaggtagcaaatcacacccacaccgatagcttagctgcagcatccgccacaaaatgaagcttcaggtagccacagtagccttcttcctcctggtgaccatggccgcgccggcgcgggccgtgacgttcgacgcgtcgaacacggcgtcgggcaccaccggcggccaacgcttcgaccaggccgtgggcctcgcgtactcgaagcaggtcctctccgacgcctccaccttcatctggagcaccttcaaccagcgcgccgcggccgaccgcaagcccgtcgacgcggtcaccctcgtcgtggaggacatcgacggcgtcgccttcaccagcgccaacggcatccacctcagcgccagctacgtcggcggctacacctccggcgacgtcaggaaggaggtgaccggcgtgctgtaccacgaggcgacgcacgtgtggcagtggaacgggcagggcgcggcgaacggcgggctcatcgaggggatcgccgactacgtgcggctcaaggccgggctcgcgccggggcactggaggccgcgggggagcggcggccggtgggatgaggggtacgacatcacggcgaggttcctcgactactgcggctcgctcaagccagggttcgtggcgcagctcaacgccaagatgaagagcgggtacagcgacgacttcttcgcgcagattctcgggaagaacgtgcagcagctgtggcaggagtacaaggccaagtttggaggttgaatggggtaatttagtcattcctccttcacggtgtgatggcatatatagcacactatacatatattgaaataatcagcaagacatgtgctttacgttgtaatgaaatttaaataaagaataaa

SEQ ID NO: 5877 - DNA, 990 bp, Panicum virgatum
tataaataaacagccacgcacaagtagatgatcacagcaggaagcagcaggcttaagatgaagcttgacgtcgccacgttcgcttccctcctggccctggccgcggccgcgtcggcggccggcgccgtcacgttcgacgcgacgaacacggcgtccagcacccccggcggccggcgcttcgaccaggccgtcggcctcggctacgccaagcgggtcctctccgacgcgtccaccttcatctggagcaccttcaaccagcgcagcgccgccgggcgcaagcccgtggacgcggtcaccctcgtcgtcgaggacatcgacggcgtcgcgttcacgagcgccaacggcatccacctcagcgcccggtacgtcggcggctactcgtccggcgacgtgcaggccgaggtgaccggcgtgctgtaccacgaggcgacgcacgtgtggcagtgggacgggcgggggagggcgaacggcggcctcatcgagggcatcgccgactacgtgcggctcaaggccgggtacgcgccggggcactgggtgaagccggggcagggcgaccggtgggaccagggctacgacgtcacggcgaggttcctggactactgcgactcgctgaagccggggttcgtggcgctgctcaacgccaagatgaaggacggctacagcgacgacttcttcgcgcagatcacggggaagagcgtgcagcagctgtggcaggactacaagaagaagtatgggggctgatgtggatagaggtggtccatggtcaacacgtacgtctagtatgacgtggcaaagttgaataaggtgtttgttgcccatctcagtgtactgttgcttactatgctgaatagtaataacgttcaaaatggcttgatgccagtttgtgatgtgaaaaaaaaggaaataaaaggatatatatatgaaataaaaggaaataaaaggatatatatataaaataaagctctcgataaggtattgagcgtggaacaa

SEQ ID NO: 5878 - DNA, 2015 bp, Triticum aestivum
gtgtgtgtcgtctgtgttcggccactccggcgagatgaagctcccgctgtccgtgggggcgcccgacgcggcgccagagctggccaagccgtcgctgccggcgacgtggctcatcctgcacgcgctcttctgcgccacctccatggccgtcggcttccgcttctcccgcctcgtcgtcttcctcctcttcctgcccacgccgcccatgaacccctccgcgcacctcgtctccctcgtcaccccgcccgtcatgctcgccagctccaacgccaccgccaccatcaccactacgacgaccacccaccaccgtcacgacgacgaccacggtggctgagagcgaggccggcgccaacgcgcaccaccaggtccaccacggcccggtcttcgtcggccgccacgccatccgcgtccgcaagtggccgcacccggaccccagcgagctcctcaaggcccacagcatcctcgccgccgtccaggaagcgcagcgccgcagccgcaaccggttggccgacgcgcccaggcccgtgattgccgtcaccccgaccaccacctccgcgctccaggcgccgtcgctcacgtccttggcgcacaccctccgcctcgtcgacgccccgctcaggtggatcgtcgtcgagcctggccaccgcaccgacgccgtcgccgccgtgctcgcccgctccggcctcgacttcctccacctcgtcgcctccgacggcgcctccaccgcgcgcctgcgaatgcacgccctcagggagatacggaaggagaagatggacggcgtggtggtgttcgcggacgagaacggcatcctccggacggagctgttcgacgaggcgcagaaggtcaagtccgtgggcgccgtgcccgtgggcattctgggcgaggacgaaggcaccaaggagtccttcctgcaggcgccggcctgcgacgaggccgggaagctggtgggctaccatgtctcggaggagacgctgctgccggcggcgcggagcgacatgctgctgtccacccggctggagtgggccgggttcgtggtgaacgcgcgggtgctctgggagagcgcatcagagcggcccgagtgggtgcgcgacctggacgccgtggacggcggcgcgcacctggacagcccgctgggtctggtcaccgacgccggccaggtggagccgctcgccagatgcgcccaggcggcgctggcgtggtcgctccggtcagacgctctgcatgaagtcaagttcccgcacgagtggaaatttgatgctcctctagtaagcgccgcttcgcgtcagcagagcagcgtagtaaatactgaagatggtcactagagcagcaaaatttttgtgggcaatagaaatcagggcaaaatcagactgctacggctcgtctgatttgtgtgagtctcctctgatgcatccttgtaccaagacatctcaactcttgagtaacataaggcagctcagctcatttgttgggaccctacagaaagtcacagaccatacatctgaatccatgttctgtatcatcctgtaaaaatagataaaaaaagtttaattatatgcaccattcatggcttctctaataggaagagttctcttaggcgcattgttttcgtgtaatataggtcagagctgatgggctcgccaaattggtctggggttaagacatttgtttgtgtaatggtgtgaaataataacgatccagctctcagttttctaatactccctttgtcctacaatgcaaggcgattttgcaagttatgttgcttgcaaaaacgtcttatgttatgggatggaaggagtactatatacatttttttcttttatataaagaggaggcaaacgatctgcctgcttttcattagttaaggagagtgaaacagagtatcatgagttaaacacattggaggttggaggttgtaattctatttcatccgtcttggacccagtcaggaattttctgaggaagttttcaaaatattttctgaacaatatagatttatacggaggaaaaggttctct

SEQ ID NO: 5879 - DNA, 1774 bp, Avena sativa
gaggagatctcgctgtgttctctccggcgacatgaagctcccgctgtcggcggggtcgccggacacggcacccgagctggccaagccgtcgctgcccaccacctggctcatcctgcacgcgctattctgcgccacctccatggcagtcggcttccgcttctcgcgcctcgtcgtcttcctcctcttcctcccggccccgcccatgaacccggccgcgcacctcgtctccctcgtcacgccgcccgtcatgctcgccagctccaacgccaccgccaccatcaccaccaccacaaccacaacaaccacagtcaccaccaccaccacggtggccgagaccgaggccttcgccaacgcgcaccaccaggtccaccacggccccgtcttcgtcggccgccacgccatacgcgtccgcaagtggccgcacccggaccccaccgagctcctcaaggcgcaccacatcctcgcagcagtccagagcgcgcagcgcagcacagccgccgcgggtccggaccgcccaggccagtcatcgccatcaccccgacaaccacctccgcgctccaggcgccgtcgctcacgtccctggcgcacaccctccgcctcgtcgacgcccgctcatgtggatcgtcgtcgagtctgggccaccgcaccgacgccgtcgccgacgtgctctcccgctccaccctcgaattcctccaccttaccggccccgtcgaggcctcaaccgcccacctgcgaatgcacgcactcagggagataaggaagcagaggatggacggcgtcgtggtgttcgccgacgagaacggcatcctgcggacggagctgttcgacgaggcgcagaaggtgaaatccgtgggcgccgtacccgtcggcgtcctgggcgaggacgaggggaccaaggagtcgttcctccaggcgccggcctgcgacgcggaagggaagctggtgggctaccacgtgtcggaggagacgctgctgccggcggagcggagcgacatgctgctgcagagcaggctggagtgggccgggttcgtgctggacgccagggtgctctgggagggcgcggcggagcggccagagtgggtgcgcgacctcgacaccgtcgacggcgccgcgcacctcgagagcccgctcgcgctggtcaccgatgccggccgcgtcgagccgctcgccggctgcggccaggccgcgctcgcgtggtcgctccggtccgatgccctgcgcgaggtcaaattcccacacgaatggaaatttgatgctcctcttgtaaatgccgcttcacgtcaactgggtgtagtaaatactgaagatggtcattagagagcaaaatttttgtggacaatagaaatctgggcaaaatcagaccgctatggcttgtctgatttgtggagcctctactgatgcctatgtgcttccttgtaccgagatatctcaactcttgagtaacacaaggcagctcagctcagctcagccagtttgttgggactccacagaaagtcacaggcgatacatctaaatcaccactcatgttctggtatcatcataatgtaaaatagaagttaaaagaaagtttaattatatgcaccattcatcgctgctccagattgtaggtttctgtaggcgcattgctttcgtgtaatataggtcagagcagaggcggtcgagaaactggtctggggacggggttaagccatttgattgtgtaattgtgtgaaataagaaagattcagctctagtttttctcatacagtatatatgtatacaatttccctgtacg

SEQ ID NO: 5880 - DNA, 2093 bp, Brachypodium distachyon
tgctgctgccaactgccgaattcccagagtaaaccccacccccgttccatccccacctcaccatccaccacctgcgccctcttttacttatctcctcctaataattgccttcttcctcgctttcccttcccttccccggccccggcctcacctcgtcctcctatcccccaccttctcttataccacacttcccccgccccgctcctagccaaagccaaacccaacctgcaaccagcaacccagccaaagtctgccccccggcccggcgagcttacgagacgaggatgaagctcccgctgtcggcggggtcgcccgacgcggcggcgctgccggagtcggccagcaagccgtcgctgccggccacgtggctgatcctgcacgcgctcttctgcgccacatccatggccgtcgggttccgcttctcgcgcctcgtcgtcttcctcctcttcctcccgaccccgcccatggaccccgccgcgcacctcgtgtcgctcgtctccccgcccgtcatgctcgccagcgccaacgccaccgccgccaccatcaccaccaccacgaccaccaccaccaccgtcaccaccaccaccacggtcgccgaggcgcatcacgaccacggccatgtccaccatggccccgtcttcgtgggccggcacgccatccgggtccgctcctggccgcacccagaccccgccgagctcatcaaggcgcaccacatcctcgccgccgtccaggacgcgcagcgcagcagcagaagacgcggggcggagccggtgaggcctgtgattgctgtcaccccgactgccacttccgcgctccaggcgccgtgcctgacttcgctggcgcacacgctgcgcatcgtcgatggcccgctcttgtggatcgtcgccgagcctggccaccgcaccgacgccgtcgccgccgtgctctcccgctccggcctcgacttcctccacctcgctggccccgccggcgcctccaccgcgcgcctgcgaatgcacgccctcagggagatacggaagcagcggatggacggcgtggtggtgttcgcggacgagaacggcatcctccgcacggagctattcgacgaggcacagaaggtgaaatccgtgggcgccgtgcccgtcggcatcctgggcgaggacgaaggcaccaaggagtcgttcctccaagggcccgcctgcgacgacgccgggaagctggtgggataccacgtctcggaggagaccctgctgccggcggagcggggcgacatgctgctgtcgagcaggctggagtgggccgggttcgtgctcaacgcgcgggtgctctgggagggcgcgccggagcggcccgactgggtgcgcgacctcgacgccgtcgacggcgccgcgcacctcgacagcccgctcgcgctcgtcaccgatgccgcccgcgtcgagccgctcgccaagtgcgcccaggcggcgctcgcgtggtcgctccgctccgatgctctgcacgaagtcaaattcccgcatgaatggaaatttgatcctcctctggtgaatgccgcttcgcgtcaacagagcgtagtaaatactgaagatggtcactagagaacagaaattttgtgaacaactgaaaatcagagctatgggccgcctgctttgtgaagcctccaccgatgcatctgtccctcgctggtgccaagggctctcaacccaagtaacagaaggtagctcggctcagctcagctaatgtgttgggagtgcagaaagtcacagacgatacatctataaatcagcaagcatgttttgtatcatcatcgtataaaatagttacaaaaaaaagtttaattatatgcaccattcatcgcttctccattaggtagatattttaggcgtatttcttttgtgtaatatatagatcagggcaggggctcgcggaattggtctgggggttaaggccgttttgttcgtgtaattgtgtgaaataataatgatccacctcatttggtgacggcgttttaccatgtatccagagtgtaccgacgttgctcagaaaaacagagcatgtgacggtatcaggttttgcgcccaaaatgaaaatgtggtcggtgatggttatggtgctcc

SEQ ID NO: 5881 - DNA, 2628 bp, Secale cereale
gactaactagccccggatagagagataagagggccgttgggaatggtgatcaccgcggccaggtcgtgtcagccgagaagatagccgcgaagagggtcttcctagcggagagagggccaagaatggcggcgctggccgccaccgctctcgtcggcctcctcctcgcccttgcgccggtggtcggggccgataccgacgccgccggcgttgcggctctgggggacctctacacctcctggaacagcccggctcagctcgtcggctggtcggcggccggcggcggcgacccctgcggcgccgcctggatgggcgtctcctgctcaggctccgccatcacctcaatcaacctttctggtatgggattgaatggcactcttggctacctactgtccagtctagtggcactgacaacgatggacttgagtaacaacagcttgcatgatgtaattccgtatcagctgccagcaaatcttatccatctgaatttggcgagaaataacttttccggtaacctcccatactctatatccaacatcttatcacttggctacctcaatctcagtcacaactctctgttccaggaaattggcgaactattcgggggcctcaattcgctttctgtattggatttatctttcaacaacttgtcagggaatcttccagtttcttttgtctctttgtcaaatctttctagcctctatatgcaaaataatcaactatcaggcacagtcaatgtcctcagcaacctaagccttaccacactaaatatagcaaacaacaacttcagtggcttgatacccggggaactcagctcgattccagacttgagcgctggagggaactcatttatcaatatgcctgcatctccaccaccagttatcatgccaccgtctcagagtccggttgctcagccagaccgtcctcaagtaccaacaacttttccaaatggccccgaggaagatatccctatcgatgaaggtgacaagaagcaaggccggcaaacaggtcttcttgtagggttggctgttgggtcagtggctgctgcttcatgtatacttttcgcgttggtgttctgccttcacagtgtccataaaagaaaggatggtggtaccggtgaaccgaaagactttgtaggtgctcttgcagtgaacatagacagagattctaacaacaacatccatcaagactctcctgtcgcagcttcagtgctccagcggcctattggcactcctgagagggcgtatggtgtaaatagttctccagcaaagaagataaaggttcctggtgcggcgacttcttatactgttgcttcgctccaagttgctacaaacagcttctgtcaagataccctactcggtgagggttcacttggtcgtgtttacagggctgatttccccaatggaaaggtacttgcggtgaaaaagatagacagtgctgccctttccttgtatgaagaggatcattttcttgaggttgtatcaaacatttctcggctaaggcacccaaacatcgtgtcgcttacgggctattgcgctgaccatggccaaaggcttcttgtatatgagcacatcggaaatggaacattgcacgaaatgttgcacttctctgatgaggcgagcaagagccttacatggaacgcccgtgtgaggattgcgctgggcactgctcgagctttggagtacctgcatgaggtgtgccttccccctgttgtacatagaaaccttaagtcatcaaatatcctgcttgatgaagagtacagcccacatctgtctgactctgggcttgctgccttttcaccaaatcctgagagagaggtttcaacggaggtgcttggctcacttggctacagtgccccagaattcgccatgtcaggaacacatactgtaaagagtgacgtgtacagttttggagtagtgatgttagagctacttacgggccgtaagccgctagacagatccagggagaggtcagagcagtcccttgtcggatgggcaaccccgcagcttcacgacatcgatgcgctcgccaagatggttgatccagcaatggatgggatgtaccctgcaaaatctctctcccgtttcgctgacataattgcactgtctgtccagccggaaccggagttccgtccaccgatctccgaggtcgtccagcaacttgtgcgtctgatgcagagggctagcatgttacgacgacaatcgggagacgatctggggtcttcgtaccgtgccccggagcgcgaaggaggcgcgtcggacgccgtctgaggccaaacctcctgccagccataaaccagagctgtatcagaacatatcattttgtgagtattagtatgtgttcagtttttactccattttctgtctggtatttcaggagcttcagcttatctgtctgtaccaaatacactgggaattttgtgaacggcttgtatagatataggattctcttctgttgatcagttgtagataaaaaaggaaaggaaagggagagaaaaggatttgtgacaagttgaatcctcactcctctgtcagacggcacctgtgtgtgccttgcccatgtggagccgtcgctgattcgcggtcgtagtacacgtcgctagtcttgctacgtcctaatatacattttacc

SEQ ID NO: 5882 - DNA, 3498 bp, Brachypodium distachyon
agggagggtatggggagagggactaatccttgccgacgccacactgcatctatctcctgcctggagcaagcatggcatcgagcacttgcttcaagtccttccccatatattagccagctagctgtcccggctggatagatagaggagagagtgggggagaagcatgggccattggccatggtgatcaccgtcattccgtcaaacaccttgctcgtgtgatgtcctcggagcactagaagagggtttcttttttccataggggagaggaatagagggaggagcgcaagaagggaagggggatgaaggagggagagaggtcaagaatggctgcgccggccgccgacgccgctctggccggcctcctcctcgccctcgtgacggtggtcggagccgacaccgacgcggccgacgttgctgctttggtgaatctctatacctcctggaacagcccggcgcagctcaccggttggtcggccggcggcggcgacccctgcggcgccgcgtggatgggcgtctcctgctcaggctctgctatcacctcaatcaacctttctggtatggggttgaacggtactcttggttaccaactgtccgatctagtagcattgaaaacgatggacttgagtaacaacaacttgcatgatgcaattccttaccagttgccacctaatcttacttatctgagtttggcaagcaataacttttctggcaaccttccatactctatatccaacatgttatcacttgtctacctcaacctcagtcacaactcgctgtttcaggaaattggtgaactatttggaaacctcaattcactttctgaattggatgtatctttcaacaacatgtcagggaatcttccaatgtcttttatctctttgtcaaatctttctagcctttatatgcaaaataatcaactatcaggcactgtcaatgtcctcagcaacctaagccttactacattaaatatagccaacaacaacttcagcggcttgatacctggggaattaagttccattccaaatttaacacttggtggaaactcatttatcaatatgcctgcatctccaccaccaactctcatgccaccgcctcagagtccacttgatcagccagaatatcctcaagcaccaataagttttccagatcgtcctcagattcctaataatcaaggtcggaagaagcaaggtctgcaaacaggtcggctcataggggtggttgttggttcaatagctgctggctcatgtatactttttgtgttggtgttctgccttcacaatgtccatagaagaaaggatggtgggagcagtgaatcaaaagaccatgtaggttcccttgcagtgaacatagacagaggttctaacagggaaatcttggacaagagccatcaagatgcttctgtagcaacttcaacactcccgcagcctactggaaaaatgactcctgagagggtatatggtacaaatggttctccagcaaaaaagataaaggttcctagtgccgcgacttcttatactgttgcttctctccaagttgctacaaacagcttctgtcaagattcccttctaggagagggttcacttggtcgtgtttacagggctgatttccccaatggaaaggtacttgctttgaagaagatagacagtgctgcactttccttgtatgaagaagatcattttcttgaggttgtgtccaacatttctcggcttaggcacccgaacattgtgtcgcttacgggctattgtgttgaacatgggcaaaggcttcttgtgtatcagtacattggaaatggtacactgcatgatttactgcacttttctgaagaagcgagcaagaaccttacgtggaatgcccgtgtgaggatagtcctaggcactgctcgagctttagagtacctgcatgaggtgtgcctgccccctgttgtacatagaaacctaaagtcatcaaatatcctgcttgatgaagagtacagcccacatctgtctgactgtgggcttgctgccctatcaccaaatcctgagagagaggtatcaactgaggtggttggctcttttggatacagtgccccagagtttgccatgtcaggaacatacaccgtaaagagcgacgtgtacagttttggagtagtgatgttagagctactgacaggccgtaagccgctagacagatccagagagaggtcggaacagtcccttgttgggtgggcaaccccgcagcttcatgacattgatgcgctcgccaagatggtcgatccagcaatggatgggatgtatcctgcgaagtccctctcccggttcgcagacataattgcattgtgtgttcagcctgaaccggagttccgtccaccgatgtcggaggttgtccagcaactggtgcgcctgttgcagagggctagcatgctaagacgacaatcggcagaggatctgggatcttcgtaccgtgcccccgagcgcgaaggcggaggtgcggcatgggacgcattctaagaccaaactcttgtcacctatagtagtactccataatacaggaggtcaagcaagaagaatacaatacaccgtccagcgattttcatctggtatttatccgtgaggttggttatctattttgaactgctgagaattttgtgatttgcatgtgcagaattactccctccgtctcatattaagtccgttccatatcaagtgactcaaatttgtccaaatatatatgtatctatgcctaaaaaatatctagatacatgtaatataaagtcacttaatatggaacatagggattatctattacgacgattggtctgattgtgtatatgtatgtatataaaaaatgcaagaagaagacggggtatggactgatttgtgcgtcgtgaactcgtgatcaataatggtgaacacctgggtgaatgctggcagacagcgacttggggggctctccggcggctgtgccttgtcagcaaggcatgcttggctgattcgctagggcatcggcgaacgtagccggagcccgtgcccgccgattgcgtggtaacgtcgaaatgctttggcagcgactcgctgatgctgacggttgtgcgcgtcaggtggttgcgttggacgtctggagtctggtcactagtagaactagaaaagctttgtccatcgcatgcaagcaaagccgatgttatcagccggtcagccctatgggcgacgacgcgacgtcgcatggctttgtcaatgactcgttgatggatgctgaagattaatcgtcacgtcgacaccgatgagttattgtgttccaggaccagtgactagtcacgagttcactagtcaccggaaaagcaaacgattccttctctctttttcgacagtacgattcctttcgagtttgaagcaagaagagtcagggcctgttcaatagtaccctgtaccaattctccagattggtagtacatgttgtttttagaggtaggagtaattgcaatgcacatacataaacttttggcagtaatacagtgcaatgcaa

SEQ ID NO: 5883 - DNA, 4298 bp, Secale cereale
ctgggacacgtcgtcgaacaagccgaggtggtatacctacgacagaatcgaacgtagggtacctattggaaccggtcggaccgttaacagtgagcagaaacggccgtgatgctgcaacaggcatccgtctccttaccccgtgcacttcgaatttctcttctccgacgaaaaccctagttcagttaggaagggcaaggggaactaggaggtggggaagacatggcggccgcggcggcctccgttgggcacagcagcagaggcggcggtgggcggatccatcggctggaggtggagaattttaagtcatacaagggaacgcagaccatcggccccttctttgacttcacggccatcatcggtcccaatggcgccggcaagtccaatctcatggacgccatcagttttgtgctcggcgtccgctccgcgcacctccgtggcgcccagctcaaggacctcatctacgccctcgacgaccgcgacaaggaggccaagggtcgcagggcctccgtacgcctcgtctacaacctcccaggcaccggcggcgagcttcaattcacccgcaccattaccggcgccggtggcagcgagtaccgtatcgatggccgactcgtcacgtgggacgactacaacgccaagctcagatccctcggcatcctcgtcaaggcccgcaacttcctcgttttccagggtgacgtggaatccattgcctccaagaatcctaaggagctcactgcacttctggagcagattgccggctctgacgagctcaggagggagtacgacgaattggaggaacagaaaaccagtgccgaagagaaatctgcacttgtctatcaagagaaaaggaccatcgtgatggagaggaagcagaagaaggcgcagaaggaagaggcagagaagcatctgcgtttacagcaggacctgaaactgttaaaaacagagcatctcctatggcaactctacagcattgaaaaagacatggaaaaaatagaagccgaacttgaggatgatagacgttctcttcagcaagtgcacgaagataatcaatcctctgacaatggacttgctgcaaaaaggaaggagcaaagtgcatttctcaagaaaattacgttatgcgagaagagtatgtccaagaaaaagcttgatattgacaaaaagcaaccagagctccttagattgaaagagcaaatatctcggctcaaatctaaaatcaaaagctgcaacaaagagattgacaaaaagaaggatgataacaagaaacatttggaagagatgaaaaggctgcagagtgctttggctgatgtcacaagtgctattgaggagttgaacgagcaaggccaagatgaaggagtgaaactgcaattagccgatgaccaagtccaggaatatcatagaatcaaggaagatgcaggaatgaggacagcaaagctgcgagacgagaaggaagtattagacaaagagctaaatgctgatattgaagccaaaaagaatttagaggagaatatgcaacagctgcgtagccgtgttgatgagatatcatcacaggagagtgaattgcagacaaagcttaataagattcttcattcaatccccaagcatgaagatgagcttacacgtttacgtgaggatcataacaagattgcaaaggaacgccaatcttcaggagctaagtatctgacattgaagcagaaggtggatgagatagatacgcagttacgtgaactcaaagctgtgaagcatgaaagtgagcgggatgctaggttttcagaaactgttaagagtcttaagaggctattccctggagtccatggtcgcatgactgaactttgtcggccctcacaaaagaaatacaaccttgctgtcactgttgccatgggaaaattcatggatgcagtagtggttgaagatgaaagcacaggaaaggaatgcattaagtatttgaaggaacagcgtcttcctccacagacatttattcccttacaatcgattcgtgtgaagccaataaccgagaggttgcgtacccttggaggatctgcacagttgatctttgatgtgatacaatttgatcgagctttggagaaagcagttctgtatgctgttgggaatacacttgtctgtgacaaacttgatgaagctaaaactctaagttggagtggtgaaaggtacaaggtcgttactgtcgatgggattcttttgactaaatctggcacaatgactggtggagtaagcggtggaatggaagctagatcaaataaatgggacgacagcagaatagaatctttgaagaagaagaaaagtaagctagaggctgaaatgtcggaacttggttcccccagggagttgcagagaaaggagcttgctgtatctgagaaaataactggactcgagaaaaagttacattactcgaatgtcgaacagaataatctcaaggagaagctacacaaattggcatctgagaaacgtaatattgagaaagaaattgatcatctggagccaggaaaggaggagttggaaagccgtcttgctaaaaacgaacgggaagtaagaaagcgggagaaaaaaataaatgagatagtcgacaggatttacaaggattttagcacgtcagttggtgtgaagaacattcgtgaatatgaagaaaagcaactgaaagatgctcaagcactgcaggagaggaagctaagtctgagcaatcaattatcgaaactgaaataccagctggaatatgaacaaaagagagatatgcatgctccgattgcgaagttaaacaacacacacgagaccctagagaaggagctgaagggcttgcaggagagagaaactcgtgctaaggctgatgctgaacatatttcaaatcagatggaagagctgaaggctgaggctgaagactggaagttgaagtcagatgaatgtgagacaacaattgaggaactaaagaaacagaatgatagtgttgctgatgcattggcaaagctggatcgccaagtgaagttaaaggagggacagatagttcaacttagatcacgccaacgtgatattcatgagaagtgcgaactggagcagttaaagcttcctacagttaatgatccaatggacactgggtcatcctcacaggaacttgtgcttgattacaaccagcttagtgaaatctacctgaaagaagtgcggctgtctgaccgtgacaaacttgaggcagagttcaaacaaaaaatatgtacactaatggctgagattgaacgcactgctccaaacttaaaagcactggaccaatatgaagcacttcaaatgaaggaaaaagaggtgagcgagaagtttgaagcagctaggaaagaagagcgagaggtagccgacaagtataactctgtcaagcaaagaaggtatgagctgttcatggaagcctttgatcatatatctaaaggcatagacaaaatctataagcagttaacaaaaagtcacacgcatccacttggaggaacagcatatttaaatctagaaaatgaagatgagccatttcttcatggaatcaagtacacagctatgccacctacgaagcgctttagggatatggaacagttatccggtggggagaagactgttgctgcactggcattgctttttgccattcacagtttcaggccatcaccattcttcatactggatgaagtcgatgcagctctagataatttaaatgttgccaaggttgctgggtttattcgatcaaagtcatgcggaagtgctggaagtgctggcgaagagcaagatggtgatggaggttgtgggtttcagagtattgtcatatcgctgaaggatagcttctacgacaaagctgaagcactggttggtgtttatcgggactcagaaagaagctgctccagaaccctcacctttgaccttacgaagtataaagaagcatgaaatccactccggttggagtcttcctacgtgttaatctgtgatagtgacagttatcgtcaactgattctgtatttcaactcgtgtatatgattagtggcatgtagttaatgtagaaacagcacaagactgcagtaccattagaagttatatgtgattttgtgtccttgtatgttctgtctgcaagaattagttgatgggcatatatcaccgcaccagcatgcgggaatgccgtgttcttcatctcctctggctggcgcttaggcatgtttggaccccaagcgatggccaaatgtcttcccaggcaaacaagagattgcgtaattcgacaagaaatcttgccatatcgcaatgacatgtcaaatgaggcatattgcaatagatag

SEQ ID NO: 5884 - DNA, 4232 bp, Sorghum bicolor
tgggcaccgagggccgacgaccgctttgtgatgggccgtccgctcttctggccctcttgcctcttcacagcgctcccttcgtcgtcttcgtccccttgctcgacctcccgtccgtttcccggtttccgaatgcccactccgaccaaaaccctagctgcttcgtgaaggcggaggggaggagatggcggcagcggatgggagcggcggcgactaccgggccaggggcggcggcgttggcggtcggattgaccggctggtggtggagaacttcaagtcgtacaagggcgagcagacgattgggcccttcgtcgacttcaccgccatcatcggccctaacggcgccggcaagtcgaacctgatggacgccatcagcttcgtgctgggcgtgcgctcagcgcaccttcgcggcgcgcagctcaaggacctcatctacgccctcgacgaccgcgacaaggaggccaagggccgcagggcttccgtccgcctcttctaccgccaatccaaccaggaggagctctgcttcacgcgcagcatcaccggcggtggcggcggcagtgagtaccgcatcaacggcagcccagtcacctgggaccagtacaacgccaagctcagatccctcggcatcctcgtcaaggcccgcaacttcctcgtctttcagggtgatgtggaatccatcgcctccaagaaccccaaggagctcaccgctctcctggagcagatctcaggctctgatgagcttaggagggagtatgacgagctggaggagcagaaagccagggccgaagagaagtctgcgcttgtctatcaagagaaaaggaccattgtcatggagcggaagcagaagaaggcacaaaaagaggaggcagagaagcatctacgccttcagcaggacctgaaactgttgaagacagagcattacctttggcaactctataccatcgaaaaagacatcgagaaagttgaagctgagcttgtggaggatagagagtctcttcagcaagtgcaggaagagaatcgatccagtgactatgaactgactacaaaaaagaaggagcaaagtgtatttctcaagaaaatgacagtgtgtgagaggaatatagccaggaaaaagcttgaatttgacaagaagcaacctgagcttcttaaattgagagagcaaatatctcggctcaaatcaaaaatcaaaagttgcaagaaagagattgacaaaaagaaggatgatcacaaaaaacatctgggagagttgagaaggctgcaaagtgatctggttgaggtcacagaagctattgaggaattgaatgagcaaggacaagataaaagtggaaaactgctattagctgacgaccaactccaggagtatcatagaattaaggaggatgcaggaatgaagacagcaaagctaagagatgagaaggaagttatagacaaaaaattaaatgctgatgttgaagcaaaaaagaatttagtggagaacttgcagcagctggaaagccgcaaggacgagatatcatcacaagagcgtgaactgcagacaaaacttaacaagattctccattctatccccaagctagaaaatgagctcacacacttgcatgaggaacacgacaaaattgcaaaggaacgccaaacttcaggatctaggtaccaaaatctgaagcagagggtggatgaaatagaaacaaaactacgggagcttaaagctgacaagcgtgaaaatgagcgtgatgctcgattaaaagaaactgttgtaactctaaagcggctattccctggagtccatggccgcatgcttgaactttgcaggccctcacagaagaaatataatcttgctgttactgttgccatggggaaattcatggatgcagttgtagtggaagacgagaacactggaaaggaatgcattaagtatctgaaggagcaccgggatcctccacagacatttattcccttgcaatcagttcgtgtgaagccaataattgagaagctgcgaactcttggtggatctgcgcagcaatctcttgttgataaagctcctctactgtatttgctaaaagatgtgaatgcatctgtcagtagggaaagatttgtgtttccatgccttgaaacatttttggagaaagcagttctgtatgctgttggaaatacacttgtctgtgataaacttgatgaagctaaagccttaagttggagtggtgaaaggtataaagttgttactgttgatgggattctgctgactaaatctggaacgatgactggtggaacaagtggggggatggaagctagatcaaacaaatgggatgacagtgcaatagaatctttgaagaagaacaaaaataagttggaaactgaaatgtcagaacttggttcccccagggagctgcagagaaaggagcttgccatatctgagaaaataactggacttgagaaaaagttgcactactcgaatgttgaacagaataaccttagagggaaactagctaaattagcatctgagaggagtaatattgaggcagagattaaacgtctgaagcctggagaggaggagctcgagacccgtattgctgagagggaagcagaagtaagaaaacttgagaaaaaaattaatgacattgtggacaaggtgtacagagattttagcatttcagttggtgtgaagaatatccgcgagtatgaagaaaggcagctaaaagatgttcaggcactacaggagaggaagctaagcctaagtaaccaaatgtcaaaattgaaataccagcttgaatatgaacaaaagcgagatatgcaggcaccaattgtgaagttaacggagacacatgagtccctagagaaagagctgaagggcttacaggagagagagtctggtgctaaggctgaagagaaacacattttgactcagatggaagaactgaagactgaggctgatgactggaaagccaagtcggacgaatgtgagaaggttattgatgaattaaaggagcagaatggtaatgttgcatctacattggcaaagctggatcgccaagtgaaatcaaaggaggcacaacttgcacaacttatatcacgccagcgggaggttcatgagaagtgtgaacttgaacagttgaagcttcctacagtaaatgacccaatggataccggaacatcctcacaagaaccaatccttgattacagccagcttagcaaaagccatctgcaggatatacgaccttctgaacgcgacaaacacgaggcagagttcaaaaaaagaacaggtgtgctactggctgatattgagcgcactgctcctaatctaaaagcactggatcaatatgatgcactccaaagaaaggaaaaggaggttactgaaaggtttgaagcagctaggaaagaagaacgagagatagctgataaatataactcagtcaagcaaaggaggtatgagctgtttatggaggcctttgatcacatatctaaaggcattgacaaaatctataagcagctgacaaaaagccatacacatccacttggaggaacagcatatttaaatctagaaaatgaagacgaaccatttctacatggaatcaagtacacagctatgccacctaccaaacggtttagagatatggaacagttatctggtggggagaagactgttgcagcactggccttgctttttgccattcacagtttcaggccatcaccgttcttcatattggatgaagtagatgctgctctagacaatttaaatgtggccaaggttgctgggtttatcagatcaaaatcatgtgaccgtgtcgctgatgaacaaggcagtgatggagcatgtggttttcagagcatagtcatatcactgaaggatagtttttatgacaaggccgaagcacttgttggtgtttatagggactcagaacgaagttgctcgagcactctcaccttcgacctcagaaagtatagggaagcatgaaacaacttttgttggatatatatatagttgccactgtatgtgattgcttttttttagataaagaactgtatgtgattgctagctagctgtcgtgaaccttagacgttttaactacttgtgtacatagtcgcgtaagctattagctgaacaggacacttgaatattcctgattcatgtggtaggttttatggcttgatgtttccaacatgcatgtacctttttacctattaattattatttatccccacggttcgcccaacatcaagtgcagtggctcccagaatttggt

SEQ ID NO: 5885 - DNA, 1911 bp, Triticum aestivum
ggcgccggaagtcgtatctggtgtctctggagcatctgaggaaaatatcagagtcttgtttaagaaggcgtacagaactgctccctcaattgtatttatagatgagatagacgcaattgcatccaagagggagaatttgcaacgtgaaatggagcgacggatagttacacagttaatgacatgcatggatgaattccaccagaatgttggatcggatggtggtgagttggactcacaatcatctgaaaagaagcctggctatgtcattgtcattggagctaccaataggcctgatgctgttgaccaagcgcttcggagaccagggaggtttgatcgagaaatatctcttggtgttccagatgagattggacggaaacagattttgaagatgcttactcagaacctaacactggagaaagaccaatttgacctgttcaagatagcaagggctaccccaggatttgttggcgcagacttgaaggcattggtagataaagcagggaatctggcaatgaagagaataattgttgaaagaaaaaaacagagtggtgggggtgatgtaaacaacaagcaggactggtggcgacatccctggagtgaaggtgagatggacagcctatgtatcactatggatgactttgaggaagcggccacaatggttcaaccatcattgagaagggaaggattttcttctgtgcctgacgtcacatgggaggatgttggaggtcttgattcgttaaagaaagaatttgaccggtgcattgttcgttgtatcaagcaccctgaagtttataaggatttcggagtgaacatgcaagctgggtttttgctgtttggacctccaggctgtgggaaaacactaatagcaaaagcagttgcacatgatgcaggggcaaattttattcacattaaggggcctgagctactgaacaagtatgttggggagagtgaatcagaagtaaggaagatattcacccgtgcaaggattaactccccatgcatcctattttttgacgagatagatgctctgacaacaaaaagagggaaagagggaggatgggttgttgaacgtctcctaaaccagttacttgttgaactcgatggtgctgatcagcgtcatggtgtttatgtcattggagctacgaacagaattgatgttatagatgaggctgtcctacggcctggcagatttgggaagaaacactttgtacctttacctggtgctgatgagcgggttgcgatattgaaagcacatactgaaaagaaaactctttcggtagatgttgatttgaacgcaattgcacgtcgagaggagtgcaataatctcactggtgccgacctggcatcactggtgaacgaagcagccatggcagcattggaggagaggtgcgaattcctggcgaaaggggactcgtcaatgagtactgacttgactaataagattaaactgcggcactttgagcatgctctctctaaagtaaagccctcggtatctgaacagcaaaggaaacacttcgacgcgctgtcaaagaaatattcggccaactgatccgccatcgtcattgtgcttacgaggaccatactgcagttttgcttttttgttttcgctcatatgatagcttagtgtagagattgcgtgggcgactctacactaaagctatacaattttggtagtgaggaacttgttttcggtgtctggaaaatatgaactcgttatgctttgttgtacgggcttcgactggtagcgaccccctttgtaatgttgcaaaatgcaaatcgaagaataattgaggagctttctgtgaactgcgaacattttcgaccaatgcacgattcttccgtccattggagatggatgcaaggctgggggcattttttggatggcgcagtgaagaatgggcgtatcatttt

SEQ ID NO: 5886 - DNA, 1648 bp, Triticum aestivum
atgacatgcatggatgaattccaccagaatgctggatcggatggtggtgacttggactcgcaatcatctgaaaagaagcctggctatgtcattgtaattggagctaccaataggcctgatgctgttgaccaagcgcttcggagaccagggaggtttgatcgagaaatatctcttggtgttccagatgagattggacggaaacagattttgaagatgcttactcagaacctaacactggagaaagaccaatttgacctgttcaagatagcaagggctaccccaggatttgttggcgcagacttgaaggcgttggtggataaagcagggaatctggcaatgaagagaataattgttgaaagaaaaaaacagagtggtgggggtgatgtaaacaacaagcaggactggtggcgacatccctggagtgaaggtgagatggacagcctatgtatcactatggatgactttgaggaagcggccacaatggttcaaccatcattgagaagggaaggattttcttctgtgcctgacgtcacatgggaggatgttggaggtcttgattcgttaaagaaagaatttgaccggtgcattgttcgttgtatcaagcaccctgaagtttataaggatttcggagtgaacatgcaagctgggtttttgctgtttggacctccaggctgtgggaaaacactaatagcaaaagcagttgcacatgatgcaggggcaaattttattcacattaaggggcctgagctactgaacaagtatgttggggagagtgaatcagaagtaaggaagatattcacccgtgcaaggattaactccccatgcatcctattttttgacgagatagatgctctgacaacaaaaagagggaaagagggaggatgggttgttgaacgcctcctaaaccagttacttgttgaactcgacggtgctgatcagcgtcatggtgtttatgttattggagctacgaacagaattgatgttatagatgaggctgtcctacggcctggcagatttgggaagaaacactttgtacctttacctggtgctgatgagcgggttgcgatattgaaagcacatactgaaaagaaatctctttcggaagatgttgatttgaacgcaattgcacgtcgagaggaatgtaataatctcactggtgccgacctggcatcactggtgaacgaagcagccatggcagcattggaggagaggtgcgaattcctggcgaaaggggactcgtcaatgagtactgacttgactaataagattaaactgcggcactttgagcatgctctgtctaaagtaaagccctcggtatcagaacagcaaaggaagcatttcgacgcattgtcgaagaaatattcggccaattgatccaccgtcgtgcttacaaggattatactgcatttttgttggtttgcttttgcgcatacgttagctcagcgtagagattgcgtgggcaactccactgaagctatacaattttggtagcgaggaacttgttttcggtgtttggaaaatatgaactcattatgcttgttgtacggctatgactggtgcttgatgaagcagtccctttgtaatgtttcggaacacgaagaaacgttgcgtgaactgtgaacattctttatcaattcacaattctctc

SEQ ID NO: 5887 - DNA, 2245 bp, Secale cereale
accaaggccatgctccgcacgcgctacgcctccctcacgcccaggaaggagcccgccgcagccgcggctgcggccgccagccagcagctcgagatcgagctcgactcggagaagccccgcggcgcgtcacgaccgacggcggcggcgctggcgaccccaagcaggaggcaggggccagcgaaggaggtggcggtggaggggcgaaggggccccggttttctgatctcggagggatgcagtccgtaattgacgagctgatgatggaggtggtggttcccctgtgccacccggagctgccgctgcggctcggggttcggcctgtggcggggattctgctgcacgggccgccgggctgtgggaaaacaacgctcgcccacgcaatcgccaacgagactggtgtgccgttctacaagatatcggcgccagaagtcgtatctggggtctctggagcttctgaggaaaatatcagagtcttgtttaagaaggcgtaccgaactgctccctcaattgtatttatagatgagatagacgcaattgcgtccaagagggagaatttgcaacgtgaaatggagcggcggatagttacacagttaatgacatgcatggatgaattccaccagaatgttggatcagatggtggtgagttggactcgcagtcacctgaaaagaagcctggctatgtcattgtcattggagctaccaataggcctgatgctgttgaccaagcgcttcggagaccagggaggtttgatcgagaaatatctcttggtgttccagatgagattggacggaaacagattttgaagatgcttactcagaacctaacactggagaaagagcaatttgacctgttcaagatagcaagggctaccccaggatttgttggcgcagacttgaaggcgttggtagataaagcagggaatctggcaatgaagagaataattgttgaaagaaaaaaacagagtggtgggggtgatataaacaacaagcaggactggtggcgacatccctggagtgaaggtgagatggacagcctatgtatcactatggatgactttgaggaagcagccacaatggttcaaccatcattgagaagggaaggattttcttctgtgcctgacgtcacatgggaggatgttggaggtcttgattctttaaagaaagagtttgaccggtgcattgttcgttgtatcaagcaccctgaagtttataaggatttcggagtgaacatgcaagctgggtttttgctgtttggacctccaggctgtgggaaaacactaatagcaaaagcagttgcacatgatgcaggggcaaattttattcacattaaggggcctgagctactgaacaagtatgttggggagagtgaatcagaagtaaggaaaatattcacccgtgcaaggattaactccccatgcatcctgttttttgatgagatagatgctctgacaacaaaaagagggaaagagggaggatgggttgttgaacggctcctaaaccagttacttgttgaactcgacggcgctgatcagcgtaatggtgtttatgtcattggagctacgaacagaattgatgttatagatgaggctgtcctacggcctggcagatttgggaagaaacactttgtacctttacctggtgctgatgagcgggttgcgatattgaaagcacatactgaaaagaaatctctttcggaagatgttgatttgaacgcaattgcacgtcgagaggaatgtaataatcttactggtgccgacctggcatcactggtgaacgaagcagccatggcagcattggaagagaggtgtgaattcctggcgaaaggggactcatcaatgagtactgacttgactaataagattaaagtgcggcactttgagcatgctctgtctaaagtaaagccatcggtatcggaacagcaaaggaagcacttcgacgcattgtcaaagaaatattcggccaactaaactaccgtcgtgcttacaaggaccatactgcagttttgttttttgtttttgcgcatacgatagctcagcgtagagattgcgtgggggactctctacactgaagctacacaattttggtagcgaggaacattttttcggtgtttgaaaaatatgaactcattatgcttgttgtacggctacgactggtgcttgatgaaccagtccctttgtaatgttttggatcacgaagaaactttgcgtgaactgtgaacatattttatcaatgcacaattctctct

SEQ ID NO: 5888 - DNA, 1623 bp, Panicum virgatum
aggtgtttggagtgaatatgcaagctggcttcctgttgtttggacctccaggctgtgggaaaacactaattgcaaaagcagtggcccatgaggcaggggctaattttattcatatcaagggacctgaactattgaacaagtatgttggggaaagtgaatcagaagtgaggaaaatattcactcgtgcacgcacaaattccccatgcatcctatttttcgatgaggtagatgctttgacaacaaagagagggaaagagggaggatgggttgttgaacgtctcctaaatcagttacttattgaacttgatggtgctgatcaacggcaaggtgtctatgtgataggagctacaaacagaattgatgtgatagatgatgctgttctacggcctggtagatttgggaagaaacattatgtacctttacctggtgcggaagagcgggtctcaatattaaaagcacatgctcgaagcaagcccatctcatttgatgtcgatttggctgcactggcacatcgtgaggaatgcaacaatctcactggagccgacctagcatcactggtcaatgaagcagccatggcagcattggaagagagattggaattccttgagaatgggacatcgtcaatgaattcctcgtctttgatcgagctctcacacttcgaacgtgctctatcaaaggttaagccatcagtatctgaacagcaaattaaacactacgaggcattgtcaaagagatactcgtcaaactgatggatcaccatgtctctgttttggtgtatgtatgataaactttgtgaaagtggatggctgcagggagtacccaattctgaagtggataagctcgtgttgacatagggaacgagagctagctcttgcgagatccctcgcaatcaatcttggtcttgcttatttgtaccggcgtggcctacgggcaactttgtatgaccataaagatacatgatacattaatgacaaaacgcatgcaactacagttttgagtgaaatgaaatatagcaagaaattgtttttcagtggtgctcagctatcttcctcttaatgaaaaacgtgctcaggcatgttcgtgaaaaaaaagtggtgctcagctattgctatgtagtactctccgttggcctcagcagcttgaggtctggtggtgtccaatttgcccagttcggcccagagctttgggtcttttagtacctgatgatgatgacgccgacggtgaggagcttgccctcccggctcgtcggcgatggcaatcgccggcatcctatccccagccgcaacactggcctgcatcccgatggtagagtccagcgaaggcgccgagcaggtcgagcgccctgaggtagggggcggggaagggcttggagcgcttgcagtcctcgccggtgacgatgagctggaagaagtcggagaggccgaggatggagatcagatggtcaccgccgcacgcttagctcaggcagcgacatgcttgacgtgactactgaagaacgttgggtatatgtctattggccgagctcataattacacatatatatctcacgaaactcagtaaaaatgccatacggatgacaaattctagtaaatagacggataagtttatagaccatctgataaa

SEQ ID NO: 5889 - DNA, 3426 bp, Setaria italica
ccgccgatgcggaagcgcccgcgtcccggcggagctggcaacttcgagaagaggatccgccgccgcatattgaatggcggcctcgccggcgccggcgcctcggccgaggacgtcgccagcacgctccgcgtccactaccccgagctacgccgccagaagccggaccccttcactgccttagtccgccgcgtcctctcctcgataccctccccctcctccccctcaggttccgacggcggcgactacgacgacgcagaagactcctccgcctcccgccaccgccaccgccaccgccaccgccacgacgcccacgccagcacctcctcctccacatccgtctccgacgaggtcgcccacccgccgccagcccctgcctacgacgtcaccaagtccgtgatccgctccaactacgccgcgcagacggccaaacggaaccccgcctctaaccagcagctggagattgaggagaccgctgagaaggcgcgccgcctcatcacgtccgatggtggcgccggtggagatgctaagccggaggccatggcctctgaaggaatcgtccgaggggacaaggggccgaggttcgccgatctcggcgggatggaggcggtgatagaggagctgatgatggaagttgttgtgcccctgtgccatccggagctgccgcagcgccttggggttaggcctgtggctgggctgctgctgcacggaccgcctggttgtgggaagaccacccttgcacatgccattgccaatgagactggtgtaccattctacaagatatcggccccggaggtcgtatctggggtatctggagcttctgaggaaaatatcaggggattgtttcagaaggcctacaggactgctccctcgattgtattcattgatgagatagatgcaattgcatccaagagggagaatctgcaacgagagatggagcggcggatagttactcaattgatgacatgcatggatcaattccaccagaatattggacctggtggtggtgatttggatgcagaatcatctgaaaagaaacctggttatgtaattgtcattggagccacaaataggcctgatgctgtggaccaagctctgcgacggccaggaaggtttgatcgagagatatcccttggtgttccagatgagaatgcacgaaaacagatactgaagatgcttattcagaatcttcgacttgaaggcaattttgacttgtttaaaatagctagggccacaccaggttttgttggtgctgacttgaaggcactagtggataaagcagggaatctagcaatgaagagaataattgataaaagaagagctcagtattatcatgaacacaatggaaatagcaagcatgactggtggagacaaccttgggatgctggtgaggtggagggcctacatattacaatgtacgactttgaggaagcaacaaaaatggttcaaccatccttgagaagagaaggattttcatctgtccctgatgtcacatgggatgatgttggaggtcttaattcattaaggaaagagtttgaccgctgcattatccgatgtatcaagcaccctgaagattacgaggtatttggagtgaatatgcaagctggcttcctgctgtttggacctccaggttgcgggaaaacactaatagcaaaagcagtggcacatgaggcaggggctaattttattcatatcaaggggcctgagctactgaacaagtatgtcggggagagtgaatcagaagtgaggaaaatattcactcgtgcacgcacaaattccccgtgcatcctattttttgatgaggtagatgctttgacaacaaagagagggaaagagggaggatgggttgttgagcgtctcctaaatcagttacttattgaacttgatggtgccgatcaacgccaaggtgtctatgtgataggagctacaaacagaattgatgtgatagatgatgctgttctgcggcctggtagatttgggaaaaaacattatgtacctttacctggtgcggacgagagagtctcaatattaaaagcgcatgctcgaagcaagcccatctcatctgatgtcgatttggaagcactagcacgccgtgaggagtgcaacaacctcactggtgccgaccttgcatcactggtcaatgaagcagcgatggcagcattggaagagagactggactttgttgagcacgggacatcatccatgagttcctcttgtttgattgagctctcacactttgaacgtgctctatcaaaggttaagccatcagtatctgaacagctaattaaatattacgaggcattgtcaaaaagatactcatcaaactgatggatcgccatgtctgtcttggtgtgtgtatgagaaccttgtgaaaaatgtatgcatgtaccatgctttccgtggttcttcggccgtgtcactatacacgaagatggctgcaggcctcttgcaccgccacaagcatacccatttctgaagttgttaacttagagaacgagagagctaggtcttgcgagatccctcgcaatcaaatttggtcttgcttatttgtaccggcaattttggtcttgctttaagatacatcatcacacatgaatgtgttgtgcgtgaagtgaaatgaaatatggcaaggaaaaatatttcagtgtgttgcacagctattgctatgtatattatgctccattggcctctgcagcttgaggtttggtggtgtccagtttgtccaattcggaccagagctttggatctgtgtagtccctgatgactaggctcgcgccgacggcggtgagcttgccctcccggctctcgtcggcgatggcgatcaccggcatcctggccgcaacaccggcctgcaccccgacggtggagtcctcaaagacgatggtgtggtccggcgaggcgccgagcaggtggagcgccctgaggtaggggtccgggtagggcttggagcgcccgcagtcctcggcggagacgatgagcttgaagaagtctgagaggccgaggatggagatcatgagctcggcgttggccctgggcgcgttggtcaccgccgcgcgcttgagcctgcgctcgtcggcccagtggcagagcgcggtgaggccggcgatctccttgagcccctcgccggcgtacctggcgaagagctcctccttctcggcgaagaaggcgtccagcctggcctggtcccagtccgggaagaggaagcggccgatctgctcgttgctccggccggccatgtgcttcatgccgaactccggcgtgatggggacgccgttgttgtaaccgaccttgaggagcatctcggaggtggcccggtggtggaaggggtcggagatccccatcgtcccgtcgatgtcgaacaggacggcttccagaggagccaccctgccgattgcactgcaagccgtacagataacagcatatgtaacc

SEQ ID NO: 5890 - DNA, 3810 bp, Sorghum bicolor
cacaaacggaagcaaaaaaagagaacgcatcagctcgtctgccgttggattgcacgctgcggccgcggggcttgcgcgattagggtttggccaggccgccgccgccgcccctccgcctctctcctctccgtcgcacgcggcagtcgcgcgaccccctcgtcacggcgcccatggccaagcgcccgcgccacgccggcaacggcgccggccgctcccagatgacgtccttagagtggaagctccaccgccacatactcaacggcggcctagcccgccgcggcgcctccgccgaggacgtcgccaacaccctccgcatccaccacccggacctcggccgccacaagcaaggccccttcctcgcctgcgtccgccgcgctctcgcctccattcccatcccctccccctcctccccttcctcctctgaatcctcctccgacgacgaaggctcctcggcctcccgccgccgccgccgccgccatgacgcccacgccaccacttcgtcctccacctccgtctccgacgccgccgctcactcgtcgccaccagcccccaccttcgacctcaccaaatccattatccgctccaactacgccgcgcagacgcccaagcggaaccagcagctggagatcgaggtcaccgcggagaagccgcgccgcctcatcacggccgacggcggcggcggcggtgacgccaagccggaggccgccccggctgctgctgaaggcttcggcagaggggacaaggggcccaggttcgccgacctcggcgggttggaggcggtgatcgaggagctcatgatggaggtggtcgtgcccctgtgccatccggagctgccacaccgacttggcgtcaggcctgtcgcggggctgctactgcacggaccgcccggttgcggaaagaccaccctagcccatgccattgctaatgagactggcgtgccgttctacaagatctccgcaccggaagtcgtgtctggggtgtctggagcttctgaggaaaacatcaggggcttgtttcagaaggcctatcggactgctccttcaattgtatttattgatgagatagatgcaattgcatccaagagggagaatctgcaacgagagatggaacggcgtatagttactcaattaatgacatgcatggatcaattccaccagaatattggatcaggcagtggcaatttggatgctgaatcatctgaaaaaaaacctggttatgttattgtcattggagccacaaataggcctgatgctgtggatcaagctttgcgaaggccaggaagatttgaccgagagatatctcttggtgtcccagatgagaatgcacggaaacaaatactgaagatgcttactcagcatcttcgacttgaaggcgaatttgacttgttcaagatagctagagcaacaccaggttttgttggtgctgacttgaaggcattagtggataaagcagggaatctagcaatgaagagaataattgatgaaagaagagttcaatatcgccgcgagcacgatgggaataccaatcatgactggtggagacaaccttgggatgaaagtgaggtggagggcctgcatattactatggatgactttgaggaagcaacgaaaatggttcaaccatctttgagaagagaagggttttcttctgtccctgatgtcacatgggatgatgttggaggtcttgattcattaagaaaagagtttgaccgctgcattattcgttgtatcaagcaccctgaagactatgaggtatttggagtgaatatgcaagctggcttccttctgtttggacctcctggttgcgggaaaacactaatagcaaaagcagtggcacatgaggcaggggctaattttattcacatcaaggggcctgagctattgaacaagtatgttggggagagtgaatctgaagttagaaaaatattcactcgtgcacgtactaactctccttgcatcctgttttttgatgaggttgatgctttgacaacaaaaagagggaaagagggaggatgggttgttgaacgtctcttaaatcagttactcatcgaacttgatggtgctgatcaacgacaaggtgtctatgtgataggagctacaaacaggattgatgtgatagatgatgctgttttacggcctggtagatttggaaagaaacattatgtacctttacctggtgcagacgaacgggtttcaatattaaaagcacatgctcgtagcaagcctttctcagctgatgttgatttggatgcacttgcacgtcgtgctgaatgcaacaatctcactggtgctgacctagcatcactggtcaatgaagcagccatggcagcattggaagagagattggaattccttgagaatgggacatcctcaatgagttcctcttgtttgattgagatctcgcactttgaacgtgctctatcgaagattaagccatcagtatctgaacagcaaatcaaacattacgaggcgttgtcaaagagatactcgtcgaactgatccatcaccatctctccacatcttagtgtgtatacgaggaccttgtgaaaaatgtattgtctgttccatgtttgcaaggaatgtgcaccgtcaccagcttactgtttctgaagtgcttaatctcgtgtgagctcttgcgggagaatagatagattatagatatagaattctgtattttctcgcaatcagttttgttatcactcatctgtgtaacagcctggcctacaggcaattttgtatgacctcaatctcatcaaaatacatcatacacgaatgggttataattcaatcatgcgtgaatgaaagtgaaatatagcaagaaattgtttttcgctactagtatttgtggtcctcagctacagttgtgtatgagttccattggcctcagcagcagcttcaggcttggcgatgtccagtttgtccaatgccgcccacagcttgggatcttcgtagtccctgatgacaagcgtggcaccgacggcgagaagcttgccctcccggctctcctcagcaatggcaaccacgggcatccctgccgcaacgcctgcctgcacgccggtggtggagtcctcaaacacgacggcgtgctccggcgagacgccaagcagctccagcgccctgaggtacgggtccgggaagggcttaaatcgctcgcactcctcggcggtgacgacgagctggaagaagtcagagaggccgaggatggagatcatgaggtcggcgttagccctgggcgcgttggtgacggcggcgcgcttgagcccacgctcgtcggcccagcggcagagcgcggtgaggccggcgatctccctgagcccctcgccggcgtaccgggcgaagagcgcctctttctcggcgaagaaggcgtcgagccgcgcctggtcccagtccgggaacaggaagcggccgatctggtcgttgctccggccggccatgtgcgccatgccgaactccggcgtgatgggaacgccgttgttgtagcctaccttgaggagcatctccgacgtggcgcggtggtggaacgggtccgagatggccatggtgccgtcgatgtcgaagagcaccgcttccaggggagccactctgccgatcccactgctgcaaccacgcacagagacagagggatcaactgggatggccatggttgcagagaactttgtttggattgaaatgaaatcttggcagtcagtctctaggggaaatagatagaagtgaatgaaatcatgcagaaaatactctagatgatgatggttgtgagcaggattacctttccatggcaggttgctgctggatgccaaactggggctttttt

SEQ ID NO: 5891 - DNA, 1125 bp, Panicum virgatum
cctgatgtcacatgggatgatgttggaggtcttgattcattaaggaaagagtttgaccgctgcattattcgacgtatcaagcatcctgaagattatgaggtgtttggagtgaatatgcaagctggcttcctgttgtttggacctccaggctgtgggaaaacactaattgcaaaagcagtggcccatgaggcaggggctaattttattcatatcaaggggcctgaactattgaacaagtatgttggggaaagtgaatcagaagtgaggaaaatattcactcgtgcacgcacaaattccccatgcatcctatttttcgatgaggtagatgctttgacaacaaagagagggaaagagggaggatgggttgttgaacgtctcctaaatcagttacttattgaacttgatggtgctgatcaacggcaaggtgtctatgtgataggagctacaaacagaattgatgtgatagatgatgctgttctacggcctggtagatttgggaagaaacattatgtacctttacctggtgcggaagagcgggtctcaatattaaaagcacatgctcgaagcaagcccatctcatttgatgtcgatttggctgcactggcacatcgtgaggaatgcaacaatctcactggagccgacctagcatcactggtcaatgaagcagccatggcagcattggaagagagattggaattccttgagaatgggacatcgtcaatgaattcctcgtctttgatcgagctctcacacttcgaacgtgctctatcaaaggttaagccatcagtatctgaacagcaaattaaacactacgaggcattgtcaaagagatactcgtcaaactgatggatcaccatgtctctgttttggtgtatgtatgataaacttagtgaaagtggatggctgcagggagtacccaattctgaagtggataagctcgtgttgacatagggaacgagagctagctcttgcgagatccctcgcaatcaatcttggtcttgcttatttgtaccggcgtggcctacgggcaactttgtatgaccataaagatacatgatacattaatgacaaaacgcatgcaactacagttttgagtgaaatgaaatatagcaagaaattgttttt

SEQ ID NO: 5892 - DNA, 1854 bp, Pennisetum glaucum
cggaggttgtatctggggtatctggagcttctgaggaaaatatcaggggattgtttcagaaggcctacaggactgctccctcgattgtattcattgatgagatagatgcaattgcatccaagagggagaatctacaacgagagatggagcgacggatagttactcaattgatgacatgcatggatcaattccaccagaatattggaccgggtggtggtgatttggatgccgactcatctgaaaagaaacctggttatgtaattgtcattggagctacaaatcggcctgatgctgtggaccaagctctgcgacggccaggaaggtttgatcgagagatatcccttggtgttccagatgagaatgcacgaaaacagatactgaagatgcttactcagaatcttcgacttgaaggcgaatttgacttgtttaagatagctagagccacaccaggttttgttggtgctgacttgaaggcgctagtggataaagcagggaatctagctatgaagagaataattgataaaagaagagctcagtattaccatgaacatgatggaaatagcaagcatgactggtggagacaaccttgggatgatggtgaggtggatggcctacatattacaatgtacgactttgaggaagcaacaaaactggttcaaccatccttgagaagagaaggattttcatctgtccctgatgtcacatgggatgatgttgggggtcttgattcattaaggaaagagtttgaccgctgcattatccgatgtatcaagcaccctgaagattatgaggtatttggagtgaatatgcaagctggcttcctgctgtttggacctccaggttgcgggaaaacactaatcgcaaaagcagtggcacatgaggcaggggccagttttattcatatcaagggtcctgagctattgaacaagtatgttggagagagtgaatcagaagtgaggaaaatattcactcgtgcccgcacaaattccccatgcatcctattttttgatgaggtagatgctttgacgacaaagagagggaaagaaggaggatgggttgttgagcgcctcctaaatcagttacttatagaacttgatggcgctgatcaacgccaaggtgtctatgtgataggagctacaaacagaattgatgtgatagatgatgctgttctgcggcctggtagatttgggaaaaaacattatgtacctttacctggtgcggatgagagggtctcaatattaaaagcgcatgctcgaagcaagcccatctcatctgatgtcgatttggatgcactggcacgccgtgaggagtgcaacaacctcactggtgccgacctagcatcactggtcaatgaagcagcaatggcagcattggaagaaagactggacttttttgagcacgggacatcatcaatgagttcatcttgtttgattgagctctcacacttcgaacgtgctctatcaaaggttaagccatcagtatctgaacagataattaaacattacgaggcattgtcaaaaagatactcgtcaaactgatggatcatcatgtctgtcttagtgtgtgtgagaacctggtgaaaaatgtatttatgtaccatattttgcgtggttcatcagcggtgtcattatgcacgaagatgctgcagggagtgcaccgccacaagcataccaatctcccattagcgaagttggtaaagtcagtgttagcttagagaatgtgagcgatcaattttgatcctgcttatttgtaccggcttggcctacgggcaattttgtatgacctttaagatatgaggagccactacagttgtgacgaaaacaaaaaaaaaaaaaaaaaacgtaaactactaga

SEQ ID NO: 5893 - DNA, 2813 bp, Panicum virgatum
cggcccaagcccacagaagccacgggtacatgagccgcgcaaggaagcccacgacatacggaaagttggaaagagagagagaggccttcatcttcttcgttgctactccctccgtccataaagagcgtaggtccaaaaccctagccgccgtccacccggccgtgaccaaaaccctagccgccgtcgaccgatggcgaagcgcccgcgtcacggcggcgctggccgctccagattgccgcccttagaggggaagctccgccgctacatattgaacggcggcctagctgtccccggcgcctccgccgaggaggtcgccgacaccctccgcatccaccacccggagttccgccgccagaagctcgaccctttcaccgccttggtccgccgcgtcctctcctcgataccctccccctcatcctcctcctccggctccgacgacgacgacgacgacggctcctccgcatcccgtcgccgccacgacgcccacgccacgacatcctcctccacctccgtcttcgacgaggccgcacacccgccgccgtcccccgccttcgacgtcaccaagtccttgctccgctcccagtacgccgcgcgcgcgcaaacgcccaagcggaaccccgccgctaaccagcagcagctggagattgaggagaatgcagagaaggcgcgccgcctcatcacgtccgacgggggcgccggcggagatgctaagccggacgccgcggcctctgaaggaatcgtcagaggggggaaggggccgagattcgccgatctcggtgggatggaggcggtgatagaggacctgatgatggaagtggtcgtgcccctgtgccatccggagctgccgcagcgccttggggttaggcctgtcgctgggctgctgctacatggaccgcctggttgcggaaagaccacccttgcgcatgccattgctaatgagactggtttgccattctacaagatctcagccccggaggtcgtatctggggtatctggagcttctgaggaaaacatcaggggcttgtttcagaaggcctataggactgctccctcaattgtattcattgatgaaatagatgcaattgcatccaagagggagaatctgcaacgagagatggagcgacggatagttactcaattaatgacatgcatggatcaattccaccagaatattggatccggcagcagtgatttggatgcagaatcagctgaaaagaaacctggttatgttattgtcattggagccacaaataggcctgatgctgtggatcaagctctgcggcggccaggaaggtttgatcgagagatatctcttggtgttccagatgagaatgcacggaaacagatacttaagatgcttactcagaatctccgacttgaaggtgaatttgacttgttcaagatagctagagccacaccaggttttgttggtgctgacttgaaggccttagtggacaaagcaggcaatctagcaatgaagagaataattgatgaaagaagagctcagtactgtcgtaatcatgatgggaatagcaagcatgactggtggagacaaccttgggatgccagtgaggtggagggcctacatattacaatggacgactttgaggaagcaacaaaaatggttcaaccatccttgagaagagaagggttttcatctgtccctgatgtcacatggaatgatgttggaggtcttgattcattaaggaaagagtttgaccgctgcattattcgacgtatcaagcatcctgaagattatgaggtgtttggagtgaatatgcaagctggcttcctgttgtttggacctccaggctgtgggaaaacattaattgcaaaagcagtggcccatgaggcaggggctaattttattcatatcaaggggcctgagctattgaacaagtatgttggggaaagtgaatcagaagtgaggaaaatattcagtcgtgcacgcacaaattccccatgcatcctattttttgatgaggtagatgctttgacaacaaagagagggaaagagggaggatgggttgttgaacgtctcctaaatcagttacttattgaacttgatggtgctgatcaacggcaaggtgtctatgtgataggagctacaaacagaattgatgtgatagatgatgctgttctacggcctggtagatttgggaagaaacattatgtacctttacctggtgcggaagagcgggtctcaatattaagagcacatgctcgaagcaagcccatctcatctaatgttgatttgattgcactggcacatcgtgcggaatgcaacaatctcactggagccgacctagcatcactggtcaatgaagcagcgatggcagcattggaagagagattggaattccttgagaacgggacatcatcaatgagttcctcttctttgatcgagctctcacacttcgaacgtgctctatcaaaagttaagccatcagtatctgaacagcaaattaaacattacgaggcattgtcaaagagatactcgtcaaactgatggatcaccacgtctctgttttgatgtgaaagtgtatggctgcagggactacccaattctgaaatggataagctagtgttggcatagggaacgagagctagctcttgcgagatccctcgcaatcaatcttggtcttgtaccggcttggcctacgggcaactttgtatgaccttatagatacatcatacattgttgacataatgtgtgcaactacagttttgcgtgaaatgaaatatagcaataaattgttttttagtggtgctcagctattgctacgtgtccaatttggccagttcggtccaga

SEQ ID NO: 5894 - DNA, 2595 bp, Zea mays
gtctggccagtcccgctgccgccccctccgcctctctcggccgtagtcgcaacgctgtgtcacgccgcacatggcgaagcgcccgcgccacgccggaaacggcgccggccgctcccagctggcgtcattcgagcggaagcttcacgacctcatactcaacggcggcctagcaggccccggcgcctccgccgaggacatcgccaacaccctccgcatccaccaccctaagttccgccgcctgaagcacggccccttctttgcctccgtccgccgcgctctcacctccatccccatcccctcctcctccgatgacgacggctcctccgcctcccgctgccgccacgacgcccacaccacctcctccgcctccgtctccgacgccgccgcccacccgtcgccaccggcccccgccttcgacgttaccaagtccacgctcttctcccattacgccgctcagacgcgcaagcggaaccaaaaccagcagctggagatcgaggtcacagcggagaagccgcgccgcctcatcacggccgaaggcggtggcggtggcgacgcgaagcccgaggccgtcccggctgctgaagggttttgcagagaggacaagggacccaggttcgccgacctcggcgggatggaggcggtgatcgaggagctcatgatggaggtggtcgtgcccctgtgccatccgaagctgccgcaccgccttggagtcagacctgtcgcggggctgctgctgcacggaccacccggctgcggaaagaccacccttgcccatgccatcgctattgagactggcgtgctgttctacaagatatctgcaccggaagttgtatctggggtgtctggagcttctgaggaaaacatcagaggcctgtttcagaaggcctatcggactgctccctcgattgtattcattgatgagatagatgcaattgcatccaagagggagaatctgcaacgagagatggagcgacgaatagttactcaattaatgacatgcatggatcaataccaccagaatattggatcggacactggcaatttggatgctgaatcatctgaatagaaacctggttatgttattgtaattggagccacaaataggcctgatgctgtggaccaagctctgcgaaggccaggaaggtttgatcgagagatatctcttggtgttccagatgagaatgcacgaaaacaaatactgaagatgcttactcagcatcttcgacttgaaggcgaatttgacttgttcaagatagctagagcgacacaaggttttgttggtgctgacttgaaggcattagtggataaagcagggaatcttgcaatgaagagaataattgataaaagaagaattcactatcgccgtgagcatgacgggaatagcaagcatgactggtggaggcaaccttgggatgaaagtgaggtggagggcctacatattactatggatgactttgaggaagcaacaaaaatggttcaaccatctttgagaagagaagggttttcttctgttcctgatgtcacttgggatgatgttggcggtcttgattcattaagaaaagagtttgaccgctgcattattcgttgtatcaagaaccctgaagactatgaggtatttggagtgaatatgcaagctggcttcctgctgttcggtcctcctggttgcgggaaaacactaatagcaaaagcagtggcacatgaggcaggagccaattttattcatataaaggggcctgagctattgaacaagtatgttggggagagtgaatcagaagttaggaaaatattcactcgtgcacgtactaactctccatgcatcctattttttgatgaggttgatgctttgacaacaaaaagagggaaagagggaggatgggttgttgaacgtctcttaaatcagttacttatcgaacttgatggtgctgatcaacgacaaggtgtctatgtgataggagctacgaacaggattgatgtgatagatgatgctgttctacggcctggtagatttggaaagaaacattatgtacctttacctggtgcacacgagcgggtttcaatattaaaagcacatgctcgcagcaagcccatctcgaccgatgttcatttggatgcacttgcacgtcgtgccgagtgcaacaatctcactggtgctgacctagcatcactggtcaatgaagcagccatggcagcattggaagagcgattagagttcattgagaacgggacatcctcaatgggttcatcttgtttgattaagctctcacactttgagcgtgctctatcgaagatcaagccatcagtatctgaacagcaaattaaatattacgaggcgttgtcaaagagatactcgtcaaactgaggtatcaccacgtctccatgactcccatccatggttcgtcagtggttgcagctttgtatttttggtggtggtgaatggtgatgaaattctacagttgtagaaatcattttaggttttgctgcctacaggcaaatttttgtatggccttaagatacattatacaaggatgagtagtaccacaaatatgtcgcagttaatgctatcgaaggcctccagtcgtggagcgcattccccca

SEQ ID NO: 5895 - DNA, 2759 bp, Zea mays
ttcggctttgcgtttgcctttggcctggccgccgccgccccctccgcctctgtctcctctctcctctctcctctctcctctccgtcgtcctgacaccgcaccacggcgcccatggcgaagcgcccgcgccacgccggaaacggccccggacgatctcagctggtgcctttcgagtggaagctccaccgcctcatactcaacggcggcttggccggtcccggcgcctccgccgaagacgtcgccgacgccctccgcgtccaccacccggagttccgccgccagaagcaaggccccttcgtcgcctccgtccgccgcgctctcacctccatccccatcccctccccatcctcctctgactcctccgacgacggctcctccgcctcccgccgccgcggccaccacgacgcccacgccaccacctcctcctccacctccgtctctgacgccgctgcccgaccgtcgccaccagcccccgcctacgacgtcaccaagtccatgctccgctcccagtacgccgcgcagacgcccaagcggagccagcagctggagatcgaggtcgcggcggagaaaccgcgccgcctcatcacggccgacggcggcggcggaggcgatgccaagccggaggccgccccggcttctgaagggttcggcagaggggacaaggggcccaggttcgccgacctcggcgggatggaggcggtgatcgaggaactcatgatggaggtggtcgtgcccatgtgccatccggagataccgcatcgccttggcgttaggcctgtcgcggggctgctgctgcacgggccgcccggctgcggaaagaccacccttgcccatgccattgctaatgagactggcgtgcccgttctataagatctccgcaccggaagtcgtatctggggtgtctggagcatctgaggaaaacatcaggggcttgtttcagaaggcctatcggactgccccctcgattgtatttattgatgagatagatgcgattgcatccaagagggagaatctacaacgagagatggaacggcggatagttactcaattaatgacatgcatggatcaattccaccagaatattggatcgggaagtagcaatttggaagctgaatcatctgaaaagaaacctggttatgttattgtcattggagccacaaataggcctgatgctgtggaccaagctctgcgaaggccaggcaggtttgaccgagagatatcacttggtgttccagatgagaatgcacggaaacaaatactgaagatgcttactcagcatctccgacttgaaggcgaatttgacttgttcaagatagctagggcaacaccagggtttgttggtgctgacttgaaagcattagtggataaagcaggaaatctagcaatgaagagaataattgatgaaagaagggctcggtgttgcattgagcaggacggtagtagcaagcatgactggtggagacaaccttgggatgaaagtgaggtggacgaactacatattaccatgaatgactttgagcaaaaatggttcagccatctttgagaagagaagggttttcttctgtccctggtgtcacatgggatgatgttggaggtcttgattcattaagaaaagagttcgaccgctgcattatccgttgtatcaagcaccccgaagactatgaggtatttggagtgaatatgcaagctggcttcctgctgtttggacctcctggttgcgggaaaacactaatagcaaaagcagtggcacatgaggcaggggctaactttattcacatcaaggggcctgagctattgaacaagtatgttggggagagtgaatcggaagttaggaaaatattcactcgtgcacggactaactccccatgcatcctgttttttgatgaggttgatgctttgacaacaaaaagagggaaagagggaggatgggttgttgaacgtctcttaaatcagttacttatagaacttgatggtgctgatcaaagacaaggtgtctatgtgataggagctacaaacaggattgatgtgatagatgatgctgttttacgtcccggtagatttggaaagaaacattatgtacctttacctggtgcagacgagagagtttcaatattaaaggcacatgctcgtagcaagcccatctcgactgatgttgatttggatgcacttggtcgtcgtgctgagtgcaacaatctcactggtgccgacctagcatcactggtcaatgaagcagccatggcagcactggaagagagactggaattccgtgacaaggggacatcctcactgagttcgtctagcttgattgagatgccgcacttcgaacgtgctctatcgaagatcaagccatcagtatctgaacagcaaatcaagaattatgaggcgttgtcaatgagatactcgtcaaactgatccatcaccagctgtccacatgttagtgtgtatacgaggacaaccttgtgaaaaaaatgtggtgttctgtaccatgtttgcaaggagtgtgcaccgtcaccagcttttacccatttctgaagcacattataatctcatgtgagagcctgtggtagagtagtttagatacaaatagaaatctgcatgttatcgcgatcagttttgtttccattttcatttgtctgtaacagactggcctacaggcaattttgtatgcatctcatcaagatacatcatacatacacgaatgagttgttattgaatcatgcgtggaagtggaatattgcaagaaattgtttttggctact

SEQ ID NO: 5896 - DNA, 1341 bp, Panicum virgatum
ggtgttccagatgagaatgcacggaaacagatacttaagatgcttactcagagtctccgaattgaaggcgaatttgatttgttcaagatagctagggccacaccaggttttgttggtgcggacctgaaggcgttagtggacaaagcaggcaatctagcaatgaagaaagtaactgatggaagaaaagctcagtacagcaagcatgactggtggagacaaccttgggatgccggtgaggtggagggcctacatattacaatggatgactttgaggaagcaacaaaaatggttcaaccatccttgagaagagaagggttttcatctgtccctgatgtcacatgggatgatgttggaggtcttgattcattaaggaaagagtttgaccgctgcattattcgatgtatcaagcatcctgaagtttatgaggtgtttggagtgaatatgcaagctggcttcctgttgtttggacctccaggctgtgggaaaacactaattgcaaaagcagtggcccatgaggcaggggctaattttattcatatcaaggggtctgagctattgaacaagtatgttggggaaagtgaatcagaagtgaggaaaatattcactcgtgcacgtacaaattccccatgcatcctatttttcgatgaggtagatgctttgacaacaaagagagggaaagagggaggatgggttgttgaacgtctcctaaatcagttacttattgaacttgatggtgctgatcaacggcaaggtgtctatgtgataggagctacaaacagaatcgatgtgatagatgatgctgttctacggcctggtagatttgggaagaaactttatgtacctttacctaatgcggaagagcgggtctcaatattaaaagcacatgctcgaagcaagcccatctcatctgatgtcgatttggctgcactggcacatcgtgaggaatgcaaccgtctcactggagccgacctatcatcactggtcaatgaagcagcgatggcagcattgggggagagattggaattcctccttgggaatgggacatcgtcaatgagttcctcttctttgatcgagctctcacacttcgaacatgcactatcaaaggttaagccatcagtatctgaacagcaaattaaacactacgaggcattgtcaaagagatactcgtcaaactgatggatcatcgtgtctctgttttggtgtgtgtatgagatccctcgcaatcaatggcctacgggcaactttgtatgaccttacttaaagatacatcatacgttaatgacaaaatgggtgcgactacagttttgcgtgaaatgaaatatagcaagaaattgttttcca

SEQ ID NO: 5897 - DNA, 984 bp, Panicum virgatum
aggtgtttggagtgaatatgcaagctggcttcctgttgtttggacctccaggctgtgggaaaacactaattgcaaaagcagtggcccatgaggcaggggctaattttattcatatcaaggggcctgagctattgaacaagtatgttggggaaagtgaatcagaagtgaggaaaatattcactcgtgcgcgcacaaattccccatgcatcctatttttcgatgaggtagatgctttgacaacaaagagagggaaagagggaggatggattattgaacgtctcctaaatcagttacttattgaacttgatggtgctgatcaacggcaaggtgtctatgtgataggagctacaaacagaattgatgtgatagatgatgctgttctacggcctggtggatttgggaagaaacattatgtacctttacctggtgcagaagagtgggtctcaatattaaaagcacatgctcaaagcaagcccatctcatgtgatgtcgatttggctgcactggcacatcatgaggaatgcaacaatctcactggagcagacctagcatcactggtcaatgaagcagcgatggcagcattggaagagagattggaagtccttgagaatgggacatcgtcaatgagttcctcttctttgatcgagctctcacacttcgaacgtgctctatcaaaggttaagccatcagtatctgaacagcaaattaaacattatgaggcattgtcaaaaagatactcgtcaaactgatggatcaccatgtccctgttttggtgtatgtatgataactttgtaagagtgtatgcctgaaacatagggaacgagagctagctcttgcaggatcccctcgcaatcaattttggtcttgcttatttgtaccggcttggcctacgggcgactttgtattgaccttaaagatacaccatacattaatgacaaaatgtgtgcaactacagttttgcgtgaaatgaaacatggcaagaaa

SEQ ID NO: 5898 - DNA, 1514 bp, Secale cereale
gtggcgggcgaggcggtggccacggccgcgatggttctcgtccgacacggcggcggtgggggtcgattcgggtaatccggtgcggcgtcgggtggcggcgctgtgggggaacggggaccacgggcggctggggctgggggcgctggagtcgcggtggaaccccacggcgtgccccttcttcctcgcgcgccccgccgacccgcctacgtcgctcgcctgcggcggcgcccacaccctcttcctcaccgagggtgggcgcgtgtttgctacggggctgaatgactttggacagctcgggataggctcctcgatgcctcatactctggaccctgttgaagtctctgggtttcatgagaaagttgtagaaatttcagctggcaaccatcattcttgtgcagtaacagcggatggtgagctcttcgtttggggcaaaaattcaagtggccagcttggccttggcaaaagtgcaggaaaagtagtctctaccccaagaaaggttgactacttggctgatgttagagtgaaaatgactgctttgggatcagagcactcaattgttgttacagaggatggtgaagccttgagttggggagctgctggtgctggtagacttggacatggccataaatctagcttcctgggattcgctatgacctcaaatgaatatactccaaggttgatcaaaaaccttgatggtatcaagattaaaaggatagctgcgggaatgctgcactcagcttgcattgatgaaaaaggtacttggaagatcaaatgatgcacctagaccaagtgttgttgaagagatacaattttcagaagaagttgcttgtggaggttatcatacttgcgctgtaacagatcgtggagatttgtattcttggggttcaaatgaaaatggctgccttggtcttgggggcacaggcatggttcgcttcccagaagttgtaagaagttcattatttaagcttcctgtatctaaggtatcctgtggttggaagcacacagctgtaatttcaggtgaagatatctacacgtggggctggggaggtgccaacggtaccttcttcgaagagggccattcttctggcgggcaattagggcatggaaacgatgtcgactattgcgagccgatgatggtagaacttggcaagaatgcaagagctgtgcatgtatcatgtggcttcaatcatacaggcgcgatactcgagtatgcggaaaactgacagcgatgccatctgcagcactgtaagtgcaaccaggcatgtttggtactacccagtcatacctgcacaaggaaaaagaataagctgacctcgaacgagtgatgaactcgtaaagcagaattacaggttagtctagctgtatagtcttctttcatatattttcattgtcggcttgtatctatgatatttgatgacttgtaaagaagtgtgtaacgttgcccaggctgtgatgtgcacggccagtttaaaatgtaaagatgttttggactaaaataaatattgtcttgtata

SEQ ID NO: 5899 - DNA, 1571 bp, Triticum aestivum
aggctatccgacaccgcgagcgacgcgaccactccagagctccaacgcggaacggcgatgtggcgggcgaggcggtggccgcggccgcgatggttctcgtccgacacggcggcagtgggcgccgattcgggcaatccggcgcggcgtcgggtggcggcgctgtgggggaacggggaccacggccggctggggctgggggcgctggagtcgcggtggagccccacggcgtgccccttcttcctcacgcgccccgccgacccgcctacctcgctcgcctgcggcggcgcccacaccctcttcctcaccgagggtgggcgcgtatttgctacggggctgaacgactttgggcagctcgggataggctcctcgatgcctcatactctggaccctgttgaagtctctggatttcacgagaaagttgttcaaatttcaactggcaaccatcattcttgtgcagtaacagcggatggtgagctcttcgtttggggcaaaaattcgagtggccagcttggccttggcaaaagtgcaggaaaagtagtctctaccccaagaaaggttgactacttggctgatgttagagtgaaaatgactgctttgggatcagagcactcaattgttgttacagaggatggtgaagccttgagttggggagctgctggtgctggtagacttggacatggccataaatctagcttcctgggattcgctatgacctcaaatgaatatactccaaggttgataaaaaaccttgatggtatcaagattaaaaggatagctgcgggaatgctgcactcagcttgcattgatgaaaaaggtacttggaagatcaaatgatgcacctagaccaagtgttgttgaagagatacaattttcagaagaagttgcttgtggaggttatcatacttgcgctgtaacagatcgtggagatttgtactcttggggttcaaatgaaaatggctgccttggtcttggaggtacaggcatggttcgcttcccagaagttgtaagaagttcattatttaagcttcctgtatctaaggtatcctgtggttggaagcacacagctgtaatttcaggtgaagatatctacacgtggggctggggaggtgcgaacggtaccttcttcgaagagggccattcttctggcgggcaattagggcatggaaacgacgtcgactattgcgagccgatgatggtagaacttggcaagaatgcaagagctgttcatgtatcatgtggcttcaatcatacaggcgcgatactcgagtacgcggaaaactgactgctgtgccatctgcagcacttacagtgcaaccaggcatgtttggtactactcagtcatacctgcacaaagaaaaagaataagctgacctcgaacgagtgatgaactcgtaaaacagaattacaggttagtctagctgtatagccttctttcatacatcttcattgtcagcttgtatctatgatatttgatggcctgtaaagaagtggtgtttgacgtcgcacaggctgtgatgtaaacggccagttgaaaatgtaaacatgattttaactaaaataaatcttgtctt

SEQ ID NO: 5900 - DNA, 3148 bp, Secale cereale
gcctttgccgaccacgcacgcaccaaacctattaaacccctgtactcctccgccgccgccgccgccattcgccgccgaacggtctcccccgaccccccttcctcgcgcccccggcagccgccgcccccccgcgccccgccgagctcgccaacatgctgcagagcaagtccttcgtcaagaagacgaagcagggccgcgtcgtcaaggtggtccgggagcactacctccgcgacgacatcccctgcggcgccttctcctgctcctcctgcgacgcggccgcccgccgcctcaacgccgacgccgccgccatcctcgtcgtcgacaccaacgtcgtgctccaccagatcgatttgttggagaatccggcgattgaggatgtcgtggttttgtcggtggtgctggacgaagtgaagaataagaacctctccgtgtacaacagactcaagaccctgtgcaccaacacggctcggaggttcttcgtgttcaccaacgagcaccacagggatacttatgtcaaggagatggtcggagagagcccaaatgatcgtaatgatagagcaatccgtgttgctgctcgttggtaccagagtcacctcggtgacagtgccaaagtgttgctggtcacaaatgatagagataacaaacggaaagctactgaagaaggcctaaatgcagagacagttgagtcatatgtacgatcgcttgcgcagcctggtttgctcgatttggtggttgtcccaagtagcggagatgttgccatggaagatgtagaagatcttaggccatccaaaaggaaatagtttacaatgagcataaacctatgtcggaaattacatctggtctgcgctgtggaatttatcatcaagggaagcttcgagttaatcgctacaatccatttgaagcatatgtcggaagtgagagcattggggatgagattattatccgtgggagttcaaatatgaacaggtcctttgacggagatatagttgctgtagaactcttgccacaggatcagtggcacgattcaaagtcatttattgctgatgatgatgaagatgataatgaagatgatgtccggttggttccaaatagtgctgatgatgctccacgaaacacaaattccacgcaatcaacagttggatcatcagctgcttctgtccccagtcgtccagttggacgtgttgttggtatcatcaagcggaattggaattcgtattgtggatcattggagccaatgcccatgcctgctggtagcgggggcgttgctcatgctctatttgtgtcgaaagatcgaagaattcctaagattcggattcaaactagacaacttgggaatcttttgaataaaaggattatcgttgcagttgattcatgggatgtcatgtctcgatacccatcaggacactatgtgcggactataggagatattggcgataaagaaactgaaacagaggttgtcctaatagaaaatgatattaacacaagacctttctctacacaagtccttgcttgtttgccgcctttgccttggacattgtcacccgaggatgtggctaatcctaataggcaagacttgcggcatgtgagagtctttagtgtggatccacctggttgtagggatattgatgatgcactacattgcacaccgcttccaaatggaaattttgaagttggagtccatattgctgatgtcactaattttgtccatcctggtacccctcttgacgaggaggcctctcaaagggcaacttctgtttatcttgttggacaacgaattgacatgctaccgaagcctctaactgaagatgtttgttctcttcgtgctaatgttgagaggctggcattctccgtcatttgggaaatgacacctgatgctgatatcatatcttcaagatacacaaagagtgttatcaagtcttgtgctgcaatgtcttatgtagaagcccaagcaagaatggatgacagccgtttggccgatccactgactgtagacttacggaacttaaattcattagcaaagataatgagaaatcgacgttgcgaaagaggggccctgactcttgcttcagcagaagtcaaattcgaaattgacagtgaaactcatgatcccctcgacataggaatatatcaaattcgcgaggcaaaccaaatgattgaagagtttatgttggcagcaaatgtttctgttgccgagaagattttgcagcactaccccttgtgttcattgctacggcgtcatcctagcccaacaaaggagatgcttgagccattactccgtaccgcctcttccgttggcctaaatctggacgtatcatcctcaaaagcattagctgaatcacttgataatgcgaagagagatgacccgtacttcaacaagcttatccggattttggcaactagatgcatgacgcaagcagtttacttttgcagtggagatttgagcttgtctgagtattatcactatgggcttgcatctgctctgtacactcatttcacttctcctattcgcagatatgcagatgttgtggtgcataggttgctagctgctgctctagatattgcgaaacttccaccagtcttccaggacggtccacaactcacaggcatcgctgacaacttgaattacaggcaccgaaatgcccaaatggcaagcagagcatcggttgagctccacactctcatatatttcaggacaaggcccgtggatactgaagctagaatagtaaagatcaaggcaaatggtttcatagtcttcgtcccaaagtttggcatagaagggcccatctatcttacggcgaagggagacaaaggggccagactgggtagtcgacgaggtgcaccagaaagtaaccaagcctggaacaaacataagctatgctgtgttgcagagtgttatgatccatatggaagtggtggagcctcagccccaccgccccaagctgcagctcaccctcagatgagcaacaactgtaactgtaacattagtgcattcacctgctacgacattgtactagggttctttaattcaacaaacattggtgatttatgatatcgtcaaatcagcctggaattgctcttcatagagttgtaaaaatctctcttcattggtgctaaaaatctaccatgacctcctgtggtcggcgcatca

SEQ ID NO: 5901 - DNA, 3632 bp, Panicum virgatum
taactctagtcgtccacttggacgtgttgctggtataattaagagaaattggaattcgtactgtggttccttgcagccaatgcccatgcctgctggtagtgggggcgttgctcatgctttatttgtttcgaaagatcgaagaattcctaaaatccgaattcaaaccagacagcttgagaatcttttgaacaaaagaattgttgttgcggttgattcatgggatgttctgtctcgctatccatcaggtcactatgtacaaacaattggagatattggtgacaaagaaactgaaacagaggttgtcttaatagagaatgatatcaacacgaggcctttctctacacaagtccttgcttgtttgccaccattaccatggacattatcaccagaagatttggctaatcctaatagacaagacttgcgtcatgtgagagtctttagcgtggatccaccaggttgtcgagatattgatgatgcactacattgctcgttacttccaaatggaaattttgaagttggagtccatattgctgatgtcactaattttgttcaccctggtacccctcttgatgaggaagctgctcaaaggggcacttctgtttatcttgttgggcagcggattgatatgcttccaaagcccctgactgaagatgtttgttcacttcgtgctgatgttgaaaggctggcattctctgtcatttgggaaatgactcctgatgctgatatcatatccacgagatatacaaagagtgtaatcaaatcttgtgctgcaatgtcttatgtggaagcccaggcaagaatggatgacagccgtttagttgatccactaactgtagacctgaggaacttaaattcattggcaaagatcatgcgacaacgccgttgcgaaagaggggctttgactcttgcttctgcagaagtaaaatttgagatcgatagtgaaactcatgatcctcttgacataggaatttatcaaatccgtggaggcaaatcaaatgattgaagagtttatgttggcggcaaatatttctgttgctgagaagattttgaagcacttcccgttatgttctttgctaaggcgtcatcctagcccaacaaaggagatgcttgagccattactccgtactgcttcttctgttggcctaaatctggacgtgtcatcctcaaaggcattagctgaatcacttgacaatgcaaagcgtgatgacccatactttaataagcttattagaattctggcgactagatgcatgacacaggctgtttatttttgcagtggagatttgaccttttctgagtattaccattacgggcttgcagcttctctttacactcatttcacttctcctattcgcagatatgcagatgttgttgttcataggttgctagctgcagctctagaaattgcaaagctcccaccaatctttcaggatggtccccaacttacaggcatcgctgacaacttgaattacagacaccgaaatgcccagatggcaagcagagcatcagttgaactccacaccctcatatatttcaggacaaggccaactgataccgaagctaggatagtaaaggtcaaggcaaatggtttcatagtcttcgtcccaaagtttggcatagaaggacccatctaccttattcctaaaggagaaaagggtggcgactgggttgttgatgaggtgcaccagagggtaaccaagcccgggacaaacatcagttatgctgtcctgcagactgttaggattcgtatggaagttgttgagcctcagccccaccgcccaaagctgcaactcaccctcatttgaaaatgtacagctgaactgtaacactagtgttctcagccttacacctctttgttccccagcccattctttaattcaacattggcgatttacactttgtaacagtagcctcgtggtcagggtcttgcactataaaatcggagtatgcatagttttcctatgtacatgggaacttagtttctgaatgtttcttgcagctgtgaattatacatcgatatattttgttattgtgaaaaagctgttgtatacttgtatgttcatgtgaaaggattcgtaagtaacgatgcattcacttacatggaaagcgaacattattttacatggccaaatctggctgatgtttaccattacttcaaaattaaattggcgacgatacgtttcgtgctcctaatttgtcaacgtcatggtatctccatcaagccgaattcagtactgatagctcacaggtcacagcacgagcaacatgaacaccgtcgaccaaagcgtgagagccagggcagcaaccagatgcgtccacaggaagatgatagagcactcctcttccccaacgtcaaacagctgagctattgtgccaatgctcatggctggaggaactgtggactgcagcaggagcacatagcggtacaggggagatcttggtaggaacccaagcttggtggcagcggtgacgacgccgatgccgcaggcagggaggacgaagtagcgtatggcaacgatcgatatcaccacaacaggctcgatcaccgtcttgcctatcccttttgttaggtttccaccgaggatcagcacggtgcatggaattgctgcatctcctagtaatttggttgtatcttggactacccgaagtggggaactttcttccgtaacaagtgacttcatcttgtctattgcgccgatagtgaatcccacgagcgcagctatacttggtggtgaccacagttctttcagtacttctaccaacaaatccttgggccgctctcacgtagcaactcaagaagctatctctaaaatcatttgaaggcaagggggaactaatggagttgccacaatcgtctgaaaaaatttcagaagtcggtggaacaaaagccacatatcgtcagttgcatcttgacccaaatgttctttggtccgagtgtgatgattcttgcattttgccttgtacagtttagcagatctcctcatgacactgtagctgtgcgtccatatgtagaaatttccgagcgccattgataacgagacataggagagaccaagagagttgcaggtattggcgtccccaaagggactgccctcctcgttgcaaattgctggaataatcatcaaagggatagtgccccagttacctgatgagcaacaagcaatgacgagtccctgaagatgttccccgggtctgaaggctttgacagacacccatcctagaactgctccaatcagaaatatgatgcccatgttcactggcatgaaccaccaggagatgatgtccttgagcgtgacagtgctcgccaagctagagaagacgagcgatggaacgaagacaatataaacaatcttattgatgttcctgcgtgcatcagatgtgagaacgtttaaacgattggatgcgagaagagcaccgagcaatcctacgaggaggacctgcagaaccggcagccatgccacgatgagcagagaccagaacctcatcttggaagcctcagattttgactgccagtatttgtgctgttccagtgatatttgcaggaagaaatgaaacgagtcaacgatctgaatgcctgccacttcaggatcaggagagaactgaaagaagacaaaatgtgctgttgctgcgcc

SEQ ID NO: 5902 - DNA, 1756 bp, Pennisetum glaucum
agtgaacaaagaattgttgttgcggttgattcatgggatgttttgtctcgatatccatcaggtcactacgtacgaaccattggagatattggtgacaaagaaactgaaacagaggttgtcttaatagagaatgatatcaacacgagacctttctctacacaagtccttgcttgtttgccaccattaccatggactttatctcaagaagatttggctaatcctaatagacaagatttgcgccatgtgagagtttttagtgtggacccaccaggttgtcgagatattgatgatgcactacattgcaccctacttccaaatgggaattttgaagttggagtccatatcgctgacgttactaattttgttcaccctggtacgcctcttgatgaggaagctgcccaaaggggcacatctgtttatcttgttgggcagcggattgatatgcttccaaagcccctgactgaagatgtttgctcacttcgtgctgatgttgaaaggctggcattctctgtcatttgggaaatgactcctgatgctgatatcatatccacgagatatacaaagagtgttatcaaatcttgtgctgcaatgtcttatgtggaggcccaggcaagaatggatgacagccgtttagttgatccactaactgtagacctgcggaacttaaattcattggcaaagatcatgcgacagcgacgttgtgacagaggagctctgactcttgcttctgcagaagtaaaatttgagatcgatagtgaaactcatgaccctcttgacataggaatttatcaaatccgcgaggcaaatcaaatgattgaagagtttatgttggctgcaaatatttctgtcgctgagaagattttgaagcacttccccttatgttctttactaaggcgtcatcctagcccaacaaaggagatgcttgagccattactccgtactgcctcttctattggcctaaatctggacgtgtcatcctcaaaggcattagctgaatcacttgataatgcaaagagcaatgacccatacttcaataagcttattagaattttggcaactagatgcatgacacaggctgtttatttttgcagtggagatttgaccttttctgagtattaccattatgggcttgcggcttctctttacactcatttcacttctcctattcgcagatatgcagatgttgttgtccataggttactagctgcagctctagaaattgcaaagctcccaccaatctttcaagatggcccacaacttacaggcatcgctgacaatttgaattacagacaccgaaatgcccagatggcaagcagagcatcagttgaactccacaccctcatatatttcaggacaaggccaactgatactgaagctaggatagtaaaggtcaaggcaaatggtttcatagtcttcgtcccgaagtttggcatagaagggcccatttaccttactcccaaaggagacaagggtggtgactgggtagttgatgaggtgcaccagagggtaaccaagcctggaacaaacatcagttatgctgtcctgcaatctgttaggattcatatggaagtagttgagcctcagcctcaccgcccaaagctgcaactcaccctcgtttgaaaatgtacagctgaactgtaacattagtgttctcagccttacacctctttgttctccagcccattctttaattcaacattggcgatttacggtttgtaacactagcctcgtggccagggttttgtactatcaaatc

SEQ ID NO: 5903 - DNA, 1029 bp, Secale cereale
catgatcccctcgacataggaatatatcaaattcgcgaggcaaaccaaatgattgaagagtttatgttggcagcaaatgtttctgttgccgagaagattttgcagcactaccccttgtgttcattgctacggcgtcatcctagcccaacaaaggagatgcttgagccattactccgtaccgcctcttccgttggcctaaatctggacgtatcgtcctcgaaagcattagctgaatcacttgataatgcgaagagagatgacccgtacttcaacaagcttatccggattttggcaactagatgcatgacgcaagcagtttacttttgcagtggagatttgagcttgtctgagtattatcactatgggcttgcatctgctctgtacactcatttcacttctcctattcgcagatatgcagatgttgtggtgcataggttgctagctgctgctctagatattgcgaaacttccaccagtcttccaggacggtccacaactcacaggcatcgctgacaacttgaattacaggcaccgaaatgcccaaatggcaagcagagcatcggttgagctccacactctcatatatttcaggacaaggcccgtggatactgaagctagaatagtaaagatcaaggcaaatggtttcatagtcttcgtcccaaagtttggcatagaagggcccatctatcttacggcgaagggagacaaaggggctgactgggtagtcgacgaggtgcaccagaaagtaaccaagcctggaacaaacataagctatgctgtgttgcagagtgttatgatccatatggaagtggtggagcctcagccccaccgccccaagctgcagctcaccctcatatgagcaacaactgtaactgtaacattagtgcattcacctgctacgacattgtactagggtccattctttaattcaacaaacattggtgatttatgatatcgtcaaatcagcctggaattgctcttcatagagttgtaaaaatctctctttattggtgctaaaaatctaccatga

SEQ ID NO: 5904 - DNA, 1586 bp, Panicum virgatum
gtagaatcaccttttagagcttccctcatagtatcattctgctatatgaggagagtacttccatcttacctctggcatttaaagaagtgtcctgatacttacatattggtgtattggtatttggaacattatgtttacaggaaatgactcctgatgctgatatcatatccacgagatatacaaagagtgtaatcaaatcttgtgctgcaatgtcttatgtggaagcccaggcaagaatggatgacagccgtttagttgatccactaactgtagacctgaggaacttaaattcattggcaaagatcatgcgacaacgccgttgcgaaagaggggctttgactcttgcttctgcagaagtaaaatttgagatcgatagtgaaactcatgatcctcttgacataggaatttatcaaatccgtgaggcaaatcaaatgattgaagagtttatgttggcggcaaatatttctgttgctgagaagattttgaagcacttccccttatgttctttgctaaggcgtcatcctagcccaacaaaggagatgcttgagccattactccgtactgcctcttctgttggcctaaatctggatgcgtcatcctcaaaggcattagctgaatcacttgacaatgcaaagcgcgatgacccatactttaataagcttattagaattctggcgactagatgcatgacacaggctgtttatttttgcagtggagatttgaccttttctgagtattaccattacgggcttgcagcttctctttacactcatttcacttctcctattcgcagatatgcagatgttgttgttcataggttgctagctgcagctctagaaattgcaaagctcccaccaatctttcaggatggtccccaacttacaggcatcgctgacaacttgaattacagacaccgaaatgcccagatggcaagcagagcatcagttgaactccacaccctcatatatttcaggacaaggccaactgataccgaagctaggatagtaaaggtcaaggcaaatggtttcatagtcttcgtcccaaagtttggcatagaaggacccatctaccttattcctaaaggagaaaagggtggcgactgggttgttgatgaggtacaccagagggtaaccaagcccgggacaaacatcagttatgctgtcctgcagactgttaggattcgtatggaagttgttgagcctcagccccaccgcccaaagctgcaactcaccctcatttgaaaatgtacagctgaactgtaacactagtgttctcagccttacacctctttgttccccagcccattctttaattcaacattggcgatttacactttgtaacagtagcctcgtggtcagggtcttgcactataaaatcggagtatgcatagttttcctatgtacatgggaacttagtttctgaatgtttcttgcagctgtgaattatacatcgatatattttgttattgtgaaaaagctgttgtatacttgtatgttcatgtgaaaggattcgtaagtaacgatgcagtcacttacatggaaagcgaacattattttacatggccaaatctggctgatgtttaccat

SEQ ID NO: 5905 - DNA, 2225 bp, Citrus sinensis
tgctatcattttttttttaagcatcttacttcctcacagatgatgaagatgaggatgatgttcatctggctccaagtagtgctgatgatgctcctagaactgcaagtgtcgctgctgctgctgctggtgaaaattctgctccaagtcgtccgtcaggccgtgttgtcggtattataaagcgaaactggcattcttattgtggatcattggagccaatgcccatgcctgccggtagtggtagtgttgcccatgcattatttgtccccaaagaccgaagaattcctaagattcggattcaaactcgacagcttgggaatcttctggacaagagaataattgtggcagttgattcttgggactgccaatcacgttatccttttggccattatgtacgggtcataggagaaataggtgacagagatactgaaagtgagatggtcctcatagataatgatattgatgctagaccattttccactcaagttttggcatgcttgccgccattgccatggtcggtttcttctgaagatttggccaatcctataaggcttgatttacgagatctgcgtgtctttagtgtggatcctccggggtgcaaggatattgatgatgcattacattgtacagctctttccagtggaaattttgaagttggagttcatattgctgatgtcacaaattttgttcatcctgggactccacttgatgatgaggcctcaaaaaggggcacatctgtctacctcgttgagcgccgaattgacatgcttcctaaacctctaacagaaggcaaatatatgttcactgcgggctgatgtggaaagactggccttctctgttatttgggaattgacacctgaagctgaaattatttcaacaagatatacaaaaagtgttatcaaatcatgtgcagcattatcttatgttgaagcgcaggctaggatggatgatagtcgattgatggatccgttaactacagatttgagaaatatgaattctttggcaaagaaaatgaggcagagacgcattgaaagaggagctttaactcttgcttctgctgaagtcaaatttcaaattgatacagagactcatgaccctcttgatatcggaatgtaccagattcgagaagcaaaccaaatggttgaggagtttatgcttgcagctaatgtttcagtggcggaacaaatccttagacaattccctctttgttcacttttaaggcgtcatccttctccaacaaaagagatgctcgaacctttgctgcgtactgccgctgctgttggtctcaacttagatgtctcatcatcgaaagcactggctgattcacttgatcgtgctgtgggtgatgatccatattttaataagctgattcggatattggctactagatgcatgacacaggcggtttatttctgtagcggggacctcactcctccagaatttcatcattatggtcttgcagcacctctatatactcatttcacctctcctataagaagatatgcagatgttgttgtacacaggttgctttctgcatctttaggtatttacaagctcccatcagtattccaagatagaccccaacttactagcatagccgataatctgaattatcggcataggaatgcccagatggcaagtcggggttcagtggagcttcatactctcatctacttcagaaaacggcccacggacacagaggctagaatagtgaagatcagatccaacggttttattgtctttgtgcccaagtttggcatagaaggacctgtgtacttgacaccaagaggtcagaagggaagcggggattggtatgtagacgagcagcagcagaagattgtaaagatggatggaaatctttcttatagtgttttacagactgtgaacattcacatggaggttgtggaacctcaaccaaaccggccgaaactccaactcaccctcatttagaagttttggtgcaccatttcatttttctgtttgtagacaaattagtaaattaactaacaaagcaatggttgtgtggttctgttttgcagaactacatctgtgttgttgcatccattatgtttagcgtaccaagttgaggataggatgttgtttgttaggcagagatgcaaagaatattgtatcataattttttttttttgaaaaaaaaaacttaaattggttttgttttgactatttattcttcggtttaagttaaatataattttattagaatattg

SEQ ID NO: 5906 - DNA, 1887 bp, Papaver somniferum
gatcgcagatttcctaagattaggattcaaactcgacagcttgataatctcttacataagagaattatcgtggctgtagattcttgggattgtttatctcggtatccttccggtcattatgtacgaaccataggagatatcggtgatagagaaactgaaagtgaggttgttttgattgagaatgatatagattccagaccattttctgctcaagtgttgtcttgtttgccacctatcccttggtcggtgtcctcggtggatctggagaatcccaacaggcaggatttgcgacacttgcgtgtatttagcgtggatcctccaggctgcagggatattgatgatgcactccactgtactcctcttccaaatggacattttgaagttggagttcatattgctgatgtcacaaattttgttcaccctggtactcctcttgatgatgaagcaacccaaaggggtacgtcagtctatcttgttgagcgacgcattgacatgcttccaaaacctctaacagaagatatatgttctcttcgttccgatgttgagagactagccttctctgttatttgggaaatgacgcctgaagccgagattatttctactagatacacaaagagtgtcatcaagtcatgtgctgcattatcttacattgaagctcaagccaggatggatgatagccgcctgatggactcactaactacggacctgcgaaatatgaatgcattggcgaagattatgaggctcagacgtattgagaaaggagctttaactcttgcttctgcagaagtaaaattccagattgacactgaaactcatgatcctcttgatattggaatgtatcaaattcgggaggcaaatcaaatggtcgaggaatttatgcttgctgctaatatttcagttgcagaaaaaatcttgaaacactttccagtattctcgctactaaggcgccatccgagtcctaccaaagagatgcttgaacctttgctgcgtactacggctgctcttggtctgggtttggatgtatcatcttcaaaagccctggctgattcacttgaccaggctgtggctgatgatccatacttcaataagcttattcgtatattggcgactagatgcatgactcaggctgtttacttctgtagtggggacctcacccctccagaatttctgcattacggtcttgctgcagctctatatactcattttacttccccaattcgaagatatgcagatgtcattgtacacagattgcttgctgcagctttggggatttataagcttccaccaatattccaagatagacctcaacttactagcattgctgacaatttaaattaccggcacaggaatgctcagatggcagggcgagcatcggtcgagttgcatacactcatatatttcaggaatcggccaacggatactgaagcaagaatagtgaagataagatccaatggatttattgtatttgtgcccaagtatggtatagaaggccccgtgtacctgacgtcgaaaggggacaagggtggaggggagtggtttgtggatgaggagcatcagaaggttaaaaagatggatggcagcatcagttacagcgttctgcaggcagttaaaattcacatggaggtcgttgaaccccagcccaatcggccgaagctccaactcactctcatctagaaagataagtaatctcgcttaatttacttcacaaactttagaaattatatatgtataatatattagttatttttagaattcttttcatagtttggatatctgagaattaggatttggtcagcacgagtgtaaaatcaaattcagcccctacacagcgttaattggggttggttggaaaagtaatagagaaagattgtgatgaatattattgtt

SEQ ID NO: 5907 - DNA, 2550 bp, Papaver somniferum
ttgaagcatatgtcagatcacttaatcgaccagatttactggacttagtagttgtgcgtcaatcttctgaggatgtaaacatggaagatgttgaagatcatagaccttcaaagagaaaagccatttatactgagcacaagccgatgtcggagattacttctggattgcatcgtggaatctttcaccaaggaaagcttcgagtcaatcgatataatccttttgaggcttatgttgggagtgagagcattggtgatgagataattattcatggcaggagtaacatgaatagggcttttgacggtgatatagtggcagcggaactctttcctaaagaacaatggcatgatgggaaatcttcctctatagcagaagatgaggatgaagaggacgaagatgttcatttagttccaaacagctctgatgatgctcctagaaacacgaaagtcgtgcaagaagctgcaaatgacatgagttccgattcaagccgtccaactgggcgtgttgttggcattataaagcggaactggcaatcttattgtggttctctggaacctatggatatgccagcagctactgggggggtcgcacatgcgttatttgttactaaagatcgcagatttcctaagattaggattcaaactcgacagcttgaaaatctcttgcataagagaattatcgtggctgtagattcttgggattgtttatctcggtatccttccggccattatgtacgaaccataggagatatcggtgacagagaaactgaaagtgaggttgttttgattgagaatgatatagattccagaccattttctgctcaagtgttgtcttgtttgccacctatcccttggtcggtgtcctcggtggatctggagaatcccaacaggcaggatttgcgacacttgcgtgtatttagcgtggatcctccaggctgcagggatattgatgatgcactacactgtactcctcttccaaatggacattttgaagttggagttcatattgctgatgtcacgaactttgttcaccctggtacacctcttgatgatgaagcaacccaaaggggtacgtcagtctatcttgttgagcgacgcattgacatgctcccaaaacctctaacagaagatatatgttctcttcgtttcggtgttgagagactagccttctctgttatctgggaaatgacgcctgaagccgagattatttctattagatatacaaagagtgtcatcaagtcatgtgctgcattatcttaccttgaagctcaagccaggatggatgatagccgcctgatggactcactaactacggacctgcgaaatatgaatgcattggcgaagattatgaggctcatacgtattgagaaaggagctttaactcttgcttccgcagaagtaaaattccagattgacactgaaactcatgatcctcttgatattggaatgtatcagattcgggaggcaaatcaaatggttgaggaatttatgcttgctgctaatatttcagttgcagaaaaaatcttgaaacactttccggtgttctcgctactaaggcgccatccgagtcctaccaaagagatgcttgaacctttgctgcgtactacggctgctcttggtctgggtttggatgtgtcatcttcaaaagccctggctgattcacttgaccaggctgtggctgatgatccatacttcaataagcttattcgtatattggcgactagatgcatgactcaggctgtttacttctgtagtggggacctcacccctccagaatttctgcattacggtcttgctgcagctctatatactcattttacttccccaattcgaagatatgcagatgtcattgtacacagattgcttgctgcagctttggggatttataagcttccaccaatattccaagatagacctcaacttactagcatcgctgacaatttaaattaccggcataggaatgctcagatggcagggcgagcctccgtcgagttgcatacactcatatattttaggaatcggccaacggatactgaagcaagaatagtgaagataagatccaatggatttattgtatttgtgcccaagtatggtatagaaggccccgtgtacctgacgtcgaaaggggacaagggtggaggggagtggtttgtggatgaggagcatcagaaggttaaaaagatggatggcagcatcagttacagcgtcctgcaggcagttaaaattcacatggaggtcgttgaaccccagcccaatcggccgaagctccaactcactctcatctagaaagataagtattctcacttaatttactgcacaaactttagaaattatatatgtataatatattagttatttgtagaattcttttcatagtttggatatctgagaattaggatttggtcagcacgagtgtgaaatcaaattcagcccctacacagcgttaattggggttggttggaaaagtaatagagaaacattgtgatgaatattattgttcttttctttggtgtctgagtaatttagaacaaatccaaaactctaaagtctatac

SEQ ID NO: 5908 - DNA, 3336 bp, Eucalyptus grandis
catgctgcacaacaagtccttcgtcaagaagacgagagcaggcaaaatcaccaagaatgtgagggagcactacttgcgggacgatatctactgcggagtcccgacgtgcaaggtctgcgacgcttccgccgctcgcctcagcggctccgcctcctccccgatcctcgtcctcgacacgaacgtcgtcctcaatcagattgatttgctggagaatccggcgatcgatgatgtggtcgtgctgtccatcgtgctgcaagaggtcaggaacagaaatttggccgtctataatagaatcagagcgctctgcagcaatttggcgaagaaattctttgtcttttcgaatgagcaccacaaggatacatttgtccaggacatggctggtgaaagtaaaaatgacaggaatgatagagctatacgtgtggcggctcagtggtatcagagtcatcttggtggtgctgcccaggttctgctcataaccaatgacagggagaataaaaggaaagctacagaagagggcattccagcagagaccattgaagcgtatgtaaaatcactggaccgcaaggatctgctagatttgcttgtgcgtcctgcatcagaggatgtagtcatggaaggagttgaagatttaagaccatcaaagaggaaagttatatatactgagcacaagcccctttctgaaattacttctgggttgcatcgaggaatatatcaccaagggaagcttcgcgttaatcgatacaatcctttcgaagcatatgttggaagtgaaagtattggtgatgaaatcattatatatgggcgtggaaatatgaatcgagcttttgatggtgatatcgtggcagtggaactcctgcctcaagatcagtggcaagaggagaattctttatcattagcagatgaagaggatgaagaggaaggagttcatctggtcccaggcagtgcagatgatgctcctaggactacaaatctggtgcagggtgcttctggtccacctccatctcgcccatctggccgggttgttggtatcataaagaggaactggcattcttattgtggatcattggagcccatgcccatgccggccggagatgggggtgttgcacatgcactatttgtttctaaggacaggagaattccaaaaattcgcatccaaactcgacagcttgggaaccttctgaacaagaggattgtcgtgactgtggactcctgggaccgtctttcacgttatccttctggtcattatgttcgtacaattggagaaataggtgatagagatgctgaaagcgaggttgtattgattgagaatgacattgatgcaaggccattttcttctcaagtattggcatgtttgcctccattaccatggtcagtctcctcagaagatttggcaaatcccatcaggcaagatttacggcatttgcgtgtcttcagtgtggatcctccaggatgcaaggatattgatgatgccctgcactgtacagccctttccaatggaaattttgaagttggagttcatattgctgatgtgacaaattttttgcacccttccacaccactcgatgatgaggctgcgcaaaggggcacttctgtttaccttgttgagcgccgcattgacatgcttccaaagcctttgacagaagatatatgttcacttcgggctgatgtggagagactggctttttctgttatctgggaaatgacacctgaagcagagataatatccacaagatatacaaaaagcattattaaatcatgtgcagctctgtcttatattgaagctcagacaaggatggatgacagtcggttggcagatcccttaactacagatttgagaaatatgaatacattggcaaagattatgaggcataggcgtattgagagaggagccttaacacttgcttctgccgaggtcaaatttcaaattgacactgagactcatgaccctcttgatattggcatgtatcagattcgagaagcaaaccaaatggtggaggagttcatgcttgctgccaatgtttcagttgctgaaaaaatccttaaacactatcctctatgttctctgttgaggcggcatcctataccaacaaaagagatgctcgaacccttgctgcgtacagctgcttctgttggtcttgagttggacgtatcttcatcaaaagcactggctgattcacttgaccgtgcagtgggagaagatccatattttaacaaattgatacgaatacttgcaactagatgcatgacacaggcagtatatttctgtagtggagacttgactccgccagaataccaacattatgggctggctgccccattatatactcattttacttcacctatcaggcgatatgctgatgtcattgtgcacaggttgcttgctgcatcattaggaattgacaagcttccagccatatttcaagacagaccccagttaacgagtattgctgacaatctgaattaccgacatagaaatgctcagatggctggtagagcctcagtggagctccatacgctcatctacttcaggaagcggcccactgacactgaagctagaattgtcaagattcgatccaatggctttattgtgtttgtacctaaattcgggattgaaggacccgtatacttgacagagagaagtgagaagggaggaggggaatggtttgttgacgaacagcagcagaagataaaaaagatggatggaagcattagttatggggtcttgcagaaggtgaacattcacatggaggttgtggagcctcaaccgaatcggccaaaacttcaacttgccctggtttaggtatgttaaaatagacatgtttagtgtagcagcaacaccatgtcagctattgagtaatggagctcgtccatcaaaattatggtaaagaactttgccgatctcagcgcctccgcaaaatcagagtttgtcgggggagcaatgtaacataacatatggtgttcgcctgcatagattagattcttccttttttgcggggtgagggtgctgcaaagtacttttatagacggccattcaaactgtttgtttttattctccttttatttctctataacctgttttcatatacttttgatatgaagtgggaattttttcttctttcttttctttatttatttgttttggtttcttatgtaatttttttaatctaagttacttggacaagttgtacgagtcagaggcaatagaacgtatttacgaattttgtttttgaatcactttccctagagtgacaatgtatcgtcttcttactatgtgaatttttcttcgcaattgtgatgtttctaaagataatgaggagaggttgagcctgaacattg

SEQ ID NO: 5909 - DNA, 3323 bp, Citrus clementina
actattcgtttgaagaaagtaaagcagaaggggcaaaacaaaaaaaggcgctgttcctcgcctctcaagcgtcttcacatcagaggctcacagttacagtggcggcagcgacgcattataaataaataaattaattaattaaaaaaataagaaaaggaagaaaggttctgcaaactactgaaggctgaggcacatcaggcatcttaattggattcagaggagaggcaaacatgttaaagagcaaatcatacagtaggaagaccaaaagtaataaaattaaaaaggaagtaagagaagtctatctccgagatgacatttggtgcggtgctgcttcttgctcaacctgcgactcctccgccgctcgcttgtccgcttccacgattcttgtcgtcgacactaacgtcgtccttaatcagattgatttgctggagaatcccgcgattgatgacgtggtggtgctgtctgtggtgttggatgaagttaagaacaagaacttatcggtttacaatagaattagagctctttgcagtaattctttgagaaatttctatgttttctcaaatacatttcacaaggatacacatgtagataagatggataaagaaagtcctaatgatttgaatgatagagcaattcgggtggcaactcagtggtaccagaagcatcttggtgatgcaacaaaggttttacttgtgactaatgatagggaaaatatgaggaaggctactgaacaaggcatattcgctgagacaattgagtcgtatgtgaagtcattgggtcaacccaatttgcttgacctgcttgtccatcctgcatctgaagatgtaaacatggaagatgttgaagatttgagaccctctaagaggaaagttatttatccagagcacaagcccatgtcagagattacttctgggttgcgtcgtggaatataccatcagggaaaattgcgagttaaccgttacaacccatttgaagcatatgttggaagtgaaagtattggtgatgaaataatcatctatggacgtacaaacatgaatagggcttttgattgtgacatagttgctgtggaacttctaccccaagaacagtggcatgaagagaagtctttatttatagcagcagaggaagatgatgaagatgaggatgatgttcatctggctccaagtagtgctgatgatgctcctagaactgcaagtgtcgctgctgctgctgctggtgaaaattctgctccaagtcgtccgtcaggccgtgttgtcggtattataaagcgaaactggcattcttattgtggatcattggagccaatgcccatgcctgccggtagtggtagtgttgcccatgcattatttgtccccaaagaccgaagaattcctaagattcggattcaaactcgacagcttgggaatcttctggacaagagaataattgtggcagttgattcttgggactgccaatcacgttatccttttggccattatgtacaggtcataggagaaataggtgacagagatactgaaagtgagatggtcctcatagataatgatattgacgctagaccattttccactcaagttttggcatgcttgccgccattgccatggtcggtttcttctgaagatttggccaatcctataaggcttgatttacgagatctgcgtgtctttagtgtggatcctcctgggtgcaaggatattgatgatgcattacattgtacagctctttccagtggaaattttgaagttggagttcatattgctgatgtcacaaattttgttcatcctgggactccacttgatgatgaggccgcaaaaaggggcacatctgtctacctcgttgagcgccgaattgacatgcttcctaaacctctaacagaaggcaagtttatatatatgttcactgcgggctgatgtagaaagaatggccttctctgttatttgggaattgacacctgaagctgaaattatttcaacaagatatacaaaaagtgttatcaaatcatgtgcagcattatcttatgttgaagcgcaggctaggatggatgatagtcgattgatggatccgttaactacagatttgagaaatatgaattctttggcaaagaaaatgaggcagagacgcattgaaagaggagctttaactcttgcttctgctgaagtcaaatttcaaattgatacagagactcatgaccctcttgatatcggaatgtaccagattcgagaagcaaaccaaatggttgaggagtttatgcttgcagctaatgtttcagtggcggaacaaatccttagacaattccctctttgttcacttttaaggcgtcatccttctccaacaaaagagatgctcgaacctttgctgcgtactgccgctgctgttggtctcaacttagatgtctcatcatcgaaagcactggctgattcacttgatcgtgctgtgggtgatgatccatattttaataagctgattcggatattggctactagatgcatgacacaggcggtttatttctgtagcggggacctcactcctccagaatttcatcattatgggcttgcagcacctctatatactcatttcacctctcctataagaagatatgcagatgttgttgtacacaggttgctttctgcatctttaggtatttacaatctcccatcagtattccaagatagaccccaacttactagcatagccgataatctgaattatcggcacaggaatgcccagatggcaagtcggggttcagtggagcttcatactctcatctacttcagaaaacggcccacggacacagaggctagaatagtgaagatcagatccaacggttttattgtctttgtgcccaagtttggcatagaaggacctgtgtacttgacaccaagaggtcagaagggaagcggggattggtatgtagacgagcagcagcagaagattgtaaagatggatggaaatctttcttttagtgttttacagactgtgaacattcacatggaggttgtggaacctcaaccaaaccggccgaaactccaactcaccctcatttagaagttttggtgcgccatttcatttttctgtttgtagacaaattagttaattaactaacaaagcaatggttgtgtggttctgttttgctgaactagatctgtgttgttgcatccattatgtttagtgtaccaaattgaggataggatgttgtttgataggcagagatgcaaagaatattgtatcataattttttttttttttgaaaaaaaaaacttaaattggttttgttttgactatttattcttcggtttaagttaaatataattttattagaatattgc

SEQ ID NO: 5910 - DNA, 2823 bp, Amsonia hubrichtii
gtggtgctatcagtggtgttggaggaggttaagaataagaatattggaatttataacagacttagggctctctgcagcacctcctcccggaaattctttgtcttctccaatcaacatcacagggatacatatgtgaaagagatggctggtgagactccaaatgatcgcaatgaccgagcaatacgggtggcttctcaatggtatcagaatcatcttggtgcttctgtgcgggtcatattgatcacaaatgatagagagaatcagaggaaggccttagaggagggtatttctgcagagacagttgaatcatatgtgaaatcacttgataagccggaattgctggacctgattgttcagcctccctctgaggatgttaccatggaggatgtagaggatctcaggccttcaaagagaaaagttgtataccctgagcataagcccatgtcagagattacttctggcttgcttcgtggaatttatcatcaaggaaaacttcgtgtaaaccgttacaatccatttgaagcatatgttggaagtgaaagtattggtgatgaaataatcatttatggtcgtgcaaatatgaatagagcttttgatggtgatattgtggctgtagaacttttgcctcaagaacagtggcatgatgagaagtctctactgatagctgatgaagaggatgaagaggaagatgttcatctagctccaagcagtgctgatgatgctcctagggccacaaatctagtgcaagagtcagttgggggtgcaagtgctgtgccttctcgtccatctggacatgttgttggtattataagacgaaattggaaatcatattgtggatctttggagccaatgccaatgccagcaggggatggcggtatagcctatgctttatttgtttccaaagatcgtagaattcctaaaattcggataaaaactcgacagcttggaaatattctggataagagaattgttgttgccgttgattcatgggattgcttatctcgatatccctctggccattatgtcaggacaatcggagaaataggtgatagagatactgaaagcgaggtggtactaatagaaaatgatatagatgccagaccattttcttctcaagttttgtcatgcttgccacctttgccctggtctgtgtcttctgaagatctggctaatcctattaggcaggatttacgtcatctgtgtgtttttagcgtggatcctccaggatgcaaggacattgatgatgcattgcactgtacagctcttccaaatggaaattttgaagtgggagttcatattgctgatgtcaccaacttcgtgctccctggaacggcccttgacaatgaggcttcccagagaggcacctctgtctaccttgttgagcgtcgaattgacatgcttcctaaacctcttacggaagatatctgttctctttgtgctgatgtggagagactagctttctcagttatttgggaaatgacccctgaagctgagattatttctacaaaatatacgaaaagtgtgatcaagtcttgtgcagctttgtcttatgtggaagctcaagcgaggatggatgatagtcgcttggtagatccagtcactacaaatttgcgaaatatgaacgctttagctaagattatgcggcaaagacgtattgacagaggagccctgacattagcttctgcggaagtgaagtttcaaattgacactgaaactcatgacccccttgatattggaatgtaccaaataagagaagctaatcaaatggttgaggagtttatgcttgcagctaatgtttcggttgctgaaaagattcttaaacatttccccctgtgttcactactcagacgacatcctagtccaacgaaagagatgctagaacctttgcttcgaactgctgctgctgttggtctgagtttggatgtgacatcatcaaaagctctggctgaatcacttgatcgtgctgtggctgatgatccttactttaataagctgattcgtattttggcaaccagatgcatgacccaggcagtctacttttgtagtggagatctcagtcctccagagttcaatcattatggtcttgcatcacctctctacactcatttcacctctccgatcagaagatatgcagatgtgattgttcacaggttgcttgcagcatcattaggaataaacaggctcccagacgtcttccaggaccgacctcagcttactagtatagctgacaatctaaattatcgccatcggaatgcgcaaatggcaagtcgggcctctgttgagctccatactcttatttatttcagaaacaggcccacagatacagaggccagaatagttaaaatacgatcaaacggcttcattgttttcgtgcccaagtatggtattgaggggccagttaatttgaacaagaagggaggagagtggttggcggatgagcagcagcagagggttaaaagaagtgacaatagcatttcatatggtgttcttcagaaagtgcagattcatatggaggttgtagaaccccagcctcatcggccaaaactcgagcttaccttaatttgaaggtagaaaaaactgttgtactaaagtatttcattttctactttagttccacacacgtttgcagttgtgcagagtgatatatattttgtcatttcttagtttgtgacatcaatttgtacaacagtaataggatgtgattaggaatacttgcatttattttttcttttgacactatttttacgtttgcgacactttgtaatctaatagaaaacctacaattcttttaacggagaaattgacaaaagtattaacttaacc

SEQ ID NO: 5911 - DNA, 2993 bp, Solanum phureja
caatatgttgaagaacaaagcattctcacgtcaaaccagacaaggcagaataattaaggaagttagggaacattatttgcgagatgatatttattgcggagccccttattgcaagaatgggtgtaaagtttcatctccttgtttaagcgactctcacttcactattcttgttcttgacaccaacgttgttctcaaccagattgatttgctggagaatcaagctattgacaatgtggtagtgctatccgtggtgttgtcggaggtcaagaacaagaacatttcggtttataacagactcagggctctgtgtagtagttctttaaggaagttctttgtcttctctaacgaaaatcacaaggatacttatgtgaaggcaatggctggtgaaagtccaaatgatcggaatgatagagctattagggttgcagctaaatggtatcaggatcatcttggcagcgcagtaagtgtcttgctaattacgaatgatagagagaataagaagaaggcaattgaagagggaatttctgcagagacagttgaatgctatgtaaagtcacttggtcagccagaattgcttgacctaatagtacagcctccttctgaagatgttaatatggctgatgttgaggatttgaggccttcaaagcgaaaagtcatttataatgagcataagcccatgtcagaaattacttctggcttgcttcgtggactccttcaccaggggaaacttcgcgttaaccgttttaatccatttgaagcatatgttggaagtgaaagcattggtgatgagataattatatatggacgtgcaaacatgaatagggcttttgatggtgatatagtggcagttgagcttttgcctccagaacagtggcacgaggaaaagtctttggcattagctgatgaagacgatgaagaagaagatgtccatttagctccaaacactgctgatgatgctcctagagtcctgaatcaagggcaaactgcacctgaggaaatgaaaccttctcgtccaactggatgtgttgttggtatcataaagcggaactggcactcttactgtggatccttggagccaatgcctatgccagctggtgatggtggtcgtgcccatgccttattcgtatccaaagaccgcaggattccaaagatacggatacaaactcgtcaattgggaaatttgctggataaacggattatcgttgcggttgattcatgggatcgtttgtctcgatatccaaccggtcactatgtgaggacaattggtgaaataggtgatagggacaccgaaacagaggtggtactaatagagaatgatatagatgccaggccattttctgcccaagtgttggcgtgcttgccaccattaccttggtctgtgtcttctcaagatttgacaaatcctattagacaggatttgcgtcacctgcgtgtatgtagtgtggaccctcctggatgcagagatattgatgatgcattgcattgtatggctctttcaaatggaaattttgaagtgggagttcatattgctgatgttactaattttgttcatcctggaactccactcgatgatgaggcttcacaaaggggtacttctgtatatcttgtagagcgtagaatcgacatgcttccaaaacctcttacggaagatatttgttcacttcgttctgatgttgaaagactagctttctcagttatctgggaaatgacacctgatgccgagattatttctgcaagatacactaaaagcgtgattaaatcatgtgcagcattatcctatgtcgaggcgcaagcaagaatggatgatagtcgcttggtggatccaataacttcagatttacgaaatttgaatgggttagccaagataatgaggcaaagacgcattgataggggtgcactgacacttgcttctgctgaagtcaaatttcagattgatactgaaactcatgaccctcttgatattggaatgtatcagattcgtgaagcaaaccaaatggttgaggagtttatgcttgctgctaatgttgcagttgctgaaaaaatccttaagcattttcctgtctgctcactattaagacgccatccaagcccaaccaaagaaatgcttgagcctcttctccgcacagctgaagcagttggtcttagtttggatttgacatcatccaaagcattggctgactctctagatcttgccaagggtgacgatccgtacttcaacaagctgatccggattctggcaaccagatgcatgacacaggcggtttacttttgtagtggagaccttagtcctccggaatatcttcattatggtcttgcctctcctctttatactcatttcacctcgcccattagaagatatgctgatgtcatcgtccatcgattgcttgctgcttctttgggaatttatcagcttcccggtgttttccaagataaacccaagctaactagtatttctgacaatctaaattatcggcataggaatgctcagatggccagcagagcatcagtagagctccatactctcattttcttcaggaagcgaccaacagataccgaggcgagaatagtgaaaataagatcaaatggcttcatcgtttttgtgcccaagtacggtattgaagggcctgtatacttgacatctaaaggcgacaatggaggggaatgggtagtcgatgagaaacaacagaaaattagaaagcttgatggaagtgtttcgtatggtgtacttggaacagtgagaattcacatggaagtcgttgagcctcagcctaatcggcctaaactacaactaacccttgtatgagaccgataactttaccaagaaagtcgaggtcgatagcatgttgtcgttattccagtgtgatagttgaattgttttttaacggacaatttgtgtatcattagatcgatgcagctcctttaaatgttcaaaaaattgatgattattcttttattactttctgccactattatatgttgcataaatgttctaa

SEQ ID NO: 5912 - DNA, 3214 bp, Solanum lycopersicum
aaagaaaatcaaaagagccgctcttttcatcttcaacaccaaacgcacttgagcataaactcctgtatccataaaccctaaatccaaagaatccatagcgatgttgaagaacaaagctttctcgcgtcaaacaagacaaggcagaataattaaggaagttagggaacactatttgagagatgatatttattgtggagccccttattgcaagaatgggtgtaaagtttcatctccttgtttaagcgactctcacttcactattcttgttcttgacaccaacgttgttctcaatcagattgatttgctggagaatcaagctattgacaatgtggtggtgctatccgtggtcttgtcggaggtcaagaacaagaatattgcggtttataacagactcagggctctgtgtagcaattctttaaggaagttctttgtcttttctaacgaaaatcacaaggatacttatgtgaagaccatggcaggtgaaagtccaaatgatcggaacgatagagctattagggttgcagctaaatggtatcaagatcatcttggcagcgcagtaagtgtcttgctaattacgaatgatagagagaataagaagaaggcaattgaagagggaatttctgcagagacagttgagtgctatgtaaagtcacttggtcagccagaattgcttgacctaatagtacagcctccttctgaagatgttaaaatggatgatgttgaggatttaaggccttcaaagcgaaaagtcatttataacgagcataagcccatgtcagaaattacttctggcttgcttcggggactccttcaccaggggaaacttcgtgttaaccgttttaatccatttgaagcatatgtcggaagtgaaagcattggtgatgagataattatatatggacgtgcaaacatgaatagagcttttgacggtgatatagtggcagttgagcttttgcctccagaacagtggcacgaggagaagtctttggcattagccgatgaagatgatgaagaagaagatgttcatttagctccaaacactgctgatgatgctccaagagccctgaatcaagggcaaactgcacctgaggaaatgaaaccttctcgtccaactggatgtgttgttggtatcataaagcggaactggcactcttactgtggatccttggagcctatgcctatgccagctggtgatggtggtcgtgcccatgccttatttgtatccaaagaccgcagaattccgaagatacggatacaaactcgtcaattgggaaatttgctggataaacggattattgttgcggttgattcatgggatcgtttgtcccgatatccaactggtcactatgtgaggactattggtgaaataggtgatagggacaccgaaacagaggtggtactaatagagaatgatatagatgccaggccattttctgcccaagtgttggcgtgcttgccaccattaccttggttggtgtcttctcaagatttgacaaatccgattagacaggatttgcgtcacctgcgtgtatgtagtgtggaccctcctggatgcagagatattgatgatgcattgcattgtatgcctctttcaaatggaaattttgaagtgggagttcatattgccgatgtcacaaattttgttcatcctggaactccactcgatgatgaggcttcacaaaggggcacttctgtatatcttgtagagcgtagaatcgacatgcttccaaaacctcttacagaagatatttgttcacttcgttctgatgttgaaagactagctttctcagttatctgggaaatgacacctgatgctgaggttatttctacaagatacactaaaagtgtgattaaatcatgtgcagcattatcctatgtcgaggcacaagtgagaatggatgacagtcgcttggtggatccaataacttcagatttacgaaatttgaatgggttagccaagataatgaggcaaagacgcattgataggggtgcactgacacttgcttctgctgaagtcaaatttcagattgatactgaaactcatgaccctcttgatattggaatgtatcagattcgtgaagcaaaccaaatggttgaggagtttatgcttgctgctaatgttgcagttgctgaaaaaatccttaagcattttcctgtctgctcactattaagacgccatccaagcccaaccaaagaaatgcttgagcctcttctccgcacagctgaagcagttggtcttagtttggatgtgacatcatccaaagcattggctgactctctagatcttgccgagggtgacgatccatacttcaacaagctgatccggattctggcaaccagatgcatgacacaggcggtttacttttgtagtggagaccttagtcctcctgaatatcttcattatggtcttgcctctcctctttatactcatttcacctcgcccattagaagatatgctgatgtcatcgtccatcgattgcttgctgcttctttgggaatttatcagcttcctggtgtgttccaagatagacccaagctaactagtatttctgacaatctaaattatcggcatagaaatgctcagatggccagcagagcatcagtagagctccatactctcattttcttcaggaagcgaccaacagataccgaggcgagaatagttaaaataagatccaatggcttcattgtctttgtgcccaagtatggtattgaagggcctgtatacttgacgtctaaaggggacaatggaggggaatgggtagtcgatgagaaacaacagaaaattagaaagcttgatggaagtgtttcgtatggtgtacttggaacagtgagaattcacatggaagtcgttgagcctcagcctaatcgacctaaactacaacttacccttgtatcagaccgataactttaccaagaaagtggaggtcgatatcatgtatcatgtagtctttattccagtgtgatagttgaattgttctttaacggacatttgtgtatcattagatcgatgcagctccattaaatgctgcaaaaacatttatagttattcttttattatatgtttacataaatgttctaaagtgtaacttacgtggttaccatagactgagatattcagtggtgtatttaggatttcgaaaaaatgtgtgtactattacgaaatgatgcatttaagatataaatttgattgatttgacctttacattcttaa

SEQ ID NO: 5913 - DNA, 3137 bp, Beta vulgaris
acaaactgtattttcaagcgcccaatgcagcggcgcaagagttaaaccctataaaccttgcaacttgcaattaaattatttcctcaacaagctaattacttcaaattatttgctgttctttgaacaatttgattcaattcattgtaataagcggaacaaattcgcgctcaaaaatgctgcaaagcaaatcctttgtcaagaaaaccaagggaggcaaagttgtcaaggttgttcgagaacactatttaagagatgatatctactgtggagcttcaatttgtaaaatttgtgattcttcagttgctcgtttattctctgatgcttccactctacttattctcgatactaatgttgttctaaatcagattgatttacttgagaatccagcaattgatgaagtggtggtgttgtcagtggtgttggatgaggttaagaataagaatctgtctgtttacaacaggcttagagcgctttgcggcaattctcaaaggaagttttttgttttttcaaatgagcatcataaggagacctatgtcaaaggtatgattggtgaaagtccaaatgatcgaaatgatagagcaattcgtgtggcaactcaatggtatcagaaacatctaggctctgcagtacgagtcttactggttaccaatgatagggagaacaaaaggaaagcaaatgaggaaggcatacttgctgagacagttgagtcatatgtcaaatcacttggtcaaccagcattgctcgatctggttgcgcaacctgcatctgaggacatggtgatggatggtgttgaagacttgagaccttccaagaggaaagtcatttacagtgagcataaaccaatgtctgagatcactgctggtttacaccgtggcatttaccatcaaggaaaacttcgtgttaaccgttataatccatttgaagcatatgttggaagtgaaagtattggggatgagatagtcatacatggacgaacaaacatgaacagagctttcgatggtgatatagtggctgtggaacttttgcctcaagatcagtggcatggagagaagtctagaatagcagatgaagaggatgaggaagatgaaaatgttcgactagctccaaatagtgctgatgatgcacccagaaatacaaatgtccaaggctccagtgcagatgatactcctggtcgtccatctggacttgttgtgggtgtcataaagcgtaactggcactcttattgtggatctctagaaccaatgtctttgcctgctggtagtggtggcactgtccatgctttatttgtttcaaaggatcgaaggatacctaagattcgtattcaaactcgacagcttgggaaccttttggataagagaattattgtggctgttgactcttgggatcgtttatctcgctatccctctggtcactatgtccaaaccattggagtaattggtgatagggaaactgaaactgaggtggtactaatagagaatgatataaactctcgaccattttcctctcaagtgttggcttgtttgccaccattaccatggtcagtgtctcctgaacatctatctgatcccaacagagaggatctaagaaatttgcgagtttttagcgttgatcctccaggttgccgggacattgatgatgcgctccattgtatacctctcccaaatggaaactttgcagtgggagtccatatagctgatgtgactaattttgtccattctggaactcctcttgatgacgaggcttcacaaagagggacatcggtgtatcttgtggagcggcgaattgacatgcttccgaaacctttgacggaagatatctgctccctcagatcagatgtggaaaggctggccttttctgttatttgggaaatgacgccacaagcagatattatatcttctaggttcacaaaaagtgtcatcaagtcatgtgcagcaatgtcatacgttgaagctcaagcgaggatggacgatagtcgtctggtcgatccgctaacaaccgatcttagaaatatgaatactttagcaaagataatgaggcaacggcgtatagagagaggagccttgacacttgcttctgcagaggttaagttccagattgatactgaaactcatgatcctcttgatattggaatgtaccaaatacgagaagctaaccaaatggtcgaggagtttatgcttgctgccaatgtttcagttgcaggcaaaatactgaaacattttccatttgttcattattaaggcgtcacccttctccaacacgagagatgcttgagcctctgctacgcactgctgctgccattggtcttgatttggatgtctcatcatctaaggcacttgctgattcacttgatcgggctgtgggttctgatccttatttcaacaagctgatccggattctagcaacaagatgtatgacacaggcagtatatttctgcagtggagatctcagtcctccggagtatcttcattatggtcttgctgctcccttgtacactcattttacttctcctatcaggagatatgcagatgtagtagtacacaggttattggctgcatccatagggatatccaagcttccagcaatatttcaggataggcctcaacttactagtattgctgacaatttgaattatcgacatagaaatgcccaaatggctggccgggcttcagttgagcttcacactctaatatactttagaaaacggcccactgatgcagaggcccgaatagtgaagatacgatccaatggttttattgtatttgtgcccaagtatggtattgaggggcccgtgtatttaactgcaagaggtgacaagggaaatggagactgggtggtagacgagcagcgtcagctggttaaaaaggcagatgagagcgttagctacaatgttttgcagatggtgaagattcatctggaggtggtagaaccgcagccaaataggcctaaacttcaacttactcttacagaataattggcaattctcattttactttgttcattgcgaggcacaaaagctatccgtaccattgatgttccttttagaagtaatttgttagctttcctcctgtaaaactgagttggttgaagtaacatttatcgtgaagtatatatcaatgagacttggtaagatttgatcc

SEQ ID NO: 5914 - DNA, 2200 bp, Artemisia annua
aatccatttgtaagcatatgttggaagtgagagtattggcgatgaaattataatatttgggcgtgaaaacatgaatagggcttttgatggagatattgttgctgtcgaagttttgactcaagatcaatggcttaacgaaaaatctctgcacatagccgacgaagatgatgaagaagatgatggtgttcacttagcaccaagcagtgccgatgatgctccaagaattgcaaattcggcacaaggttcttctgaaaatgctaacaatgctccttcacgtcgttctgggcgtgttgttggcattattaaacgtaattggcatgcttactgtggatctttagagccaatggctatgccagcaggtaatgctggtattgcccatgctttatttgtgtctaaggatcgaagatttccaaagataagaattcaaactcggcagctcggtaatcttttggacaaaagaatcattgttgcggtcgatacttgggattgccaatcccgatacccttctggtcattatgtccgaacaataggagatattggagaccgtgaaactgaaacagaggttgtattaatagagaatgatatagatgcaaaaccatttacttctcaagttttggcatgcctaccaccgttaccatggtcagtgtcctcagaagatctatcaaatcccattagacaggacttgcgtcatttacgcatatttagcgtggacccaccaggatgcaaggacattgatgatgcattacactgtacttcacttccaaatggaaactttgaagttggagttcatattgctgatgtcacgaatttcgtccatcctggaacaccccttgataatgaagctacacaaagaggaacttctacctaccttgtcgaacgccgcattgacatgcttcccaaacctcttacagaagatatatgttccctacgggctgatgtggagaggctagccttttctgttatttgggaaatgacttccgacgcacatgttatttctaccagatatacaaagagtgtcatcaagtcatgtgccgctttgtcttacgttgaagctcaagcaaggatggatgacagccggttgttggatccagtaaccacggatttgcggaatatgaatatgttagcaaagataatgcgggcaaggcgtatcgaaagaggggccataactcttgcttctgcagaagtcaaattccaagttgacacggagacacatgatcctcttgacattggcatgtatcaaatccgagaagcgaatcaaatggttgaagagtttatgcttgctgctaatgtttcagttgctgaacaaatccttaagagcttccctcagtgttcattgttgagacgccatcctagtccaaccaaagagatgcttgaacctttgctacgtactgctgcttctgttggccttgatttggatgtgtcatcatccaaagcactcgctgactcacttgaccgtgctgtgggtgaggacccatatttcaataagttgatccgtattctagcaacaaggtgtatgacacaggcggtttacttctgtagtggggagcttagcccgccagagtttcaccattatgggcttgctgcacctctatatactcatttcacctcaccaattagaagatacgctgatgtcatagtgcacaggttgcttgctgcatctttaggaatatacaagctgccacctatattccaggacagaccacaactcaccagcatcgctgacaatctaaattatcggcataggaatgctcagatggcaagtcgtgcctccatagagcttcatactataatctttttcaggaaaaggcctactgatactgaagccaggattgtaaagattagagcgaatggatttattgttttcgtgcccaagtatggtattgaagggccagtgtacttgacaatgagaggtgagaaaggagggggtgaatgggtcgtggacgagcagcagcagaagattagaaagattgatgggtcgatatcttatggtgttcttcagactgtacaaatccatatggaggttgtagaaccgcaacccaaccggcctaaacttcagctcactcttatttaaacagtaagattttgaacttaaacttttctatatgtttttctagcttctgtcaagatagcattataaatatgaggatgtgtgtatgcaaagaatattgttcattattctattcaaatacaagaacttttt

SEQ ID NO: 5915 - DNA, 1521 bp, Cirsium arvense
gagttcatattgctgatgtcacaaatttgttcaccctggaacaccccttgatagtgaagccacacaaagaggaacttctacctatcttgttgaacgccggattgacatgcttcccaaacctcttacggaagatatatgttctctacgggctgatgttgagaggcttgccttttctgttatttgggaaatgactcctgatgcacatgttatttcttcaagattcacaaagagtgttattaagtcatgtgctgctttgtcttatgttgaagctcaagctaggatggatgacagccgcctgatggatccagtaactacggatctgagaaatatgaatactttggcaaagataatgaggcaaaggcgtattgaaagaggagcaataacccttgcttctgcagaagtcaaattccaagttgacactgagactcatgatcctcttgacattggtatgtatcaaatccgagaagcgaaccaaatggttgaagagtttatgcttgcggctaatgtttcagttgctgaacagatccttaagaacttccctctttgttcactattgaggcgccatcctagtccaacaaaagagatgcttgaacctttgttacgtacggctgcttctgttggccttgatttggatgtatcatcttctaaagcacttgctgattcacttgaccatgctgtggccgaagatccatacttcaataagttgatccgtattctggcaacaagatgtatgacacaggctgtttacttctgtagtggggatcttagtcctccagagtttcaccattatgggcttgcggcacctctatatacacatttcacctccccaattagaagatacgctgatgtcatagtgcacaggttgcttgctgcatctttagggatatacaagctgccaaccatatttcaggacagaccacaacttaccagcattgccgacaatttaaattatcgccatcggaatgctcagatggcaagtcgctcctccatagagctccatactattatatttttcaggaaaaggcctacagacactgaagcaagagttgtgaagataaaggcaaacggatttattgtatttgtgcctaagtatggtatagaagggccagtttacttaacaatgagaggtgagaaaggaggtggagaatgggttgtggatgagcagcagcagaagatcaaaaagattgatggatcgatttcttatggtgttcttcagaccgtaaacatccacatggaggttgtcgaaccacaacccaaccgccctaaacttcaactcactctcatttaaaaggtaaagactcccaacttatttatctttttctgattctgttaagcttgctgtagaataggaatacccatacagacgttagcagttatgaatggattttaaagaccattgttgcttattcttttttaaatatgagaagaagaaaaaagatcattttcagcaaaaaagaagattagtactactaattagggcagaagatttcaaaatttacattggtacaatcacgtgagcaa

SEQ ID NO: 5916 - DNA, 1502 bp, Euonymus alatus
tcgaagttggagttcatattgctgatgtaacaaattttgttcaccctggaacaccacttgctgatgaggcttctcaaaggggcacgtcagtataccttgttgagcgccgaattgacatgttgccaaaacctctaacagaagatatatgttctcttcgagctgatgtggaaagactagctttctctgttatttgggaaatgacgcctcaggcagagatcatctctacaagatacacaaaaagtgtcatcaaatcatgtgcagcattgtcttatgttgaagctcaggctagaatggatgacagtcgattgattgatcccctaactactgacttgagagctatgaataccttagcgaagataatgagacagaggcgagttgaaagaggagccttaactcttgcttcagccgaagtcaagtttcagattgatactgagacccatgacccccttgatatcggtatgtaccagattcgagaagcaaaccaaatgatcgaggagtttatgcttgctgctaatgtttcggtggctgaaaaaatactaaaacattttccactgtgttctttgttgaggcgtcatccgactccgacaaaagagatgcttgaacctttacttcgtaccgctgctgccattggtctgaacttggatgtcacatcatcaaaagctctagctgattcacttgataacgctgtgggtgatgatccgtatttcaataaactaattcggatattggcaaccagatgcatgacccaggcggtttatttctgtagcggggacctcagccctccagaatttcatcattacggacttgcttcacctctatatactcatttcacctctccaatcaggagatatgccgatgtcattgtgcacagattgcttgctgcatctttagatataagtaaacttccacaaattttccaagacagaacccaactaactagtattgctgagaatttaaactatcgacataggaatgctcagatggcaagccgggcatctgtggagctccatactctgatctactttaggaagcggcccaccgatgaggaggccagaatagtgaggataagatcgaatggtttcatagtatttgttcccaagtacggtatagaagggcctgtatacttggtaccaagaggcgagaagggagatggggaatggtttgtggatgagcagcagcagaaggtaaaaaagatggatggaagtgttagttacagtgttctgcagtcggtgaagattcacatggaggttgtggaaccccagccgaaccggccaaagcttgaactttcccttatttagaagcttgtacgtctcagcagcaaaggaaactttgtccttatttgggactgttttatggaacttgtggctttgtttgaaacacattaggctttcataattagatggctgcgatggggaataccaaacatttgtgttattgtaaaatagagtacaagattgtctttgaatcttgtattttgaagcgtgtatttttttttcccttcc

SEQ ID NO: 5917 - DNA, 2740 bp, Silene vulgaris
gcaaagtttgcgatgcttccgtttcgcgtttgagtgctgatgcttccactattttagttcttgacaccaatgtcgttcttaatcagattgatttactcgagaaaacggctatcgatgatgtggtggtgctgtcagtagtgttggatgaggttcagaataagaataagtctgtttacaaaaggcttagagatatttgcagcaatcctagtcgaaagtattatgttttctcgaacgagcaccacaaggagacttatgttaaagctatggctggagaaagtcctaatgacagaaatgatagagcaatccgggtggcggctcaatggtatcaaaaacatctaaattctgcagttagggttttactgattactaatgatagggagaacaagaggaaggcatgcgaggagggcatagctgcagagacagtcgagtcatatgtcagatcattgggtcaaccagagttgcttgattcactcaggcagccttcctcggaggatgtggccatggatgatgtcgaagacttaaggccttccaagaagcaagctatttacagtgagcataaacccatgtctgaaatcactgccggtttacatcgcggcatttaccatcaagggaaacttcgtgtcaatcgttataatccatttgaagcatatgtaggcagtgagagcattggtgatgagataatcatacataggcgagccaacatgaacagagcttttgacggtgatatagtggctgttgaacttttggctcaggatcagtggcatggggacaaatcctatattgccgatgaagatgaggagtatgaaggtgtaggtcttcctccaggctgtgctgattatgctcctcgaaccacaaatgttcagggctccaacacggaagctttaattacttctgatcgcccatgtggttatgttgtgggtatcatcaaacggaattggcactcttattgtgggtctttggagccaatgaatttgcccgctggtagtggtggcgttgcacatcctttgtttgtttcaaaggataggaggataccgaagattcgtatccaaactcggcaacttggaaatcttctggataagagaattattgtgaccgtggactcctgggatcgtttttcacgatatccttcaggtcactatgtcaagactataggagaaattaatgacagggatactgaaactgaggtcgtgttgatagagaatgatataaactcccggccattttcttctcaagtgttggcatgcttgccaccattgccgtggtctgtggctcctgaacatatatctgatcctaacagagaagacctaagaagtttacgagtttttagtgttgatcctccaggttgccgagatattgatgatgcactacactgcacacctcttttaaatggaaacttcgaagtgggtgttcacattgctgatgtgaccaattttgtccaccctggaaccccacttgatgatgaagcttcacaaagggggacttcagtgtatcttgttgaaaggcgaattgacatgctcccgaagcctttgaccgaagatatctgttctctgagatcggacgttgagaggctctcattttctgttatttgggaaatgacgccacaggcagatattgtatcttccaggttcacaaaaggtataatcaagtcatgcgcggcattgtcttatgttgaggctcaagccaggatggatgatagtcgtttgatggatccagtgactactgacctaagaaatatgaatcagttagcaaagattatgaggcagagacgtattgatagaggagctttgactcttgcttctgcggaggtcaagttccagattgatactgaaactcatgatcctcttgatattggtatgtatcaaattcgtgaagccaaccaaatggttgaggaatttatgcttgctgctaatattgcggtggcagaaaaaatattgaagcattatcctttctgttcattattaaggcgacacccttctcccacaagagaaatgcttgagccactacttcgaactgctgcagctattggccttgatttggatgtcacgtcatcaaaagcactagctgattcccttgaccgtgctgtggggaatgatccgtacttcaataagctgattcgtattctggcgacaagatgcatgacacaggcagtctacttctgtagtggggatgtcagccctccagagtatctgcattatgggcttgccgcacctttgtacacacacttcacttcccccatcagaagatatgctgatgtcatagtgcacagattgctagctgcatctattgggatatccaagcttccagtgatattccaggataggcctcaactcactagtattgctgataatctgaattatcgacatagaaatgcccaaatggccggccgagcatcagtagaacttcatacacttatatactttaggaaacgtcctaccgacacagaggccagaattgtgaaaataagatccaatggattcattgtatttgttcccaagtttggcattgagggtccggtttatttaactgcaaaaggtgacaaggagtctggagagtgggtggtagatgagcagcatcagcaggtgaaaaaggtggatggttctataacttacaatgttctgcaaatggtgcaaattcacatggaagtcgtagaaccccagccaaaccgccctaaacttcagttgaatcttatatagaatagatgtcattttacctagttactttagcaatacgccatatcata

SEQ ID NO: 5918 - DNA, 3115 bp, Valeriana officinalis
ccgccattagagcccgagaaagctaaggtcacactgtgtgtgctgctgaatcacaaccgaatatatacaaatcacagaactctcataatttcgaaatcaaaccttcggtgtattattgtgcaaattcatacccccaaaaccagttgccaccagcagagagcttcgtactggaatcgcaaaaatgttacagagcaaatcatttgtccggaaaactaagcaagggaaagtagtcaaggtcgtacgagaacactatcttagagatgatatatactgtggagcttccttttgtaaagtttgtgatacttcaactgcacgtttgagctcttctgcttccacaattctcgttattgacactaatgttgtcctcaatcagattgatttgcttgagaatccagcaattgatgaagttgtggtactatcagttgttttggaagaagttaaacacaagaatgttgctgtgtataatagacttagggctctctgcagtagttcttcgaggaagttcttcgttttttctaatgaataccacaaggatacatatgtgaaagccatggctggcgagactccaaatgaccgaaatgatagagctattcgggtagcagctcaatggtatcaaaatcatcttggcaatgcattccgggtcttactaatcacgaatgaccgggaaaataaaagaaaggcaagcgaagagggtatttctgctgaaacagttgaatcatatgtgagatcgctaggtcaacctgcattgcttgacctacttgttcaacctccctctgaagacactcgaatggaagatgctgacgattcaagaccatcaaagagaaaagttatatataatgagcataagcctatgtcagagatcacttcagggttgcttcgtggaatatttcatcaaggcaaacttcgcgttaaccgttataatccattcgaagcatatgttgggagtgagagcattggcgacgaaattataatctatggccgtggtaacatgaacagagcttttgatggtgatgtcgttgctgtagaactgttacctcaagatcaatggcatgatgaaaaatccttatctatagctgagcaagaggacgaggaggacgacgatgttcatttagctccgagcagtgcagatgatgctccagtgaaaggatctaatggagatatgagtaatgtgcctcctcgtccatctgggcgtattgttgggatcatcaaaaggaactggaaatcgtattgtggatcattggatccaatgccgatgccagctggcaatggtggtgttgctcacgctctatttgtttctaaagaccgaagaatccccaagattcggattcaaactcgacaactggggaatcttctggacaaaagaataatcgtttcagttgattcttgggattgcgcatctcgatatccatccggtcattacgtaaggacaataggagatataggtgacagagataccgaaagtgaggtggtgttgatagagaatgacatagatgcacggccgtttacttctcaagttcttgcttgcttgcctccgttaccttggaatgtttctgcagaagatttggccaatcctattagacaagatttgcgtcatttacgtgtcttcagtgttgacccaccaggatgcaaggacattgatgatgcattgcactgtacactctctccgaatgggaactttgaagttggagtccatatcgctgatgttacgaactttgttcaccctggaaccccactggatgacgaggcaacacagaggggtacttctgtatatcttgttgaacgccgtattgacatgctcccaaaacctctaacagaagatatatgttcacttcgggctgatgttgagaggctggctttctcagttatttgggaaatgacacccgaagctgagattatttctacacgatacacaaaaagtgtgattaaatcatgtgcagcactttcttatgttgaagctcaagcgaggatggatgacagccgcctaatggatccagtaactaccgatttgcgtaacatgaacgcattagcaaagaaaatgaggcaaagacgtattgacagaggtgcattaactcttgcctctgcagaagtcaaatttcaaatcgataccgaaactcacgacccactcgatattgggatgtaccaaattagagaagcaaaccaaatggtcgaggagtttatgcttgctgctaatatatcagttgctgaaaaaatcctacaaacattttccactatgctctttgttaaggcggcatccaagtccaacaagaaatgcttgacctttacttcgtacagcagtcgctgttggcgtcagtcttgatttgtcatcatccaaggcactggctgattctcttgatcgtgctgtgggggaggatccatacttcaataagttgataagaatattggctaccagatgcatgtcacaggcagtttacttttgtagtggggatctaagtcccccggagtactatcattacgggcttgcagctcttctttacacgcatttcacgtctcctattaggagatacgcagatgtttttgtacacagattgctcgctgcatctctagggatatacaagcttccactcatattccaagacagaccccaacttactagcgtcgccgataatttgaattatcggcatagaaatgctcagatggcaagcagggcttcggttgaacttcatacagttatttatttcaggaataggcccacagataccgaggcaagaatagtgaaactaagatccaatggatttatcgtctttgttcccaagtatggtattgaaggaccggtatatctaacagcaagaggagaaaaaggaggagattgggtagtagacgagcaacaacaaaaggttaaaaaaatcgacggtacaatttcttacggcgttcttcagtcagtaaaaatccacatggaagttaccgaaccgcaacccaaccgccctaaacttcaacttactctcatctaatcactgtaagtcaattttttgctagatttatttcatgtgcaagacagcaaaactgattttgtttttgaaatagtcaaagaaaacagcattaaataccatacccagatagattttggctggctaaaatatatcctagtcagaatttg

SEQ ID NO: 5919 - DNA, 1230 bp, Aristolochia fimbriata
atccattaactactgatcttcgaaacttgaattctttggcaaagattatgaggcagagacgtattgataggggggctctaacccttgcctctgcagaagtcaagtttcaaattgacacagagacacatgatccacttgatattggcatgtatcaaattcgagaggcaaatcagatgattgaagaatttatgttggctgctaatgtgtcagttgcagaaaaaaatttgaaacattttcctctgtgttctctgctaaggcgtcatcctagtccaaccaaggagatgcttgaacctttgttgcgtacagcagctgctattgggctgagtttggatgcttcctcctcaaaagcgcttgctgattcacttgatcgtgcagtgggtgatgatccatacttcaataaactcatccgcattatggcgactagatgcatgacacaggctgtttatttttgtagtggagatctcactcctccggaatttcaccattatgggctggcatcccctctgtatactcatttcacttctccaattcgtcgctatgcagatgttattgtccaccggttgcttgctgcggctttagcgatagaaaagctaccaccaatttttgaagatagaccccaacttactaatgttgctgacaatttgaacaatcgccaccggaatgctcagatggcaagccgggcttctgtggagctccatactcttatctatttcagaaatcggccaacagacactgaggccaggattgtgaagataagatccaatggctttatagtttttgtgcccaagtatggtatcgaaggcccggtgtatttgatacgcaaaggagagaaaggggaatggttagtggatgagaagcaccagagggttacaaaggctgatgcaagtgtcagttacagtgtcttgcaacccgtcagaattcaccttgaggtcgtggagcctcagccccacaggccaaagcttgaactctccctcatataaaacatgtaaatttgatttgtcatgtttgtgtgaatattttattttatattataatttcttcttttgaaaaatatgtatgcatacctttcttgtctccgttctgtgtcgttcagcttgcttaggtttgcaaatataaccgagttcagtcaaatgctcatcgtcacatattgttaaactctactattagcagtgttttgaaaactccggttcaacctcgaaccaatcggattgaaaatctttcttcctcttt

SEQ ID NO: 5920 - DNA, 3061 bp, Euonymus alatus
tttatggtgggggagcctttacagtatagaagaaacacacaaaagttgctcaactaatccagaaagataaacggagatgttgcagagcaaggtcttcagcaagaggaccagaggaggcaaagtgcaaaagactgtgagagaggtgtatttgagggacgacttggcatgtggagctcccttttgcaaagtgtgcgacacttccaaggctcgcttgactgcttccggttcttctccaattctcatcgtcgacaccaatgtcgtgctcagtcagattgatttactggagaatccggcaataaacaatgtggtggttctgtcggtggtgagggacgaggtgaagaagaggaacatggcggttttcaaaagaattgagactctctgctataattctaccaggaattttttcgtgttctataatacattacacaaggatacatttgttcatgacgtttcaggtgaaagtcccaatgatcgaaacgatagagctatacgggttgctactcagtggtatcagaatcatcttggtggtgagacacgggttttgcttatcacgaatgacagagaaaacaagaggaaggctaccgaagaggggatttccacagagacaattgaatcctatgtgaagtcattgggtcaaccaaatttgctcgatctactggttaagcctgtctctgaagatgtagaaatggagaatcctgatgctttaattccttcaaagaggagagttctttatgcagagcacaagcccatgtctgaaattacttctggtttgcgatgtaaaatataccatcaagggaaacttcgagttaatcgctataatccatttgaagcatatgttgggagcgagagcataggtgatgaaataatcatttatgggcatgcaaacatgaacagggcttttgatggtgatatagtggcagtggaacttcttcctcaagatcagtggcttgaggagaagtttttgtctatagcagaggaaggggaagaggaggaggaagaagatgttcatcttgctccaaatactgctgatgatgctccaagaaatacaaatcttccaaactctgccgatgataaaaaatctgttccatgccgtcctgcaggtcatgttgtcggtattataaagcgaaactggcactcttattctggatctttagaaccacttcctatgcctgcagctagtggcagtattgctcatgcattatttgttccgaaagatcgtagaatttctaagatccggattcaaacccggcaacttgagaatcttttggaccagataattgttgtggcagttgattcttgggaccgcaaatttcggtatccttcgggccattatgtacggaagataggagaaattggtgacagaaatgttgaaagtcaggcagtcttaatggagagtgatatatgcgacgagccattttctcgtcagattttgaactgcttacctccattaccatggtctgtgtcagctgaagatttggccgaccctatcagaatggacttacggcatttgcgcgtcttcagtgtagatcctcctggatgcaaggatattgatgatgctctacactgtacagctcttcctaatggaaatttcgaagttggagttcatattgctgatgtaacaaattttgttcaccctggaacaccacttgatgatgaggcttctcaaaggggcacgtcagtataccttgttgagcgccgaattgacatgttgccaaaacctctaacagaagatatatgttctcttcgagctgatgtggaaagactagctttctctgttatttgggaaatgacgcctcaggcagagatcatctctacaagatacacaaaaagtatcatcaaatcatgtgcagcattgtcttatgttgaagctcaggctagaatggatgacagtcgattgattgatcccctaactactgacttgagagctatgaataccttagcgaagataatgagacagaggcgagttgaaagaggagccttaactcttgcttcagctgaagtcaagtttcagattgatactgagacccatgacccccttgatatcggtatgtaccagattcgagaagcaaaccaaatgatcgaggagtttatgcttgctgctaatgtttcggtggctgaaaaaatactaaaacattttccactgtgttctttgttgaggcgtcatccgactccgacaaaagagatgcttgaacctttacttcgtaccgctgctgccgttggtctgaacttggatgtcacatcatcaaaagctctagctgattcacttgatcacgctgtgggtgatgatccgtatttcaataaactaattcggatattggcaaccagatgcatgacccaggcggtttatttctgtagcggggacctcagccctccagaatttcatcattatggacttgcttcacctctatatactcatttcacgtctccaatcaggagatatgccgatgtcatcgtgcacagattgcttgctgcatctttagagataagtaaacttccacaaattttccatgacagaacccaactaactagtattgctgagaatttaaactatcgacataggaatgctcagatggcaagccgggcatctgtggagctccatactctgatctactttaggaagcggcccaccgatgaggaggccagaatagtgaggataagatccaatggtttcatagtatttgttcccaagtacggtatagaagggcctgtatacttggtaccgagaggcgagaagggagatggggaatggtttgtggatgagcagcagcagaaggtaaaaaagatggatggaagtgttagttacagtgttctgcagtcggtgaagattcacatggaggttgtggaaccccagccgaaccggccaaagcttcaactttcccttatttagaagcctgtacgtctcagcagcaaggaaactttgaccttatttgggactattttatggaacttgtggttttgtttgaaacacattaggctttcagaattagatggctgcgatggggaataccaaacatttgtgtttttgtaagatagagtacaattgtctttgaaaaaaaaaaaa

SEQ ID NO: 5921 - DNA, 3028 bp, Helianthus annuus
ggggaacaaaacaattaaaagaagccagaggatttgaacagcttcaacaaggtgaatatcataaaccccataaaccgccgccattggagctcaaacccaccatccttcttcgtttctcatacccctaaatcactaaattagccccaaaatcatgttacaaagcaaatcattcgttcgaaaaacgaaacagggcaaagttgttaaagtggtcagagaacattatcttagagatgatatatactgtggagcttcgttttgcaaagtttgtgatacgaaaggcgctcgctttacctcccctgaatgtacaatccttgttcttgatactaatgttgttctgaatcagatcgatttactcgagaattcagcaattgatgatgtggtggtgctttctgtggtgttggatgaggtcaagaacaagaatcttgcagtttacaaccgactcagggccttatgtagcaatactttaagaagattctttgttttttccaacgaacaccacaaggacacatatgtgaaggctatggcaggcgagagtccaaacgatcgcaatgacagagctattagagttgcagcccagtggtaccagaaccatcttggtggtcccacaagaatcttgatggtcacaaatgatagggaaaataaaagaaaggccactgaagagggaatatctgcagatacagtggagtcatacgtgaaatcacttggtcaaccagcccttcttgatctgcttgttcaacctaactcatccgaggatatggaaatcgaagatttgaggccttcaaagaagaaagctatatatactgagcataagcccatgtcagagatcacatctggaatacgatgtggaatataccatcagggcaaacttcgtgttaaccgttataatcctttcgaagcatatgttggaagcgagagtatcggtgatgaaataataatatccgggcgtggaaatatgaatagagcttttgatggcgacgtagttgcggttgaacttttgcctcaagatcaatggcaaaatgaagcgtctcttcacatagctgaagaagatgatgaagatgacggtgtccacctggcaccgagcagcgctgatgtggctccaagaatcaccaatcccgcacaaggatcttctgagaatgcgaataatcctccttctcgtccttctgggcgcgttgttggcattataaagaggaactggcatgcttattgtggatctttggagccaatgcctatgccagctggaaacgctggtatagctcatgctttatttgtctctaaggatcgaagatttcccaagatacgaatccaaactcgccagctcgggaatcttctcgataaaagaattatcgttgctgttgacacttgggattgccaatctagatacccttccggtcattatgttcgcacaataggagatatcggagaccgtgaaactgaaacagaggttgtgctaatagaaaatgatattgatgcaagaccattttcttcacaagtcttggcatgcctgccccccttaccttggtcggtttcgtcagaagatttgtcaaatcctataagacaggacttgcgtcatttacgcatatttagtgtggacccgccagggtgcaaggatattgatgatgcattgcactgtaccccacttcctaacgggaactttgaagttggagttcatattgctgatgtcacaaattttgttcaccctgggacaccccttgatagtgaagctacacaaagaggaacttctacctaccttgttgaacgtcgtattgacatgcttcctaaacctcttacggaagatatatgttctcttcgggctgatgtggagagacttgccttttctgttatttgggaaatgactcctgaagcacatgttatatctaccagatatacgaagagtgtgatcaagtcatgtgccgctttgtcttatgttgaagctcaagcaaggatggatgatagccgcctgatggatccagtaactgcggatttacgaaatatgaatgctttagcaaagataatgaggcaaaggcgtatagaaagaggggccataactcttgcttcggcagaagtcaaattccaagttgacactgagactcatgatcctcttgatattggcatgtatcaaatccgagaagcaaaccaaatggttgaagagtttatgcttgctgctaatgtttcagttgctgaacaaattcttaagaagttccctcagtgttcattattaaggcggcatcctagtccaaccaaagaaatgcttgaacctttgttacgcactgctgctgctgttggtcttgatttagatgtgtcatcatcgaaagcacttgctgactcgcttgaccgtgctgtgggtgatgatccatactttaacaagttgatccgtattctagcaacaagatgcatgacacaggctgtttacttctgtagtggcgatcttagccctccagagtttcaccattatgggcttgctgcacctctgtatacacattttacctcaccaattagaagatacgcagatgtgatagtgcacaggttgcttgctgcatctttagatatatacaagcttccgccaatattccaggaccgaccacaacttactagcattgctgacaatctaaattatcggcataggaatgctcagatggcaagtcgctcctccatagaactccatactattatatttttcagaaaaaggcctactgacactgaagccagaattgtgaaaataagagcgaatgggttcattgttttcgtgccaaagtatggtattgaaggtccagtgcacctgacaatgagaggtgcaaaaggagggggagaatgggtggtggatgagcagcaacagatgattaagaaggtcgacgggtcgatttcttacggtgttcttcagcctgtaaagattcatatggaggtcgttgaaccccaacccaaccgacctaaacttcagctcactctcatttaaaatgtaagattttctactgatgtcattttagatatatttaaaagaccatggtttattctttttatatacaaccttttt

SEQ ID NO: 5922 - DNA, 2986 bp, Eutrema parvulum
ttggttattttgtcgcgacagcaagtaagagaggtttatctacgagacgacatatactgtggagctttttcttgcaattcatgcgatacttcagctgctcgcttgtcttcccctaagattattgttgtggataccaacgttgttcttcaccaaattgatttgttggagaatcaggccatagacaatgttgttgttctgtctgtggtgctggacgaggttaagaacaggaacagatctgtttacaatagaatcagagctctctgcagcaatccagcgaggcaattttatgttttctccaatcatgtccacaaggatacttatgtgcaggccatggaaagagagagtgccaatgaccacaacgatagagctattcgtgttgctacgctatggtaccagaagcatctaggggctacatctcaggtgttgcttgtaactaatgacagagagaataaacggaaggccaccgaagagggaatatctgcagagacaattgaagcttatgtaaaatcaattggacaacctgaattgttggatctgcttgcccaaccaaccactgaagacgtaaccatggaagatgcagatgattccagaccttcgaagaggaaacttgtatacctagagcataagcccatgtctgaaattactgctggcttacaccgtgggatatatcatcaaggaaaactccgtgtcaatcgtttcaatccttttgaagcttatgttggaagtgagagcattggcgaagagataattatctatgggcgcagcaacatgaacagggccttcgatggtgatattgttgcggtagaactcttgcctcgcgaccaatggcaagaggagaaggcattatctatagctgaagaagatgaggaagaagacgatactgttcatttggctcccaacagtgctgatgatgctcctagaacctcaaatttagcccaagaaacttctggggataaaaatgctaaccctgctcgtccatcaggtcgtgtagtcggtgttatccgtaggaattggcactcctattgtggatctcttgaaccaatgtcactacctgctggtagtggtggaacggcacacgctttatttgtctctaaagatcgcagaattcccaagattcgcattaacactcgacaacttcagaaccttttggatatgaggatagtagtggcagttgattcttgggacggccaatctcgatatccttctggccattatgtacgaccaatcggcaaaataggtgacagggaaactgaaacagaggttgtcttgatagagaacgatgttgactactcaccattttcgtctcaagttctgtcatgcttgccacccttaccctggtctgtatcctctgaagacgtatccaatcctgttaggcaagatttacgacatttgcttgtctttagtgtggaccctccgggttgcaaggatattgatgatgcattgcactgtacatcgcttccaaatgggaactttgaacttggagtccacattgccgatgtaacaaattttgttcaccctggtactcctttggatgatgaggcatcaaaaagaggcacatctgtctaccttgttgagcgccgtattgacatgcttcccaagcctttaactgaagatatttgctctcttagagctgatgtggaaagacttgcattctcggttatttgggaaatgaaccctgaagctgaaattatctcgacaagatttacaaagagtataatcaagtcttctgcagcattgtcctatgttgaagctcaggctcggatggatgacagccgattgacagaccccgtgacaacagatctgaggaacatgaatgctttggcaaagataatgaggcaaaggcgtatcgataggggagccttaactcttgcttctgctgaagttaaatttcagattgatactgagactcatgatcctcttgacattggcatgtatcagattcgggaagcaaaccaaatggttgaggaatttatgcttgctgcaaacgtttcagttgctgaacaaatccttaaacaatttccttcttgttcattattaaggcgtcatcctactccaacaagagaaatgcttgaaccgctgttgcgtactgctgcagctattgggcttagcttagatgtctcgtcatctaaagctttggctgattcgctggaccgagctgtgggtgaggatccatatttcaataagctgatcaggatattggcaactaggtgcatgacacaggctgtgtacttctgtagtggggatctcagtcctccagaatatcttcattatgggcttgcggcacccctatacactcattttacatctcctatccggagatatgctgatgtctttgtgcacaggttacttgccgcatcgttaggaatatacaagcttccgatggtattccaagacagacctcaacttactagtgttgctgataatttgaactatcggcataggaatgcccagatggcaagtcgagcttcagtagagttgcacactctcatctacttcagaaaccgacccacagatgcagaggcgagagttgtgaagataagatccaatggttttatagtattcgtccccaagtatggaatagaaggccctgtttatttaacagcaaagggtgagaaaggagctggtgactggtacgtagatgaggagaagcagaagatcgttaagatggacggaagtttatcatacagtgtcttgcaaacagtgaagattcacatggaggtagtggagcctcagcctaaccgaccgaaactcgaactcaccctcttgtaaaactcttcaaccttgaagtctcagcttcattacttacgtggtatggaccgactgtcaagagttcatgtggtatttacatttgttttgttttgtttaccttatgcctatttatttccatctctgtgtttcattgtcaaagtcaaaaagacattgtatcatcatttcacttatctattaatggatgcgagtttttgttggctatgcatcacttgtgatc

SEQ ID NO: 5923 - DNA, 3090 bp, Eutrema halophilum
aggtttaagggatttaaaaaaaaaagcttccgacgactgagttctttcaccggcgaaattttctcagcgagagagaggttaaagaagatgttgcagagcaaagttttcaataagaaaacaagaggagggcgaattcaaaagcaagtgagagaggtttatctacgagatgacatatactgtggagctttttcttgcaagtcttgcgatacttcagctgctcgcttgtcttctcctaagattattgttgtggacaccaacgtcgttcttcaccaaattgatctgttggagaatcaggccatagacagtgttgttgttctgtctgttgtcctggacgaggttaagaacaggaatagatctgtttacaataggatcagagctctatgcagcaatccagcgagacaattctatgttttctctaatcatgtccacaaggacacttatgtgcaggccatggagagagagactgccaatgaccacaacgatagagctattcgggtcgctacgctatggtaccagaagcatctaggggattcatctcaggtgttgcttgtaactaatgacagggaaaataaacggaaggccactgaggagggaatatctgcagagacaattgaggcttatgtaaaatcaattggacaacctgaattgctggatctgcttgcgcaaccaaccactgaagacgtaaccatggaagatgcagatgattccagaccttcaaagaggaagcttgtatacctagagcataagcccatgtctgagattactgctggcctacaccgtggaatatatcatcaaggaaaactccgtgtcaatcgtttcaatccttttgaagcttatgttggaagcgagagcattggcgaggagataattatctatgggcgcagtaacatgaacagggctttcgatggtgatattgttgctgtagaactcttgcctcgcgatcaatggcaagaggagaaggcattatctatagctgaagaagatgaggaagaggacgatactgttcatttggctcccaacactgctgacgatgctcctagaacctcaaatttgccccaagaaacttctggggataaaaatgctatccctgctcgtccttcaggccgtgtagtcggtattatccgtagaaattggcattcgtattgtggatctcttgaaccaatgtcactacctgctggtagtggtggaacggcgcatgctttatttgtttctaaagatcgcagaattcccaagattcgcattaatactcgacagcttcagaaccttttggatatgaggatagtagtggcagttgattcttgggaccgtcaatctcgatatccttctggccattatgtccgaccaatcgggaaaataggtgacagggaaactgaaacagaggttgtcttgatagagaacgatgttgactactcgccattcacttctcaagttctggcatgcttgccacccttaccctggtctgtatctcctgaagatgtatccaatcctgttaggcaagatttacgacatttgcttgtctttagtgtggatcctcctggttgcaaggatattgatgatgcattgcattgtacatcacttccaaacgggaactttgagcttggagtccacattgcggatgtaacaaattttgttcaccctggtactcctttggatgatgaggcatcaaaaagaggcacatctgtctaccttgttgagcgccgtattgacatgcttcccaagcctctaacagaagatatttgctcgcttagagctgatgtggaaaggcttgcattctcggttatttgggaaatgaaccctgaagctgagattatttcaacgagatttacaaagagcataatcaagtcttctgcagcattgtcctatgttgaagctcaggctcggatggatgacagccgattgacggactcggtgactacagatcttaggaacatgaatactttggcaaagataatgaggcaaaggcgtattgataggggagccttaactcttgcttctgccgaagttaaatttcagattgataccgagactcatgatcctcttgacattggcatgtatcagattcgagaagcaaaccaaatggttgaagaattcatgcttgctgcaaatgtttcagtcgctgaacaaatacttaaacatttcccttcttgctcactattaaggcgtcatcccactccaacaagagaaatgcttgaaccgctgttgcgtactgctgcagctattgggcttaacttggatgtttcttcatctaaagctctggctgattcactggaccgagctgtgggtgaggatccatatttcaataagcttatcaggatattggcaactaggtgcatgacacaggccgtgtacttttgtagtggggatctcactcctccagaataccttcattatgggcttgcagcacctttatatactcattttacgtcccctatccggagatatgctgatgtctttgtgcacagattacttgccgcgtcattaggaatatacaagcttccaacggtgtttcaagacagacctcaacttactagtgttgctgataatttgaactatcggcataggaatgcccagatggcaagtcgagcttcagtagagctgcacacactcatctacttcagaaaccgacccacggatgcagaggcgagagttgtgaagataagatcaaacggttttatagtattcgtcccaaagtatggaatcgaaggccctgtttatttaacagcaaaaggtgagaaaggagccggtgactggtacgtagacgaggagaagcagaagattgttaagatggatggaagtttatcttatagtgtcttgcaaacagtgaagattcacatggaggtagttgagcctcagcctaatcgaccgaaactccaactcactcttttataaaactctttaaagtctctcacttttcacagtttcacttatatgtcaaagagttcgtgtgctattctacatttgttttgtttactttacgcatgtttactagttggtgatctgcgtttcgagctgaattttgtattattatttactaatatggttaatcactgttaagtcacattcatatataaagcataatagacttaatca

SEQ ID NO: 5924 - DNA, 3051 bp, Ambrosia trifida
tttacgcatatttagtgtcgaacccaccagggtgcaaggatattgatggtgcattgcactgtacttcacttcccaatgggaactttgaagttggagttcatattgctgatgtcacaaattttgttcaccctgggacaccccttgatagtgaagctacacaaagaggaacttctacctatcttgttgaacgccgtattgacatgcttcccaaacctctaacagaagatatatgttctcttcgagctgatgtggagaggctagccttttctgttatttgggaaatgactcccgaagcacatgtgatatctaccagatatacaaagagtgtgatcaagtcatgtgccgctttgtcttatgttgaagctcaagcaaggatggacgacagtcgcctgatggatccagtaactgcggatttacgaaacatgaatgctttagcaaagataatgaggcaacggcgtatagaaagagggccataactcttgcttcagcagaagtcaaattccaagttgacaccgagactcatgatcctcttgatattggcatgtatcaaatccgagaagcaaaccaaatggttgaagagtttatgcttgctgctaatgtttcagttgctgaacaaatccttaagaagttccctcagtgttcattgttgaggcggcatcctagtccaaccaaagaaatgcttgaacctctgttacgtactgctgctgctgttggtctcgatttagacgtgtcatcatctaaagcacttgctgactcacttgaccgtgccgtgggtgatgatccgtacttcaataagttgatccgtattttagcaaccagatgtatgacacaggctgtttacttctgtagtggtgatcttagccctccagagtttcaccattatgggcttgctgcacctctttatacacattcacctcaccaattagaagatacgcagatgtgatagtgcacaggttgcttgctgcatctttagatatatacaagctgccacccgtattccaggacagaccacagcttactagcattgctgacaatctaaattatcggcataggaatgctcagatggcaagtcgctcctccatcgagctccatactattatatttttcagaaaaaggcctaccgacactgaagccagaattgtgaaaataagagcgaacggattcattgtttttgtgccaaagtatggtattgaaggcccagtgcatctgacaatgagaggtgcaaaaggagggggagaatgggtggtggatgagcagcaacaggtgatcaaaaaggttgatgggtcgatttcttatggtgttctgcagactgtaaagattcatatggaggtcgttgaaccccagcccaaccgacctaaacttcagctcacactcatttaaaatgtaagattcaactgatttcattttagatgaattttaaggactggcttgtttttatttatacacgaccttttcagattgttcatgttcttgcagttttttaatttatatatttgtgtatataaattaaattgatgatccgaggaatattgaatgttccatttctaacgataaattgatatcaattgaattgaataaagtagactactaatacatatatatgatcgatgcttgtttatcgcatctgtaattatacatgaatcatagggaggattatatgcatgcttgtatgacctaatgtggtcggtccatttgtaaactccaggatttctacttctacctgaatatcacatattagcatcatctgtagatggatcatgtcaaaatccacatgaacaccgttgaccatccagttaacgcaaacgctgcagccaagtaactccacatcgtaagcactgaacactcctcttgtcccacattgaatagttgtgccatcgtactgatattcatggctggggggacggtatactgaatcaatagcacaaaactgaataatggatctgctggaagtattcctagacttgtagctgctttaaccaccatgattccaacaatgggaagaatcacgtatcgaacacaaatcattgtgattatgataaccggtttaatgcttgcctttcgcagaccttgtataaggttgcctcctagtataagagtaatgcatggtatggttccatccccgagtaatgtaacggaatcttgaataactcttaatggagcatcatctccaatcacaaggtttttcagccatggtgtagccccaaaaattaatcctacaatcgatccaagggttggtggagccaacagctcttccaacacactatgtagtatatcttttagtttacttgagaaagatctatcttctttctcatccttgcttaacaatccttggtgtaaagtttttacaggttggatttgtgcgtcgtcactagttgagtatgataatgggacaacaacgtcgatgtattcttggctttctccattcagaagttgagttttttcatcggcgttggtgtccttgttaggttcttgtggtgagtcctcggtttctttcaacgcaatgtaccttaaactcgagcttttcaataactggaaagtgtatgtccaaatgtacagactgcccaaagccattgagaaggatgcataagagagtcccttggacttgcagacactatgttctccaaaagggctaccaccttgggtgcatattgcagggactattatcaaaagaatgtttcctagatttcctgtggagcacatagctatgagtaggccctcaatatgtggctttggtcttattatttttgttgctatccatcccaaaattcctccacaaagaaatgtcattccaatatttattggcataaaccaccatgagataatgtcttcaagggtgacggtctttgccagactagcgaaaataagtgagggagtaaatgccacaaatacaatcttgttaagcgatttgcgggtatcgctagagaggagattgaaatattgggtagccatgagggctcctattgcactgactaacaacacctcgagtattggcattgttgccaccgtaaacaacgaccagaaccccataaccacgatttttttaattcgtaa

SEQ ID NO: 5925 - DNA, 1297 bp, Fagopyrum esculentum
ctcaagctaggatgggtgatagtcgcttgatggattcactaactactgatctgcgtaatatgaataacttggcgaagataatgaggcaaagacgcattgacggaggagcattgactcttgcatctgcagaggttaaatttcagattgatacggagactcttgaccctctcgatattggaatgtatcaaattcgagaagcaaatcagatggttgaagagtttatgcttgcagccaatgtctctgttgcagagaaaatattgaagcattttccaatatgttccttgctgaggcggcatccaactccaaccagagaaatgcttgaaccattgctccgcactgctgcagctgttggtcttgacttggatgtctcatcatccaaagcattggctgattcacttgaccgtgcagtgggagatgatccatatttcaataagctgatacgtatattggcaacaaaatgcatgacacaggcagtctatttctgtagtggcgatcttagccccccagaataccttcattatggacttgcagctcccctctacacccatttcacatctcctatcaggagatacgcagatgttgttgtacataggttgcttgctgcgtcattgggaatatccaagcttccagcaatttttcaggataagccccaacttacaagcatcgcagacaatctgaattatcggcataggaatgcacaaatggctggcagggcttcagtagagctgcacacactcatttatttcaagaacagacctgttgaaacagaagccagaattgtgaagataagatccaacggatttatcgtgtttgtgcccaagtttggaatagaagggccggtttacctgaccccgagtggccagaaatcgggaggagaatgggtagtagacgagcaaagccagaaaatcagaaagattaatggcaatgtgtgctattccattctccagacggtaaggattcgcttggaggtggtcgagccacaaccgcacaggccaaagcttcagctcacgcttatatagtcaggttagacatcacttgtttgttgaatatccaacgtagctcgacctgtgtacacacttctgtgttgctattacaaggtatagtttcaagaaggagatttatgaatcgtgtcgacaaaaactcatcaatagcacatcaaagcttaaaagatgcattgttttccatttgagcgtctaaaaattacagaagttgccatcatctttacgtttgttgcatccttagcatttgtataagtcacatctagtatgtatcctgtgttctgatgatgccaaacgct

SEQ ID NO: 5926 - DNA, 1494 bp, Tripterygium wilfordii
aggggcacatcagtatatcttgttgagcgccgaattgacatgttgccaaaacctctaaccgaagatatatgttctcttcgagctgatgtggagagactagctttctctgttatttgggaaatgacacctcaggcagagattatctctacaagatacacaaaaagtatcatcaaatcatgtgcagcattatcttacgttgaagctcaggctaggatggatgacagtcgattggttgatcctttaactactgacttgagagatatgaatacattagcgaagataatgaggcagaggcgaattgaaagaggagccttaactcttgcttcagctgaagtcaaatttcagattgatactgagacccatgaccccctcgatataggtatgtaccagattcgagaagcaaaccaaatggtcgaggagtttatgcttgctgctaatgtttcagtggctgaaaaaatactaaaacattttccactgtgttctttgttgaggcgtcatccgactccgacaaaagagatgcttgaacctttacttcgtaccgctgctgccattggtctcaacttggatgtcacatcatcaaaagctctagctgattcacttgatcgtgctgtgggtgatgatccctatttcaataagctaattcggatattggcaaccagatgcatgacccaggcggtctatttctgtagcggggatctcagccctccagaattccatcattatggacttgcttcccctctatatactcatttcacctctccaatcaggagatatgctgatgtcattgtgcacagattgcttgctgcatctttagagataaataaacttccacaaattttccaagacaggacccaactaactagtattgccgagaatttaaactatcgacataggaatgctcagatggcaagccgggcctctgtggagctccatactctgatctactttaggaagcggcccactgacgaggaggccagaatagtgaagatcagatccaatggtttcatagtatttgttcccaagtacggtatagaagggcctgtatacttgacacctagaggtgagaagggggatggggaatggtttgtggatgagcagcagcagcaggtcaaaaagatggatggtagtgttagttacagtgttctgcagtcggtgaagattcacatggaggttgtggaaccgcagccgaaccggccaaagcttgaactttcccttatttaggagatgagaagaatatacgtggcctgtacgtctaagcagcaaaggagcctttgacctgatttgggactgttttatggaacttgtggtggtgttgtttgaaacactttaggtttcaggttttttatggctgcagtgggggataggaaacatttgtgttattgtaaattagagtgcaatcgaaatcgattatcgttgaatcttgtattttcatgtgtcaatattgtaaatttttttattttcaatgcaggttatttattaggttttattcaacaa

SEQ ID NO: 5927 - DNA, 3482 bp, Glycine max
gccgccgctgcacgcccgcacctgcgtcctgctccgacactccggcgattgtgatcaccgccggaaaacaccgcggtcctactcccaacaccggttcctttcttaggcgctaaggtgaattttttttcccggaagaatcaactttttcttttccacgccagcatcttcaccattccaaagtagagaaagcttcgaaacgaacacactctccaagtagggttactcagcgcagagcaatctcctccgctgtcaacatgctccacaacaagtccttcgtcaagaaaaccaaaggtggcaaagtcataaagcaagtgcgggagcactacctgcgcgacgatatatactgtggcgcaccgttttgcaccgtttgcgattcttccagtgctcgcctcagtgcttcgccttccatcattctcgtcgtcgacaccaatgtcgttctcaaccagattgatttgctggagaatccggcaattgacgatgttgtggtgttgtccattgtgttggaagaggttaagaacaagaacatgtctgtttacaaccgtataagagctatctgtagcaattccatgaggaagttctttgttttttccaatgaataccacagggatacatatattaaggaaatgagtggggaaactaaaaatgataggaatgatagagctattcgagtggctactcagtggtatcagaatcatcttggtggtgcagtaaaggtgttgcttttaactaatgacaaagagaacaaaaggaaggctagtgaagagggtattttggccgaaacagttgagtcatatgtgaagtctttggaccaacctgatttacttgatctgcttgtgcggcctgcatctgaagatgtggacatggaagaggttgaagatcttagaccatccaagaggaaagtcatctactccgagcataagccgatgtcagaaattacttctggtttgcatcgtggaatatatcatcaagggaaacttcgtgttaaccgttataatccatttgaagcatatgttgggagtgagagcattggtgatgaaataattatttatgggcgctcaaacatgaatcgagcatttgatggggatattgtggcagctgaacttctgcctcaggaccagtggcaaggagtctcatctctatctatagcccatgaagaagacgaggatgaggatgaagatgttcatctagctccaaatagtgctgatgatgcacctagaactatttctcagcagggttcttctgaacaagtaaatgctgtgcccagtcgtccttctggtcgtattgttggcattataaagagaaactggcattcgtattgtggatctttggagccaatgcctatgcctgcagggagtggtggtattgcccatgccttgtttgtctccaaagatcgcagaattcccaagattcgaatccaaacccgtcaacttgagaaccttttggataagaggattattgtggcagttgattcttgggatcgtcagtctcgatatccatcaggccattatgtgcgaactataggggagataggtgatagagatactgaaagcgaggtggttttgatagaaaatgatataaatacacggccattctcttcacaagtgctggcatgcttgccaccattgccatgggtagtctcttctgaagatttgtctaatccaatcaggaaggatttgcgtcatctgcgtgtcttcagtgtggaccctccaggctgcaaggatattgatgatgcactccactgtcacgtccttccaaatggaaactttgaagttggagttcatattgctgatgtgactaattttgtttatcctggcactccccttgatgatgaggctgcacaaaggggtacgtctgtctaccttgttgagcggcggatagacatgcttcccaaacctcttacggaggacatatgttctcttcgttctgatgtggaaaggcttgcattctctgtcatatgggaaatgacacccgaagcagatattattgccacctcatacacaaaaagtgtcataaaatcttctgcggcattgtcttatgttgaagcacaggcaaggatggacgatagtcgattgatggatccgattactgcagatttgaggaatatgaatagtttagctaagaaaatgagattaaggcgtattgagagaggagctttgactcttgcatctgctgaggtcaaatttcaaattgacacggagactcatgatccacttgatattggaatgtaccagatccgggaggccaaccaaatggtggaggagtttatgcttgcagctaatgtttccgttgcacaacaaattcttaaaagttttccattgtgctcattattaaggcgtcatccaacaccaacaagagagatgcttgaacccttactacggactgctgctgcagttggcttgcacttggatgtctcgtcatcaaaagcgttggctgattctcttgaccatgctgtgggtgatgatccatacttcaataagttaatccgtatactggcaactaggtgcatgactcaggcagtttatttctgcagtggggatcttagccctccagaatatcatcattatgggcttgcagctcctttgtatacccatttcacatcacctataagaagatatgcagatgtcattgtgcacaggctacttgctgcttctttagggatatccaagttaccacctgtatttcaagacagtctccagctcactagtattgcagacaatttaaattatcggcacaggaatgcccagtatgcagggcgggcatctgtagagctacatactctaatttatttcaggaagaggcctacagacacggagggtagaatagtgaaaataagatctaatggattttttgtgtttgttcccaaatatggcatagaaggacctgtatatttgacaaaagcagaaaagggaagtggagaatggtatgtagatgagcaacagcagaagattaaaaagatggatggtagcctttcatacaacgttttgcagacagtccaaattcacatggaggttgtggagcctcagcctaaccggccaaaacttcagcttaccctcatctagaggtatatgagcattgaacaacaggcatgcctcgaatataactcctatgtagattgccatatgcatctcagcacttttcaatgaaggtttctggtattggaattggccggcatgaaaaattatcgaatgaacgaaacattgatggaagattttggttggagaaattttttgtagatggaacataagatttttggttgacaaggtaagttttagttagtccttttgcaactatttgcttttaaattgtgaagtaagacgtggaatttttatacatgtgatgctgtaagcaagcgtgaacagctcaagtaaaaaaaaatacgttagcttaaatgtgccaatattgtattttgaaagaatatcagaattgttgcattaagaaatatggaatcattcaagaggctccaccaaagtttagtttcttaa

SEQ ID NO: 5928 - DNA, 3735 bp, Glycine max
cacagcatcataaggaaaaaatgtacaattcgttataattaagaaattaattgtatgattaagtcataattaatcatagggtaattcggtcaaatttcctacacctttcgcaccacttaacacgctacaattctcttgaactgcttgccctctgctacctccacagtgccgccgctgcacgcccgcacctgcgtcctgctccgacactccggcgattgtgatcaccgccggaaaacaccgcggtcctactcccaacaccggttcctttcttaggcgctaaggtgaattttttttcccggaagaatcaactttttcttttccacgccagcatcttcaccattccaaagtagagaaagcttcgaaacgaacacactctccaagtagggttactcagcgcagagcaatctcctccgctgtcaacatgctccacaacaagtccttcgtcaagaaaaccaaaggtggcaaagtcataaagcaagtgcgggagcactacctgcgcgacgatatatactgtggcgcaccgttttgcaccgtttgcgattcttccagtgctcgcctcagtgcttcgccttccatcattctcgtcgtcgacaccaatgtcgttctcaaccagattgatttgctggagaatccggcaattgacgatgttgtggtgttgtccattgtgttggaagaggttaagaacaagaacatgtctgtttacaaccgtataagagctatctgtagcaattccatgaggaagttctttgttttttccaatgaataccacagggatacatatattaaggaaatgagtggggaaactaaaaatgataggaatgatagagctattcgagtggctactcagtggtatcagaatcatcttggtggtgcagtaaaggtgttgcttttaactaatgacaaagagaacaaaaggaaggctagtgaagagggtattttggccgaaacagttgagtcatatgtgaagtctttggaccaacctgatttacttgatctgcttgtgcggcctgcatctgaagatgtggacatggaagaggttgaagatcttagaccatccaagaggaaagtcatctactccgagcataagccgatgtcagaaattacttctggtttgcatcgtggaatatatcatcaagggaaacttcgtgttaaccgttataatccatttgaagcatatgttgggagtgagagcattggtgatgaaataattatttatgggcgctcaaacatgaatcgagcatttgatggggatattgtggcagctgaacttctgcctcaggaccagtggcaaggagtctcatctctatctatagcccatgaagaagacgaggatgaggatgaagatgttcatctagctccaaatagtgctgatgatgcacctagaactatttctcagcagggttcttctgaacaagtaaatgctgtgcccagtcgtccttctggtcgtattgttggcattataaagagaaactggcattcgtattgtggatctttggagccaatgcctatgcctgcagggagtggtggtattgcccatgccttgtttgtctccaaagatcgcagaattcccaagattcgaatccaaacccgtcaacttgagaaccttttggataagaggattattgtggcagttgattcttgggatcgtcagtctcgatatccatcaggccattatgtgcgaactataggggagataggtgatagagatactgaaagcgaggtggttttgatagaaaatgatataaatacacggccattctcttcacaagtgctggcatgcttgccaccattgccatgggtagtctcttctgaagatttgtctaatccaatcaggaaggatttgcgtcatctgcgtgtcttcagtgtggaccctccaggctgcaaggatattgatgatgcactccactgtcacgtccttccaaatggaaactttgaagttggagttcatattgctgatgtgactaattttgtttatcctggcactccccttgatgatgaggctgcacaaaggggtacgtctgtctaccttgttgagcggcggatagacatgcttcccaaacctcttacggaggacatatgttctcttcgttctgatgtggaaaggcttgcattctctgtcatatgggaaatgacacccgaagcagatattattgccacctcatacacaaaaagtgtcataaaatcttctgcggcattgtcttatgttgaagcacaggcaaggatggacgatagtcgattgatggatccgattactgcagatttgaggaatatgaatagtttagctaagaaaatgagattaaggcgtattgagagaggagctttgactcttgcatctgctgaggtcaaatttcaaattgacacggagactcatgatccacttgatattggaatgtaccagatccgggaggccaaccaaatggtggaggagtttatgcttgcagctaatgtttccgttgcacaacaaattcttaaaagttttccattgtgctcattattaaggcgtcatccaacaccaacaagagagatgcttgaacccttactacggactgctgctgcagttggcttgcacttggatgtctcgtcatcaaaagcgttggctgattctcttgaccatgctgtgggtgatgatccatacttcaataagttaatccgtatactggcaactaggtgcatgactcaggcagtttatttctgcagtggggatcttagccctccagaatatcatcattatgggcttgcagctcttttgtatacccatttcacatcacctataagaagatatgcagatgtcattgtgcacaggctacttgctgcttctttagggatatccaagttaccacctgtatttcaagacagtctccagctcactagtattgcagacaatttaaattatcggcacaggaatgcccagtatgcagggcgggcatctgtagagctacatactctaatttatttcaggaagaggcctacagacacggagggtagaatagtgaaaataagatctaatggattttttgtgtttgttcccaaatatggcatagaaggacctgtatatttgacaaaagcagaaaagggaagtggagaatggtatgtagatgagcaacagcagaagattaaaaagatggatggtagcctttcatacaacgttttgcagacagtccaaattcacatggaggttgtggagcctcagcctaaccggccaaaacttcagcttaccctcatctagaggtatatgagcattgaacaacaggcatgcctcgaatataactcctatgtagattgccatatgcatctcagcacttttcaatgaaggtttctggtattggaattggccggcatgaaaaattatcgaatgaacgaaacattgatggaagattttggttggagaaattttttgtagatggaacataagatttttggttgacaaggtaagttttagttagtccttttgcaactatttgcttttaaattgtgaagtaagacgtggaatttttatacatgtgatgctgtaagcaagcgtgaacagctcaagtaaaaaaaaatacgttagcttaaatgtgccaatattgtattttgaaagaatatcagaattgttgcattaagaaatatggaatcattcaagaggctccaccaaagtttagtttcttaaagagaattgcctactttattttttctcactagcataggttacccagtttgggtgttatattgtcaatttatcatcaacaattgaat

SEQ ID NO: 5929 - DNA, 3276 bp, Malus domestica
atgtagaagtaagaccactcgaagccgccgctcgtatatctctctcgcggcagtcccattccagttcactcgccacttcaccagcaaccgaaaacgacgccgtcgcacgtatcagggaggccgaaacatgttgcagaacaagtcattcgtcaagagaaccagaggcggcaaaatcaccaaggtcgtgagagagcactatctccggcacgatatttactgtggagctccggtatgcaaagtttgcgatacgtccggagctcgattgagccctaccgcttccaccattctcatcttcgataccaatgtcgtccttcatcagattgatttgattgagaatccggcaatagacgatgtggttgtgctttcgattgtgttggaagaggttaaaaacaggaacttgtctgtttacaatagagttagagctctgtgcagcaattctttgaggaaatttttcgtcttttcgaacgaacaccacaaggatacttatgttacagacatgagcggagaaagcaaaaatgatcgaaatgatagagcaattcgggtagctgctcaatggtatcaaactcatcttgctggttcagctaaggttttacttataaccaatgataaagagaataagaggaaggctattgaagagggaatttctgcagagacagttgaatcatatgtgaggtcattgagtaggccagaattgctcgaccttctcgtgcagcctgcatccgaagatgtaaagatggaggacactgaagatttgagaccatcaaaaaggaaagtcatctactcagagcataagcccatgtctgaaattacttctggcttgcatcgtggcatataccatcaaggaaaacttcgagttaatcgttacaacccctttgaagcatatgttggaagtgagagcattggtgatgaaattataatatatggacgtacaaatatgaatagggcttttgatggtgatatagtggcagttgagcttctgccgcaagatcaatggcatgaggagaagtctctagctttagcagatgaagaggatgaggaagaagatgttcatctggttccaggcagtgctgatgatgctcctaggactatagctgcccaaggctctgctggagtaacagaacctgtccaaaatcgaccatctggccgtgttgttggtattataaagcggaattggcattcttattgtggatctttggagcccatggctaagcctgcgggtggtggtggtattgcccatgctttatttgtctcaaaagatcgaaggattccaaagattcgaattcaaactcgacagcttgagaatctgatggataagagaattattgtggcagttgattcatgggaccctttgtctcggtatccttctggccattatgtacgaaccataggagtaataggtgataaagatactgaaactgaggtggtcttgattgagaatgatataaatacaagaccattttcttctcaagttcttgcatgcttgccaccgctaccatggtttgtgtcttctgaagatttggcaaatcctattagacaggatttgcgacaattgcgtgtctttagtgttgatcctcctggatgcaaggatattgatgatgcattgcactgtacagctctgccaaatggaaattacgaagttggagtccatattgctgatgtaacaaattttgtacactcgggaactcctcttgatgatgaggcttcacaaagaggcacatcggtctaccttgttgaacggcgcattgacatgcttccaaaacctctgacggaagatatatgttctcttcgagctgatgtggaaaggctagctttttctgttatttgggaaatgacagctgaagctgagatcatttctacaagatacaccaaaagtgtgattaaatcatgtgcagcattatcttacattgaagctcaagcgaggatggatgatagtcggttgatggatccattaactacagatttaagaaacatgaactctttagcaaagataatgagggcaaggcgtattgagagaggagccttaactcttgcatctgctgaagtcaaatttgaaattgacacagagactcatgatcctcttgatatcggtatgtaccagattcgtgaagcaaatcaaatggtggaggagtttatgcttgccgctaatgtttcagttgctgagaaaattcttaaacattttcctctatgttcactattgaggcggcatccttctcctaccagagagatgcttgaaccattgttgcgtacagctgcagctattggtctgaacttggatgtctcatcatcaaaggcactagctgattcacttgactctgctgtgggtgatgatccgtacttcaacaagctgattcggattttggctacaagatgcatgacccaggctgtttacttctgtagtggggatcttagccctccagaatatcttcactatgggcttgcagcatctctatacactcatttcacctctcctattaggagatatgcagatgtcataacacacaggttgcttgctgcatctttggggatatacaagcttccaactatattccaagatggaccccgactcacaagcattgctgacaatttaaattatcggcataggaatgcccagatggcaagtcgggcctcagtggagctccatactgtcatttttttcaaaaagcggccgacagacacagaggcaagaatagtcagaataagatccaacggatttttcgtatttgtgcccaagtacggcatagaagggccggtgtacttgaccccaaggggtgagaaggggggcggagaatggtatgtagatgagcaacaacagaagattagaaaaatggacggtagtatttcatacagcgttctgcagacggtgtttattcacatggagattgtggaaccccagcccaacaggccaaaactccaactatcgctagtgtagaccagcaactttgcctctccccagtaccctcctttaagatgagaaaagtgtctggaatggtggcgtgagccaggagcttggctctaaccatcttgggcagcgaagatatgtcacgggacacacattgaaatattgtatagtttcatttagtacagtttgttttactgcgtgaacttaaggtgtgagtaagagttttggtaaatcgggtgtagagctgagaggttagcagcagtctgcgagttaaagacgggatgccgtcgaaacagtgctgtgttttgtgcacaaaatttgcattcaagaggtgtaattcaaactgttttttcccaaggtatcacttttatctgtta

SEQ ID NO: 5930 - DNA, 1202 bp, Nicotiana benthamiana
cagtcgcttggtggatccaataacttcagatttacgaaatctgaatgggttagccaagataatgaggcaaagacgcattgataggggtgcactgacacttgcttcggctgaagtcaaatttcagattgatactgaaactcatgaccctcttgatatcggaatgtatcagattcgtgaagcaaaccaaatggttgaggagtttatgcttgctgctaatgttgcagttgctgaaaaaatcctgaagcattttcctctctgctctctactaagacgccatcctagcccaaccaaagaaatgcttgagcctcttctccgcacagctgaagcagttggtcttagtttagatgtgacatcatccaaagcaatggctgactcactggatcgggctgtgggtgatgatccatacttcaacaagctgattcggattctggcaaccagatgcatgacacaggcggtttacttctgtagtggagaccttagtcctccggaatatcttcattatggtcttgcctctccactttatactcatttcacctcgcccattagaagatatgctgatgtaatcgttcatcggttgcttgctgcatctttggggatatataagcttcctggtgttttccaagatagacccaagctaactagtatttctgacaatctaaattatcggcataggaatgctcagatggccagcagagcatcagtagagctccataccctcattttcttcaggaagcggccgacagatactgatgcgagaattgtgaaaataagatccaatggcttcattgtctttgtgcccaagtatggtattgaagggcctgtttacttgacatcaaaaggcgaaaacgcaggggaatggttagctgatgagaaacaacagagaatacggaaggttgatgggagtgtctcttatggtgtgcttggaacagtgaggattcatatggaggttgttgagcctcagcctaatcggcctaaactccaacttacccttgtatgaggcccagaactttaccaagaaagtggcggtaacagctccacccgtaggccaatatagctcttgctttaggccccaaaagttatttttattagatataaaaatatgtaattcaaatgatttttagcgtgttttaatgataagtaaatctttttaaccgtttgttgtcagtttgtatcatatatcaatataattcttattttatact

SEQ ID NO: 5931 - DNA, 2655 bp, Vinca minor
ctagctccctctgaggatgttagcatgcaagatgtagaggatatcaggccttcaaagagaaaagttgtataccccgagcataagcccatgtcagagattacttctggcttgcattgtagaatttatcatcaaggaaaacttcgtgtaaaccgttacaatccatttgaagcatatgttggaagtgaaagtattggtgacgaaataatcatttatgggcgtgcaaatatgaatagagctttcgatggtgatattgtggctgtagaacttttacctcaagaacagtggcatgaagagaaatctctagtgatagctgatgaagaggatgaagaggaagatgttcatctagcaccaagcagtgctgacgatgctcctagggtcatgaacctagtgcaagggtcagctgggggtgccagtgatgtgccttctcgtccatctggacgtgttgttggtattataaaacgtaattggaaatcatattgtggatcattggagccaatgccaatgccagcagcgagtggtggtacagtcaatgcattgtttgtttcgaaagatcgtcgaattcctaaaattcggataagaactcgacagctagaaaatctattggataagagaattgttgtttcggttgactcgtgggattgcttatctcgatacccctctggccattatgtcaggacaattggagaaataggtgatagagatactgaaagtgaggtggtactaatagaaaatgacatagatgcaagaccattttcttcccaagttttgtcatgcttgccaccgttgccctggtctgtgtcttctgaagatcttactagtcctattaggcaggatttacgtcacctatgtgtttttagtgtggatcctccaggatgcagggatatcgatgatgcattgcactgtatggctcttccaaatgggaattttgaagtgggagtccatatcgctgatgtcaccaattttgttcaccctggaactgcccttgacaatgaggctgcccaaagaggcacctctgtttaccttgttgagcgtcggattgacatgcttccaaaacctctgacagaagatatttgttctcttcgtgctgatgtggagagactagctttctcagttatttgggaaatgacccctgaagctgatatcatttctacaaaatatacaaagagtgtgatcaagtcctgtgcagctttgtcatacgtggaagctcaagcgcggatggatgacagtcggttggcagatccagtaactagggatttgcgaaatatgaatgctttggcaaagatcatgagacaaagacgtattgacagaggagcccttacattagcttcagcagaagtgaagtttcaaattgacactgaaactcatgatccccttgatattggaatgtaccaaataagggaagctaatcaaatggttgaggagtttatgctcgcggctaatgtttcagttgctgaaaagattctgaaacattttccactgtgttcactgctcagacgacatcctactccaacaaaagagatgctagaacctttgcttcggacggctgctgctattggtctgagtttggatgtgacatcatcaaaagccctggctgaatcacttgatcgtgctgtgggtaacgatccttactttaataagttgattcgtattctggcaaccagatgcatgacccaggcagtctacttttgtagtggagatctcagtcctccagaattcagtcattatggtcttgcagcagctctttacactcatttcacctctccgatcagaagatttgcagatgtaattgttcacaggttgcttgcagcatcattagaaataaacaagctcccagctgtcttccaggaccgacctcagcttacgagtattgctgacaatctaaattatcgccaccgaaatgcacaaatggcaagtcgtggttctgttgagctccatactcttatttatttcaaaaacaggcccacagataccgaggcaagaatagtgaaactaagatcaaatggcttcattgtcttcgtgcccaagtatggtatcgaagggccagttaatttgaacaagaagggaggagaatggttggtagatgaacaacagcagcgggttaaaaaaagcgacaatagcatttcgtatggtgttcttgaaacagtgcatattcatatggaggttgtagagccccagcctcaccgaccaaaactcgagcttaccttaatccaaaaataaaaagaatgtactgtagttacatgcttgcagtggagcagaatgagatatattttttcattcttagttttttttttttttgtttcggtccttagatgctatgacgtcttacacagtattagttactagtgacgacggcccgccctactccttacttttaccaagtccgtacccgttaaggtaggtagtaattaaactaaactagtagtaattaccgaacgaaccccaacccgaatactacgaaacgttacctttactacttacgaaccttccttaccttacgtaacacctaacttacttttaaccaaacctaacctaaaattcgtacggtttaccttttccccttaccccgtacgttaccctaaccctcccctaattaactaaaagtgtaagtagtaacgttaaccgttaaccgaaacgtccttagtaacctaaaacgtt

SEQ ID NO: 5932 - DNA, 1812 bp, Pennisetum glaucum
ctccgacccgctcaccgtcgacggcgctggcggcgggggccgcggcggcgcctcgcggttccccgtcgaccaggaggtcaactccaggatctacctctggcgagggcacccctggaacctcgaggtcgacgccgtcgtcaattccaccaacgagagcttggacgaggcgcacagtagtcctggcctgcacgccgcagcagggtcagggctcgcggaggaatgcgccaccttgggcgggtgccgaaccgggatggcgaagatgactaatgcctatgatcttcctgcaaggaaggttatccatactgtgggccccaaatatgctgtcaagtatcacacagctgctgagaatgcacttagtcactgctaccggtcctgtttggaactgctcattgagaatggtcttgaaagcattgcaatgggttgcatatacacggaagctaaaaactaccctcgtgaaccagctgctcatgtggcaataagaactgttagacgttttctggagaagcaaaaaggcaatatagctggtgttgtgttttgtactacatcttcatctgacacagagatatacaaacgattgctccctctatatttccctcgggacaagcaggaggaagaaattgcgatatcaaaactcccagctgatgtcggggatgagaatggtgaaacagtaattgatgaaaggaaaataagaataagacctttgcctgctggcgtggtagacagaacagtaactgcaacacctatagatcctcctctttctgaatctggatcggcattgaagagggcttctttcaaattggattcatatttggatccttcatttatgtcaataattaaagatccagatctgcggcgtagggagcagtgggaaaaatctgctcaagctcaaaaggggtttaattatgctaggttacttggatatggtgatcttggttgtccttcgttatctgcagcagaggaatattcgcttcattcacgataccttgctaaagcgaattctctgaatctttcagaaatcgctgaaatgaaaataatctatcgtggtggagttgatattgaaggacgcccagttatggttgttgttggtgcacattttcttcttcgttgccttgatcttgaacggtttgttctacatgtagtgaaggagtttgaacctttgattcagaagccatatacaattgtatacttgcactctgcagcatcattacaaccgcaaccagatttgggattcatgaagcgattacaacaaatacttggacggaaacatcagcgcaaccttcatgcgatttatgttctccacccaacattgggattgagaacagctgttttggcaatgcagatgtttgtagatggagaggtctggaagaaggttgtatatgtggataggcttatgcagctgttcagatatgtaccacgcgagcaacttacaattcccgattttgtctttcagcatgatctggaggtgaatggtgggaagggcctaattgtcgacccaagaactaagcacatttatcagagggcatccagttcatgatggtaacagttctgaggaccaaaagttcaatagttcttgcactgtaccattctgatgtttgcttcttgtaactttattccatgttgatgtttatttctgtatctagttaagttgctctattccatttgttcattcttctgccttatcatttgtatatgttgatttgtataaccgaataaaagtggtctctagtctagataatgttcaattttcactcagtctgtacaaaacttgaccatctgaaataggagtttgtttcaatgtttcgccattcaaaa

SEQ ID NO: 5933 - DNA, 1687 bp, Triticum aestivum
ctgggctcgcggaggaatgcgccaccttgggagggtgccgaactgggatggcaaagatgaccaatgcatacgatcttcctgcgaggaaggtcatccatacagtgggacccaaatatgctgtcaagtatcacacagctgcggaaaatgcacttagtcattgctaccggtcatgtttggaactactcattgagaacggccttgaaagcatcgcaatgggttgcatatacacggaagctaaaaactatcctcgtgaaccagctgcccatgtggcaataaggactgttagatgttttctggagaaacagaaaggcaagatagctggtgttattttttgtattacatcatcatctgatacagagatatacaaaagattgcttccgctatatttccctcgggacaagcaagaggaagagactgcggtatcaaaacttccagctgatgtcggggatgagaatggtgaaactgtaatagatgaaaggaaaataagaataagaccattgcctgctggtgcagcagatagaacagtggctacagctgctgctcttgatcttcctcttgagtctggattggcatcaagcaggagtacattcaaactggattcgtatttggacccttcatttatgtcattaattaaagacccggatctgcggcgcaaggagcagtgggaaaaatcttctcaagctcaaaagggatttaattatgctaggttgcttggatatggtgatataggtttccctccattgtctgctgccgaggaatattcacttcattcacgataccttgcgaaagcaaattcccttaatctttcagaggttgctgagatgaaaataatttaccgtggcggagttgatagtgaagggcgcccagttatggttgttgttggtgcgcactttcttcttcgctgcctggatcttgaacggtttgttctacatgtagtgaaggagtttgaacctttgattcagaagccatatactattgtctatctccactcggcagcatcattacaaccgcaaccagatttaggattcatgaaaaggatacaacaaatactaggccggaaacatcagcgaaaccttcatgggatttatatactccacccaaccttggggttgagaacagctattctggggatgcagcttttgattgatggagaggtatggaagaaagttgtgtatgttgacaggctggtgcaattgttcagatatgtaccacgcgaacaattaactatcccagattttgtatttcagcatgatttggaggtgaatggtggtagaggcatgattgtggacccaagaacaaaacatatctatcagagaccatctggctgattcatgtcatttatgcagtccaatgctcatacttcttgcttttgcaagtctttgtataattactcctttgttgatatttctctttttcctttgtatctaatttaggtgttctattcctttcattcgttcctcagccttcagggaaggggattattgtttgtagtatatgtcaatttctacagccgaataaaaagtggcgtctcagtgctcgtcagtttaagttccaccagacagggcattcgtctagtagcataaaatatgctactctctcctatccaacataagtgacccagttttgaactaagcttagttcaaccttatttgtgtcgttcaaccttagttcaaaactgtgacactta

SEQ ID NO: 5934 - DNA, 1520 bp, Saccharum officinarum
cctgcaaggaaggtcatccatactgtgggccccaaatatgctgtcaagtatcacacagctgcagagaatgcacttagtcactgctatcggtcctgcttggaactgctcattgagaatggtcttgaaagcatcgcaatgggttgtatatacacagaagctaaaaactaccctcgtgaaccagctgctcatgtggcaataagaactgttagacgttttctggagaagcaaaaaggaaaaatagctggtgttgttttttgtactacatcatcatctgatacagagatatacaaacgattgctcccactatatttccctcgggacaagcaggaggaagagattgcgatattaaagctcccagctgatgttggggatgagaatggtgagacggtaatagatgaaaggaaaataagaataagacctttgcctgctggtgtggtagacagaacagtgtctgcaactcttgttgatcttcctctttcagattctggatcggcattgaaaaagggttctttcaaagtggattcatatttggatccttcgtttatgtcaataattaaagatccagatctgcggcgcaaggagcagtgggaaaaatctgctcaagctcaaaagggatttaattatgctaggttacttggatatggggatctagcttgcccttcattatctgcagcagaggaatactcacttcattcacgatacgtcgctaaagcaaattctgttaatctttcagagattgctgaaatgaaaataatttatcgtggtggagttgatattgaaggacgcccggttatggttgttgttggtgcacactttcttcttcgatgccttgatcttgaacggtttgttctacatgtagtgaaggagtttgaacctttgattcagaagccatatacaattgtatatttccactccgcagcatcattacaaccgcaaccagatttagggttcatgaagcggttacaacaaatactaggacggaaacatcagcgaaaccttcatgcaatttatgtactccacccaacattgggtttgagaacagctgttttggcaatgcagatgtttgtagatggagaggtctggaagaaagttgtatatgtggatagacttgtgcagctgttcagatatgtaccacgcgagcaacttacaattcctgactttgtctttcagcacgatctggaggtgaatggtgggaggggcctaattgttgacccaagaacaaagcacatttatcagaggacgtccagttgatatgtgctggttctgaggcctgaagtttgttagttcttgcactgtaccattctaatgttcacttgtaactgtattccatgtgtttatttctgtatctagttaagttagtctattccattcgttcgttctccagccttccgcaaggggtattctcatatgtatctgttgatatctagaactgaataaaaagggtgtttactcttagatgttggtcaagtttcacttatcctgtacaaattttggcaggaaatatgatcaagtttatttca

SEQ ID NO: 5935 - DNA, 1679 bp, Panicum virgatum
tgagcaagttcattatctggttatgtaggaaggtcatccacactgtgggccctaaatatgctgtaaagtatcacactgctgcagagaatgcgcttagccactgctacaggtcttgtttggaactactcatagagaatggccttgaaagcattgcaactggttgcatatacacggaagccaagaattatcctcgtgaaccagctgctcatgtggcaataagaactgtgagacgttttctggagaagcaaaaagacaaaataactgctattgtcttttgtacaacatcatcacctgacacagagatatataagagattgcttccactatatttccctcgggacaagcccgaagaagagatagctgcattgaaacttcctgctgatgttggggatgagaatggtgagacagtaatagatgaaaggaaaataagaataaaacccttacccgctggggcagcaaatagcaagacgccaattcctgcacttgcagatatccctctcccggattctggattgacacgtcgaaggaattctttcaagctggactcatatttggatccagcttttatgtctataattaaagatcctgatctccggcgcaaggagcagtgggaaaaatctgctcaggctcacaagggacttaacttggctaacttgcttgggttcggtgatcttggcagtccaccattatctgctgctgaagaatactcccttcattcacgataccttgctaaagcaaattcaatgaatctttcagatattgcggaaatgaaaataatttaccgtggaggagttgatagtgaaggtcgggcagttatggtggttgttggtgctcactttcttcttcgctgcttggatcttgaacggttcgttctatatgtagcaaaggagtttgaacctttgattcaaaaaccttactcgattgtctatttccactctgcagcatccttacaaccacagcctgatttaggattcatgaagcggttacagcagatactaggccggaagcatcaaaaaaatctccatgctatatatgtacttcacccaactctaggattgagaacagctattctggcgatgcagctttttgttgacggagaggtctggaagaaagttgtatatgtcgacagacttgtgcagctgttcagatacgtaccacgtgaacaactaacgatccctgattttgtctttcagcatgatctcgaagtgaatggtggaaaaggcataatcgtagacccaagaacaaagcatgtctatcagagaccatctggttgatctgtcaacttgcaagtgagcgcttcacgtatcgctctgtacaacccatctgtccattgtagaagatttcccttcttgatctgtgcattttgtatctagttgagttgacatttgttctgggctattcattttcctttagggaggcgtaattatgtatcttaattatattatgtataaacaaataaaggctgtatcttatctcttaagttatgtagagctcggcgtgctctttgggtactgtaaaattttgacaggtcagaataatatggcagtttgttctgtctcagagaaattaatcggcacgtttgaatgttttggtaggcctgaagactaatttgtttgcccttgcaagcaatagtaagaacaagtctggatggggaaaaataaagcctgatctattttgca

SEQ ID NO: 5936 - DNA, 1885 bp, Pennisetum glaucum
ctcctcctccgaccggctcaccggcgacgacgcggccgcggggcccgggggccgcgccgcgtcgcggttccccgtcgatcacgagatcaactcgaagatctacctctggaggggccacccgtggaacctagaggtcgatgccgtcgtcaactccaccaacgagaacttggacgaggcacatagtagccctgggcttcacgctgcttcagggccaggactcgccgaggagtgcgctacattgggtggctgccgcactgggatggctaagatgaccaatgcttatgatctgcctgccaggaaggtcatccacactgttggccctaaatatgctgtaaagtaccacacagctgcagagaacgcgcttagccactgctacagatcttgtttggaactgctcattgagaacggccttgacagcattgccactggttgcatatacacggaagccaagaattaccctcgtgaaccagctgctcacgtggcaattagaaccgtgagacgttttctagagaagcaaaaggacaaaataagagctattgtcttttgtacaacatcatcatctgacacagagatatataagagattgcttccactatatttccctcgggataagcaggaagaagagatagctgcattgaaacttcctgctgatgttggggatgagaatggtgagacaataatagatgaaaggaaaataagaataaaacccttgcctgctggtgcagcaaatagcaaaacaccaattcctacacttgcagatatccctcttcccgattctggattgacacgcagaaggaactctttcaagttggactcatatttggatcctgcctttatgtcaataattaaagatcctgatctccgacggaaggagcaatgggaaaaatctgctcaggcaaacaagggaattaactttgctaacttgctcgggtttggtgatcttggcagcccaccattatctgctgctgaagaatattcacttcattcacgataccttgctaaagcaaattctatgaatctttcagatattgctgaaatgaaaataatttaccgtggaggagttgatagtgaagggcgtccagttatggtggttgttggtgctcactttcttcttcgctgtttggagcttgagcgatttgttctatatgtagtaaaggagtttgaacctttgattcaaaagccttactcaattgtctatttacactctgcagcatccctgcaaccacaacctgatttaggattcatgaaacgcttacaacaaatactaggccggaagcatcaaagaaatcttcatgctatatatgtactacacccaacactgggattgagaacggctattttggcaatgcaacttcttgttgacggggaggtctggaagaaaactgtatacatcgacagacttgtgcagctgttcaaatacgtaccacgggaacaactaacaatccctgattttgtcttccagcatgaccttgaagtgaatggtggaaagggaataattgtagacccaagaataaagcatgtctaccagaggccatctggttgatctgccatggacttgcaaatgagcggttcacgccttcgcatgccactctgtacaacctatctgtcctctgtagaagtattcccttctagatctgtccattttgtaactagttgagttgacattattgctctttgctattccttttcctctagggaggcgtaattatgtatgtcaattattatgtataaacaaataagggatgtatctaaatgtctcttaagttctctagagctcggtatactctttgggtatgtaaaattttgacagagccataggtacataagatggcagtttgttctgtctcacagaaatgaatcagctcgtcgggatggtttgttgagc

SEQ ID NO: 5937 - DNA, 1598 bp, Panicum virgatum
caaaagttcattatctggttatgtaggaaggtcatccacactgtgggccctaaatatgctgtaaagtatcacacagctgcagagaatgcgcttagccactgctacaggtcttgtttggaactactcatagagaatggccttgaaagcattgcaactggttgcatatacacggaagccaagaattaccctcgtgaaccagctgctcatgtggcaataagaactgtgaggcgttttctggagaagcaaaaagacaaaataactgctattgtcttttgtacaacatcatcatctgacacagagatatataagagattgcttccactatatttccctcgggacaagcccgaagaagagatagctgcattgaaactgcctgctgatgttggggatgagaatggtgagacagtaatagatgaaaggaaaataagaataaaaccgttgcccgctggggcagcaaatagcaaaacgccaatccctgcacttgcagatatccctcttccagattctggattgacacgtcgaaggaattctttcaagttggactcatatttggatccagcttttatgtctataattaaagatcctgatctccgacgcaaggagcagtgggagaaatctgctcaggctcacaagggacttaacttggctaacttgcttgggtttggtgatcttggcagtccaccattatctgctgctgaagaatattcccttcattcacgataccttgctaaagcaaattcaattaatctttcagatattgctgaaatgaaaataatttaccgtggaggagttgatagtgaaggtcgtgcagttatggtggttgttggtgctcactttcttcttcgctgcttggatcttgaacggttcgttctatatgtagtaaaggagtttgaacctttgattcaaaaaccttactcgattgtctatttccactctgcaggatccttacaaccacaacctgatttaggattcatgaagcggttacagcagatactaggccggaagcataaaaaaaatcttcatgctatatatgtacttcacccaacactgggattgagaacagctattctggcgatgcagctttttgttgacggagaggtctggaagaaagttgtatatgtcgacagacttgtgcagctgttcagatacgtaccacgtgaacaactaacgatccccgattttgtctttcagcatgatctcgaagtgaatggtggaaaaggcataatcatagacccaagaacaaagcatgtctatcagagaccatctggttgatctgtcaacttgcaagtgagcgcttcacggatcgctctgtacaacccatctgtcctttgtagaagatttcccttctagatctgtgcattttgtatctagttgagttgacatttgttctgtgctattcattttcttttagggaggcgtatttatgtatcttaattatattatgtataaacaaataaaggctgtatctaactatctcttaatttatgtagagctcagcgtactctttgggtactgtaaaattttgacaggtcagaataatatggcagtttgttctgtctcggagaaattaatcggcacgttggaatgttttggtaggc

SEQ ID NO: 5938 - DNA, 1822 bp, Saccharum officinarum
gggggctgggggccgtggcgcgtcacggttccccgtcgatcacgagatcaactcgaagatctacctctggcgaggccacccgtggagcctcgaggtcgacgccgtcgtcaactccaccaacgagaacttggacgaagctcatagcagtcctgggctgcacgctgctgcagggacggggctcgccgaggagtgtgccaccttgggtggctgccgcactgggatggctaagatgacaaatgcttatgatcttcctgccaggaaggtcatccataccgtgggcccaaaatatgctgtaaagtatcacacagctgcagagaatgcgcttagccactgctacaggtcttgtctagaactgctcattgagaatggccttgaaagcattgctactggctgcatttacacagaagccaagaattatcctcgtgaaccagctgctcatgtggcaataagaactgtgagacgtttcctggagaaacaaaaggacaaaataacagctattgtcttctgtacaatatcatcatctgacacagagatatataagaggttgcttccactatatttccctcgggacaagcaagaagaagagatagccgcattgaagcttccagctgatgttgggatgagaatggtgagacagtaatagacgaaaggaaaataagaataaagcccttgcctgctggggcagcaaatagcaaaacaccaattcctacacttgcagatatccctcttcctgattcgagattgacacgtggaaggaattctttcaagttggactcatatttggatcctgcttttatgtctataattaaggatcctgatctccgacgcaaggagcaatgggaaaaatctgctcaggcaaacaagggacttaacttggctaacatgcttgggtttggtgatcttggcagtccaccattatctgctgctgaagaatattcacttcattcacgataccttgctaaagcaaattctatgaatctgtcagatgttgctgaaatgaaaataatttaccgtggaggagttgatagtgaagggcgtccagttatggtcgttgttggtgctcactttcttcttcgctgcttggatcttgaacgatttgttctatatgtagtaaaggagtttgaacctctgattcagaagccttacacaattgtctacttccactctgcagcatcattacaaccgcagcctgatttaggattcatgaaacggttgcaacagatactaggtcggaagcatcaaaaaaatcttcatacaatatatatactccacccgacactgggattgagaacagctgttatggcgatgcagctttttgttgacggggaggtctggaagaaagttgtatatgtcgacagacttgtgcagctattcagatatgtaccgcgtgaacagttaaccattcctgattttgtattccagcatgatcttgaagtgaatggtggaaagggcataatcgttgacccaagaacaaagcatgtctaccagagaccatctggttgatctgtcttgaacctgcaaatgagcgcttcacggtaccactctcactctgtagtctgtacagactctctgtccggtcctctgtagaaggtcctgtcctctgtagaagagttcccttctagagctgtgcattttgtatctagttgacattgctgctctgtgctattccttctccttttagggaggcatatttttgtataaacaaataaatgccgcatctaaatgtctctcaagttgcctagagctgggcgtgctcattaggtactgtaaaattttgacaggtccatagataatattgagaaataagattgcagtttgttcc

SEQ ID NO: 5939 - DNA, 1796 bp, Panicum virgatum
ggggcccgggggccgcggcgcgtcgcggttccccgtcgatcacgagatcaactcgaagatctacctctggcgaggccacccgtggaacctagaggtcgatgccgtcgtcaactccaccaacgagaacttggacgaagctcatagtagccctgggcttcatgctgctgcaggaccagggctcgccgaggagtgcaccaccttgggtggctgccgcaccgggatggctaagatgaccaatgcttatgatcttcctgccaggaaggtcatccacactgtgggccctaaatatgctgtaaagtatcacacagctgcagagaatgcgcttagccactgctacaggtcttgtttggaactactcatagagaatggccttgaaagcattgcaactggttgcatatacacggaagccaagaattaccctcgtgaaccagctgctcatgtggcaataagaactgtgagacgttttctggagaagcaaaaagacaaaataactgctattgtcttttgtacaacatcatcatctgacacagagatatataagagattgcttccactatatttccctcgggacaagcccgaagaagagatagctgcattgaaactgcctgctgatgttggggatgagaatggtgagacagtaatagatgaaaggaaaataagaataaaaccgttgcccgctggggcagcaaatagcaaaacgccaatccctgcacttgcagatatccctcttccagattctggattgacacgtcgaaggaattctttcaagttggactcatatttggatccagcttttatgtctataattaaagatcctgatctccgacgcaaggagcagtgggagaaatctgctcaggctcacaagggacttaacttggctaacttgcttgggtttggtgatcttggcagtccaccattatctgctgctgaagaatattcccttcattcacgataccttgctaaagcaaattcaattaatctttcagatattgctgaaatgaaaataatttaccgtggaggagttgatagtgaaggtcgtgcagttatggtggttgttggtgctcactttcttcttcgctgcttggatcttgaacagttcgctctatatgtagtaaaggagtttgaacctttgattcaaaaaccttactcgattgtctatttccactctgcagcatccttacaaccacaacctgatttaggattcatgaagcggttacagcagatactaggccggaagcataaaaaaaatcttcatgctatatatgtacttcacccaacactgggattgagaacagctattctggcgatgcagctttttgttgacggagaggtctggaagaaagttgtatatgtcgacagacttgtgcagctgttcagatacgtaccacgtgaacaactaacgatccccgattttgtctttcagcatgatctcgaagtgaatggtggaaaaggcataatcatagacccaagaacaaagcatgtctatcagagaccatctggttgatctgtcaacttgcaagtgagcgcttcacggatcgctctgtacaacccatctgtcctttgtagaagatttcccttctagatctgtgcattttgtatctagttgagttgacatttgttctgtgctattcattttcttttagggaggcgtatttatgtatcttaattatattatgtataaacaaataaaggctgtatctaactatctcttaatttatgtagagctcagcgtactctttgggtactgtaaaattttgacaggtcagaataatatggcagtttgttctgtctcggag

SEQ ID NO: 5940 - DNA, 1982 bp, Hordeum vulgare
atggatcctatagatggtcaatggcggctgttgttcacggagagtcccgatcccccgtagaccctgaggtcaactccagaatctccctctgacggggccacccctggaacctcgaggtcgacgccgtcgtcaactccaccaacgagagcttggacgaggcgcatagtagccccgggctgcatgcggcggcggggccggagctcgctgaggagtgtgccaccttgggtgggtgccggactgggatggcgaagatgaccaatgcctatgatctgcctgctaggaaagtcatccatacagtgggccctaaatatgctgtcaagtatcacacagctgcagagagtgcacttagccactgctacaggtcttgcttggaactactagtagagaatggtcttgaaagcatcgcaatgggctgcatatacacagaagccaaaaattatccccgtgaaccggctgcccatgtggcaataagaacagtgagacgttttctggagaagcagaaggacaaaataactgctgttgtcttttgtaccacatcatcaactgatacagagatatataagcgattgcttcctctttatttcccacgggacaaacaagaggaagagatagcttcgttaaaacttccagctgatgttggggatgagaatggtgagccaataatagatgaaaggaaaataagaataaaaacattgcctgctgaggccgcaaatagcaagtatccagttcccgtgcccgcagatattcctctttctggttctggattgacacgtagaagaaattctaagttggattcatatttggatccatcctttatgtccataattaaagatccggatctccgacgcaaggagcaatgggaaaagtctgcgcaggcaaagaagggattcaattttgctaagttgcttggatttggtgatcttggtggtcctgcattatcagctgcagaagaatattcacttcatcaacgataccttgctaaagcaaattcccttaatctttcagaaattgctgaaatgaaaataatctaccgtggcggagttgacagtgaagggcgcccaattatggttgtcgttggcgctcactttcttcttcgctgtttggacctggaacgatttattctatatgtagtaaaggagtttgaacctttgattcaaaagccttactcaattgtctatttccactcggcagcgtccttacaagtacagccagacttgggattcatgaagcggttacaacaaatgctaggtcgtaagcatcagcgaaatcttcaggctatatatgtactccacccaacgctgggattgagaacggctattttggcgttgcagcttcttgttgatggagatgtctggaagaaagttgtctatgtcgacagacttatgcagctgttcagatacgtgccacgggaacaactaacaattccagattttgtctttcagcatgatctcgaagtgaacgggggaaagggcataatcgttgatcctagaacaaagcatgtctaccaaagaccgtcaggttgacatttagcaacttgtccctcccggttccgggtcacccccctgtcaaatctctgttctctgtagaaaagttcacatctagatccgtgaagtatgtatctagttgagttgacattatgttctactccccctgtcccaaaataaatgtcgctgctttagtattatatttgtactaacttagtactaaatttgcgtcacttattttgggatggagggagtacattgcattctttcttgtcttaggaaggtagttatgtatatgtattttgttctgtataaccaaataaaggctgtacctaaatctctcttaagttctcccgctgggctaaatcgcctagtgtttgtgtactgtaaaattttgagtggtccttgcagtggaggagtagattgtcctgctatcaatgttctggacatgctggcgtaataatcttgtgaagtcacgtagatacaccctttcccaaa

SEQ ID NO: 5941 - DNA, 2141 bp, Hordeum vulgare
ccgtggcgctcgaccaggtcccgcgctggagcgaccccgaccagcgcttccactcgccctcctcccccaccgcggccggatctgaggcccccgcctcctccttcctctccttcgccgaccccctcgacgcggccgcggcgggcgggggccacggcgcgtgccgcttccccgtcgaccccgaggtcaactccaggatctacctctggcggggccacccctggaacctcgaggtcgacgccgtcgtcaactccaccaacgagagcttggacgaggcgcatagtagccccgggctgcatgcggcggcggggccggagctcgctgaggagtgtgccaccttgggtgggtgccggactgggatggcgaagatgaccaatgcctatgatctgcctgctaggaaagtcatccatacagtgggccctaaatatgctgtcaagtatcacacagctgcagagagtgcacttagccactgctacaggtcttgcttggaactactagtagagaatggtcttgaaagcatcgcaatgggctgcatatacacagaagccaaaaattatccccgtgaaccggctgcccatgtggcaataagaacagtgagacgttttctggagaagcagaaggacaaaataactgctgttgtcttttgtaccacatcatcaactgatacagagatatataagcgattgcttcctctttatttcccacgggacaaacaagaggaagagatagcttcgttaaaacttccagctgatgttggggatgagaatggtgagccaataatagatgaaaggaaaataagaataaaaacattgcctgctgaggccgcaaatagcaagtatccagttcccgtgcccgcagatattcctctttctggttctggattgacacgtagaagaaattctaagttggattcatatttggatccatcctttatgtccataattaaagatccggatctccgacgcaaggagcaatgggaaaagtctgcgcaggcaaagaagggattcaattttgctaagttgcttggatttggtgatcttggtggtcctgcattatcagctgcagaagaatattcacttcatcaacgataccttgctaaagcaaattcccttaatctttcagaaattgctgaaatgaaaataatctaccgtggcggagttgacagtgaagggcgcccaattatggttgtcgttggcgctcactttcttcttcgctgtttggacctggaacgatttattctatatgtagtaaaggagtttgaacctttgattcaaaagccttactcaattgtctatttccactcggcagcgtccttacaagtacagccagacttgggattcatgaagcggttacaacaaatgctaggtcgtaagcatcagcgaaatcttcaggctatatatgtactccacccaacgctgggattgagaacggctattttggcgttgcagcttcttgttgatggagatgtctggaagaaagttgtctatgtcgacagacttatgcagctgttcagatacgtgccacgggaacaactaacaattccagattttgtctttcagcatgatctcgaagtgaacgggggaaagggcataatcgttgatcctagaacaaagcatgtctaccaaagaccgtcaggttgacatttagcaacttgtccctcccggttccgggtcacccccctgtcaaatctctgttctctgtagaaaagttcacatctagatccgtgaagtatgtatctagttgagttgacattatgttctactccccctgtcccaaaataaatgtcgctgctttagtattatatttgtactaacttagtactaaatttgcgtcacttattttgggatggagggagtacattgcattctttcttgtcttaggaaggtagttatgtatatgtattttgttctgtataaccaaataaaggctgtacctaaatctctcttaagttctcccgctgggctaaatcgcctagtgtttgtgtactgtaaaattttgagtggtccttgcagtggaggagtagattgtcctgctatcaatgttctggacatgctggcgtaataatcttgtgaagtcacgtagatacaccctttcccagataggattcataatgtatatggagccaatatattttggccattggt

SEQ ID NO: 5942 - DNA, 1238 bp, Triticum aestivum
ccgaaacccaaaccgaacccctaacggttaggaaggaaccgttaaaactaacccaaaggtaagtaaacccgttaccggtaaaagtaatttaaccaggaagaacggcaagcagaagaagaacaacaacagcacaaatgatagtgaaaaagcagctaactgaggatttgaaggtcttggatcagagtacgattcctgagacaaatgatgaatggatcaaccacacacctagtgagactacacaaatgcctgaaacatttgccgaggaagaacaacaagaacaagaacaacaaacgatagtgatacgggaagcatttaccgaggaggaagaacagcggcaacaaatgatagtgaaagagcatctaactgacggctctgatgatcataccacaacgtccatcagtactgaaaatttgcaggatcacaagacacatgttgttacatgcgattctttgacagagaaccaactcctgctcatgagactgctggtaaaggatcggtacttgctggaaaccgcaaaggcgatcgtcagagttgacgctcccgtcagtttcatcgacgctgacgccggtgcaccgaactggtcggtcgacaaaggcaacaacctcctctccgatgtggcccgggaggtggtcagaaggaaaggcaagaggagcgaggccatggaggaggtcagcgtggcgcgcaccgccaacctgaggctgcaataccttgacgatctcgtcagagagctggacggcgacgtcgagagcctggacatgtcaaagtccaagagaactcagcagcagggtgacaatcgcgcggccgaaaatctgcgtaggatacttgagagtgacattcagaatgaccaccccgacgccaactcgacgtgggatttcgggtggaaccgcgtgtgggagctgccgttggagaagggcgacgtcgtgagggatctggagaagaacatactgggcggcatcatcaccgacgtggcgagggatctcatcggagtatcggtgcgacatggctgttgtccctgcgtggcttgagtggagctgaggagtgctgcacctgcacagccgcgcaggagagaaaacttttagagtgattgaggtcactaggttaggctaattttttgatctgtaccacgtttattcgctgtaaataacttctgtgaggtttctctatattaaggaaatgtgtgtgttcggtgttcccttctgttccttttttcgacaggttgtagttttttcctagtagta

SEQ ID NO: 5943 - DNA, 996 bp, Secale cereale
gatgaaaagatcaaccacacacatagtgagactacacagatacctgcaatatttgccgaggaagaacaacagcaacaagagcagcaacgaatgatagtgaaagatcaactaaccgaggatatgaagttcttggatcagagtgcgattcctgagacaaatgatgaatggatcaaccacacacctagtgaggctatgcaaatgcctgaaacatttgccgagcaagaacaacagcagcagcaacaagaacaagaacaccaaactacagtgatacctgaaacatttaccgaggaggaagaacatcagcaacaaatgatagtgaaagagcaactaactgacggttctgatgatcataccacatcatccatcagctcagaaaatttgcaggatcacaagacgcatgtcgttgcatgcgattctttgacagagaaccagctgctgctcatgagactgctggtaaaggatcggtacttgctggaaaccgcaaaggcggtcgtcagagttgatgctcccgtcagtttcatcgacgacgaagccggtgcgccgaactggtcggacaagggcaacgatctcctctccgacgtagcccgggaagtggtcagaaggaaaggcaagcggagcgaggccatggagggggtcagcgtggtgcgcaccgccaacctgaggctgcggtacctcgacgatctcgtcagagagctggacggcgacgtcgagagcctggacatgtccaagtccaagagaactcagcagcagcagggcgacaatcgcgcggccgaaaatttgcgcaggatacttgagagtgacattcagaatgaccaccccgacgccaactcgacgtgggatttcgggtggaaccgcgtgtgggagctgccgtttgagaagggcgacgtcgtcagggatctggagaagaacatactgggcggcatcatcaccgacgtggcgagggatctcatcggagtatcggtgcgacatggctgttgtccctgcgtggcttgagtg

SEQ ID NO: 5944 - DNA, 1090 bp, Triticum aestivum
gaacgttagaaccgtacaacaccgtagtgtagactaactactacgtataccgtataagtattacgacgtaagaacgagagcagagaagacaactaacacgtgaacgaaacgtagatagtagtaacgtagacgacgtaactgtaggatttgtaagtcttcgtatcagaggtatgtattcctgagacaatagatgaataggatcaaccacacacctagtgaaggccacacaataacctgaacgaatttgccgagagaacagcagcagcaacaacaacaacaggaacacaaacggtagtgataccggaaaggcagtttaccaaggaggaagaagagcagcaacaaatgatagtgaaagagcaactaactgacggctcggatgatcataccacaacgtccgtcagttctgaaaatttgcaggagacacatgttgttacatgcgattctttgacagagaaccagctcatgctcatgagactgctggtaaaggatcggtacttgctcgaaaccgcaaaggcgatcgtcagagtagatgcccccgtcagtttcatggacgacgtcgccggtgcgccgagctggtcggacaagggcaacgatctcctctccgacgtggcccgggaagtgatcagaaggaaaggcaaacggagcgaggcgatggaggaggtcagcgtggcgcgcaccgccaacctgaggctgcgatacctcgatgatctcgtcagagagctggacggcgacgtcgagagcctggacatgtccaagtccaagagaactcagcagcagggcgacaaccgcgcggccgagaatctgcgcaggatacttgagagtgacatccagaatgaccaccccgacgccaactcgacgtgggatttcgggtggaaccgcgtgtgggagctgccgttggagaagggcgacgtcgtgagggatctggagaagaacatactgggcggcatcatcaccgacgtggcgagggatctcatcggagtatcggtgcgacatggctgttgtccctgcgtggcttgagtggagctgtggagagaaaacttttagagtgattggggtcactaggttaggctaattttttgatctgtgccgc

SEQ ID NO: 5945 - DNA, 2607 bp, Secale cereale
gtcatgctccaggacgcctccaggtacatgaaggggcagggagcggactcagaggcaaggagaaccgcaagagctcggcggcggcgcgctcggcgaggatcgaggagatcgtcgacgaagattcagacgccgagcaacccaaaaatgcttccatgcagatggttgttcacaacaagtttcagagccatcagactgatcagagtacaggcagaagctcagtcatggagtctggtccaagcacttccaacatcaacaactcttctgaaggtgaaaaggatggctcgaaggtaaggatgcccagcgtgatcgccaagctgatggggctggagaacctgccatcgtcgtcgacgacgaccgccgcggagcgcaaggggacagagaggtttgtgaaacccggagcagcaccaagaatggagatcagaggaaacactatggaccgcaaactgccgatacggatcatcgcttcggagaagggtcagcacaagattgtgctggcaggggagtggaagaacggcctgacaaactttggggagtctgaactaggtgcggctgcagtgtcaaacagttcatcacaccctgcgactgcaactggtaatagcaagcaaggaaggttgaccatgagggaggtgctgaggaagatggtggcagcagagacaggtgccgatgaaaaacaggaagtagaggagaggaacatccatgaggacaaggggattgctgaagaaatcaaactgcagaactccgtcagcgtcgggtgccgcgccgattcgggcaagaggatggattttctgaaaagattcaggaagaattcagacaacagcaggcctgtcaaggaagagaagcagagtgctcaggtgaagaatgcagaagttgggaagaagcaggccaccggcatgcgacggttgctggggagagacggcgaggcgaaatcgaggagggcgagggagaaggttaacaaggagaaccttgccactgcagataccaaggctgcaggaaagaatgtgaagggggatcaggtcaaacgtcaagcacaaagtaaacatgtggacagacaaagcaagccgagaaaaccgcagagcgaaacgccgagtcggaagttggaaaacaagaagaagtcactgatgccagaagcagggcatatgaaaaggaagcctgagtatactgtagtgacacaacaggagaaagaagaacaagcaaaagtaaatgatgctatcaatttcagtaaaccagcagatagcacgcgtggcgaaggcggtttgccggaaccattggcaatagcagtgagacggaacttggaaaacaagaagtcactgatgatgccagaagcagcacatatgagaaagaagcctgagtacactgcagtgtcacaacaggagagtgaagaatatacaaaagtaaatgaaaccatcagtttaagcaaaccagcagatagcgcgcgtggtgatggcggtttgtccgaaccatcggtaatggtggtgagtgatagcagcagggctggagaagcttctttggaccaacctttacagaaaataactgaaggaactagtgatcatacagttcctgtacagactattgttgtacaggcaatgggggatgtggagttcttggatcatagtgctattgttgagataaatgatgaaaagatcaaccacacacatagtgagactacacagatacctgcaatatttgccgaggaagaacagcagcagcaagaacaacatcagcgacaaatgatagtgaaagatcaactaaccgaggatatgaagttcttggatcagagtgcgattcctgagacaaatgacgaaaggaacaaccacacacctagtgaggccacacaaatgcctgaaacatttgccgaggaagaacaacagcagcagcaacaagaacaacaacaccaaacgatagtgataccggaaacatttatcgaggaggaagaacatcagcaacaaatgatagtgaaagagcaactaactgacggttctgatgatcataccacatcatccatcagctcagaaaatttgcaggatcacaagacgcatgtcgttgcatgcgattctttgacagagaaccagctgctgctcatgagactgctggtaaaggatcggtacttgctggaaaccgcaaaggcggtcgtcagagttgatgctcccgtcagtttcatcgacgacgaagccggtgcgccgaactggtcggacaagggcaacgacctcctctccgacgtggcccgggaggtgatcagaaggaaaggcaagcggagcgaggccacggaggaggtcagcgtggtgcgcaccgccaacctgaggctgcgatacctcgacgaccttgtcagagagctggacggcgacgtcgagagcctggacatgtccaagtccaagagaactcagcagcagcagggcgacaaccgcgcggccgaaaatctacggaggatacttgagagtgacattcagaatgaccaccccgacgccaactcgacgtgggatttcgggtggaaccgcgtgtgggagctgccgttggagaagggcgacgtcgtcagggatctggagaagaacatactgggcggcatcatcaccgacgtggtgagggatctcatcggagtatcggtacggcatg

SEQ ID NO: 5946 - DNA, 1878 bp, Triticum aestivum
cgccgccagccctggcgcggacaggcggcatccgcatctcaaagccaggcagctcaggcagcggcacggccatggccacaggaggatctacttttacttgctcgccgcggattcctcgcccaagtaccagccgggccagtcctgccggaagatccggagaaaggagccgaggttgcaggctgaaggtggggatggcaagggcaatgctgccgagggtctggaggagggccaggcaaaatctgattgcaccgatgagcaacatgatttggatggtgaggtgggccaagacgggcgaggttcttgtggtggcagtgagtatgagaagggtggggagatggagagagtccttgagaatcaggctgcgctgattgggcagtatgaggcacaagaaaatgctcagagggagtgggagaagaaattcaatgggagccgagattcaacttcggatgatgttgaccgagataataagttaaatcagaatggaaaaacatggggacagaggggcagagctgcgcagattgtgaatagagaactagttggtgaagaggcacgatcaagggataaaagagatctctctggaattaacagtccatcggagtgtttgtcgaacgaatctgcctttggcttgtccacaaatgctcgaaatgtaagtgctattgggaagtctgaaggatctgataatgattttgagcgggctactgcagtagttgcttcagttgttgatgaattgcatgctaggaaggatgaactagtacataaaagttatactaaaattattgaagggagtgggaataatcttggaagatcagcttcttcaccacaaaaaggctatcatagcagcccaaatgcagtacataataaaggtcaaggagatgggaattcagacagtggttcaagctaccatgggaatgctcgctcttatgagcactatgtaaccacaccatcacttggaagtcctttaagtgatacccctaaaagcaaagtgtctgaatggagctcgtcatgctttcataaccataccgataaccagattgacatgcagccaccctcaagtgatgatgtgggaggtgttctagaggcacttcaacgtgccaagatgtccctcagggaaaaactgggcagggcaagtccacccaggcaagacatgttggcacttccagcaccagaggatcactacacagatgatgatttgcaagtcgacgacacagaacttccactttgcatgtcacaacggcttagccaggaaatattgacactgccagcatcagaagactaccttagcaggatcagtttaccaggtgatgatgcaaaggtaccagttggccctgctggcttgttccggttgccaacagacccgtttccccaaaacgaggtgtgttccactgatggctatggctcaaggttcagtttgacgtcaagtcggcagaccgtcttttcaagaaaccctgctagtcatatcatgttaacttcatcccgcccccagtatggttctggtttctcaccgaatccgtattacgatcttcataattcaatgtagtcaatggctacaacaggggatgcttctttcatcccagaaattctaaggtctagcgatgattcaaaaaggggaatgtcttctggtgatgcaggcatgctttcccagtatggtagtgcttatgattagtagctggagtgtactagtagctatgcatggttagaatcccaatatagcctttgagctagatgctatctgttgcgtcggttcttcgtatggtttgataatgatgtgtgtcatgttgtattactatccaagaataaatcttgtttgtaagcagtgtaggctttctctcttatgccctcatgaggcattacaaattgctactgataatgatgtgtgtc

SEQ ID NO: 5947 - DNA, 2003 bp, Triticum aestivum
cgccgccagccctggcgcggacaggcggcatccgcatctcaaagccaggcagctcaggcagcggcacggccatggccacaggaggatctacttttacttgctcgccgcggattcctcgcccaagtaccagccgggccagtcctgccggaagatccggagaaaggagccgaggttgcaggctgaaggtggggatggcaagggcaatgctgccgagggtctggaggagggccaggcaaaatctgattgcaccgatgagcaacatgatttggatggtgaggtgggccaagacgggcgaggttcttgtggtggcagtgagtatgagaagggtggggagatggagagagtccttgagaatcaggctgcgctgattgggcagtatgaggcacaagaaaatgctcagagggagtgggagaagaaattcaatgggagccgagattcaacttcggatgatgttgaccgagataataagttaaatcagaatggaaaagcttggggacagaggggcagagctgctcagattgtgaatagagaactagttggtgaagaggcacgatcaagggataaaagagatctctctggaattaacagtccatcggagtgtttgtcgaacgaatctgcctttggcttgtccacaaatgctcgaaatgtaagtgctattgggaagtctgaaggatctgataatgattttgagcgggctactgcagtagttgcttcagttgttgatgaattgcatgctaggaaggatgaactagtacataaaagttatactaaaattattgaagggagtgggaataatcttggaagatcagcttcttcaccacaaaaaggctatcatagcagcccaaatgcagtacataataaaggtcaaggagatgggaattcagacagtggttcaagctaccatgggaatgctcgctcttatgagcactatgtaaccacaccatcacttggaagtcctttaagtgatacccctaaaagcaaagtgtctgaatggagctcgtcatgctttcataaccataccgataaccagattgacatgcagccaccctcaagtgatgatgtgggaggtgttctagaggcacttcaacgtgccaagatgtccctcagggaaaaactgggcagggcaagtccacccaggcaagacatgttggcacttccagcaccagaggatcactacacagatgatgatttgcaagtcgacgacacagaacttccactttgcatgtcacaacggcttagccaggaaatattgacactgccagcatcagaagactaccttagcaggatcagtttaccaggtgatgatgcaaaggtaccagttggccctgctggcttgttccggttgccaacagacccgtttccccaaaacgaggtgtgttccactgatggctatggctcaaggttcagtttgacgtcaagtcggcagaccgtcttttcaagaaaccctgctagtcatatcatgttaacttcatcccgcccccagtatggttctggtttctcaccgaatccgtattacgatcttcataattcaatgtagtcaatggctacaacaggggatgcttctttcatcccagaaattctaaggtctagcgatgattcaaaaaggggaatgtcttctggtgatgcaggcatgctttcccagtatggtagtgcttatgattagtagctggagtgtactagtagctatgcatggttagaatcccaatatagcctttgagctagatgctatctgttgcgtcggttcttcgtatggtttgataatgatgtgtgtcatgttgtattactatccaagaataaatcttgtttgtaagcagtgtaggctttctctcttatgccctcatgaggcattacaaattgctactgataatgatgtgtgtcatgttttattactaatctgatcgctctacaaaaaagaaaagtccgactgcgactctgccgtttagactaccacttgcgttggccgtctcggtctggagactgaccaaggtcacacgagggatagg

SEQ ID NO: 5948 - DNA, 1744 bp, Secale cereale
cacaggaggagctacttttacttgctcgccgcggactcctcgcccaagtaccagccgggccagtcctgccggaagatcaggagaaaggagccgagattacagactgaaggtggggagggcaagggcaatgctgccgagggtctcgaggaggaccagggaaaatccgattgcaccgatgagcagcatgatttggacggtgaggcgggccgagacgggcgaggttcttgtggtggtagtgagtatgagaagggtggggagatggagagagtcctcgagaatcaggctgcgctgattgggcagtatgaggcacaagaaaatgctcagagggagtgggagaagaaattcaatgggagcagagattcaacttcggatgatgttggccgagataacaaattaaatcagaatgaaaaagcttggggacagaggggcagagctgctcagattatgaaaaaagatctctctggaatcaacagtcgatcggaatgtttgttgaatgaatctgcctttggcttctccacaaatgctccaaatgtaagcgctattgggaagtgtgaaggacctgataatgatttcgagcgggctactgcagtagttgcttcagttgatgatgaattgcgtgctaggaaggatgagttagtacataaaagttataccgaaaccattgaagcgagtgggaataatcttggaagatcagcttcttcgccacaaaaaagctaccatagcagcccaaatgcagtacataataaaggtcaaggagatgggaattcagacagtggttcaagctaccatgggaatgctcgctcttatgagcactatataaccacaccatcacttggaagtcctttaagtgatacgcctaaaagcaaagtgtctgaatggagctcgtcatgctttcataaccatactgataaccagattgacatgcaatcacccgcaagtgatgatgtgggaggtgttctggcggcccttcaacgtgccaagatgtccctcagggaaaaactgggcagggcaagtccacccaggcaagacatgttggcacttccagcaccagaggatcactacacagatgatgatttgcaagtcaacaacacagaacttccactttgcatttcacaacggcttagccaggaaatattagcactgccagcatcagaagactaccttagcaggatcagtttaccaggtgatgatgcaaaggtaccagttgcccctcctggcttgttccggttgccaacagactcgtttccccaaaacgaggtgtgttcggctgatggctatggctcgaagttcagtttgtacatcaagtcagcagaccgtcttttctaaggaaccctgctagtcatatcatgttaacttcatcccgccccagtatggttctggtttctcgccgaatccgtattacgatcttcataattcaatgtagtcaatgcctacaacaggggatgcttctttcatcccagaaattctaaggtctagcgatgattcaaaaaggggaatgtcttctggtgatgcaggcatgctttcccagtatggtagtgcttatgattagtagctgagtgtagtagctatgcatggttagaatcccaaaatagcctttgagctagtagacgctatctgttgcgtcggttcttcgtatggtttgataatgatgtgtgtcatgttgtattactatccaagcataaattttgtctgtaagcagtgtaggcttctcttttatgccctcatgaggcattacaaattgtta

SEQ ID NO: 5949 - DNA, 1502 bp, Secale cereale
tcaagggcgtgttccggctcaaggcgagcccggcgtccggcgccgcggtgcacgtccagggcgcgcccgccggcgtcgacgtcaaggtgatggatctccaggtgttcgccacggaccgcaaggcccgcttcaagaagctcaggaagaagactgacaaggtgcgcaggcgcgacgtggtgctcaagttcgccggcgccggggcgtcgtcggcggtgtcgggggcgtcgatccgggtgatgcagatggacacgagcttcgcgttcggcgcgtgcatcaacccggcggtgatccaggagccggcgttcgtggactacttcaccaagcacttcgactgggcggtgttcgagaacgagctcaagtggtaccacacggaggcggtgcaggggcagctcaactacgccgaccccgacgcgctgctcgacttctgcgaccgccacggcaagcccgtgcgcggccactgcatcttctgggccgtcgaccgcatggtgcagaagtgggtcaaggacctgcccaacgaccagctcaccgccgccgtccagggccgcctcaccagcctcctcacccgctacgccggccggttcccgcactacgacgtcaacaacgagatgctccacggcagcttcttccaggaccgcctcggcgacgacatcaacgccttcatgttcaaggagacgcaggatgaccccggcgccgcctcttcgtcaacgactacaacgtcgagggcggcggcgacccaacgccaccccggagaagtacatcgcgcaggtcaacgcgctcatggagaagggggcgcccgtgggcggcatcgggctgcaggggcacgtcaccaaccccgccggcgagatcatctgcgacgcgctcgacaagctcgccaccaccgacctgcccgtctggctcaccgagctggacgtgtgcgagtccgacgtctgcctccgcgccgaggacctcgaggtggtgctccgggaggcgtacgcgcacccggccgtcgagggcgtcgtgctctgggggttcatgcaggggcacatgtggcgccaggacgcctgcctcgtcaactccgacggcaccatcaacgacgccggccaaaggttcatcaacctgcggcaggagtggacgtcgcacgcgcgcggcaagatcgacagcgacggcaacttcaagttcagggggtaccacggctcgtacgtcgtgcagctcgccacggccacggggaagatgcacaaggccttcagcgtcgagaagggggacacacctctcgtgctagacatggacgtgtgaccacggttaactactacggttattatctcgtatagttatactactgatattgatacacacatacatacatgcacacattaatttgacctaatggaattggcaaaggaattgtaccatatacagcaactactacaattttacatttctgaatttgggtatatattgtacaagggattgtaactaatgtattgtattggcttaaagttaatggagacaaatgaataaaacag

SEQ ID NO: 5950 - DNA, 2274 bp, Brachypodium distachyon
agtggggtagtggtggttgcttcgagctttcacaaatttttctgcaagtgttgggtgcggccttttgagctattttcgccgtgatcccgaccgccgacccttccgccttttatatacggcccgccgccgcgatcagtcctaccaccgcaagaacccaccgtcgacaagccaagccaagcccgtagcttccctgcttcctcgatcccgccatgggctgcgctcgctgcaccatggcttgctgcgctgctcagcacgaggtggtgttcgacgccaacctgatcaagaacagcacgctggaggacgggctcgccgggtgggcgccgctgggcgcgtgcaccaagctctcggcgcgcgtcgaggagccggccatggtgcccaccgagagcatcaacgaggactacaagccgagcggcaggtacattcttgcctcttcccgcgaatgccaggaggacggcctgtgccagccgatcccggcgtcggcgctcaagccccgggtcacgtaccgtgtggccggctggatcagcctcggcgccgggtgcgccgataatggcgacgccgtgacggacgccgtggtgcgcgtcaacattcgccttgatgggaacggcgtcggagacgaagacaaggaaggggggaagaagaagtgttctgtggtcgagggcggcgtggtgtgcgccgaggccgggaagtggacggagctcaagggcgcgttccggctcaaggcgtgccccgcggccggcgccatggtgcacgtccagggcgcgccccccggcgtcgacgtcaaggtgatggatctccaggtgttcgccacggaccgcaaggcccggttcaagaagctcaagaagaagactgacaaggtgcgcaggcgtgacgtggtgctcaagttcggcggcgcggggtcaggatcggcgtcggcgatctccggcgcgtccatccgtgtaatgcagatggacacgagcttcgcgttcggggcgtgcatcaaccctgccgtgatccaggaccagggcttcgtggacttcttcaccaagcacttcgactgggcggtgttcgagaacgagctgaaatggtaccacacggagccggcgcaagggcagctcaactacgccgacacggacgcgctgctcgacttctgcgacgcccacggcaagcccgtgcgcggccactgcatcttctgggccgtggacaacgtggtgcagcagtgggtcaaggccctggacaaggacgggctcaacgccgccgtccaggcccggctcaacagcctcctcacgcgctacgccggccggttcccgcactacgacgtcaacaatgagatgctccacggcagcttcttccagacccgcctcggcgacgacatcaacgccttcatgttcaaggagacggcccggatcgatcccggcgccacgctgttcgtgaacgactacaatgtcgagggcggcatggacccgaatgcgacgccggagaagtacattgcccagatcaacgcgctgcaggagaagggcgccccggtgggtggcattgggcttcagggacacgtcactaaccctgttggggaagttgtctgtgacgcgctggacaagctggctactactgacctgcctatctggctgactgagctggacgtctgtgagtctgacgtggatctccgtgctgaggacctggaggtggtgctccgggaggcgtacgcgcacccgggcgttgaaggcgtcatcttctggggtttcatgcagggccacatgtggcgccaggacgcctgcctcgtcaacgccgacggcaccgtcaacgacgccggcgaaaggttcatagatctgaggagggagtggacgtcgcacgcgcgcgggaagatcgacagcgacgggcacttcaagttcagggggtaccacggctcctacgtcgtgcagctctcgacggccacggggaagatgcacaagaccttcagcgtcgagaaaggggacacgcctctcgtgctcgacatggacgtctgatgccggttaatcgatcgtgaccatatagttatactactaaattactgatgcatacacatattttgatccaattgagatcaagggaattgtaccacactcaaatactagcagctgttactacaattttacattcgggtattgtattgggaagagtaagcaaggtattgtattggttaacgttaatggggatgaatgaataaagtaaacgagctattcctcgttttatagaaaaatgatactagtactgaatgatgtggacttttaagctctgtttggaactgaatggcttcgtttc

SEQ ID NO: 5951 - DNA, 2007 bp, Oryza sativa
caccgcaaatcaccaatccacggcgaacaagtcgttccagactccggcgatcacctgctcctgctgccacgatcatggcctgcaccaagggggtggttttcgacgtgaacctgctcgagaacagcacgctggaggacgggctcgccggctgggcggcggtcggcgagtgcacggcgctgtccgtgcacaatgaggagccggagaaggtgccgaccgagaccatcaacacggtggccgacgactacaagcccagcggccggtacatcctcgcggcgggccgcgccggcgaggaggacgggctgcgccgggcggtggccggcgcgctcaagccccgcgtcacgtaccgcgtggccgggtggatcagcctcggcgacggcgccgaggggagccacccggtgcgcgtcaacctccgcctcgacgacgacgacgagtgcgtcgtcgagggcggcgcggtgtgcgcccaggccggcaggtggacggagatcaagggcgcgttccggctcaaggcgagcccgtgcggcgcgacggtgttcgtccagggcgcgcccgacggcgtcgacgtgaaggtgatggatctccaaatcttcgccacggatcgcagggcacggttcaggaaactcaggaagaagactgacaaggtgcggaagcgggacgtcgttctcaagttcggtggggcggggagcatatcgggggcgtccgtacgcgtgatgcagatggacagcagcttcccgttcggggcgtgcatcaatggcggggtgatccagaacccggcgttcgtggacttcttcacgaagcacttcgactgggcggtgttcgagaacgagctcaagtggtactggacggaggcgcagcaggggcagctcaactacgccgacgccgacgcgctgctcgacttctgcgaccgctacggcaagccggtgcgcgggcactgcatcttctgggccgtcgacaacgtggtgcagcagtggatcaaggggctcgaccacgaccagctgacggccgccgtgcagggccgcctcaccggcctcctcacccgctacgccggcaggttcccgcactacgacgtcaacaacgagatgctccacggcagcttctaccaggaccgcctcggcgacgacatcaacgccttcatgttccgggagacggcgcgcctcgacccgggcgccacgctcttcgtcaacgactacaacgtcgagggcggcaacgaccccaacgccacgccggagaagtacatcgagcagatcaccgcgctgcagcagaagggcgcggccgtcggcggcatcggcctccagggccacgtcaccaaccccgtcggggaggtcatctgcgacgcgctcgacaagctcgccaccaccgacctccccgtctggctcaccgagctcgacgtctgcgagtctgacgtcgacctccgcgccgacgacctcgaggtggtgctccgggaggcgtacgcgcacccggccgtcgagggcgtcatgttctggggtttcatgcagggccacatgtggcgccaggacgcctgcctcgtcaactccgacggcaccgtcaacgacgccggcgagaggttcatagatctccggcgggagtggacgtcgcacgcgcgcggccacatcgacggcgacggccacttcaagttcaggggcttccacggcacgtacgtcgtgcagctcgcgacggcgacggggaagatgcacaagacgttcaccgtggagaagggggacacccctcttgtgctggatatggacgtctgacgattacttccattattttatactccatacagtttatactgatgattatttgatcgaacagagggcaaagcaacttttacctcgatcacatacaacaactacaattttacattttcaactattgtatgagaaaagtaaggtattgtactggttaaagttaattaagaaataaagtaaaaacgggctattcctcgttttatagtacatgattatctttttaaaaatatatatatatataatataacgggattatctgtgc

SEQ ID NO: 5952 - DNA, 2195 bp, Setaria italica
atgcctgtctgtggtggttgcttcgagttcgcacgacgtcttggcgttcggtgcgctttacaaccatttcgtggtgatcctgacgagcgacccatcgggcctttatataaggtgagccgccgtggtccttggccatcgcaacccaatcgacagcgaacaagttttcccaccaaactagcccttattagcgatcaccttcttggcttctttccttcaatccttcctctgatccagtgtgccatggcctgcactcaggaggtggtgttcgacgtgaacctgatcgagaacagcgccctggaggacgggctggccggctgggcgccggtgggctcgtgcacggcgctgtcggtgcacgaggaggagccggccaaggtgccgacggagacgatcaacgacgtggcggaggactacaggcccagcggccggtacatccttgcgtcgggccgcgccgacgagacggacggcctgcgccaggcgatcaagggcgcgctgaagccccgggtcacgtaccgcgtctccgggtggatcagcctcgggggcggcgccgccaccaccgcggaggagggggccggcggccacgcggtgtgcgtcaacctccggctagacgacgagtgcgtggtgaagggcggcgcggtgtgcgccgaggttggaaggtggacggagatcaagggcgcgttccggctcaagaagagcccgtgcgccgccgccgtgtacgtgcagggcgcgcccgccggcgtcgacgtcaaggtcatggacctccaggtctacgccaccgaccgcagggcgcggttcaggaagctcaggaggaagactgacaaggtgcgcaagcgcgacgtcgtcctcaacttcggcagcgcggcgtcgggcatctccggcgcgtccgtccgggtgtttcagatggacagcagcttcccgttcggggcgtgcatcaaccccagcgtcatccagaacccggccttcgtggacttcttcaccaagcacttcgactgggccgtgttcgagaacgagctcaagtggtaccacacggaggcgcagcaggggcagctcaactacgccgactccgatgcgctcctcgacttctgcgaccagcacggcaagccggtgcggggccactgcatcttctgggccgtcgagaacaccgtccagcagtgggtcaagaacctcgacgatgaccagctcaagtccgccgtccaggaacgcctccagagcctcctcacccgctacgccggccggttccctcactacgacgtgaacaacgagatgctccacgggagctactaccggagccggctcggcgacgacatcgacgccttcatgttccgggagacggcgcggctggacccgggggccacgctgttcgtcaacgactacaacgtggagggcgggagcgaccccaacgcgacgccggagaagtacatcgagcagatcgcggcgctgcagcagaagggcgcggccgtgggcgggatcggcctgcaggggcacgtcacgaaccccgtcggggaggtgatctgcgacgcgctcgacaagctctccgccgccaccgacctccccgtctggctcaccgagctggacgtgtgcgagtccgacgtcgacctccgcgccgaggacctcgaggtcgtgctccgggaggcgtacgcgcacccggccgtcgagggcgtcgtgttctgggggttcatgcagggacacatgtggcgccaggacgcctgcctcgtcaactccgacggcaccgtcaacgacgccggcgaaaggttcgtggatctccggagggagtggacgtcgcacgcgcgcgggcacatcgacagcgccggccacttcaagttcagggggtaccacggctcgtacgtcgtgcagctcgccacggcgacggggaaggtgcacaagaccttctccgtggagaaaggggacacccctctcgtgctggacatgaacctttgacgatcaccgctgccactccctagttatcatatactgccttgaaacaaaggtcctagttaattataccgatgcatacacactacatatacattgatttgatcctacggagtgcgaaagatatgtaccgcaaacagaaagcactccgtaattttacatttctatgattactgggtattgtaagagaaacttaaggtattgtactccttaagaattattggtggtgatgaataaagtcaacgagctattcctcgttttgtagt

SEQ ID NO: 5953 - DNA, 738 bp, Pennisetum glaucum
acttcggaactcttctgaggtttgggggcgctgtggagacggcgcggctggacccgggcgccacgctgttcgtgaacgactacaacgtggagggcgggaacgaccccaacgcgacgccggagaagtacatcgagcagatcgcggcgctgcagcagaagggcgcggccgtgggcgggatcggcctgcaggggcacgtcaccaaccccgtcggggaggtcatctgcgacgcgctcgacaagctctccgccgccaccgacctccccgtctggctcaccgagctggacgtgtgcgagtccgacgtcgacctccgcgccgaggacctcgaggtggtgctccgggaggcgtacgcgcacccggccgtcgagggcgtcgtgttctgggggttcatgcagggacacatgtggcgccaggatgcctgcctcgtcaactccgacggcaccgtcaacgacgccggcgaaaggttcgtggatctccggagggagtggacgtcgcacgcgcgcggccacatcgacagcgccggccacttcaagttcagggggtaccacggctcgtacatcgtgcagctcgccacggcgacggggaaggtgcacaagacattctccgtggagaaaggggacacccctctcgtgctggacatggacctttgacgatcaacggctaccactccctagttattatctgctcctccctagttaattgttgatacatatacactcgtatacattgatttgatcctac

SEQ ID NO: 5954 - DNA, 1217 bp, Panicum virgatum
aggtgcgcaagcgcgacgtggtcctcaacttcggcagcgcggcggcgtcgggcatctccggcgcgtcggtccgggtgatgcagatggacagcagtttcccgttcggcgcgtgcatcaaccccgccgtcatccagaacccggccttcgtggacttcttcaccaagcacttcgactgggccgtgttcgagaacgagctcaagtggtaccacacggaggcgcagcaggggcagctcaactacgccgactcggacgcgctgctcgacttctgcgaccgctacggcaagccggtgcgcgggcactgcatcttctgggccgtcgagaacaccgtccagcagtgggtcaagagcctcgacaaggaccagctcacggcggcggtgcaggcccgcctccagagcctgctcacccgctacgccggccgcttcccgcactacgacgtcaacaacgagatgctgcacggcagcttctaccgcgaccgcctcggcgacgacgtcgacgccttcatgttccgggaggcggcgcggctggacccgggcgccgcgctgttcgtcaacgactacaacgtggagggtggcaacgaccccaacgcgacgccggagaagtacatcgagcagatcgcggcgctgcagcagaagggcgcgcccgtgggcgggatcggcctgcaggggcacgtcaccaacccggtcggggaggtgatctgcgacgcgctcgacaagctctccgccgccaccgacctccccgtctggctcacggagctggacgtgtgcgagtccgacgtcgacctccgcgccgacgacctcgaggtggtgctccgggaggcgtacgcgcacccggccgtcgagggcgtcgtcttctgggggttcatgcagggccacatgtggcgccaggacgcctgcctcgtcaactccgacggcaccgtcaacgacgccggcgagaggttcgtggatctccggagggagtggacgtcgcacgcgcgcgggcacatcgacagcgccgggcacttcaagttcagggggtaccacggcacgtacgtcgtgcagctcgccacggcgacggggaaggtgcacaagaccttctccgtggagaaaggggacacacctctcgtgctggacatgaacatctgacgatcgctgctacgaccacgcacaccgtacccggcctagttacattacatacagccttgaaacgaaggtcctagtagttatactgatatcatacac

SEQ ID NO: 5955 - DNA, 2051 bp, Panicum virgatum
ggcagcagcagccaagttttccaaccaaaactctgcgatagatcacctgctagctccttcatctgatcgagtgtcatggcctgcactcaggaggtgatgttcgacttgaacctgatcgagaacagcgccctggaggacggcctggccggctggtcgccggtgggctcgtgcacggcgctgtccgtgcacgaggaggagccggccaaggtgccgacggagacgatcaacgacgtcggcgaggactaccgccccagcggccggtacatcctcgcgtcggggcgcgccgacgaggcggacggcatgcggcaggcgatcaagggcgcgctcaagccccgggtcacgtaccgcgtcgccgggtggatcagcctcggcggcgccgccgccgccgacgccgagggggccggccacgcggtgcgcgtcaacctccgcttggacgacgacgagtgcgtcgtggagggcggcgcggtgtgcgccgaggttgggaagtgggcggagatcaagggcgcgttccggctcaagaagagcccgcgcgccgccgcggtgtacgtgcagggcgcgcccgcgggcgtggacgtgaaggtgatggacctccaggtcttcgccaccgaccgcaaggcacggttcacgaagctcagaggaagactgacaaggtgcgcaagcgcgacgtggtcctcaacttcggcagcgcggcggcgtcgggcatctccggcgcgtccgtgcgggtgatgcagatggacagcagcttcccgttcggcgcgtgcatcaaccccgccgtcatccagaacccggccttcgtggacttcttcaccaagcacttcgattgggccgtgttcgagaacgagctcaagtggtaccacacggaggcgcagcaggggcagctcaactacgccgactcggacgcgctgcttgacttctgcgaccgctacggcaagccggtgcgcgggcactgcatcttctgggccgtcgagaacaccgtccagcagtgggtcaagagcctcgacaaggaccagctcacggcggcggtgcagacccgcctccagagcctgcttacccgctacgccggccgcttcccgcactacgacgtcaacaacgagatgctgcacggcagcttctaccgcgaccgcctcggcgacgacgtcgacgccttcatgttccgggaggcggcgcggctggacccgggcgccgcgctgttcgtcaacgactacaacgtggagggtggcaacgaccccaacgcgacgccggagaagtacatcgagcagatcgcggcgctgcagcagaaagggcgcgcccgtgggcgggatcggcctgcaggggcacgtcaccaacccggtcggggaggtgatctgcgacgcgctcgacaagctctccgccgccaccgacctccccgtctggctcacggagctggacgtgtgcgagtccgacgtcgacctccgcgccgacgacctcgaggtggtgctccgggaggcgtacgcgcacccggccgtcgagggcgtcgtcttctgggggttcatgcagggccacatgtggcgccaggacgcctgcctcgtcaactccgacggcaccgtcaacgacgccggcgagaggttcgtggatctccggagggagtggacgtcgcacgcgcgcgggcacatcgacagcgccgggcacttcaagttcagggggtaccacggcacgtacgtcgtgcagctcgccacggcgacggggaaggtgcacaagaccttctccgtggagaaaggggacacacctctcgtgctggacatgaacctctgacgatcgctgctacgaccacgcacaccgtacccggcctagttacattacatacagccttgaaacgaaggtcctagtagttatactgatatcatacacgtattacgtattgatttgctcgaacggagtgcatgcgaaaggaagtgtacggcaaacataaagcactctgtagttttacaattctacaattgggtattgtaagagaaacttaaggtattgtactcccttaagaattattggtgatgatgaataaagtgaacgagctattcctcgttttatagtat

SEQ ID NO: 5956 - DNA, 2180 bp, Panicum virgatum
tggtggttgcttcgagttcgcacgacgtcttggcgttgggtgcgctttacaaccatttcgtggtgatcctgacgagcgaccaaaatccggcccctttatataaggtgagccgccgcgatccttggtcatcgcaacccaatcggcagcagccaagttctccaaccaaaactcagcgatcacctgctgctagctccttcatctgatcgagcgccatggcctgcactcaggaggtggtgttcgacttgaacctgatcgagaacagcgcgctggaggacggcctggccggctgggcgccggtgggctcgtgcacggcgctgtccgtgcacgaggaggagccggccaaggtgccgacggagacgatcaacgacgtcggggaggactaccggccgagcggccgctacatcctcgcgtccggccgcgccgacgaggcggacggcctgcgccaggcgatcaagggcgcgctcaagccccgggtcacgtaccgcgtctccgggtggatcagcctcggcggcggcggcgccgccgagggggccggccacgcggtgcgcgtcaacctccgcgtggacgacgagtgcgtcgtggagggcggcgcggtgtgcgccgaggccggcaagtgggcggagatcaagggcgcgttccggctcaagaagagcccgcgcgccgccgcggtgtacgtgcagggcgcgcccgcgggcgtcgacgtgaaggtgatggacctccaggtcttcgccaccgaccgcaaggcacggttcaggaagctcaggaggaagactgacaaggtgcgcaagcgcgacgtcgtcctcaacttcggcggcgcggcggcgtcgggcatctccggcgcgtccgtccgggtgatgcagatggacagcagcttcccgttcggcgcgtgcatcaaccccagcgtcatccagaacccggccttcgtggacttcttcaccaagcacttcgactgggccgtgttcgagaacgagctcaagtggtaccacacggaggcgcagcaggggcagctcaactacgtcgactccgacgcgctgctcgacttctgcgaccgctacggcaagccggtgcgcgggcactgcatcttctgggccgtcgagaacaccgtccagcagtgggtgaagagcctcgacaaggaccagctcacggcggcggtgcagggccgcctccagagcctgctcacccgctacgccggccggttcccgcactacgacgtcaacaacgagatgctgcacggcagcttctaccgcgaccggctcggcgacgacatcgacgccttcatgttccgggaggcggcgcggctggacccgggcgccgcgctgttcgtcaacgactacaacgtggagggcggcaacgacccgaacgcgacgccggagaagtacatcgagcagatcgcggcgctgcagcagaagggcgcgcccgtgggcggcatcggcctgcaggggcacgtcaccaacccggtcggggaggtcatctgcgacgcgctcgacaagctctccgccgccaccgacctccccgtctggctcaccgagctggacgtgtgcgagtccgacgtggacctccgcgccgacgacctcgaggtggtgctccgggaggcgtaagcgcacccggccgtcgagggcgtcgtgttctgggggttcctgcaggggcacatgtggcgccaggacgcgtgcctcgtcaactccgacggcaccgtcaacgacgccggcgaaaggttcgtggatctccggagggagtggacgtcgcacgcgcgcgggctcatcgacagcgccggacacttcaagttcagggggtaccacggcacctacgtcgtgcagctcgccacggcgacggggaaggtgcacaagaccttctccgtggagaaaggggacacccctctcgtgctggacatgaacctttgacgtaacgatcgctgctaccatccgccacacccggcctagttacattacatacagcctttgaaacgaaggtcctagttatactgatatcatacacgtatatattatgtatattgatttgatcgaacggagtgcgaaaggaaatgtaccgcaagcagaaggcactctgtaattttacaattctacgattgggtattgtaagagaaacttaaggtattgtactcccttaagaattattggtgatgatgaataaagtgaacgagctattcctcgttttattgcaaa

SEQ ID NO: 5957 - DNA, 2481 bp, Sorghum bicolor
gccgccgcccaggctccacatgtcagcaccctgatgcgttcatgacgcactagctccgagccggacagacatggccgccggatctagcttgcttgcgcattctttactgtcactccaaagcagaagcacagaccacacacacagagagaaaaaaagacacacattctccgtctgttggtggttgcttcgagttcgcacgacgttatggcgcggcgttcgttcgctggtgcactttacaacaattctcgtggtgatttcgaccaacgaccaatcgcctctttatataaggtgtgcccgccgcgatccctctccctcaccacaccgcaagcaaatccacagcaagcaagtttctccagccaaccaaactcccggcgatcacctgctccgccgcctaagtctcatcgtccaccgcccggcttccaacaatggcctgcacccagggggtattgttcgacgtgaacctgatcgagaacagcgcgctggaggacgggctgtccggctggtcgccggtggggacgtgcacggcgctgtccgtggtcgaggaggagccggccaaggtcccgacggagacgatcaacgacgtggcggacggatacaggccgagcgggcggtacatcctggcgtcgggccgcgccgacgaggcggacggcctgcgccggccgatcgcggccgccgcgctcatcaagccccgcgtcacgtaccgcgtcgccggctggatcgccctcggcggggacggcgccaccgcgggggacagccacgcggtgcgcgtcaacctccgcctggacgacgacgacgggtgcgtcgtcgagggaggcgccgtgtgcgcggagcccggcaagtggacggagatcaagggcgcgttccggctcaagaagagcccctgcgccgccgaggtgtacgtccagggcgcgccccctggcgtcgacgtcaaggtcatggatctccaggtcttcgccaccgaccgcaaggcacggttcaggaaactcaggaagaagactgacaaggtgcgcaagcgggacgtggtgctcaacttcggcagcgcggcggcgtcgggcatctccggcgcgtccatccgcgtgatgcagatggacagcagcttcccgttcgggacctgcatcaacaccaacgtgatccagaacccggcgttcgtggacttcttcaccaagcacttcgactgggcggtgttcgagaacgagctcaagtggtaccacacggaggcgcagcaggggcagctcaactacgccgactccgacgcgctgctcgacttctgcgaccggtacggcaagcccgtgcgcgggcactgcatcttctgggccgtcgagaacacggtgcagcagtgggtcaagagcctcgacgccgacgggctcacggcggcggtgcaggagcggctgacgagcctgctcacccgctacgccggcaggttcccgcactacgacgtcaacaacgagatgctgcacgggagctactaccaggaccgcctcggcgacgacatcaacgccttcatgttccgggagacggcgcggctggacccgggcgccacgctcttcgtcaacgactacaacgtcgagggcggcaacgaccccaacgcgacgcccgacaagtacatcgcgcagatcgccgcgctgcagcagaagggcgcggcggtgggcggcatcgggctgcaggggcacgtcaccaaccccgtcggggaggtcatctgcgacgcgctcgacaagctcgccaccaccgacctgcccgtctggctcaccgagctggacgtcagcgagtccgacgtcgacctccgcgccgaggacctcgaggtggtgctccgggaggcgtacgcgcacccggccgtcgagggcgtcatgttctggggcttgatgcagggccacatgtggcgccaggacgcctgcctcatcaacgccgacggcaccgtcaacgacgccggcgagaggttcgtcgatctccggagggagtggacatcgcacgcgcgcgggcatatcgacagcgctggccacttcaagttcagggggtaccacggcacatacgtcgtgcagctcgcgacggcgacggggaaggtgcacaagacgttctccgtcgagaaaggggacacccctctcgtgctggacatgaacctttgacgaacacttctaccattccctactagttatatacagccttgaaaaaggtcgtagccttatactgatatacatacgtacgtactactacgacatatggcattgatttgatcgaacgggaagtgcagaagaaatggaacgcaaacagaaagcactccaattttaattacatatctatctatgattggtattgtaagagaaacttaaggtattgtactccttaagaattattggtgattggtgaataaagtgaacgagctattcctcgttttgtagtaaaccatatttggtgttctctatatcacggatcctacgcagatgattctatccttttcttgtacgatacgtaaagtgactgtttttt

SEQ ID NO: 5958 - DNA, 2285 bp, Sorghum bicolor
ggcccaggtgccagcgcccggcggccgatgagctttggaatccacgcgtctcctctcctccccttttgcctcgcaaagtcgttcgcaactcgcaacgcaagcctctcacgacattcggcgattcgaatcccactcccacccacgaccccgccgtgccgtccgccgctgccaccaccagttcaccaccacccggcagagcaaagcaaaagcgcccgccaccgagagacctccgccgcccgcgcgcctccgcgcgtcattgactcccgcccgcgcgccggcgaatattctcatcccgtccgccgcggccgcgggcaggggcaggggcagttccgtccgacgcgccgcaggaagcccccggggtgcaactaacgcggggggcggtttggtcattccccctcaggctccccctccccactacgcagcagcaggccagcaggcagcagcgtagtacggcctttttctagttccgtgtgcggctgtgcgctcgcgcttttcttctccttcgttccaccgcgtgaaagcttccagaaacaagggaaccggagaggcggagaccaaggaaaggagccgagtcgcttcaaatgctctgatctccgaccgagggctctcctcccggtcgatcctccctccctccctccctccctccctccatggcgcgcgtcctcccgctcagcatcgaggcgggggagatggccagtgtagctgccgcttcgcaggcacagaagcgaagaggcagtgacggacatgccaaggtcttcagcaggggcatcatgcacagcaattgaccattctgagcagaacacaaaggatgatgaatatgagaggctggttatacgggctcaacatgaaacatctggcacggcaattttatctgagcaaacaaagtcaagatccttcatttggtggatgaaagttctgcttggctgcttccttcttatattagtgggttatgtcttcgtgaaatggggagtcccctttgcctttgagaaggttctcgtgccaatcatgcaatgggaagcaagtgcttttgggcgtccagtattagctgttgttcttgttgcatctttggctctctttccagttattctagttccttctggaccttctatgtggttagcaggaatgatctttggatatggttggggtttcttgattataatggtcgggactactattggcatggtggtaccatactggattggctcattattccgtgaacgtctgcatgtatggttagcaaagtggcctcagcagatagcattaataaaacttgcaggtgaagggaattggttccagcagtttcgggttgttgcgcttttcagaatctcgccattcccatatacaatttttaattatgccgtaactgtgactgaaattaagttcaacccttatctctgtggttctgttgctggaatgatacctgaggccttcatctatatttacagtgggcgtttaatacggacattggctgacatgaagtacggcaactataaaatgacaccagtggaaatagcatacaacgccatttccttggttatcgccatcgtcctcacagtcgccttcacggtgtatgccaagagagctctgaatgacattgaaagttcggacggtatcactaaagaagatcacagcccaaatggctcaggggcgcgtgtgagtcatcgtcaggagcgcgccgatgcgcgttccatacaactagatgttgtatgatggtgtgttgaccgggaggttgcttggaattggaaggaggctggtaggtcggcaggtgcagcccaggtagctagctataggttacaagaggaggttaaaaaaaaacaataacacacacccagctgacgtgggtggtctgattcatttcgtgtgctttgcctgcacggccatactgaatctgaagtcactgaccgagcgatgctgctctcagcgatgtttttgttaccgttatgctgttagtgatggatccattgaactttacgtagagtgagaagcaccggcttgcaacgagctaccacagcgggcggacattcgaagcagaaccaaatcaatcttgtccttgatctgaaacttacactagagcttcatgtttgttgaagcatactacattggagtagtacattttgtacataataacatagctgctgatatagttagcattatgatctaagttcgaacaggaacctcatgaggtccgttgagcgatgtttggcacagtatttgggagcttgaatctgtgtgtgtatatgcagaacaaaactttccccaattggttgaacctttttgctttgccg

SEQ ID NO: 5959 - DNA, 1630 bp, Setaria italica
gcttttgttcttcccctccctccctccctccctccgctgcagcctgcaaaaagcttccagaagcaagggaagaaagggggaaggagccgagacgccgctccaaatgctttgatctccgtccgtgggctctcctcccgatcgatctcggctcctccatggcgcgcgtcctcccgctcagcatcgacacgggggagatggccagaggcgaagatatggtgacagacatgccaagttcttcagctggggcgtcgtgcgcagcagttgaccattctgagcaaaacacaaaggacgatgaatatgcgaggctggttacacgagctcaacatgcaacatctgatgtcagtgcgacaattttacctgagcaaccaaggtcaagatccttcatttggtggatgaaagttctgcttggctgcttccttcttataatagtgggttacgtctttgtgaaatggggagtcccctttgcctttgagaaggttcttttgccaatcatgcagtgggaagcaagtgcttttgggcgtccagtattggctgttgttcttgttgcatctttggctctctttccagttattttagttccttctggtccttctatgtggttagcaggaatgatctttggttatggttggggtttcttgattataatggtcgggactactattggcatggtggtaccgtattggattggctcattgttccgcgaacgtctacatgtatggttaacgaaatggcctcagcagatagcactaataaaacttgctggtgaagggaattggttccagcagtttcgagttgttgcgctattcaggatctcaccattcccatatacaatttttaattatgctgtcactgtgacagaaattaagttcaacccttatctatgtggttcaattgctggaatggtaccagaggcattcatctacatatacagcggacggttaatccgtacattggctgacatgaagtatggcaactacaaaatgacgccggtggagataacatacaacgtcatctccttcatcatcgccatcgtcctcacagtcgccttcacggtctacgccaagagagctctgaacaacataaaaagttcagaaggtatctgtaaagaagaagttctgagccctgccggctcgggtgcacgtctgaaacaccatcaggagcgctctggttcatgctctgtagaactagatgttgtatgacggtgtatttcattcaccgggagagtagatacaaagattgcctgagaggaggctgttaggtgtagggttgcgccgggtagataggctacaacagcaggttaaataatagtataatacacccagctgacgtggtttactcgattcatttcgtgtgctttgtctgcgtggccatacttgaactgaatccgggggtgcaatagtactgaatactgaattgtgactgagcgttgccgctctcagcgatggtgtaaccagaatgctgttgctggcgtgtagactccacgtggagatttctgtagagtccagaggcctccataagcacggccttgcaactagtctaccactgcggtctgcgggcatctgaaacattgtgcactttgtaacttctgatacagtttgcacatgccatatgatccgttttgatccgtttt

SEQ ID NO: 5960 - DNA, 1376 bp, Pennisetum glaucum
ccctacctccgctgcagcctgcaaaagcttccagaaacgatacaaaggggcgaaggagccgagccgccgctccaaatgcgttgatctccgccggtgggctctcctcctgaccgatctcccctcctccatggcgcgcgtcctcccgctcagcatcgacgcgggggagatggccagaggtgaagaggtggtgacagacatgccaagttcttcaggcgcgtcatgtgcagcagttgaccattccgaccataacacaaaggatgatgaatatgcgaggctggttacacgagctcagcatgcaacatctgatgtcagtgcgacaactttacctgagcaaccaaggtcaagatccttcatttggtggatgaaagttctgcttggctgcttccttcttatactagtgtcttacgtctttgtgaaatggggagccccctttgccttcgagaaggttcttgtgccgaccatgcagtgggaagcaagtgcttttgggcgcccagtattggctgttgttcttgttgcatctttggctctctttccagttattctagttccttctgcaccttctatgtggttagcaggaatgatctttggttatggttggggtttcttgattataatggtcgggactactattggcatggtggtaccgtattggattggctcattgttccgcgaacgtctacatgtatggttaatgaaatggcctcagcagatggcgttaataaaacttgcgggtgaagggaattggttccagcagtttcgagttgttgcgctattcaggatgtcaccattcccatacacaatttttaattatgccgtcactgtgacagaaatgaagttcaacccttatttatgtggttcgattgctggaatggtaccagaggcattcctctacatatacagcgggcggctgatccgtacattggctgacatgaagtatgccaactacaaaatgacaccggtggagatagcatacaacgtcatctccttcatcatcgccatcgtcctcacagtcgccttcacggtgtacgccaagagagccctgaacgacataaaaagttcagaaggtatctataaggaagaagttccgggccctgccttctccggtgcacgttcgaaacaccatcaggagcgctctggttcataccctgtagaactagatgttgtatgacgatgtatttggttcaccgggagagtatatatacagagattgcccgagaggaggctgctaggttacctgtagggttgcggcgttgcgccgggtagatatataggctataaacagcagattaaatatacacacccagctgacgtggtttatttgattcgtttggtgtgcctcgtattccttcgttgctatgcttgaatccgaatctgga

SEQ ID NO: 5961 - DNA, 1556 bp, Saccharum officinarum
aatttatgctgctgattttgcaaatgattttctgctcagttacaaccacagctacgatcccttagcagaatatctctcattcattgataatgatgtcttctcagttgatggtgtactgactgatttccctgtcacagcatcagaggcaattggatgttttaccaatttgaacaaaagcaacactgatcatggaaagcctttaattatttcccacaatggtgctagtggggattaccctgggtgcactgatctagcttatcaaaaagcagttgatgatggtgcagatgtcattgattgccctgttcaagtgaccaaagatggaataccaatatgcatgtcttccattgacctaatgacgtatactactgttgcaagatcgcaattcatctctcagactgccacgataaaggatattcagattgcaccaggggtttttagtttcaacctcacctgggatgacattgtaaagaacctgaaacccaaaatatccaccccatggaccgacttcgcattggatcgaaatccgagatataggaatgcaggaaagttcatgaggctatcagactttttggactttacaaaagataaagatttgtctggaatcatgatcagtgtagagcatgctgccttcatggcaggagaacttgggtttgacatggtcgataaagttatcaaagcccttgacgacgctggttaccatgaccaaactgctcagaaagttatgattcagtcaactgatagttcagttctagagaagttcaaggagcaaacaaagtacgaccttgtgtacatgatcaacaaagaagtcggggacgctgcaccttcctcgctcgcggacattaaaaagtttgctagtgccgtttccgttgataccagctctgtcttccctgaaacccactacttcacagtgtatgaaaccaatcttgtccagacactgcagacggctggcctctcggtctacgtttatactcttatgaacgagttcccgtctcaaccatacgacttcttctcagatgctacagcacagatcaatgcctatgttaagggtgctctagtggatgggctaatcacggatttccctgctacagctcgaagatacaagttgaacaattgcatgaacatggggaacagcacgccgaaatacatggcccctgctcatgccggtgatctcatgcaaagcatcagcaagagtgcgcaaccaccagcattggctcccattccgcccttgactgagtccgacgtggcacagccgcctttgcctcctgccagatcaaacagtacagctccgacccagtcacccgcgagcaggacgcatgcctgtgctgctcacatcccgatccttatcacactggcaatgctttgcgcttggcgttcccttgcctgagcttgcaatgcaggcgacccttatggcttgagcttgagcggcgaactacaaacagaaattttctccaccctggacaagagttatttgttaaggaaattgctttaggggctgggcggaaggcatttaacaaaccaaccttcttgggagagtttcctattggactttgggaaaa

SEQ ID NO: 5962 - DNA, 4234 bp, Zea mays
cccaaaccacgtgcagctcgccgttgtatgtcgcagagcgtggctaatccggctcgatccgccggtttgagggttccgatggagaccacagaggcggcggccgcgcatccgcagaaggacagtgtgaaggtggccgttaacataaggccgctcatcacggtggagctgcaggatggctgcacggattgcgtcacagtcacgcaaggcgaacctcaggttcaaattgggccccatgtcttcacttttgatcacgtctatggcagctcgggcccttcatcatcattaatatttgagcaatgcgtgcaccccttgatcgatgcattgttcagcggatacaatgccactgttctagcatatggccagaccggttctggcaagacatacacaatgggtactaactatagcggtgaagagaactgcggtgggataattcctcaagttatggatacaatatttagaaaagttgacacctcaaaggatggctcagagtttttaattagagtatcttttattgagatattcaaggaagatgtttttgatttgctcgatgcaaatcaagctgctgtaagacttgatgcaggttctatggcaaaagcatcagcccctggcagagtgccaattcaaatccgagagactgcaactggaggcataatccttgctggtgtcacagaggctgaggtgaagtcaaaagaagaaatggcatcatatttgacacgtgggtcgtcgtcgcgtgcaacagcaagcacaaacatgaatatgcagtcgagtcgctctcatgccatctttacaatatgtgttgaacaaaagagaacatctggtacatccgacaagtcagccagcagtgactatgatatactatcatcaaagtttcacctagttgatcttgctggttctgaaagggctaaacgtactggagcagatggacataggcttaaagaagggatacacataaataaaggccttctagctcttggcaatgttataagtgcattaggtgacgaaaagaaaaggaaagaaggggcatttgtaccataccgggatagcaaattaacccgtcttctacaggattctctaggaggaaacagcaaaacagttatgattgcatgcattagccctgctgatataaatgcagaagaaaccataaacacactcaaatatgccaatcgcgcacgcaacattcaaaacaaagcagtggtaaaccgtgatccagctacagcagagatgcaaaaattgaggagccagctggagcagctgcaaactgaacttttgttttctcgcagtgggagtgcagcgttagaagaacttcagttgctgcagaaaaaggtctctcttcttgagctaaagacttctgagcttaacaatgaacttaaggagaaggaattgtcatgtgagcagttggcagagcgggcacaggctgctcagttggaaagggatcagttgatgctgaagattgaatccgtgaggaatggaaaatcgttggatgatattgaaaatattgataacgaccaagacatggaccttttgaagggctacatatcaaaaatacagcagttggagagtgcgctgatgcgtcaaaacttctccaatgcttgcagacatggcttacatgaccagcttgccatggaccaggacatttttctaaatgaattgggttctggatgtgaagtagaaacaactgatgcttcaaatgaagttgatgaagaagaaaaggagagggaacattcattcatgcaagaccaacttgataaagagctgcaggaactagataaacgacttcagcaaaaggaggcagagatgaaacaatttgccaagagtgatacttctgttctcaagcaacattatgaaaagaagttaactgacttggagcaagaaaagaaagctcttcagaaagaaatagagaatcttcgccatgcattaaccaacatatcttcttctatggatgataatgctcaaaaagttaaagaaaactatcttcagaagctgaatgcacttgagtcccaggtccatgagctcaagaaaaagcaggaagctcaacaacagcttctaaggcagaaacagaggagtgatgaggcagcaaagcgcttacaagaagatattcagcgtataaaatctcagaaggttcaacttcaacaaaagatcaagcaagagtctgaacagtttaggtcttggaaggctgcccgtgaaaaggaagtacttcagctcaagaaggaagggagacgaaatgaatatgagatgcacaagctcttggccttaaatcagaggcagaagatggtcttacagaggaaaactgaggaagcagctgctgctacaaaaagattgaaggagttgctggaagcaaagaagtcatcacgtgaaacatatggcagtgcaaatggttcggggatgcaggccttaatacgagctattgacgatgaactagaagtcactgtaagagcacacgaattacgctcatattacgagcgacaaatgcaagagagagcagcaatatccaaggaaatagcaaaactaaaggaggaatcaaagcacaagatcagtgattgtcctcaagctatgtcacctagtgctagaagttctaggatatcagcattagagaatatgttgtcctcctcatctagtgctatggtatctatggcttctcaactgtcagaagcagaggagcgggagcgtgtattcaatggtaaaggtagatggtaccatgtcaggtccctcccagaggcaaagaatataatgaattaccttttccagttagcatcatctgcaaggtctcaagtactggataaagaagtaatttgtaatgaaaaagaacacaccattactgaattgaaggaaaaggtggttgtgcttaatggtggaattaggcagttggaaacacaagtgagggatctaaggagccaaaatacacagcttttcactgcattgaacaatgcaaagaaatctgctaggtcgaatggcactggatttgctgggcgtaagagtgttcgatcttcccagcattttggttatagtaaggacaacttcaattgggtggatgatatggacatttcagacagtgagcactcggatgagttagagaatatgagtgatggatccgattcagactgggtacagtcgacgaggaaagccaaaaaacaccagagaagagtgtctagccattcaaatcctaacctggattgtcaaaatacacaaggcagtgcagaaccagagaagccctcagatgaaaagtgcattttgcccaaatacatttcatcagacggctgttcatgctcaaaatcctcctcatgcaagaccaacaaatgcgagtgcagagggtcaggtgcacaatgcggtgcaggctgtggttgtaaggattccaaatgttctaacagggattcttctactatagaaaaagccaatcagggagccatgcttcttcagaccgcgttttctgagaaggaagcccaagatgcaaagccaagaaagcctttgactaacattggtaataatgtggttaaccaaactgccgagacaaagaagcccaggaaaaaccggcgcaagtcggcaattcaactcgtcccaggacctctcctgccgtccgagccagtggccaccgaagctgcccctcgggacattgccaacattcccctcaagctaccgagagccatgtcctcggtgactcctgcggagagcaaccctcccctcacagaccgcaatgctgccaaacccgacgaatcagtgagcaccggcagcaagaatagcaccggagctgcagccacgagagcaccgtctcagctgagaaaaaacgcaaccaccgagaaggagaaccagttgcgataatccgattgctgacatgcagtatccgtgactccgtgtcgcttaagccttctgtttaacagtgggggaggctgcctcggcgtcctttggagaggcaggtagactctggaagggctggcgctctcgggttcctgtgggaaatggcgtgttctgtggaaagccttagctctgctttggctggaatgcgaccttcttgtataatggaaaagtaacatgctggattaagctatgtcagtctcgtaaatggtctccgttcattttgaacatactgaggaaatcaatctgcgcatctgtatgcttagactggtacactgcaggatgcacatttcctccacagttcgacagcataacagatgcaatcgtatatatcgttgcaaccaagtggtgttcttttgagattataatatatcttgaaaaagtcaaa

SEQ ID NO: 5963 - DNA, 4145 bp, Setaria italica
tttggggaattcgtggttagggttccgatggagactccggaggcggcggccgcgcaccagcagaaggacagcgtgaaggtggccgtcaacatcaggccgctcatcacgatggagctgcaggacggctgcacggattgcgtcaccgtcacgcccggcgaaccgcaggttcaaattgggccgcatgtgttcacctttgatcacgtatatggcaactcaggcccttcatcatcatttatattcgagcaatgtgtgagaccgctgattgatgcattgttcagtggatacaacgctactgttctagcatatgggcagacgggttctggcaagacatatacaatgggtactgattatagtggcgagggtaactgtggagggataattcctcaagttatggagacaatattcagaaaagttgaagcctcaaaggatggcacggagtttttaattagggtgtcttttattgagatattcaaggaagaagtctttgatttgctcgattcaaatcatgctgctgcaagacttgattcagtctctgtagcgaaaccatcagcacctgccagagtgccgattcaaattcgagagactgcaaccggaggcataacccttgctggtgtcacagaggctgaggtgaagtcaaaagaggaaatggcatcatatttgatacgtggttcctcatcgcgtgcaacagcaagcacaaatatgaataggcagtcaagtcgctctcatgccatctttacaatatgtgttgaacaaaagagaacatctggtatatctgacaagtcagccagcagtgactatgatatattatcttcaaagtttcacctggttgatcttgctggttctgaaagggctaaacgtactggagcagatggacacagacttaaagaaggcatacacataaataaaggccttctagctcttggcaatgttataagtgcattaggtgatgaaaagaaaaggaaagaaggggcatttgttccatatcgggatagtaaattaacccgccttctgcaggattctcttggaggaaacagcaaaactgttatgattgcatgcattagtcctgcagatataaatgcggaagaaacaataaacacactcaaatatgccaatcgtgcacggaacatccaaaacaaagcagtggtgaaccgtgacccagctacagcagagatgcaaaaactgaggagccagttggagcagcttcaaactgaactattgttttcacgcagtgggagtgcagcgttagaagaacttcagttattgcagaaaaaggtctctctactggagctaaaaaattctgagctgaaccatgaacttaaggaaagggacttgtcttgtgagcagttggcagaacgcgcacgggctgctcagttggaaagggatcagttaatgctgaagattgcatccgcaaggaatggaaagtcatgggatgatattgaaaatgctgataatggccaagatgtggaccttttgaagagctacatatcgaaaatccagcagttggagagtgaactgatgcggcaaaacttctctaatggttgcagacatggtttacatgatcagctaaccatggaaagggacattcttctaaatgacctgggttctgaaggcgaagtaggaacgcctgatgcttcaagtgaagttgatgaagaagaaaaggagagagaacattcatccatgcaagaccaactggataaagagcttcaagaactagataaacgacttcagcaaaaggaggcagagatgaaacaatttgccaagagcgatacctctgtcctcaagcaacattatgagaagaagttaaatgagttggagcaagaaaagaaagcccttcagaaagaaatagagaatcttcgccatgcattaaccaatatatcttcttctacggatgagagtgctcaaaaactgaaagaaaactatattcagaagctgaacgcacttgaatctcaggtctctgaactcaagaaaaagcaggaagctcaacaacagcttctacggcagaaacaaaaaagtgatgaggcagcaaaacgattacaagaagatattcagcgcataaaatctcagaaggttcaacttcaacaaaaaatcaagcaggaatctgaacaatttagatcttggaaggctgctcgtgaaaaggaagtacttcagctcaagaaggaagggagacgaaatgaatatgagatgcacaagctcctggccttaaatcagaggcagaaaatggtcttacagcggaaaactgaggaagctgctgctgcaacaaaaagattgaaggagttgctggaagcaaagaagtcatctcgtgaaacatatggaggtgcgaacggttcggggatgcaggctgtaatgcgagctatcgatgatgaacttgaagtaactgtaagagcacatgaactacgctcatattacgagcgacaaatgcaagagagagctgccatatccaaggaaatagccaaactaaaggaggaatcaaagcacaagatgagtgattgtcctcaagctatgtctcctagtgctagaagttctaggatctccgcattagagaacatgctatcctcgtcatctagtgctatggtgtctatggcctctcaactttcagaagctgaggagcgggaacgtttattcaatggtaaagggagatggcaccatgtcaggtccctcccagaggctaagaacattatgaactacctttttcagttagtatcttctgcaaggtgtcaagtacaggataaagatgcgacttgtaatgaaaaagagcacatcattagtgaattgaaggaaaaagtggttgtgcttaatagtgggatcaggcagttagaaatgcaagtgaaagatctaggccaccaaaatatgcagcttttcactgcattgaacaatgcaaagaaatctgctatttcttcagggaatagcactggtgtttcagatgatggtcagacttatgccttgcgcaagagtgttcgatcttctcagtactttggttatagtaagaaccacttcaactggttggacgatatggacacgtcagactctgattactcggaagaagataaaatgagcgaggagtctgatggagactgggtaaagccgaccagaaaagttagaaagcaccggcaaacagtgtccagccatgcaagtcttaatctgggttgtcaaaacacacaagaaaatgcagaaccagagaagaagcccacagatgaaaagtgcattttgcccaaagatgttccatcagaatgctgctcatgctcaaaattctcatcatgcaagaccaacaagtgcgagtgcagaggctcaggtgcacattgtggtccaggatgtggttgtaaggactccaaatgttctaatagggattcttcagataatacagagatagtcaatcagggaatcatgcttcttgagaacgctttctctgagaaggatgcgcaagatgcaaagacaagaaagcctttggccgatattggtaataatgaggttaaccaaactgcagagacgaagaagaaaccgaggaaaaactggcgcaagtcgacagttcagctcgtcacagtccctctcccaccctctgtgccagagaccaccgaagctgccccgcgggacagagccgacatccccctcaagctgccgagagccatgtcttctgcatccgcagagagcaaccctcctcccctcacggaccgcaatgccgccaagccagacgagtccgtgagcaccgggaccaaggagagcacggctgccacgaggccaccgtctcagctgcgaaagaacgctgccaccgagaaggagaaccagttgcgatgatgtgattcatgcagtagctgtgcggcggaagtctgttgtcgtgacaatgggggaggccgcctcggcgtccttcgactctggaaggaagggagcccttctcgggttccctttggatgaggttatgtcccattctatcgccatgtgccttgtacgtgccttagctctgctttggctggaacgcaacgcttttgaacgatggtgcattaaaatagtgggttaagttatgccatcaatcttgtaaatggtgcccgttccttttggacacagcttttgtccgttaagctgtgcaatgctgtacgagttcttcgttgtagacattgatcggttgatatgctactggtaaaagtgtaatgcca

SEQ ID NO: 5964 - DNA, 1613 bp, Ambrosia trifida
atatttgatatatgtaaattgcattggttgcggctcaaaccttatcccccactttcacccacatacaatgcaccatctttataaagttaaaaacacactacacaaaaccctccctacaaaacctttcctgggaataatgtgtctcctcctagtccccttcatcttcttccacctccttccggccaccatccctgccgtagcgccgccgctccaccccggatactatgccaaatcatgcccaaatgccgaatatatcgttagagacgtcctgaaaaaggcgatgatccgagaaccccgaagtggagcttcggtcatgcgatttcaattccatgattgttttgttaacgggtgtgatggatcgatgttattggatgatactccgaccatgctaggagagaagctctctttgtcgaacatagattcgttgcggtcgtacgaggttgtcgatgaaatcaaggaagcgcttgagacggcctgccctcagacggtttcttgtgcagatattattatcatggcgtctagggatgctgtcgctctgagtggaggtccggattgggaagtgaagttgggaagaaaagatagcctaaccgcaagtcaagaggatgccgatgccataatgcctagtccgcgagccaacgcaaccatgctcatcgatctctttgccaagttcgatctctcggtcaaagatttagtagccctttcgggctcacactcaattggtaaagggcgttgtttctccattgtgtttaggctctacaaccagtcaggcactggccgccctgacccctccatcgagcccaagtttagacaaaagttaaacaaactttgtccactaggcggtgatgggaatgtcacgggcgatttggactttacgcctcgcgtattcgacaatcaatatttcaaagatttggtaagtgggagagggtttttgaattcggatgaaacattgtatacttattggagaacaagagagtatgttaagaggtatagtgaggatcaagatgagttctttagggactttgttgaggggatgattaagatgggcgacttgcaatcggggcggccgggagagattcggaagaattgtagggtggtcaacggtggtccaccggtggacttggtggtggaaggatataaagataggaggatattgagttatgaaacttaagttgaacacattatgtatttatcatgagtatggataatgtagcatatggtgtgtcaacttttttatataagttattgattagagtcgcagtcggtacttttttctttttcaaacagaaaacacatcatagcaaaagccttgatgcatactagaaatctcaaatacatataacagaaacagctgcagcccaaccatacatatatctgcagctacaacacagaccccatagagacaccacaacagaaacagtaagtactaaaaacaacaaaaccaatgaatagtaataagtaaagataataacgcttagaccgggttaaccacaaactcctacaagtattcttacttcatcttcatcttcaccctcgcctgactccagcccaacttctcataactccttctccagtgcccgccaaatccctacacgagccttcggaagaactccacc

SEQ ID NO: 5965 - DNA, 1030 bp, Flaveria ramosissima
ctcctctgcctccctccggcaaccgtcgccgccgcctccgccgcaccaccgctccggccggcgtactactcccaaacatgcccaaatgcagagctcatcgtcagaaacaccctcaaaaaggccatgatcagagaccccagaagcggagcctccgtcatgaggttccaatttcacgattgtttcgtcaacgggtgtgatggttcgatgctattggatgatactccgacgatgctgggggagaagctgtcgttgtcgaatattaattcgttgcgatcgtacgaggtggttgacgagatcaaggaagctcttgaatcggcctgccctatggtcgtgtcttgtgcggatattattattatggcctctagagatgctgtcgcactgagtggaggtccggattgggaagtgaagttgggaagaaaagatagcctaaccgcgagtcaaaaggatgccgatgacataatgccgagcccacgagcaaacgcgagcaccctcatcgatctctttgccaagtttgacctctcggtcaaagacctagtagccctttcgggctcccactctattggtaaaggacgttgtttctccattgtgtttaggctctacaatcaatcaggcacgggccggcctgatcccaccatcgagcccaagtatagggaaaagttagacaaactttgccctcttggcggtgatgggaatgtaacgggcaatttggactttacgccttacatcttcgacaaccaatatttcaaggatttggtacatggaagagggtttttgaattcagatgaaacattgtatacttattggaaaacaagggaatatgttaaaaggtatggtgaggatcaagaggagttctttagggattttgtcgaggggatggataaagatgggggacttgcattcggggcggcccggtgagattaggagaaactgtagggtggttaacgacggcccgccggtggacttggtgttggaggggtttaaagataggaaaatattgagttcttaaacttaatttcaacacaatgtgtat

SEQ ID NO: 5966 - DNA, 1430 bp, Lactuca sativa
tattattgtctcatttttcaaaatttggaagaaaaaatgtgattggctgtgattccaaaacaaacgtgattggttgtgacaacccgtagctacactcagtccacatcacagttacaccttagtggggtggtgttcacgcgtgagtatctttgccacataggctgctacacgtcaaaaacgatggccttatataattaaataacctctcacaaaaacctttatcaatgtgtcttctctccttcgtcttgtgtctacttccggtggtcatctccgccgcagcgccaccactccagccgggatactacgccaaatcctgcccaaatgcagagctcatcgtcagagatgtgatgaagaaggcgatgatcagagaacccagaagtggagcttctgtcatgcgacttcaattccatgattgttttgttaacggatgtgacgggtcgctgttgttggatgataccccgaccatgcttggggagaaactctcgttgtccaacataaattcgttgagatcttacgaggttgtcgatgaaattaaggaagctcttgagtcggcctgccctcgtattgtttcttgtgcagatatcattatcatggcctctagagatgctgttgctctgagtggaggtccagattgggaagtgaaattgggaagaaaagacagtttaacggcaagccaaaaagattccgacgacataatgccgagtccaagagccaacgcaagttctctcatcgatcttttcgccagattcgatctctcagtgaaagatctcgtgtccctttccggttctcactccatcggaaacggtcgttgcttctccatcgtcttccggctatacaaccagtcaggaaccggccgcccagatcccaccatcgagcctaagttccggaaaaagttagacaagctttgccctcttggaggagacgggaatgtcaccggcgatttggacttcacgcctcatgtttttgataatcagtactttaaagatttggtgaacggaagagggtttcttaattccgatgaaacgttgtttacttttccggaaacgagagggtatgtgagaaggtatagtgaggatgaatccgagttttttagggattttgtcgatgggatgataaagatgggggacttgcagtcagggcggccgggggagattcggaggaattgtagggtggttaatgacccgccgcaggtagaggtggtggtcggggaattcagggataggaaaatcttgagcaagtgatttgtgatgtcgtcttaaatacgagtataatttatatctgctaaaagtgctacatatgttctcagacaatgcgtttcataatatgacgctataaattctagttattaaagaaactttttgggatagaaattataagttcaaaaataacttaggaaggtaactaccttttatccgtgtttatatattggc

SEQ ID NO: 5967 - DNA, 1144 bp, Artemisia annua
tacaaaaatgtgtctcccttttctcctccttcctttcatctttctcagtcaacttccggtcaccgtccccacaacgatccatcccggatactacgcgaaaacatgcccgaatgccgagctcatcgtacgagatgtgatgcaaaaagccatgatccgagaacctagaagtggtgcttcagtcatgagacttcagtttcatgattgctttgttaacggatgtgatggttcgttattgttgatactcctaccatgcttggagagaaactgtctttgtcaaacataaattcgttaagatcgtacgaggttgtcgatgaaatcaaggaagcacttgaaacggcctgccctcaaattgtctcttgtgccgatatcattatcatggcctctagagatgccgtcgcgctgagtggaggtccggattgggaagtgaagttgggaagaaaagacagcctaactgcaagccaaaaagattcagatgacataatgcctagtccgagagccaatgcaagcactctcatcgatctatttgccaagtttgacctttctatcaaagatttagtagccctttcaggctctcactcgattggtaatggacgttgcttctccattgtgcatagactttacaaccaaacagacgatggtcgcccagacccttccattgagccaaggtatcgacaaaagttggacaaactttgtcctcttggtggtgatgaggaagtcataggtgatttggactttacgcctcgtgtatttgacaatcaatatttcaaagatttggtgcatggaagaggttttcttaattcagatgaaacattgtatactttttggcaaacaagaggatatgttcaaaggtatagtgaaaatccatcggcgttctttaaggattttgtggagggaatgataaagatgggagacttgcaatcggggcggccaggggaaattcgtaagaattgtagggtggttaatgatgcgccacccatggaaatagtgatgaggggttcgaaagataggaaaatattgagtttctaagcaaaatttgaccacagtgtatatttatcatgttattggatgctttgtcgcgcattatcaatgtttagtactaagtatggactagtattgaaattttaacacttgatataattagtat

SEQ ID NO: 5968 - DNA, 1172 bp, Cirsium arvense
cttcctcttctctccacttccgatcaccatctccgccgtagcgccgccgctcgtgccggaatactacgcgaagtcgtgtccgaatgcggagctcatcgtacgagacgtcatgaaaaacgccatggccagagaacctagaagcggagcttccgtcatgcggcttcagtttcatgattgtttcgtaaacggatgtgacggttcgttgttgttggatgatactccgaccatgttgggggagaagctctcgttatcgaacataaattcgctccggtcgtacgaggttgtcgatgaaatcaaggaagctctcgagaaggcctgccctcggactgtttcttgtgcggatatcattatcatggcctctagagatgccgtttttctgagcgggggtccgaactgggacgtgaagctaggaaggaaagacagtctgactgcgagccaagaggatgctgacgacataatgccgagtccccgagccaatgcaagcatgctcatcgatctctttgctagattcgacctatctgtcaaagatttagttgccctttcgggttcgcactcgatcggcaagggccggtgcttctccatcgtgtttcggttatacaaccaatcgggcacgggccgacctgacccgactatcgagccgaggtttcgacagaagttggacaaactatgtccgcttggcggtgatggaaatgtgaccggtggtctagacttcacccctcaagtgttcgataatcaatatttcaaggacttggttaacgggcacgggtttcttaattccgacgaatcattattttcgtttttggaaaacgagaccgtatgttcagaggtatagcgaagatgaatcggagttttttagggattttgtggaggggatgataaaattgggggacttgcaatcggggcggccaggggagattcggaggaattgtagggtggttaacgggcggccgccggtggatgtggtggttgggggattaagggacagaaaaatctttgggtttgaaacgtaatttgattaatatgtatgtatcatctattacaagaatagagaaatatatcatatgttatcatcttttagtgttatttatatttttagaagatgtttgtgatttagagttaaaactaatttgtaagatataatagaatatatttgtgttttaaattaaaaagaa

SEQ ID NO: 5969 - DNA, 1036 bp, Cirsium arvense
tgtgtcttcttcttcttcttctcttgtgtctacttccggtgaccatctccgccgcatcgccaccactcctgccggaatattacgccaaatcatgtccaaatgcagagctcatcgtcagagacgtcatgaaaaagcgatgagcagagaaccaagaagtggagcttctgtcatgagacttcaatttcatgattgtttcgtaaacggatgcgatggttcgttgttgttggatgatactccgacgatgttgggagagaaactttcgttgtcgaacataaattcgctccggtcgtacgaggttatcgatgaaatcaaggaagctcttgagacggcctgccctcacactgtttcttgtgcagatatcattatcatggcctctagagatgctgttcttctgagtggaggtccgaattgggacgtgaagttaggacggaaagacagtttaaccgcaagccaacaggattccgacgacataatgccgagtccccgagccaatgcaagcatgctcatcgatctctttgccaaattcgacctttccgtcaaagatttagtcgccctttcgggttctcactcaatcggcaagggtcgttgcttttccattgtgtttcggctatacaaccaatcgggtacgggccaaccggaccccaccatcgagccaatgtttcgaaaaaagctcaacaaactatgcccactcggtggtgacggaaatgtgaccggaggtttggacttcaccccacaagtgttcgataatcagtatttcaaggatttggttaacgggcacgggtttcttaactccgatgaatcgttgtttacgtactttaaaacacgaccatatgttcgtagatatagtgaagatgaattggagttttttagggtattttgtggaggggatgataaaattgggggacgttgcaatccgggcggccgggggaggttcgtcggaattgcagggtggttaatgggccgccggtggatgtggtggttgggggattgaaggacagaaaaatctttggaattgaaaggtaatttgagtaatata

SEQ ID NO: 5970 - DNA, 1076 bp, Flaveria ramosissima
gcaccaccgctccggccggcgtactacgcccaaacatgcccaaatgcagagctcatcgtcagaaacgccgtcaaaaacgccatgatcagagaccccagaagcggagcctccgtcatgaggttccaatttcacgattgtttcgtcaacgggtgcgatggttcgatgctgttggatgatactccgatgatgcttggggagaagctgtcgctgtcgaatattaattcgttgcgatcgtacgaggtgattgatgaaatcaaggaagctcttgaatcggcctgccctatggtcgtgtcttgtgcggatattattattatggcctccagagatgccgtcgcactgagtggaggtccggattgggaagtgaagttgggaagaaaagatagcctaaccgcgagtcaaaaggatgctgacgacataatgccgagcccgcgagcagacgcaaggaccctaatcgatctcttcgccaagtttgacctctcggtcaaagacctagtagccctttcgggctcccactcgattggtaagggacgttgtttctccattgtgtttaggctctacaatcaatcaggcacgggccggcctgatcccaccatcgagcccaagtataggcaaaagttagacaaactttgcccgcttggcggtgatgggaatgtaacgggcaatttggactttacgccttacatcttcgacaaccaatatttcaaggatttggtacatggaagagggtttttgaattcagatgaaacattgtatacttattgggaaacaagggaatatgttaaaaggtatagtgaggatcaagaggagttctttagggattttgttgaggggatgataaagatggggaacttgcaatcggggcggcccggggagattaggaggaattgtagggtggttaacgacggcccgccggtggacttggtgttggaggggtttaaagatagggaaaatattgagttcttaaactatatttgaacacattatgtatgataattattgtcatgataatattgaagatgtagcttatgttgtcagcttttcatataaattatagaatttacagtattagggtaaag

SEQ ID NO: 5971 - DNA, 2019 bp, Nicotiana benthamiana
atgaagagtcgtttcggaactccatttgaaggcattgcagaggatattcgaggacgcgtttcttgctacaagcaggattggattgctggaattagatctggaatagggatattggctccaacaacgtacatatttttcgcatctgctcttccagttattgcttttggagaacaattgagcagagatacagatgggagcctgagtacagtggaaactttagcttctacagctatttgtggaatcattcattcaatattcggcgggcaacctcttatgatactaggagttgcagaacctacaattattatgtacagttacttgtacaactttgccaaagggagagaagaattgggacagaccctttacttggcttgggctggatgggtttgtgtgtggacagctcttatattgtttcttctagcaatatttaatgcctgctctatcattagtaaatttacaaggattgctggggagacttttggcatgcttattgctgtgcttttcattcaagaagcaattaagggattagtaagcgagtttcacattcctaaatccgatgacccaagctcagagaaaaatcaattccattggctttacacaaatggtctgcttggaatcatatttacctttggccttctctacacagcctcaaaaagcaggaaagcaaggtcatggtggtatggcacaggctggattagaagcttcatcgcggactatggagttcctttaatggttattatgtggtcagctctctcatttatcgtgccaaacaaagttccgtctggaattcctagaactctctatagtccccttccttgggaatctgcatctttataccactggactgtaatgaaggatatggggaaggttcctccagcatatatatttgcggccataataccagctgtgatgatagcaggactctattttttcgatcacagtgttgcttctcagatggcacaacaaaaggagttcaacttaaataatccttctgcttatcattatgatatcttactcttgggatttatgactttgttatgcggtttgattggattgcctccttcaaatggtgtcctgccacaatcccctatgcatactaaaagtttggctattcttaaaaaacagttgattaggaaaaagatggttgaaagtgcaaaagagagtatcagaagaaaagcaagcaactctgaaatctatggcaacatgcaagcggtattcatagagatagatagttctcctgttagtgcagtagctaaagaattgaaacacttgaaagaggcaataatgaaacatgaaattgaaaatgcaaatggcggaaagtcaaatggcaaatttgatccggagaagcatattgatgcatacttgcctgttcgagtcaatgaacaaagagtgagcaatctactgcagtcactactagtagcagcatcagtatgtgctatgccagttataaagaagataccaacctcagttctttggggatattttgcctacatggctattgacagcttgtcgggaaatcaactatgggaaagaatcttgcttctcttcatcacacctggcaggagattcaaggtccttgaaggggtacatgcatcttttgtggagtcagtaccatttagatgcatggcaatcttcacagtgttccaacttgtatatttacttgtgatctttggtgtcacttggattcccatagctggcattctattccccttgccattctttctcctcttaagtataaggcagcatttgctacccaaattgttccaccctcgtcatttgcaagagcttgatgcagcagagtatgaagaaattgctggtaccccaaaacgtgcacttagcttctctttcagggaaacggagataactcttcctggaactgaagaaggcaaaatagaaatttgtgatgctgagactttggatgaacttacaactagcagaggagagttgaaattcaggacggtcagcttcagcgatgataagcgcccacaggtaccttgacaatgaatttcataattatta

SEQ ID NO: 5972 - DNA, 617 bp, Triticum aestivum
gcggcggcggcggcgggtgagctcgcgcataacggatcgatcccagctctagaggggagcagccatggcgggggacggcgacgaggagctgccggcgatgggcggcgacaagctgatcctgcgggggctgcagttccacgggttccacggcgtgaagcaggaggagaagaagctcggccagaagttcgtggtcgacgtggacgcctggatggacctcgccgccgccggggactccgacgacatcgcccacaccgtcagctacaccgacatctacaggatagccaagggcgtggtggaaggcccgtcgcgcaacctcttggagtcggtggctcagtcgatcgccggcaccacgctgctcgagttcccccagatctccgccgtccgggtgaaggtcgggaagccccacgtcgcggtgcagggcgtcgtggactacctgggggtggagatactgaggcgcagagaggcatgagcacaagaaccgaacagaattcatctcagttgagccgatcgatctctgtctcttatacctatgtatgaatgaacatatgttgatcgcgctcatgaaacaagaatcacgaacggaataatttctgaaatggggatcatgttcttgccta

SEQ ID NO: 5973 - DNA, 672 bp, Secale cereale
gactcaacaactaaactcacccgcaggttcccggccatatctcaccgaatcttcccaggttccacccacccacccactctctaaaggaggaggcggcggcggcggccggcgggtgagcgcacgcccaagcccaaatcgatcgatcccaactctagagactagaggggagggagcaaccatggcgggggacggggaggacgagctgccggcgatgggcggcgacaagctgatcctgcggggcctgcagttccacggcttccacggcgtgaagcaggaggagaagaagctgggccagaagttcaccgtcgacgtggacgcctggatggacctcgccgccgccggggactcggacgacatcgcccacaccgtcagctacaccgacatctacaggatagccaagggcgtggtggaaggcccgtcgcgcaacctcttggagtcggtggctcaggcgatcgccggctccacgctgctccggttcccccagatctccgccgtccgggtgaaggtcgggaagccccacgtcgcggtgcagggcgtcgtcgactacctgggtgtggagatactgaggaggcgcagagaagcatgagcaggtcgatctctgtgtcttatatccatgtatgaatgagcgtatgttgaccctgctcatgaaacatgaatcgtgaacggaataat

SEQ ID NO: 5974 - DNA, 559 bp, Secale cereale
aatcttccaggttccacccacccacccacacgcgccagctctcctctccaaagtaggatccggcggccggcgggtgaacgcacgcccaagcccaaatcgaccgatcccaactctagagactagaggggagggagcaaccatggcgggggacggggaggacgagctgccggcgatgggcggcgacaagctgatcctgcggggcctgcagttccacgggttccacggcgtgaagcaggaggagaagaagctgggccagaagttcaccgtcgacgtagacgcctggatggacctcgccgccgccggggactcggacgacatcgcccacaccgtcagctacaccgacatctacaggatagccaagggcgtggtggaaggcccgtcgcggaacctcttggagtcggtggctcaggcgatcgccggctcgacgctgctccagttcccccagatctccgccgttcgggtgaaggtcgggaagccccacgtcgccgtgcagggcgtcgtcgattacctgggtgtggagatactgaggaggcgcagagaagccccatgagcacaagaa

SEQ ID NO: 5975 - DNA, 688 bp, Secale cereale
agctctcctctccaaagtaggatccggcggccggcgggtgaacgcacgcccaagcccaaatcgaccgatcccaactctagagactagaggggagggagcaaccatggcgggggacggggaggacgagctgccggcgatgggcggcgacaagctgatcctgcggggccttcagttccacggcttccacggcgtgaagcaggaggagaagaagctgggccagaagttcaccgtcgacgtggacgcctggatggacctcgccgccgccggggactcggacgacatcgcccacaccgtcagctacaccgacatctacaggatagccaagggcgtggtggaaggcccgtcgcgcaacctcttggagtcggtggctcaggcgatcgccggctccacgctgctccagttcccccagatctccgccgtctgggtgaaggttgggaagccccacgtcgcggtgcagggcgtcgtcgactacctcggggtggagatactgaggaggcgcggagaagccccatgagcacaataactgaacagagttagtctcagttgagccgatcgatctctgtgtcttataggagtatctatcaatctacttgtatgaacatatgttgattgcgcccacgaaacaagaataatgaacataataatttctgaaatgggggatcatgttcttgcctgcaaaaaaaaagtc

SEQ ID NO: 5976 - DNA, 2834 bp, Hordeum vulgare
agtctccttccccgtgcactacgaatttcccttcgacgaaaaccctagttcagttaggaagggcaaggggaactagcaggtggggaagacatggcggccgcggcggcctccgttggacacagcagaggcggcggtgggcggatccatcggttggaggtggagaattttaagtcgtacaagggaacgcagaccatcggccccttcttcgacttcacggccatcatcggtcccaatggcgccggcaagtccaatctcatggatgccatcagttttgtgctcggcgtccgctccgcacacctccgtggtgcccagctcaaggacctcatctacgccctcgacgaccgcgacaaagaggccaagggtcgcagggcctccgtacgcctcgtctacaacctcccaagcaccggcggcgagcttcacttcacccgcaccattaccggcgccggtggcagcgagtaccgtatcgacggccgactggtcacgtgggacgactacaacgccaagcttagatccctcggcatcctcgtcaaggcccgcaacttcctcgttttccagggtgacgtggaatccattgcctccaagaatcctaaggagctcactgcacttctggagcagattgccggctctgacgagctcaggagggagtacgacggattggaggaacagaaaaccagtgccgaagagaaatctgcacttgtctatcaagaaaaaaggaccatcgtcatggagaggaagcagaagaaggcgcagaaggaagaggcagagaagcatctgcgcttacagcaggacctgaaactgttaaaaacagaacatcttctgtggcaactctacagcattgaaaaagacatggaaaaaatagaagctgaacttgaggatgaaagacattctcttcagcaagcgcgggaagataatcaatcctccgacaatggacttgctgcaaaaaagaaggagcaaagtgcatttctcaagaagattactttatgtgagaagagtatggccaagaaaaagattgatatggacaagaagcaacccgagcttcttagattgaaagagcaaatatctcggctcaaatccaaaatcaaaagctgcaacaaagagattgacaaaaagaaggatgataacaagaaacatttggaagagatgaaaaggctgcagagtgctttggctgatgtcacaagtgctattgaggatttgaacgagcaaggccaagataaaggagtgaaactgcaattagctgatgaccaagtccaggaatatcatagaattaaggaagatgcaggaatgaggacagcaaagctgcgagacgagaaggaagtattagacaaagagctaaatgctgatattgaagccaaaaagaatttagaggagaatatgcagcagctgcgtagccgtgttgatgagatatcatcacaggagagtgaattgcagacaaagcttagtaagattcttcattcaatccccaagcatgaagacgagcttaccaacttacgtgaggatcataataagattgcaaaggaacgccaatcttcaggagctaagtatcagatgttgaagcagaaggtggatgagatagatacgcagttacgtgaactcaaagctgtgaagcatgaaagtgagcgggatgctcgattttcagaaactgttaagagtcttaagaggctattccctggagtccatggtcgaatgactgaactttgtcggccttcacaaaagaaatacaaccttgctgtcaccgttgccatgggaaaattcatggatgcagttgtggtggaagatgaaagcacaggaaaggaatgcattaagtatttgaaggaacaacgtcttcctccacagacatttattcccttacaatcgatccgtgtgaagccaataacagagaggttgcgtaccctgggagggtctgcacagttgatctttgatgtgatacaatttgatcgagctttggagaaagcagttctgtatgctgttgggaatacacttgtgtgtgacaaacttgatgaagctaaaactctaagttggagtggtgaaaggtacaaggttgttactgttgatgggattcttttgactaaatctggcacaatgactggtggagtaagcggtggaatggaagctagatcaaataaatgggacgacagcagaatagaatctttgaagaagaagaaaagtaagctagagtctgaaatgtccgaacttggttccccacgggagttacagagaaaggagcttgctgtatctgagaaaataactggactcgagaaaaaattacattactcgaatgttgaacagaataatctcaaggagaagctacataaattggcatctgagaaacgtaatattgagaaagaaattgatcatctggagccaggaaaggaggagttggaaagccgtcttgctaaaaacgaacgggaagtaagaaagcgggagaaaaaaataaacgagatagtagacaggatttacaaggattttagcacgtcagttggtgtgaagaacattcgtgaatatgaagaaaagcaactgaaagatgctcaagcactgcaggagaggaagctaagcctgagcaatcaattatcaaaactgaaataccagctggaatatgaacaaaagagagatatgcatgctccgattgcgaagttaaacaatacacatgagaccctagagaaggagctgaagggcttgcaggagagagagactcatgctaaggctgacgctgaacatatttcaaatcagatggaagagctgaaagctgaggctgaaggtacacttccgaagcatgttgtctgtttttctgtagtccttgataaggatgcaattggggtgggatgcgttgagctggg

SEQ ID NO: 5977 - DNA, 4535 bp, Brachypodium distachyon
gaatttacctggggacttcacagaggcagagagccaagtcttcttctcccctttccgtcttctccgacgaaaaccctagtccggttcggaagggcaagggcagttaggagccatggcggcggcgccctccgatggtcacagccgcaggagcggcggagggcggatccatcggctggaggtggagaatttcaagtcgtataaaggaacgcagactatcggccccttcttcgacttcacggctatcatcggccctaacggcgccggcaagtccaacctcatggatgccatcagcttcgtgctcggcgttcgctccgcacacctccgtggcgcccagctcaaggacctcatctacgccctcgacgaccgtgacaaggaggccaagggccgcagggcctccgtccgcctcgtctacaacctccccagcaccggggccgagctccatttcagccgcaccatcactggtgctggcggcagcgagtaccgaatcgacggccgggtcgtcacctgggacgactacaacgccaagctcagatcccttggtatccttgtcaaggctcggaacttcctcgtcttccagggtgatgtggagtccattgcctccaagaaccccaaggagctcaccgcacttctggagcagatcgctggctctgacgagctcaggcgggagtatgacgagacggaggatctgaaaaccagggccgaagagaaatctgcacttgtctatcaagagaaaaggaccatcgtcatggagaggaagcagaagaaggcgcaaaaggaagaggcagagaagcatctacggttacagcaggacctgaaagtgttgaaaacagagcatctcctatggcaactctacaccattgaaaacgacatggagaaaatagaagctgagcttgaggagggcaggcagtctcttcagcaagtgcgggaagagaatcagtcctctgaccacgagcttgctgcaaaaaagaaagagcaaagtgcatttctcaagaaaatgaccttatgcgagaaaagtatggccaagaaaaagcttgatattgacaagaagcaacctgagcttcttagattgaaagagcaaatatctcggctgaagtccaaaatgaaaagctgcaacaaagagattgacaaaaagaaggatgatagcaagaaacatttggaagagatgaaaaggctgcatagtgctttggttgatgtcacaagagctattgaggagttgaatgagcagggccaagataaaagcgtgaaactgcaattagctgatgatcaagtccaggaatatcatagaattaaggaagatgcaggaatgaggacagcaaagctgagagacgagaaagaagtattagacaaagagctgaatgctgatgttgaagccaaaaaaaatttggaggagaatatgcagcagcttcgtagccgcgtggatgagatatcatcacaagagagtgaattgcacaccaggcttaataagattcttaactcaatccccaagcatgaagatgagctcacacgtttacgtgaggaacataacaaaattgcaaaggaacgccagtcttcaggtgctaagtatcaaacattgaagcagagggttgatgagattgatacacaattacgagaactcaaagctgacaagcatgaaggtgagcgggatgctcgattctcagaaactgttaggagtcttaagcggctattccctggagtccatggtcgcatgactgaactttgtaggcccgcacagaagaaatacaaccttgctgttactgttgccatggggaaattcatggacgcagtagtggtggaagatgaaagcacaggaaaggaatgcattaagtatttgaaggaacaacgtcttcctcctcagacatttattcccttgcaatcagtccgggtgaagccaataattgagaagttgagaactcttgggggatctgcacagttgatctttgatgtgattcaatatccttttttttttcctgtatcttagtgttgtttgatgcatgcatctttttcttttcatttcatctattatacatttgatcgagctttggagaaagcagttttgtacgctgttgggaatacgcttgtctgtgataaacttgatgaagctaaaactttaagttggagcggtgaaaggtacaaggttgtcactgtcgatgggattcttctgacaaaatctggcacaatgactggtggagtaagtggtggaatggaagctagatcaaataaatgggatgacagcagaatagaatctttgaagaagaagaaaaatcagctagaatctgaaatgtcagaacttggctcccccagggagttgcagagaaaggagcttgctgtatctgagaaaataactggactcgagaaaaagttacattactctaatgtcgaacagaataacctcaaggagaagctacacaaattggcatctgagaagcgtaatatcgagaatgaaattgatcatctggagccaggaaaggaggagttggagaaccgtcttgctaaaaatgaccgggaagtcagaaagcgggagaaaaagataaatgagatcgtggacaggatttacaaagattttagcatgtcagttggggtgaaaaacatccgtgaatatgaagaaaggcaactgaaagatgcccaagcactgcaggagaggaaactgagcctaagtaatcaaatgtcaaaattgaaataccagctggaatatgagcaaaagagagatatgcatgcaccaattgcaaagttaaaggagtcacatgagtccctagagaaggagctgaagggcttacaggagagagagtctggcgctaaggctgaagcagaacatattttgaatcagatggaagaactgaaagctgaggctgaagactggaaactgaagtcagacgaatgtgagaaggctattgatgaactaaaggagcagaatgctagtgttgctgctgcattggcaaagctggatcgccaagttaaactaatggaggggcaacttgctcaacttagagcacgccggcgggagattcatgagaagtgtgaactggagcagctgaagcttcccaccgttagtgatccaatggataccggatcatcctcacaagaactggtccttgattacagccagctcagagaaatctacatgcaggacatgcggttatccgaacgtgacaaacttgaggcagatttcaaacaaaaaataggtacattaatggctgagattgagcgcactgctccaaaccttaaagcacttgaccaatatgaagcactgcaaaggaaggaaaaggaggttaccgaaaagtttgaggcagctaggaaagaagagcgagagatagctgaaaagtataactccgtcaagcaaaaaaaggtatgagctgttcatggaagcctttgatcacatatctaaaggcatagacaaaatctataagcagttgacaaaaagtcacacacatccacttggtggaacagcatatttgaatctagaaaatgaagacgagccatttctgcatggaatcaagtacacagctatgccacctacgaagcgctttagagatatggaacaattatctggtggggagaagactgttgcagctctggcattgctttttgccatccacagtttcaggccatcaccattcttcatattggatgaagtggatgcagctctggataatctaaatgttgccaaggttgctgggtttatcagatcaaagtcatgtgaaggtgctggcgaagagcaagatggtgatggaggctgtgggtttcagagtattgtaatatcgctgaaggacagcttctacgacaaagcggaagcactggttggtgtttacagggactcagaaggaagttgctccagaaccctcaccttcgacctgacgaaatataaagaagcatgatgacatgcgctttggttggagtcttgctacttgttttattgcgttgatgactgtccttaacaggtcccgattttaactttgtgtacataagtgattagtggaatgtactagttaatgtagaaatggatcgacactgcagcatggagtcttcctacttgttttattgcgttttttcagtgttgtttgcgcaattatcacccaacaggttttgccaggaggagtagatgtataagacaaaatgaatgggtagcttgatgctttgtgggatgttgagcagcacgagaagggcatatcaccgtgattgggaagaagccaccacatgcatgctagtgggagtggtgttgtcatatccctgcttctatctgaagaactaacacctgcggaggctatgagtattcagttatcgtgtgggggcaagttactttactgttcccctttctgtagctttcacccagcagtaactactgcgcctatatagttggccggctgagtgccgtgtaagtttttatcgcattattctctgaagtcattgaaacaaatatacaatatattctatatagaaaagagctacgatctagggttcgccccgagaggcggatctcgctcaaattcgtgtgctattgttcctgattcctgtgtgataactgtactgggatctgacag

SEQ ID NO: 5978 - DNA, 1015 bp, Avena sativa
gtaaggggagctaggaggaggggaggacatggcggccgcgtcggcgacaccctgtgggcacggcagcagggccgtcggcgggcgtatccatcggctggaggtggagaatttcaagtcgtacaaggggacgcagacaatcgggcccttctacgatttcacggccatcatcggccccaacggcgccggcaagtccaacctcatggacgccatcagttttgtgctcggcgtccggtccgcacacctccgtggcgcccagctcaaggacctcatctacgccctcgacgaccgcgacaaggaggaaaggggccgcagggcctccgtccgcctcgtctacaacctccccggcaccggcgccgagctccagttcacccgcgccatcaccggcgccggcggcagcgagtaccgcatcgacggccgagtcgtcacgtgggacgactacaacgccaagctcagatccctcggcatcctcgtcaaggcccgcaacttcctcgttttccagggtgacgtggaatccattgcctcaaaaaatcccaaggaactcaccgcacttctggagcagattgcggcctccgacgaactcaagagggagtacgaggacttggagaagcaaaaaaccactgccgaagagaaatctgcacttgtctatcaagagaaaaggaccatcgtcatggagaggaagcagaagaaagcgcagaaggaagaggcagagaagcatctacgcttacagcaggatctgaaactgttaaaaacagagcatctcttatggcaactctacagcatcgaaaaagacatggagaaaatagaagctgaacttgaggaggaaagaggttctcttcagcaagcgcgggaagagaatcaatcctctgaaaatgaacttactgcaaaaaagaaggagcaaagtgcatttctcaagaaaattaccttgtgcgagaagaatatggccaagaaaaagcttgatattgacaagaagcaacctgagcttcttaaattgtaaagagcaaatatcccggctcaa

SEQ ID NO: 5979 - DNA, 1497 bp, Panicum virgatum
  misc_feature (35)..(35): n is a, c, g, or t
  misc_feature (88)..(88): n is a, c, g, or t
  misc_feature (140)..(140): n is a, c, g, or t
  misc_feature (344)..(344): n is a, c, g, or t
  misc_feature (353)..(353): n is a, c, g, or t
  misc_feature (360)..(360): n is a, c, g, or t
  misc_feature (478)..(478): n is a, c, g, or t
  misc_feature (632)..(632): n is a, c, g, or t
  misc_feature (1133)..(1133): n is a, c, g, or t
  misc_feature (1228)..(1228): n is a, c, g, or t
  misc_feature (1277)..(1277): n is a, c, g, or t
  misc_feature (1307)..(1307): n is a, c, g, or t
  misc_feature (1319)..(1319): n is a, c, g, or t
  misc_feature (1337)..(1337): n is a, c, g, or t
  misc_feature (1371)..(1372): n is a, c, g, or t
  misc_feature (1376)..(1376): n is a, c, g, or t
  misc_feature (1385)..(1385): n is a, c, g, or t
  misc_feature (1391)..(1391): n is a, c, g, or t
  misc_feature (1434)..(1434): n is a, c, g, or t
  misc_feature (1446)..(1446): n is a, c, g, or t
ggtctgcttccggagggatgtctgcgccccgaacnaaaaccctaggtatcccagttcttgaagcccgaggggaggagatggcggcggnggatgggcgcagcagcgacggtggcggtggtcggatccaccggctggaggtngagaacttcaagtcgtacaagggtacgcagacgattggacccttcttcgatttcacggctatcatcggccccaacggcgccggcaagtcgaatcttatggacgccatcagcttcgtgcttggcatgcgcacagtgcaactccgcggcgcgcagctcaaggacctcatctacgccctcgacgaccgcgacaaggaggctaagggncgcagggcntccgtcngcctcgtctaccgccaacccaaccaggaggagctccacttcacccgcaccatcaccggcgcaggcggcagtgagtaccgcatcgacggccgccttgtcacctgggacgagtataacgncaagctcagatccctcggcatcctcgtcaaggcccgcaatttcctcgtcttccagggtgatgtggaatccatcgcctccaagaaccccaaggagctcactgcgcttctggagcagatctcaggctccgatgagcttaggagggagtatgacganctcgaggagcagaaagccagggccgaagagaactctgcgcttgtctatcaagagaaaaggaccattgtcatggagcggaagcagaagaaggcgcaaaaagaagaggcagagatgcacctacgtctccagcaggacctgaaactgttgaagacagagcattccctgtggcaactctataccatcgagaaagacagagagaaaatggaggctgagcttgcagaggacagagagtcccttcagcaagtgcaggaagagaatcaatctgctgaaaatgaactaactgcaaaaaagaaggagcaaagtgcttttctcaagaaaatgacattgtgcgaaaagagtatagccaagaaaaagcttgaactagacaagaagcatcctgagcttcttaaattgaaagagcaaatctctcggctcaaatcaaaaatcaaaagttgcaagaaagagattgacaaaaagaaggatgataacaagaagcatctggaagagatgagaaggctgcanagtgctctagttgatgtcacaaaagctattgaggaattgaatgagcaaggacaagataaaagtggaaaactgcagttagctgacgaccaactccnggagtatcatagaattaaggaggatgcaggaatgaagacagcaaagctnagagatgagaaggaagtcatagacaaaaanttaaatgctgangttgaagcaaaaaagaanttagaggagaacatgcagcagctgcgtagccgtnnggangagatatcntcacangagactgaattgcagacagacttgacagattcttcattccatncccaaacatganaatgagctcgcacacttacgtgaggaacataccagaattgcaaaggaacgc

SEQ ID NO: 5980 - DNA, 2036 bp, Panicum virgatum
tggtaataaagaaagagaaactcgtattgggctccggaggccacatccgctctcttctggccctcttcaactcccttcgtcttcctccttcccgtcggtctgttttcggatgtctgcgctccgactaaaaccctaggtatcccagttcttgaaggtccgtcgaggggaggagatggcggcggtggatgggcgcagcggcgataacctagccaggggcgacggtggcggtggtcggatccaccggctggaggtcgagaacttcaagtcgtacaagggtacgcagacgattggacccttcttcgatttcacggccatcatcggccctaacggcgccggcaagtcgaatcttatggacgccatcagcttcgtgcttggcgtgcgctcagcgcacctccgcggcgcgcagctcaaggacctcatctacgccctcgacgaccgcgacaaggaggctaagggacgcagggcgtccgtccgcctcgtctaccgccaacccaaccaggaggagctccacttctcccgcaccattaccggcgcaggcggcagtgagtaccgcatcgacggccgccttgtcacctgggacgagtataacggcaagctcagatccctcggcatcctcgtcaaggcccgcaatttcctcgtcttccagggtgatgtggaatccatcgcctccaagaaccccaaggagctcactgcgcttctggagcagatctcaggctccgatgagcttaggagggagtatgacgagctcgaggaggagaaagccagggccgaagagaactctgcgcttgtctatcaagagaaaaggaccattgtcatggagcggaagcagaagaaggcgcaaaaagaagaggcagagatgcacctacgtctccagcaggacctgaaactgttgaagacagagcattccctgtggcaactctataccatcgagaaagacagagagaaaatggaggctgagcttgcagaggacagagagtcccttcagcaagtgcaggaagagaatcaatctgctgaaaatgaactaactgcaaaaaagaaggagcaaagtgcttttctcaagaaaatgacattgtgcgaaaagagtatagccaagaaaaagcttgaactagacaagaagcatcctgagcttcttaaattgaaagagcaaatctctcggctcaaatcaaaaatcaaaagttgcaagaaagagattgacaaaaagaaggatgataacaagaagcatctggaagagatgagaaggctgcaaagtgctctagttgatgtcacaaaagctattgaggaattgaatgagcaaggacaagataaaagtggaaaactgcagttagctgacgaccaactccgggagtatcatagaattaaggaggatgcaggaatgaagacagcaaagctgagagatgagaaggaagtcatagacaaaaaattaaatgctgacgttgaagcaaaaaagaacttagaggagaacatgcagcagctgtgtagccgtatggacgagatatcatcacaagagactgaattgcagacaagacttgacaagattcttcattccattcccaaacatgagaatgagctcgcacacttacgtgaggaacataccagaattgcaaaggaacgccaatcatcaggatctaggtaccaaacactgaagcagagggtggatgaaatagatacacaactacgagagcttaaagctgataagcatgaaagtgagcgtgacgctcgattaaaggaaactgttggaagtctaaagcggctattccctggagtccacggtcgcatgcacgaactttgtaggccctcacagaagaaatataatcttgcagttactgttgccatggggaaattcatggatgcagttgtagtggaagatgaaaacaccggaaaggaatgcattaaggtgctcttacatgatttcttattgtctaattattctacttttttcttagtgttggtgtatattgagcccatgtatagaggcccatctagaggcccatgtataggaactatatatcccacccttctagggtttggaggaatac

SEQ ID NO: 5981 - DNA, 4143 bp, Zea mays
ctagtccactcttctggtcctctcgcttttgcgctcccttggtcgtcttcgtcccctgctcgtctcccgtccgttttcggatgcccactccgaccaaaaccctagctacttcgtgaaggtggaggggaggagatggcggcagcggatgggcgcagcggcgacttccgggtcaggggtggcagcgttgggggtcggatcgaccgactggtggtggagaacttcaagtcgtacaagggtgagcagacgattgggcctttcgtcgacttcacagccatcatcggccctaacggcgccggcaagtccaacctgatggacgccatcagcttcgtgctgggcgtgcgctcaacgcaccttcgaggcgcgcagctcaaggacctcatttacgccctcgacgaccgcgacaaggaggccaagggccgcaaggcttccgtccgcctcttctactgccaacccaaccaggaggagctctgcttcacccgcagcatcaccggcgccggcggcagtgagtaccgcatcgaccgcaaccaagtcacctgggacgtctacaacgccaagctcaggtccctcggcatcctcgtcaaggcccgcaacttcctcgtctttcagggtgatgtagaatccattgcctccaagaaccccaaggagctcaccgctctcctggagcagatctcaggctctgatgagcttaggagggagtatgacgagctggaggagcagaaagccagggccgaagagaagtctgctcttgtgtatcaagagaaaaggaccattgtcatggagcggaagcagaagaaggtgcaaaaagaggaggcagagaagcatctacgccttcaacaggacctgaaactgttgaagacagagcattacctttggcaactctataccatcgaaaaagacatagagaaaattgaagctgagcttgtggaggatagagaatctcttcagcaagtgcaggaagagaatcgatccagtgactatgaactgactgcaaaaaagaaggagcaaagtgcatttctcaagaaaatcacattgtctgagaaaagcataaccaagaaaaagcttgaactcgacaagaagcaacctgagcttcttaaattaaaagagcaaatatctcgtctcaaatcaaaaatcaaaagttgcaagaaagagattgacaaaaagaaggatgatcacaaaaaacatcttggagagctgagaaggctgcaaagtgatctggttgaggtcacagaagctattgaggaattgaatgagcaaggacaagatacaagtggaaaactgttattagccgacgaccaactccaggagtatcatagaatgtgagtgtgactagacatcttatgtgcagcgttgattttatatttagtctatctagtcctctggcttcaatgccatccttactgcactttacttttgttacagtaaggaggatgcaggaatgaagacagcaaagctaagagatgagaaagaagttatagaaaaaaaattaaatgctgatgctgaagcaaaaaagaatttagtggagaacatgcagcagctggaaagccgtaaagatgagatatcatcacaagaacgtgaactgcagacaaaacttagcaagattctccattctattcccaagcttgaaaatgagctcacacacttgcatgaggaacacaacaaaattgcaaaggaacgccaatcttcaggatctgaataccaaatgctgaagcagagattggatgaaatagaaacacaactacgggagcttaaagctgacaaacatgaaagtgagcgtgatgctcggttaaaagaaaccgttggacgtctaaagcggctattccctggagtccatggccgcatgcttgaactttgcaggccctcgcagaagaaatataaccttgctgttactgttgccatgggaaagttcatggatgcagttgtagtggaagacgagaacactggaaaggaatgcattaagtatctgaaggagcagcggcatcctccgcagacatttattcccttgcaatcagtccgtgtgaagccgataattgagaagctgcgaactcttggtggatctgcacagttagtttttgatgtcattcaatatccttatcttaaaaaagcagttctgtatgctgttggaaatacacttgtctgtgataaacttgatgaagctaaagccttaagttggagtggtgaaaggtataaagttgttactgtcgatgggattctgctgactaaatctggcacaatgactggtggaacaagtggggggatggaagctagatcaaacaaatgggatgacagcacaatagaatctttgaagaagaagaaaaatctgttggaaaataaaatgtcagaacttggttcccccagggagttgcagagaaaagagcttgccatatctgagaaaataactggacttgagaaaaagttgcactactcgaatgttgaacagaataaccttagagggaaactagctaaattagcatctgagaggagtaatattgagacagagattaatcgtctgaagcctggagaggaggagctcgagacccgtattggtaaaagggaagcagaagcaagaaaacttgagaaaaaaattaatgacattgtggacaaggtgtacagagattttagcatttcagttggtgtgaagaatatccgcgagtatgaagaaaagcagctaaaagatgctcaagcactacaggagaggaagctaagcctaagtaaccaaatgtcaaaattgaaataccagcttgaatatgaacaaaagcgagatatgcatgcaccaattgtgaagttaacggagacacatgagtccttagagaaagagcttaagggcttacaggagagagagtctggtgctaaggctgaagctgaacaaattttggctcagatggaagaactgaagactgaggctgatgactggaaatccaagtcggatgaatgtgagaaggttattgatgaattgaaggagcagaatggtaatgttgcatctacattggcaaagatggatcgccaagtgaaatcaaaggagggacaacttgcacaacttatatcacgccagcgagaggttcatgagaagtgtgaacttgaacagttgaagcttcctactgtaaacgacccaatggataccggaacatcctcacaagaaccaatccttgattacagccagcttagcaaaagccatctgcaggatatacgaccttctgaacgtgacaaacatgaggcagagttcaaaaaaagaactggtgtgctactagctgatattgagcgcactgctcctaatctaaaagccctggatcagtatgatgcactccaacaaaaggaaaaggaggttactgaaaggtttgaagcagctaggaaagaagaacgagagatatctgacaaatataactcagtcaagcaaaggaggtatgagctgtttatggaggccttcgatcacatatctaaaggcatcgacaaaatctataagcagctgacaaaaagccatacacatccactcggaggaacagcatatttaaatctagaaaatgaagacgaaccgtttcttaatggaatcaagtacacagctatgccacctaccaagcggtttagagatatggaacagttatccggtggggagaagactgttgcagcactggctttgctttttgccattcacagttttaggccatcaccgttcttcatattggacgaagtagatgctgctctggacaatttaaatgtggccaaggttgccgggtttatcagatcaaaatcatgtgaacgtgttggtgatgaacaaggcagcgatggcgagagtggttttcagagcatagttatatctctgaaggacagtttctatgacaaggccgaggcacttgttggtgtttatagggactcagaacgaagttgctcgaggactctcaccttcgacctgagaaagtatagggaatcgtgaagcagcttttgttgaatgtttgtactatgtgtgtagttgcctgctccatcagcttgctagatagctgtcgtgagccttcgatgttttaactatctgtatactcctagtcctacataagtgctagctgaacaaggaccctgaaatattcatttggtaggtggataactgatgtttcgaacacgcataaacttttttacctgttgtatgaagccatttct

SEQ ID NO: 5982 - DNA, 1141 bp, Arabidopsis lyrata
ttttttttttcattttatctcgagaagaaccacacacatacacagagacagagattcatcaatggcggtttcttgcaaccactctgcgattctcttctctccatccaccgctggttcctcctccgtttcttcttcctcgtcgctcatcggcttacctcgtttccaaacgctgcgtttcaaatcaagaagcctttattcgaaatctagagtttctcctgtctcggcattgccttcacggtctttagaagctctgattttcgattgcgacggtgtgattctcgaatcggagaatctacaccgtcaagcttacaacgacgctttctcgcatttcgatgttcgatgtcctccttcttcctctgagtctctcaattggagcctcgagttctacgataagtttcaaaatctagtcggaggtggaaaaccgaaaatgcgttggtatttcaaagaaaatggatggccaacttcgactattttcgagtcacctcctgagaatgatgatgatcgagccaagttaatcgatactcttcaggattggaaaactgagaggtataaagaaatcataaaatcgggaagtgtagaaccaagacctggtgtaataagactaatggatgaagcaaaagctgctggtaaaaaactagctgtttgttctgcagctacaaagagttcagtaatcttatgtcttgagaatctaatcgatatcgagcggttccaaggacttgattgcttccttgcaggggatgatgttaaggagaaaaaacccgatccttcgatatatattacagctgccgagaagttaggtgtttcagtgaaagactgtttggttatagaggacagtgtgattggcctgcaggctgctacaaaagcagggatgtcatgtgtgattacatacacttcttcaacctctgatcaggatttcaatgatgcgattgccgtataccctgatctcagtaatgtgaaattgaaagacctggaaactctgcttcaaacaattgtcactgcagcttaagacatttgtctcttattcatttctgactgttcttctgcaactgtacatttgtttttgcttaataatttttcattcaataacaaaaaaagattcaattgtataaatagcagtacaatacaatcaagacctaccctg

SEQ ID NO: 5983 - DNA, 3132 bp, Eutrema parvulum
aaccacacacacacacacaaactgagagtagagattcatcaatggcggtttcttgcaaccactcggcgattctcctctctccatccaccgccggctcctcctccgtttgctcttcttcttcttcctcatcgctcatcggcttcaaccgcttccctcgtctccaaacgctgcgtttcaaatccagaaacgcttatcagaaatcgagggtttcttcagtctcggcatcttcacggtctctcgaagctctgattttcgactgtgacggtgtgatactagaatcggagaatttgcaccgtcaggcttacaacgatgctttctcgcatttcgatgttcgatgtccttcttcttcctccgagtctctcaattggagcctcgaattctacgacaagtttcagaatctggtcggaggtggaaaacccaaaatgcgatggtacttcagagaaaatggatggccaacatctaccattttcgattcacctccagagaatgacgatgatcgtgccaagttaatcgacactcttcaggattggaaaactgagaggtacaaagaaatcataaaatcaggaaatgtagaagcaagacctggtgtaacaagactaatggacgaagcaagagctgctgggaaaaaactagctgtttgttctgcagctacaaagagttcggttattttatgtctcgagaatctaatcgaaatcgagcgattccaaggacttgattgcttcctcgctggagatgatgttaaggagaaaaaacccgatccttcgatatatataacagctgccgagaaactaggtatttcagtgaaagactgtttggtcatagaggacagtgtgattggtctgcaggctgctacaaaagcagggatgtcatgtgtgatcacgtacacttcatcaacttctgatcaggatttcaaagacgcgatcgctgtatatcctgatctcggtaatgtgagattgatagacctggaaactctgcttcaaaccattgtcactgcagcttaatacagacatttgtctccttttcatttttgtctattcttctggaaatgtacatttgtttttgtttgataaatcgttcatcaatcaaaaagaagattcaaatatataaatagcagtacaataaaaacaagacctaccttgaatcctgaaaaaatccagaaattttgttttaaaaggtagaaccaaaaaaaatgtccaaaattaaagaggaaaaaccaaagaaacagttctccagttttcctctcacctaatacgtctttcttcttcctcttgctgatcttctccatcactagaagaaccattagaaagatcacaagcagaggatgatgaatctatgtaacaccacatttcacctctactttttgtgtgtgatttttatctcctgctattagctaccttgttcttgctcatatcagcaagttcctcaacaagtttcttctcttctttactcaatctcttgggaatttcaacttgcactcttactaactgatcacctctcatcttactcttattcaacaccggaactccctttttcgccattaccagcgttgtgctcggttgtgtccccgcaggtactttcaaatccaccatcccatcaacggttggaaccttcaaagtcgtgcccaatatcgcatctacatacgatatcttacacgtataaagtatattcgtgtcatcccgcttcaagatcggatccggaatcacctcaagaactgcaaaaagatctcccggtgatccgcctctctttcctgcattcccttctcccctcactcttagcctgctaccggaatccacacccgcgggaactttaagactgatccgcttcgtcctcctcacacgcccatctcctgaacacgcaccgcatggttttgaaacctctcctgttccgttacagggagagcaagtcatgacctgttggaatacaccgagtggtgtccttgtagatgctaccacctgtccttgcccaccgcatgttttgcatttggtcggtttggttcctgcttttgcacctgaaccattgcaagtcccacagctctctagtcgggatatctctatctctttctcgataccaaaaacagcttctttgaaatccaagattagcgagtaatactcgtcttcaccgtcaatagctctgctccttgaacctctgctacccattccaccgcccattcctcccatcccacccattccttcgaataatgactcgaatagatcaaacggattactgtaatcctacaaagttaaataaaaaaaaacaaagtcagcagttgtagttcacattctgatcatcggaatgttgattcagatgtcttatagaagaatatatacccccatgcctcccatcccggcgcctttaactcctgcctcaccatatctgtcgtatagagatcttttctcatcatctgataagatctgcaagaaagaaaagaaaggaaaaaaccaattagactcttcaagtatcagtacagttatgagaaaaaactaaaagcatcccaagacgatggaattcacctcatatgcattacttatttctttgaatttatcttctgccccagaatccctgcagtcaaacgtataaacagaacggtgacgactaatacctttagaagcagtttcagggttcttcagctacttagtctgtgttttcatatatttaatctggtggttatatattcatatagggaaacttgaccaaaaaaattgcaaaaaatctcttgctgtagcgtttctcaaatattgtaatcaagttctaacaagaaacacaccaatcttgatgcaggaaggtaacaactcatacagacaccttattctagatgctggatttaaagtaaagttttccacttacttattcacgtccggatggtaactcctagcgagcttgcgataagctgaaaatatgtgcagaggagaacaattttccttgttaaaatttcgaaatgcacaacccaaaagctgaacaaagaagctcaaatggaattattgatgagagctacacatcaatgttgtggttagatgattatggaatccagtgaaaagcacataccgcttttaatctcagctttagttgcagttttcgagactccaagaacagaatagaaatcctggaaattgaacacacacaaactgtttagca

SEQ ID NO: 5984 - DNA, 1261 bp, Eutrema halophilum
aaccacgagacatttggagtatggtggaaaagttagttaatgaccgttgattgcaacgaagattagcttttgcaaattgtagccacagatttttattttattttatctcactaagtcacagtagccaaaaatcctcattcacacgatttgagcttcatcaatggcggtttcttgcaaccactactcgattatcctttcttcatcaaccgccggttcctcctcccgttgctgttcttcttcttcttcctcgtttctcggctttcctcgtctccaaacgctgcgtttgaaatccagaagcgtttatccgagatccagagtttcccatgtctcggcatcttcacgatctctcgaagctctgattttcgattgcgacggtgtgatactcgagtcggagaatttgcaccgtcaagcttacaacgacgctttctcgcatttcgatgttcgttgtccttcttcttccttagagtctctcaattggagcctcgagttctacgataagtttcagaatcttgtcggaggtggaaaacccaaaatgcgatggtactttagagaaaatggatggccaacatcgacccttttcgattcacctccagagaatgacgatgatcgagccaagttgatcgatactcttcaggattggaaaactgaaaggtacaaagaaatcataaaatcaggaagtgtagaagcaagacctggtgtagtaagactaatggatgaagcaagagctgctgggaaaaaactagctgtttgctctgcagctacaaagagttcagttatattatgtctcgagaatcttatcgaaatcgagcgatttcaaggactcgattgtttcctcgctggggatgatgttaaggagaaaaaacccgatccttcgatatatataacagctgccgagaagctaggtgtttcagtgaaagactgtttggttatagaggacagtgtgattggcctgcaggctgcgacaaaagcagggatgtcttgtgtgatcacatacacttcttcaacctctgatcaggatttcaaagatgcaatcgctgtataccctgatctcagtaatgtgagattgaaagacctcgaaactctgcttcaaaccattgtcactgcaacttaagacatttgtctccttttcatttgtctcagttcttctgcaactctacatttgtttttgtttaataaattttcattaaaaaaaaaattcaaatataaaaatagcagtacaatacaaacaagaactaccaccctgaatcctgataaatccaga

SEQ ID NO: 5985 - DNA, 1001 bp, Secale cereale
ccggagagaaccctagacctagacccagcagcctccctcccctctccggcgacgacgcaggcaggtggcgaggatgaggcccgtgttcgtggggaacctggactacgacacccgccactcggagctcgaccgcctcttctaccgctacggcaggatccaacgcatcgacatgaagtcagggtttgcttttgtctactttgaggatgagcgtgatggtgatgatgcaatacgggctctggatggttatccctttggccctgggagacgcagactttcagtggagtggtcacggggcgaccgtggaaccagacgtgatgaccgtgatggctacagtaaaccaccagtgaataccaagcctactaagacactgtttgtcattaactttgacccgatcaacaccagagtcagtgatcttgaaaggcattttggtcattttgggaggatttcaaatgttcggataaggaagaactttgctttcgtgcaatttgaaacacaggaagaagccacaaaagccctagatgctactcatttgacgaagttattggacagagtgatttctgttgagtatgccttcagggatgatagtgaaccaggtgacaagtatgacaggccaagcagaggtggtggctatggaaggcaggatgacagttcatatcgccgttctgttagccccatgtaccgaaggtcacgacctagtcctgactatggtcgtccagtgagtcctcagtatggtgcatatggcaggagcaggagtcctgttcgtgatcgctatcgaagccgatctcctgtccagcgctcaagatccccagctcccaacagaagaggttatgactgatggacagttatctcggtttatggtagcgaggcagcttccatatgctgttctagctttagcattagtaaacaagaagacttttatgtgcctgtaccgaagcttatcgtttagctgacaccgtgttataagagtcgtcgtgtgttataagaagttagacctgtacttt

SEQ ID NO: 5986 - DNA, 904 bp, Secale cereale
acctagacccagcagcctccctcccctctccggcgacgacgcaggcaggtggcgaggatgaggcccgtgttcgtggggaacctcgactacgacacccgccactcggacctcgaccgcctcttctaccgctacggcaggatccaacgcatcgacatgaagtcagggtttgcttttgtctactttgaggatgagcgtgatggtgatgatgcaatacgggctctggatggttatccctttggccctgggagacgcagactttcagtggagtggtcacggggcgaccgtggaaccagacgtgatgaccgtgatggctacagtaaaccaccagtgaataccaagcctactaagacactgtttgtcattaactttgacccgatcaacacaagagtcagtgatcttgaaaggcattttggtctattttgggaggatttcaaatgttcggataaggaagaactttgctttcgtgcaatttgaaacacaggaagaagccacaaaagccctagatgctactcatttgacgaagttgttggacagagtgatttctgttgagtatgccttcagggatgacagtgaaccaggtgacaagtatgacaggccaagcagaggtggtggctatggaaggcaggatgacagttcatatcgccgttctgttagccccatgtaccgaaggtcacgacctagtcctgactatggtcgtccagtgagtcctcagtatggtgcatatggcaggagcaggagtcctgttcgtgatcgctatcgaagccgatctcctgtccagcgctcaaggtccccagctcccaacagaagaggttatgactgatggacagttatctcggtttatggtagcgaggcagcttccatatgctgttctagctttagcattagtaaacaagaacacttttat

SEQ ID NO: 5987 - DNA, 1063 bp, Triticum aestivum
cggagaagaaccctagacctagacctagccgccgacctccctccctccctcccctctccggcgacgcgacgcaggcaggtggtgaggatgaggcccgtgttcgtggggaacctggactacgacacccgtcactcggagctcgaccgcctcttctaccgctacggcaggatcgagcgcatcgacatgaagtcagggtttgcttttgtctactttgaggatgagcgtgatggtgatgatgccatacgggctctggatggttatccctttggccctgggagacgcagactttcagtggagtggtcacggggtgaccgtggaaccagacgtgatgaccgtgatggctacagtaaaccaccagtgaatactaagcccaccaagacactgtttgtcattaactttgacccgatcaacacaagagtcagtgatcttgaaaggcattttggtcattttgggaggatttcaaatgttcggataaggaagaactttgctttcgtgcaatttgaaacacaggaagaagccacaaaagcccttgatgctactcatttgacgaagttactggacagagtgatttctgttgagtatgccttcagggatgatagtgaaccaggtgacaagtatgacaggccaagtagaggcggtggctatggaaggcaggatgacagttcatatcgccgttctgtcagcccaatgtaccgaaggtcacgacctagtcctgactatggccgtccagcgagtcctcagtatggtgcatatggcaggagcaggagtcctgttcgtgatcgctatcgaagccgatctcctgtccagcgctcaagatccccagctcccaacagaagaggttatgactgatggacagttatctcggtttatggtagcgaggcggtttccatatgctgttctagctctagcattagtaaacaagaacccttctgtacccgtaccgaagcttatcgtctagctgacaccgtgttataagaagttggacctgtcctttgacaactgctttgtcgtcgtgtgttataagaagttagacctgcactttgacacctgctttgtgcctaaa

SEQ ID NO: 5988 - DNA, 1527 bp, Triticum aestivum
gagctcgaagccggagaagaaccctagacctagacctagccgccgacctccctccctccctcccctctccggcgacgcgacgcaggcaggtggtgaggatgaggcccgtgttcgtggggaacctggactacgacacccgtcactcggagctcgaccgcctcttctaccgctacggcaggatcgagcgcatcgacatgaagtcagggtttgcttttgtctactttgaggatgagcgtgatggtgatgatgccatacgggctctggatggttatccctttggccctgggagacgcagactttcagtggagtggtcacggggtgaccgtggaaccagacgtgatgaccgtgatggctatagtaaaccaccagtgaatactaagcccaccaagacactgtttgtcattaactttgacccgatcaacacaagagtcagtgatcttgaaaggcattttggtcattttgggaggatttcaaatgttcggataaggaagaactttgctttcgtgcaatttgaaacacaggaagaagccacaaaagccctagatgctactcatttgacgaagttactggacagagtgatttctgttgagtatgccttcagggatgatagtgaaccaggtgacaagtatgacaggccaagtagaggtggtggctatggaaggcaggatgacagttcatatcgccgttctgtcagcccaatgtaccgaaggtcacgacctagtcctgactatggccgtccagcgagtcctcagtatggtgcatatggcaggagcaggagtcctgttcgtgatcgctatcgaagccgatctcctgtccagcgctcaagatccccagctcccaacagaagaggttatgactgatggacagttatctcggtttatggtagcgaggcggtttccatatgctgttctagctctagcattagtaaacaagaacccttctgtacccgtaccgaagcttatcgtctagctgacaccgtgttataagaagttggacctgtcctttgacaactgctttgtcgtctgtgtgttataagaagttagacctgcactttgacacctgctttgtgcctaaattgcgtcattttcgtatatctgtgtgtctatttatgtctggattttttatgtgtgcctaaacatatacacctgctagaagtttaaggttatctcattttcgtatattttgcaagaatttcataaccgaaaaacaaagtttcaaacacgtttgagtctggaattcccaacaacattgtaataactatgaactatttgaattcataaataattcagatactacctgatactgtgagtagagaatatttcttgtgattttgacaagtttatgctgtttcttggtgtatcaactggacattgtaataatactactagtggacgcaattttgtgtgtgttctaccagtagtccccacaggagcaggagccgtctctgaaatggtggaacctcctgacatccctgagcacaatctcacgcccaaccatcttcgacatgaacttggccgcctcatggca

SEQ ID NO: 5989 - DNA, 1145 bp, Pseudoroegneria spicata
gaagaaggaccacgccacacgccaccaccgccaccgccaccgcagcgcgtagccggaggagaaccctagacctagccgcctccctccctcccctcctcccctctcctacgacgcaggcagggtctcgatcggatcgtgccggcgaggatgaggcccgtgttcgtggggaacctggactacgacacccgccactcggagctcgaccgcctcttctaccgctacggcaggatcgagcgcatcgacatgaagtcaggaactaccgagggtttgcttttgtctactttgaggatgagcgtgatggtgatgatgcaatacgggctctggatggttatccctttggccccgggagacgcagactttcagtggagtggtcacggggcgaccgtggaaccagacgtgatgaccgtgatggctatagtaaaccaccagtgaatactaagcccactaagacactgtttgtcattaactttgacccgatcaacacaagagtcagtgatcttgaaaggcattttggtcattttgggaggatttcaaatgttcggataaggaagaactttgctttcgtgcaatttgaaacacaggaagaagccacaaaagcgctagatgctactcatttgacgaagttattggacagagtgatttctgttgagtatgccttcagggatgatagtgaaccaggtgacaagtatgacaggccaagtagaggtggtggctatggaaggcaggatgacagttcatatcgccgttctgttagcccagtgtaccgaaggtcacgacctagtcctgactatggtcgtccagtgagtcctcagtatggtgcatatggcaggagcaggagtcctgttcgtgatcgctatcgaagccgatctcctgtccagcgctcaagatccccagctcccaacagaagagcttatgactgatggacagttatctcggtttatggtagcgaggtggcttccatatgctgttctagctctagcattagtaaacaagaacccttctgtacccgtaacgaagtttatcgtttagctgacaccgtgttataagttggacctgtccttcgacacctgctttgtcctgtgttataagaagttagacctgtactttgacacctgcccatgtgcctaaatcgtgacattttcgta

SEQ ID NO: 5990 - DNA, 1158 bp, Leymus cinereus x Leymus triticoides
  misc_feature (958)..(958): n is a, c, g, or t
ggaagggaagaaaggagcgcaccacacgccaccaccgccaccgcagcgcgaagccggaggagaaccctagtcctcgccgcctccctccccagctcgctcgacgacgacgcagggtatcggatctcgtcggcggagatgaggcccgtgttcgtggggaacctggactacgacacccgccactcggagctcgaccgcctcttctaccgctacggcaggatcgagcgcatcgacatgaagtcagggtttgcttttgtctactttgaggatgaacgtgatggtgatgatgccatacgggctctggatggttatccctttggccctgggagacgcagactttcagtggagtggtcacggggcgaccgtggaaccagacgtgatgaccgtgatggctatagtaaaccaccagtgaatactaagtccactaagacactgtttgtcattaactttgacccgatcaacacaagagtcagtgatcttgaaaggcattttggcccatttgggaggatttcaaatgttcggataaggaagaactttgctttcgtgcaatttgaaactcaggacgaagccacaaaggccctagatgccactcatttgacgaagttattggacagagtgatttctgttgagtatgccttcagggatgatagtgaaccaggtgacaagtatgacaggccaagtagaggtggtggctatggaaggcaggatgacagttcatatccccgttctcttagcccagtgtaccgaaggtcacgacctagtcctgactatggccgtccagtcagtcctcagtatggtgcatatgacaggagcaggagtcctgtacgtgatcgctatcgaagccgatctcctgtacaccgctcaagatccccggctcccaacagaagagcttatgactgatggacagttatctcggttatggtagcgaggtggtttccatatgctgttctagctctagccntagtaaacaagagcacttctgtacccgtaccgaagcttatcgtttagctgacaccatgttatattggacctgtccttcgacacctgctttgtcctgtgttataagaagttagacctgtactttgacacctgctttgtgcctaaatagcgacattttcatatgtctccgtgcttatttatgtctggattttgtgtgtgata

SEQ ID NO: 5991 - DNA, 1012 bp, Avena sativa
aaaaaaaaaccaaaaagaaacggaaagaaggaggtcgaagccggagaagaaccctacgacgcccctcctctctctctccctcgctcggcgacgaagggtttttcctgttgcacgggggcctcggatctcggcgaagatgaggcccgtgttcgtggggaacctggactacgacacccgccactcggagctcgaccgcctcttctaccgctacggcaggatcgaccgcatcgacatgaagtcaggatttgcttttgtctacttcgaggatgagcgtgatggtgacgatgccatacgggctcttgatggttatccctttggccctgggagacgcagactttcagtggagtggtcacggggtgaccgtggaaccagacgtgatgatcatgatggctatagtaaaccaccagtgaatactaagcctactaagacattgtttgtcatcaactttgacccaatcaacactagagtcactgatcttgaaaggcattttggtccatttgggaagatatcgaatgttcggataaggaagaactttgcgtttgtgcagtttgaaacacaggaagaggccacaaaagctctggatgctactcatttgaccaagttgttggacagagtgatttctgttgagtatgccttcagggatgatagtgaacccggtgacaggtatgacaagccaggtaggggtggcggctatggaaggcaggatgatagttcatatcgccgttctgtcagcccagtgtaccgaaggtcacggcctagtcctgactatggccgtccagtgagtcctgcatacggctcatatgacagaagcaggagccctgtccgtgatcgttatcgaagccgatctcctgtacagcggtcaagatccccggttaccaacagaagagcttatgactgatagagaaatatctaggttatggcagtgaggtggcttccgtttgcgattctagctctagcacttagtaaagaaaggtgtactgtatctgtattgaggcttttcgtttagtcttac

SEQ ID NO: 5992 - DNA, 1193 bp, Brachypodium distachyon
caaactgcaaaaggagaagagaagaggctcagagcctcagacagcaagcacaacacgaagccgaggaagaaccctagcctcctccctccttctcgacgacggcgcagggtttttcctgtgcacgcggccttggatccttgtaccgcgagaggtgaggcgaggttccttcttcggtgaagatgaggcccgtgttcgtggggaacctggactacgacacccgccactcggagctcgaccgcctcttctaccgttacggcaggatcgagcgcatcgacatgaagtcaggatttgcttttgtctactttgaggatgagcgtgatggtgatgatgccatacgggctcttgatggtgtgccctttggccctgggagacgcaaactttcagtggagtggtcacggggtgaccgcggtaccagacgtgatgaccgtgatggctatagtaaaccacctgtgaatactaagcctactaagacactgtttgtcattaactttgacccgatcaacacaagagtcagtgatattgaaaggcattttgatccatttggaaagatctcaaatgttcggataaggaagaactttgcttttgttcaatttgaaacacaggaagaagccacaaaagccctcgatgctactcattctacgaagttattggacagagtgatatctgttgagtatgccttcagggatgacagtgaaccaggtgacaggtatgacaggccaattagaggtggtggcggcggcggcggctatggaaggcaggatgatagctcgtatcgccgttctgttagccctgtgtaccgaaggtcacgacctagtcctgactatggtcgtccaaggagtcctgctgagttgagtcctgtgtatggttcatatgacaggagcagaagtcctgttcgtgatcgctatcgaggccgatctcctctgcgctcaagatccccgcttgccaacaggagagcttacgactgagagagttttcagtgaggcgcctcgcatccgccattctagctctagcactagcaaagaagtacatctgtactcgtacctatgcttattgtttagctgacatggatatatagacctgttcttattcaagacctactgtgtgcctaaaatgttgcaagattaccgtatgcactgtgtccctatttctgcctggccattatttgttttctcaatagtttctattttgcctaa

SEQ ID NO: 5993 - DNA, 1263 bp, Secale cereale
gcgattcgtgccactgccatcagttccatcatgccataccatgccatcagttccatcatgccatatcatgccacgactagaagtatccaccaggcatcgacttgataacttgctatgtgtgctgtctcagtaagcaatgtctgtgaggctctttggtctgtagaatggtgaagcatgttcagtgccgccagtcgtaccttcttactttggaacttttggatataagttgtacaacaccatgcctagtcatgaatggaatctaccagtaagctcaatagctctgttgataccatcagatctgtgcagggtttgcttttgtctactttgaggatgagcgtgatggtgatgatgccatacgggctctggatggttatccctttggccctgggagacgcagactttcagtggagtggtcacggggcgaccgtggaaccagacgtgatgaccgtgatggctacagtaaaccaccagtgaatactaagcccactaagacactgtttgtcattaactttgacccgatcaacacaagagtcagtgatcttgaaaggcattttggtcattttgggaggatttcaaatgttcggataaggaagaactttgctttcgtgcaatttgaaacacaggaagaagccacaaaagccctagatgctactcatttgacgaagttattggatagagtgatttctgttgagtatgccttcagggatgacagtgaaccaggtgacaagtatgacaggccaagcagaggtggtggctatggaaggcaggatgacagttcatatcgccgttctgttagccccatgtaccgaaggtcacgacctagtcctgactatggccgtccagtgagtcctcagtatggtgcatatggcaggagcaggagtcctgttcgtgatcgctatcggagccggtctcctgtccagcgctcaagatccccagttcccaacagaagaggttatgactgatggacagttatctcggtttatggtagcaaggcagtttccatatgctgttctagctctagcattagtaaacaagaacccttctgtaccgtaccgaagcttatcgtttagttgacaccgtgttataagaagttggacctgtccttttatacctgctttgtcggtcgtgtgttataagaagttagaccttttactgtgacacctgcattgtgcctaaatcgcgacatttcgtatatctgcgtgtctatttatgttctggtatttttgtgtgtgatatttgaaattttctaggttaatactaaac

SEQ ID NO: 5994 - DNA, 3377 bp, Triticum aestivum
tcgagctcgccaacatgctgcagagcaagtccttcgtcaagaagacgaagcagggccgcgtcgtcaaggtggtccgggagcactacctccgcgacgacatcccctgcggcgccttctcctgctcctcctgcgacgcggccgcgcgccgcctcaacgccgacgccgccgccatcctcgtcgtcgacaccaacgtcgtgctccaccagatcgatttgttggagaatccggcgattgaggatgtcgtggtgctgtcggtggtgctggacgaagtgaagaataagaacctctccgtgtacaacaggctcaagaccctgtgcaccaacacggctcggaggttcttcgtgttcaccaacgagcaccacagggatacttatgtcaaggagatggttggagagagcccaaatgatcgtaatgatagagcaatccgtgttgctgctcgttggtaccagagtcacctcggtgacagtgccaaagtgttgctggtcacaaatgatagagataacaaacggaaagctactgaagaaggcctaaatgcagagacagttgagtcatatgtacgatcgcttgcgcagcctggtttgctcgatttggtggttgtcccaagtagcggagatgttgccatggaagatgtagaagatcttagaccatccaaaaggaaaatagtttacaatgagcataaacctatgtcggaaattacatctggtctgcgctgtggaatttatcatcaagggaagcttcgagttaatcgttacaatccatttgaagcatatgtcggaagtgagagcattggggatgagattattatccgtgggagttcaaatatgaacaggtcctttgacggagatatagttgctgtagaactcttgccacaggaccagtggcatgattcgaagtcatttattgctgatgatgatgaagatgataatgaagatgatgtccggttggttccaaatagtgctgatgatgctccacgaaacacaaattccacgcaatcaacagttggatcatcagctgcttcagtccccagtcgtccagttggacgtgttgttggtatcatcaagcggaattggaattcgtattgtggatcattggagccaatgcccatgcctgctggtagcgggggcgttgctcatgctctatttgtgtcgaaagatcgaagaattcctaagattcggattcaaactagacaacttgggaatcttttaaataaaaggattatcgttgcagttgattcatgggatgtcatgtctcgatacccatcaggacactatgtgcggactataggagatattggcgataaagaaactgaaacagaggttgtcctaatagagaatgatattaacacaagacctttctctacacaagtccttgcttgtttgccgcctttgccttggacattgtcacccgaggatgtggctaatcctaataggcaagacttgcggcatgtgagagtctttagtgtggatccacctggttgtagggatattgatgatgcactacattgcacaccgcttccaaatggaaattttgaagttggagtccatattgctgatgtcactaattttgtccatcctggtacccctcttgatgaggaggcctctcaaagggcaacttctgtttatcttgttggacaacgaattgacatgctaccgaagcctctaactgaagatgtttgttctcttcgtgctgatgttgagaggctggcattctccgtcatttgggaaatgacacctgatgctgatatcatatcttcaagatacacaaagagtgttatcaagtcttgtgctgcaatgtcttatgtagaagcccaagcaagaatggatgacagccgtttggccgatccactgactgtagacttgcggaacttaaattcattagcaaagataatgagaaatcgacgttgcgaaagaggggctctgactcttgcttcagcagaagttaaattcgaaattgacagtgaaactcatgatcccctcgacataggaatatatcaaattcgtgaggcaaaccaaatgattgaagagtttatgttggcagcaaatgtttctgttgctgagaagattttgcagcactaccccttgtgttcattgctacggcgtcatcctagcccaacaaaggagatgcttgagccattactccgtaccgcctcttctgttggcctaaatctggacgtatcatcctcaaaagcattagctgaatcacttgataatgcgaagagagatgacccgtacttcaacaagcttatccggattttggcaactagatgcatgacacaagcagtttacttttgcagtggagatttgagcttgtctgagtattatcattatgggcttgcatctgctctgtacactcatttcacttctcctattcgcagatatgcagatgttgtggtgcataggttgctagctgctgctctagatattgcgaaacttccaccagtcttccaggatggtccacaactcacaggcatcgctgacaacttgaattataggcacagaaatgcccaaatggcaagcagagcatcggttgagctccacactctcatatatttcaggacaaggcccgtggatactgaagctagaatagtaaagatcaaggcaaatggtttcatagtcttcgtcccaaagtttggcatagaagggcccatctatcttacggcgaagggagacaaaggggctgactgggtagtagacgaggtgcaccagaaagtaaccaagcctggaacaaacataagctatgctgtgttgcagagtgttatgatccatatggaagtggtggagcctcagccccaccgccccaagctgcagctcaccctcatatgaacaacaaatgtacaattgaattgtaacattagcgcattcaccctttttccgctacaacagtgtactagggtccattctttaattcaacaaacataggtgattttatgatattgtcaaatcagcctggaattgctcttcacagagttgtaaaaatctctctttattgatgctaaaaatctaccatgacctgctgtgttccccttatcagttgctcatctctgggcatatcttatttgtgttatcacttgacaatgcttgaaacacactgtgcaaatgtgccgatgcaaaattttcttgctgaagagatcctcaggacacgagtgacatgaacaccgtcgaccagagggtgagagccagggctgcaaccaggtgcgtccagagaaagacgatggagcactcctcttccccaacatcaaacagctgggctatcgtcccgatgctcatggccgggggaagcgtggactgtagaaggagaacgtagcggtacaggggcgatcttggcaggaacccaagctcgctggcggccttcaccacgccgattccgcacgcggggag

SEQ ID NO: 5995 - DNA, 4372 bp, Triticum aestivum
tcgagctcgccaacatgctgcagagcaagtccttcgtcaagaagacgaagcagggccgcgtcgtcaaggtggtccgggagcactacctccgcgacgacatcccctgcggcgctttctcctgcccctcctgcgacgcggccgcccgccgcctcaacgccgacgccgccgccatcctcgtcgtcgacaccaacgtcgtgctccaccagatcgatttgttggagaatccggcgattgaggatgtcgtggtgctgtcggtggtgctggacgaagtgaagaataagaacctctccgtgtacaacaggctcaagaccctgtgcaccaacaccgctcggaggttcttcgtgttcaccaatgagcaccacagggatacttatgtcaaggagatggttggagagagcccaaatgatcgtaatgatagagcaatccgtgttgctgctcgttggtaccagagtcacctcggtgacagtgccaaagtgttgctggtaacaaatgatagagataacaaaaggaaagctactgaagaaggcctaaatgcagagacagttgagtcatatgtacgatcgcttgcgcagcctggtttgctcgatttggtggttgtcccaagtagcggagatgttgccatggaagatgtagaagatcttagaccatccaaaaggaaaatagtttacaatgagcataaacctatgtcggaaattacatctggtctgcgctgtggaatttatcatcaagggaagcttcgagttaatcgctacaatccatttgaagcatatgtcggaagtgagagcattggggatgagattattatccgtgggagttcaaatatgaacaggtcctttgacggagatatagttgctgtagaactcttgccacaggaccagtggcatgattcgaagtcatttattgctgatgatgatgaagatgataatgaagatgatgtccggttggttccaaatagtgctgatgatgctccacgaaacacaaattccacgcaatcaacagttggatcatcagctgcttcagtccccagtcgtccagttggacgtgttgttggtatcatcaagcggaattggaattcgtattgtggatcattggagccaatgccaatgcctgctggtagcgggggcgttgctcatgctctatttgtgtcgaaagatcgaagaattcctaagattcggattcaaactagacaacttgggaatcttttaaataaaaggattatcgttgcagttgattcatgggatgtcatgtctcgatacccatcaggacactatgtgcggactataggagatattggcgataaagaaactgaaacagaggttgttctaatagagaatgatattaacacaagacctttctctacacaagtccttgcttgtttgccgcctttgccttggacattgtcacccgaggatgtggctaatcctaataggcaagacttgcggcatgtgagagtctttagtgtggatccacctggttgtagggatattgatgatgcactacattgcacaccgcttccaaatggaaattttgaagttggagtccatattgctgatgtcactaattttgtccatcctggtacccctcttgatgaggaggcctctcaaagggcaacttctgtttatcttgttggacaacgaattgacatgctaccgaagcctctaactgaagatgtttgttcccttcgtgctgatgttgagaggctggcattctccgtcatttgggaaatgacacctgatgctgatatcatatcttcaagatacacaaagagtgttatcaagtcttgtgctgcaatgtcttatgtagaagcccaagcaagaatggatgacagccgtttggccgatccactgactgtagacttgcggaacttaaattcattagcaaagataatgagaaatcgacgttgcgaaagaggggctctgactcttgcttcagcagaagtcaaattcgaaattgacagtgaaactcatgatcccctcgacataggaatatatcaaattcgcgaggcaaaccaaatgattgaagagtttatgttggcagcaaatgtttctgttgctgagaagattttgcagcactaccccttgtgttcattgctacggcgtcatcctagcccaacaaaggagatgcttgagccattactccgtaccgcctcttctgttggcctaaatctggacgtatcatcctcaaaagcattagctgaatcacttgataatgcgaagagagatgacccgtacttcaacaagcttatccggattttggcaactagatgcatgacacaagcagtttacttttgcagtggagatttgagcttgtctgagtattatcattatgggcttgcatctgctctgtatactcatttcacttctcctattcgcagatacgcagatgttgtggtgcataggttgctagctgctgctctagatattgcgaaacttccaccagtcttccaggatggtccacaactcacaggcatcgccgacaacttgaattataggcaccgaaatgcccaaatggcaagcagagcatcggttgagctccacactctcatatatttcaagacaaggcccgtggatactgaagctagaatagtaaagatcaaggcaaatggtttcatagtcttcgtcccaaagtttggcatagaagggcccatctatcttacggcgaagggagacaaaggggctgactgggtagtagacgaggtgcaccagaaagtaaccaagcctggaacaaacataagctatgctgtgttgcagagtgttatgatccatatggaagtggtggagcctcagccccaccgccccaagctgcagctcaccctcatatgaacaacaaatgtacaattgaattgtaacattagcgcattcaccctttttccgctacgacactgtactagggtccattctttaattcaacaaacataggtgatattatgatattgtcaaatcagcctggaattgctcttcacagagttgtagaaatctctccttattcatgctaaaaatctaccatgacctgctgtgttcccctcatcagttgctcatctctggccatatcatattgtgttatcacttgtcaatgcttgaagcacatttgtacaaatgtgctcatacaatttttttttgctgaagagatcctcaggacacgagtgacatgaacaccgtcgaccagagggtgagcgccagggctgcaaccaggtgcgtccagagaaagacgatggagcactcctcttccccaacatcaaacagctgggctatcgtcccgatgctcatggccgggggaagcgtggactgtagaaggagaacgtagcggtacaggggcgatcttggcaggaacccaagctcgctggcggccttcaccacgccgattccgcacgcggggaggatgacgaagcgtatcacgatgattgatacgaccaccaggggcttcatcgtcgtcctgcctctgccttttgtgaggtttccaccgagtatgaggacggtgcatggtatcgcagcatctgctagtaacttggcggtgtcttggactactcggagagggccatcttcctccgtaatgagcggtctcagcttgtcgattgcgccgacggtaaaccctacgagcgctgcaacactgggaggtgaccacagttcattcagtatctctaccagcaaatcctttgctcttcttaagtagtgcaggaagctaccagcaacatcactggaaggcaagctagaacgtaccgggtcgctctctacatcctcatgaaattcccctgacgacaggggaagaaaagccgcatgattgccattttcggcttctcctgagtcttcttctttcctcatgttagttgtgggatcaccacatttcttgtaaagctgagcagatctcttcatgacgctgtagctatgagtccagataaagaaattccctagcgccatggagagcgagacgtaggagaggccgagagatttgcaggtgtcggcatcaccaaaggggctgtcctcctcattgcaaatcgccggaacaatcatcagaggaatagttccccagttacctgctgagctgcaagcaatgacaagcccctgaagatgtgctcctggcttcagggccttgacggccagccacccaagagccgctccgatgaggaatatgatgcccatgttcactggcatgaaccaccaggaaatgatgtccttgagcgtgacggtgcctgccaagctcgagaagacgagcgacgggacgaacacgatgtaaacaaccttgtttatgtgcctccgagcatcggaggtgaggacgtcgaaacggctggacgcgaggcaggctccgaggccgccggcgaggaggacctgcaggacgggcagccatgccacggcgagcagagaccagaacctcatct

SEQ ID NO: 5996 - DNA, 4750 bp, Brachypodium distachyon
atgaaaaaccagttccgaacggacagattggagtccaaacccaaacccagatcaagctcaaccctattaaacccctgttcctcttcgccgccgccgcctcctccattctgccgccgccgaaggtccgccctcttcacgctccccgccgccgctcgtctgcgcgccgtcgacctcgccaacatgctgcagagcaagtccttcgtgaagaagacgaagcaaggccgcgtcgtcaaggtggtcagggagcactacctccgcgacgacatcccctgcggcgccgcctcctgctcctcctgtgacacagccgctcgccgcctcggggtcgacgcggccgctatcctcgtcgtggacaccaacgtcgtgctccaccagatcgatttgttggagaatccagcgattgaggatgttgtcgtgctgtcggtggtgctggatgaggtgaagaataagaacctctctgtgtacaacaggatcaaaacactatgcaccaacaccgcgcggaggttcttcgtgttcaccaacgagcaccacagggatacttacgtgaaagagatggttggggagagccctaatgatcgtaatgatagagcaattcgtgttgctgctcgttggtaccaaagtcatcttggtgagagtgccaaagtgatgttgattacaaacgatagagataacaaacggaaagctaccgaagaaggtctcaatgcagagacagtcgagtcatatgtacgatcgcttgcgcagcctggtttgctcgatttggtcgttgtcccaagcagtggagatgttaccatggaagatgtagaagatcttagaccatccaaaaggaaagtaatttacagtgagcataaacctatgtcagagattacatctggtctgcgttgcggaattttccatcaagggaagcttcgagttaatcgttacaatccatttgaagcatatgttggaagtgagagcattggtgatgagattattattcgtggtcgttcaaatatgaacagggcatttgatggagatatagttgctgttgagctcttgccacaagatcaatggaatgagtcaaagtccttcattgcagatgatgatgaagatgataatgaagaggatgtccatttggttccaaatagtgctgatgatgctccacggaacaccaattccacgcaatcaacagttgaatcatcagctgcttctgtctccagtcgtccagttggacggattgttggtatcatcaagcggaactggaactcgtattgtgggtccttggagccaatgcccatgcctgctggtagtgggggtgttgctcatgctctatttgtgtcgaaagatcgaagaattcctaaaattcgtattcaaactaggcagcttgggaatcttctaaataaaaggattgtcgttgcagttgattcatgggatgtcctgtctcgatacccatcaggacactacgtccggactataggagatattggtgacaaggaaaccgaaacagaggttgtcctaattgagaatgacattaacacaagacctttctctacgcaagttcttgcttgcttgccacctttgccttggtcattatcacctgatgatttggctaatcctaatagacaagacttgcgtcatgtgagagtctttagtgtggatccacctggttgtagggatattgatgacgcactacattgtacaccacttccaaatgggaattttgaagtcggagttcatattgctgatgtcactaattttgtccttcctggtaccccccttgatgaggaggcctcacaaagggctacttctgtttatcttgttgggcaacggattgacatgcttccgaagcctctaactgaagatgtttgttctctccgtgctgatgttgagaggttggcattctccgtcatttgggaaatgacacctgatgctgatatcatatcctcaagatacacaaagagtgttatcaagtcttgtgctgcaatgtcttatgtggaagcccaagcaagaatggatgacagccgtttggtcgatccgctaactgtggacttgcgaaacttaaattcattagcaaagataatgagaaaccgacgttgcgaaagaggggctctgactcttgcttctgcagaagtcaaatttgaaattgatagtgaaactcatgatcctcttgacataggaatctatcaaattcgtgaggcaaatcaaatgattgaagagtttatgctggcagcaaatgtttctgttgcagagaagattttgaagcactaccccttgtgctcattgctaaggcgtcatcctagcccaacaaaggagatgcttgagccattacttcgtactgcctcttctgttggcctaaatctggacgtgtcatcctcaaaagcattagctgattcacttgataacgcgaagagagacgacccatacttcaacaaacttatcagaattttggcaactagatgcatgacacaagcagtttatttctgcagtggagatttgagcttgtctgagtattaccattacggtctcgcgtctgctctttacactcatttcacttctcctattcgcagatatgcagatgttgttgtccataggttgctagctgctgctttagatattgcaaaacttccaccggtctttcaggatggtccacaactcacaggcatcgctgacaacttgaactataggcaccgaaacgcccagatggcaagcagagcatcggttgagctccacaccctcatatatttcaggacaaggccggtcgacactgaagctagaatagtaaagatcaaggcaaatggtttcatagtcttcgtcccaaagtttggcatagaagggcccatctaccttacagcgaagggagacaaaggggctgattgggtagtagacgaggtgcaccagaaagtaaccaagcccggagcaaacataagctatgctgtgttgcagagtgttatgatccatatggaagtggtcgagcctcagcctcaccgcccaaagctgcagctcaccctcttatgaaaatgtacaaatcaactgtaatattagtgcatccatattttttcactgtaacattgtatcctgagtcaattctttcaatattggtgattttctgacgttaccaaaataggcgcatggaatttctctttacagaatcgattaaaattctctatttttacggaagagcttttattatgcccattacatcacatttacttgcaaatcaatgtttctttccatggtcgactcgatctgccactaagcattgctagaacacattaaagatgtgctgatgcaatgttctcctgtgctgaatggacttgtaagaagattgagcaccgttgtcatatgctgtcacaactcaacaactgccgagtgctttcagctggatggatatacgggctcatgacacgagtgacatgaacacagtggaccagagcgtgagcgccatggcggcaaccaggtgcgtccacaggaagacgatcgagcactcctcttccccaacatcgaacagctgagccattgtccctgtagcatccaagaaaccgcatctcagaacacagccgccccaacacactcatcagcagaatatcttgtaactctgcataccgatgctcatggctgggggaaccgtggactgcaacaggagcacgtagtggtacaggggggatctcggcaggaacccaagctcgccggccgccttgaccacgccgatcccgcaggcggggaggatggcgaagcgtatcgcgatgatcgacacgactaccagaggcttcatcaacgtcctgcccctgcctggccgtgcagaaaatttgtaaacatggaatggaagggatggataaagttagacaatggctgaactgtaccttttgtaaggttcccaccgagtatgaggacagtgcacggtattgcagcacctctgctcccaagtttgggggtgtcatcccagaaaagaaggtcagcagcagattgacatcaaagatgcagcagccttaaataaaagatgaagcagcgctgctgttgtttagactcaccctagtaactttgccgaatctaggactactcgaagagggccatcttcttccgtaacaagtgatttcagcttgtcgattgtgccgatagcaaaccctatgagctgcagagtggtaggagttatatctgaattcaagagttcatgatggtgcaaagcaggtcacataccgcagcaacactgggaggtgaccatagttcattcagcatctctactaacaaatcctttgctcttcttaagtagtacatgtagctacttgcaagctggttagaaggcaagccagaactgacctacaatcaaaactcacagaagttaagatttgttcatcacttgcactcttcaaatctttacagtacaatggaactcctaacatcctcgcagaattctccagatggttggggaagaaaagccctatagtgaccatttgcatcttctcctgaattttcttctttccttatgttagttggaaggtgattattatgagatttcttgtacagttgagcagatctcttcatgacgctgtagctatgagtccatatgtagaaatttccgagctgcatgaaacatttatgaatccaaaatgtaccatgatagcctcgacagaatcaatcaggggaggacagccttaccgccatcgataacgagacataggagaggccgagggagttgcaggtgctggcatcaccaaaggggctgtcctcctcgttgcagatcgccggaacaatcatcaaaggaattgttccccagttacct

SEQ ID NO: 5997 - DNA, 3340 bp, Sorghum bicolor
cacggctcacttctcacgtgtccaagtccaaccgatgccccgcggtcgaacccacactgagtcccagacctgagtcaggctagctcaaccgaccccacaacgaaccaaactaaaccccgttggcccctttgccgccgccggcacttcccccgccgacggctggtacacgtctcctccgcgctcctcgccgccgccggagccgcctcgcggcgcgctgtctaactcaccaccatgctgcagagcaagtcattcgtgaagaagacgaagcaaggccgcatccaaaaggttgttagggagcactacctccgcgatgacgtctactgcggcttcgtcccctgctccgcctgcgccgccgccgctgagcgcaagctcgccgccgccgccgctgccatcctcgtcgtagacaccaacgtcgtgctccaccagatcgatttgctggagaaccccgcgattgaggatgtcgtcttgctgtcagtggtgctggacgaggtgaagaataagaacctttcggttttcaacaggatcaaggcactctgtaccaacaaagcacggaggttctatgttttcgccaacgagcagcacagggatacttatgtcaaagatatggttggggagagctctaatgatcgtaatgacagagcaattcgtgttgctgctcgttggtaccaaagccatcttggtgagagcgtgaaggttctactgattacaaatgacagagataacaaaaggaaagctattgaagaaggccttaacgctgagacagttgagtcatatgtaagatcgcttgcacagcctggtttgcttgatttggtggttgttccatctagtggagatgttaccatggaagatgtagaagaccatagaccatccaagaagaaagtaatctataatgagcacaaaccaatgtcagagattacatctggtttgcgatgtggaatctatcatcaagggaagcttcgagttaatcgttacaatccatttgaagcttatgttgggagcgagagcattggagacgagattgttatccgtggccgctcaaatatgaacagggcctttgatggtgatatagttgctgttgagctcttgccacaagatcaatggcatgagtcgaagtctttcatagcagatgatgatgaagaagaagaagatgtccatctggtccccaatagtgctgacgatgctcctaggaacaccaattctacacaatcaacagttggatcttcagctccttctgtctccagtcgtccagttggacgtgttgtgggtataatcaagcgaaattggaattcgtactgtgggtccttggagccgatgcctatgcctgctggtagtgggggcgttgctcatgctttatttgtttcaaaagatcgaagagttccaaagatccgaattcaaaccaggcagcttgagaatctcgtgaacaaaagaattgttgttgcggttgattcatgggatgttttgtctcgatatccatcaggacactatgtacgcaccattggagatattggtgacaaagaaactgaaacagaggttgtcttaatagagaatgatatcaacaccaggcctttctctactcaagtccttgcttgtttgccacctttaccttggacattatcaccagaggatctggctaatcctaatagacaagacttgcgccaagtgagagtctttagtgtggatccaccaggttgtcgagacattgatgatgcactacattgcacgctacttccaaatgggaattttgaagttggagtccatatcgctgatgtcactaattttgttcatcctggtacccctcttgatgaggaagctgcgcagaggggcacttctgtttatcttgttgggcagcggattgatatgcttccgaagcccctgactgaagatgtttgttcacttcgtgctgatgttgaaagattggcattctctgtcatttgggaaatgactcctgatgctgatgtcatatccacaagatatacaaagagtgttatcaaatcttgtgctgcaatgtcttatgttgaagcccaggcaagaatggatgacagccgtttagttgatccacttactgtagatttgcggaacttaaattcattggcaaagatcatgcgacaacgacgttgtgaaagaggagctctgactcttgcttctgcagaagtaaaatttgagatcgatagtgaaactcatgatcctcttgacataggaatttatcaaattcgcgaggcaaatcaaatgattgaagagtttatgttggctgcgaatgtttctgttgctgagaagattttgaagcacttccccttatgttcattgctaaggcgccatcctagcccaacaaaagagatgcttgagccattactccgtaccgcctcttctgttggcctcaatctggatgtatcatcctcaaaggcattagctgaatcacttgacaacgcaaagagcaatgacccatacttcaacaagcttattagaattttggcgactagatgcatgacacaggcagtttatttctgcagtggagatttgaccttttctgagtattaccattacgggcttgcagcttctctttacactcatttcacctctcccattcgcagatatgcagatgttgttgttcatagactgctagctgcagctctaggtattgcaaagctcccgccaatctttcaggatggtccacaacttacaggaatcgctgacaacctgaattacagacatcgaaatgcccagatggcaagcagagcatcggtagaactccacacccacatatatttcaagacaaggccaactgacactgaagctaggatagtaaagatcaaggcaaatggtttcatagtctttgtcccaaagttcggcatagaagggcccatctaccttactccgaagggagacaaaggtggtgattgggtagttgacgaggtgcaccagagagtaaccaagcccggaacaaacatcagctatgctgtcctccagagtgttaggattcatatggaagtagttgaacctcagcctcatcgcccaaagctgcaactcaccctcatatgaactgtaacattagtgtttttcccagcctcttacacagctcattcttgaatccgacattggtgtgattttcgatttgtaacactaaccacatgatcaggattttgtagtatcagatagttttttctcgatacatgggaacttagttttgctactcacagcggagaaaatacatagcactatattctgttagtgtgaaagagctgttgtatgctaatgtgacagggtggttgtttttttaggcaacattcatttatatggaaagaaaacattgttttgcatggccaaatcttgctaatgttaccat

SEQ ID NO: 5998 - DNA, 3437 bp, Oryza sativa
cctatcaaaacctctcttctctctctccaccgccgccgccggtctgcgccgtctcactcacgctcagggccgccgcgacgccgtgtccctctccgccgccgccgccgccgccgccgctagcctgcgacgcccgacctcgccgacatgttgcagagcaagaccttcgtgaagaagacgagggcaggccgcgtccagaaggtggtcagggagcactacctccgcgacgacatctcctgcggcgccgcctcctgctccacctgtggcgcggtcgagcacccgctctccgccgacgcggccgccatcctcgtcgtcgacaccaacgtcgtgctccaccagatcgatttgctggagaatccagcgattgacgatgttgtcctactatcggttgtgttggatgaggtgaagaataaaaacctcgcagtgttcaacaggatcaaggccctgtgttctaacaaggcaaggaggttcttcgtgttcaccaatgagcaccacagggatacatatgtcaaagagatggttggagagagcccgaatgatcgcaacgatagagctattcgtgtggctactcgttggtaccaaagtcatcttggtgagaatgtgaaagttttgctgatcacaaatgatagagataacaaacggaaagctattgaagaaggcattaatgctgagacagtggaatcatatgtacgatctcttgcacagcctggtttgctcgatttagtggttgtttcaactagtggagatgtcacaatggaagatgtagaagatcttagaccgtccaaaaagaaagtaatttacagtgagcacaaacctatgtcagaaattacagctggcctgcggtgtggaatttatcatcaagggaagctccgagttaatcgttacaatccatttgaagcttacgttggaagtgagagcattggtgatgagattgttattcatggccgttcaaacatgaatagggcttttgatggagacatagttgctgttgagctcttgccacaagatcaatggcatgaatcgaagtcatttattgcagacgacgatgaagatgatgaagaagacgtccatttggctccaaatagtgctgatgatgctccacggaaagccaatcccacacaatcaacagctgcatcatcagctgattctgtctctagtcgcccagttggacgtgttgttggtataatcaagcgaaattggaattcgtattgtgggtccttggagccaatgcccatgcctgctggtagtggaggcgttgctcatgctctatttgtgtctaaagatcgacgaatcccaaagattcgaattcaaactagacagcttggcaatcttctggacaaaaggattattgttgcagttgattcatgggatgtcttgtctcgatacccatcaggacattatgtacggactataggagatattggtgacaaagatactgaaacagaggttgtcttaatagagaatgatatcaacacaagacctttctctacacaagtccttgcttgtttgccaccattgccatggacattatcacctgaagatcttgctaatcctaatagacaagatttacgccatgtgagagtctttagtgtggatccgcctggttgtagggatattgatgatgcgctacattgcacgccactcccaaatgggaattttgaagttggagttcatattgctgacgtcactaactttgttcatcctggtactcctcttgatgaggaggcctcacaaaggggcacttctgtatatcttgttggacagcgaattgacatgcttccaaagcctcttactgaagatgtttgttctcttcgtgctgatgttgagagattggcgttctctgtcatttgggaaatgacacctcatgctgatatcatatccacaagatatacaaagagtgttatcaagtcttgcgctgcaatgtcttatgtggaagctcaagcaagaatggatgacagccgtttggtcgatcccctaactgtagacctgcggaacttaaactcgttagcaaagattatgaggcatcggcgttgtgaaagaggggctctaacacttgcttcagcagaagtcaaattcgaaattgatagtgaaacccatgatccgcttgacataggaatatatcaaattcgtgaggcaaatcaaatgattgaagagtttatgttggctgcaaatatctctgtcgctgagaagattttgaagcacttccccttgtgttcattgctaaggcgccatcctagcccaacaaaggagatgcttgagccattactccgaactgcgtcttctgtggggctaaatctggatgtgtcatcctcaaaagcattagcagaatcacttgataatgcaaagaatgatgacccatacttcaacaagcttatcaggattttggcaactagatgcatgacacaggcagtttatttctgtagcggagacttgaccttttctgagtattaccattatggccttgctgcttctctttacacacatttcacctcccctattcgcagatatgcagatgttattgttcataggttgttagctgctgccctagaaattgccaaacttccacccctctttcaggatggtccacaacttacaggcgtagctgacaacttgaattatagacatcgaaatgcccagatggcaagcagagcatcagttgagcttcataccctcatatatttcaggacaaggcggatggacactgaagctagaattgtaaagatcaaggcaaatggtttcatagtatttgtcccaaagtttggcatagaagggcccatctaccttactccaaagggagacaaggggggtgattgggtagtagatgaggtgcaccagagagtaaccaagcccgggacaaacgtcagttacgctgtcctgcagaccgttatgattcatatggaggtggttgagcctcagcctcaccgcccaaagttgcaactcaccctgatatgaaaatgtgcaagtgaactgtataattattgtgtttatctttttccatatagtgtagtagctgggtcaattctttaattcagaattggggattgatgatctgtagcattttagccagatggacaaaccagcagagtgatgaaatcgttgagtggaatttctggtaagagtgtagtcaatccaatttataggtttaaaaagaaccgatatctaatgttcgattttatttgagcatagattactataagtgtattacacaaatttgctgattacaattattaatttgagatgatatttgccagattacattgagcgcaattttcctatgatgctatacagtaatacagatctccggaccaggatcctctgacttcatatgtggatcttgatccatagtaggtcctcatgtgttccgttcggtgcacaactgtcctatgctagccattgtacaatttggatgattgctgaaagacctgtaattatgatgttcc

SEQ ID NO: 5999 - DNA, 3226 bp, Setaria italica
cctcgccgccggctggtacacgtctcctccagtctcctcgccgccgcctcgcggcacgccgtcgctttccaccatgctgcagagcaagtcattcgtgaagaagacgaagcaaggccgcatccaaaaggtcgtcagggagcactacctccgcgacgacatctactgcggtttcgtcccctgctccgcctgcgacgcggccgcggagcgcaaactcgttgccgacgcggccgccatcctcgtcgtcgacaccaacgtcgtgctccaccagatcgatttgctggagaacccggcgattgaggatgtcgtcctgctgtcggtggtcctggacgaggtgaagaataagaaccttgcggtgttcaacaggatcaaggcactatgtaccaacaaagcacggaggttctacgttttcgccaacgagcagcacagggatacttatgtcaaagacatggttggggaaagttctaatgatcgtaatgacagagcaattcgtgttgctgctcattggtaccaaagccatcttggtgagagtgtgaaggttctgctgattacaaatgacagggataacaaaaggaaagctattgaagaaggccttaatgctgagacagttgagtcatatgtaagatcgcttgcgcagcctggtttgcttgatttggtggttgttccaactagcggggatgttaccatggaagatgtagaagatcatagaccatccaagaggaaagtaatctacagtgagcataaaccaatgtcagaaattacatctggtctgcgctgtggaatctaccatcaaggaaagcttcgagttaatcgttacaatccatttgaagcttacgtgggaagtgagagcattggcgatgagattgttatccgtggccgctcaaatatgaacagggcctttgatggtgatatagttgctgttgagctcttgccacaagatcaatggcatgagtcaaagtcatttatagcagacgatgacgaagaagaagaagaagaagaagatgtccatctggttcctaatagtgctgatgatgctcctcggaatgccagttccacacaatcatcagttggatcatcagctccttctgtctctagtcgtccagttggacgtgttgttggtataatcaagcgaaattggaattcgtactgtggatccttgcagccaatgcccatgcctgctggtagtggaggcgttgctcatgctttatttgtttcaaaagatagaagaattcctaaaatccgaattcaaacaaggcagcttgaaaatctcgtgaacaaaagaattgttgttgcggttgattcatggggtgttttgtctcgatatccatcaggtcactacgtacgaaccattggagatattggtgacaaagaaactgaaacagaggttgtcttaatagagaatgatatcaacacgaggcctttctctacacaagtccttgcttgtttgccaccattaccatggacattatcacaagaagatttggctaatcctaatagacaagacttgcgccacgtgagagtctttagtgtggacccaccaggttgtcgagatattgatgatgcactgcattgcaccctacttccaaatgggaattttgaagttggagtccatatcgctgatgttactaattttgttcaccctggtacccctcttgatgaggaagctgcgcaaaggggcacatctgtttatcttgttgggcagcggattgatatgcttccaaagcccctgactgaagatgtttgctcacttcgtgctgatgttgaaaggctggcattctctgtcatttgggaaatgactcctgatgctgatatcatatccacgagatatacaaagagtgttatcaaatcttgtgctgcaatgtcttatgtggaagcccaggcaagaatggatgacagccgtttagttgatccactaactgtagacttgcggaacttaaattcattggcaaagatcatgcgacagcgacgttgtgacagaggggctctgactcttgcttctgcagaagtaaaatttgagatcgatagtgaaactcatgaccctcttgacataggaatttatcaaatccgcgaggcaaatcaaatgattgaagagtttatgttggctgcaaatatttctgttgctgagaagattttgaagcacttccccctatgttctttactaaggcgtcatcctagcccaacaaaggagatgcttgagccattactccgtactgcctcttctattggcctaaatctggacgtgtcatcctcaaaggcattagctgaatcacttgacaatgcaaagagcaatgacccatacttcaataagcttattagaattttggcaactagatgcatgacacaggccgtttatttttgcagtggagatttgaccttttctgagtattaccattatgggcttgcagcttctctttacactcatttcacttctcctattcgcagatatgcagatgttgttgttcataggttgctagctgcagctctagaaattgcaaagctcccaccaatctttcaggatggtccacaacttacaggcatcgctgacaacttgaattacagacatcgaaatgcccagatggcaagcagagcatcagttgaactccacaccctcatatatttcaggacaaggccaactgatactgaagctaggatagtaaaggtcaaggcaaatggtttcatagttttcgtcccaaagtttggcatagaagggcccatccaccttactcctaaaggagacaagggtggcgactgggtagttgatgaggtgcaccagagggtaaccaagcctggaacaaacatcagttatgctgtcctgcaaactgttaggattcatatggaagtagttgagcctcagcctcaccgcccaaagctgcaactcaccctcatttgaaaatgtacagctgaactgtaacattagtgttctcagccttacacctctttgttctccagcccattctttaattcaacattggtgatttacgatttgtaatactagcctcatggtcagggttttgtactatcaaattggaatatggatagtttttctctgtacatgggaatttggtttctgaacggtactcgcagctgagaattatacagtgctacactctgttaatgtgaaagagctgttgtaatgttcatgtggaagaattgtttggtagcactgcattcatttacatggaaagcaaacatttattttgcatggccaaatcttgctgatgtttaccat

SEQ ID NO: 6000 - DNA, 3285 bp, Zea mays
cccagaccaggcaggcaggcagccagccactcacctcgaaccaaattattagccccgttgtcgccgccggctgctacacacacttctccgcgttcctcgccgccgccggagcaatcccgcggcgcactgtctaactcaccaccatgctgcagagcaagtcattcgtgaagaagacgaagcaaggccgcatccaaaaggtcgtcagggagcactacctccgcgacgacatctactgcggcttcgtcccctgcaccgcctgcgccgcagccgcggagcgaaagcttggcgccgctgccgccgccatcctcgtcgtcgacaccaacgtcgtgctccaccagatcgatttgctggagaacccggcgattgaggatgtcgtcctgctgtcagtggtgctggacgaggtgaagaataagaacctttcagttttcaacaggatcaaggcactgtgtatcaacaaagcacgtagattctatgttttcgccaacgagcagcatagggatacttacgtcaaagacatggttggggagagctctaatgatcgtaatgacagagcaattcgtgttgctgcacgttggtaccaaagtcatcttggtgagagcgtgaaggttctactgatcacaaatgacagagataacaaaaggaaagcgattgaagaaggccttaacgctgagacagttgagtcatatgtaagatcgcttgcacagcctggtttgcttgatttggttgttgttccaactagcggagatgtttctatggaagatgtagacgatcatagaccatcaaagaagaaagtaatctacaatgagcacaaacctatgtcagaaattacatctggtttgcggtgtggaatctaccatcaagggaagcttcgagttaatcgttacaatccgtttgaagcttatgttggaagcgagagcattggtgatgagattgttatccgtggccgctcaaatatgaacagggcctttgatggtgatatagttgctgttgagctcttgccacaagatcaatggcacgagtcaaagtcttttatagcagatgatgatgaagaagaagaagaagatgttcatttagtccctaatagtgctgatgatgctcctcggaacactaattccacacaatcaacagttggatcatcagctccttccatttctagtcgtccagttgggcgtgttatgggtataatcaagcgaaattggaattcgtactgtggatccttgcagccgatgcccatgcctgctggtagtgggggtgtcgctcatgctttatttgtttcaaaagatcgaagagttcctaagattcgaattcaaaccaggcagcttgagaatcttgtgaacaaaagaattgttgtcgcggttgattcatgggatgttttgtctcgatatccatcaggacactatgtacgaaccattggagatattggtgacaaagaaactgaaacagaggttgtcttaatagagaatgatatcaacaccaggcctttctctacacaagtccttgcttgtttgccacctttaccttggacattatcaccagaagatctggctaatcctaatagacaagacttacgccaagtgagagtctttagtgtggatccaccaggttgtcgagacattgatgatgcactacattgcacactacttccaaatgggaactttgaagttggagttcatatcgctgatgtcactaattttgttcaccctggtacccctcttgatgaggaagctgcgcaaaggggcacttctgtttatcttgttgggcagcggattgatatgcttccaaagcccctgactgaagatgtttgttcacttcgtgctgatgttgaacggttggcattctctgtcatttgggaaatgactccggatgctgatgttatatcaacgagatatacaaagagtgttatcaaatcttgtgctgcaatgtcttatgttgaagcccaggcaagaatggatgacagccgcttagttgatccactaactgtagacttgcggaacttaaattcattggcaaagatcatgcgacaacgccgttgtgaaagaggggctttgactcttgcttctgcagaagtaaaatttgagattgatagtgaaactcatgatcctcttgacataggaatttatcaaatccgtgaggcaaatcaaatgattgaagaatttatgttggctgcaaatgtttctgttgctgagaagattttgaagcatttccccttatgttcattgctaaggcgccatcctagcccaacaaaagagatgcttgagccattactccgtactgcctcttcgattggcctaaatctggacgtgtcatcctcaaaggcattagctgaatcacttgacaacgcaaagagcaatgacccatacttcaacaagcttattagaattttggcgactagatgcatgacacaggctgtttatttctgcagtggagatttgaccttttctgaatattaccattatgggcttgctgcttctctttacactcatttcacttctcccattcgcagatatgcagatgttgttgttcatagattgctagctgcagctctgaatattgcaaagctcccaccaatctttcaggatggtccacaacttacaggcattgctgacaacctgaattacaggcacagaaatgcccagatggcaagcagagcatcagttgaactccacacccacatatatttcaagacaaggccaactgacactgaagctaggatagtaaagatcaaggcaaatggtttcatagtatttgtcccaaagtttggcatagaagggcccatctaccttactccgaagggcgacaaaggcggtgattgggttgttgacgaggtgcaccagagagtaaccaagcccggaacaaacatcagctatgctatcctccagactgtcaggattcatatggaggttgttgaacctcagcctcatcgcccaaagctgcaactcaccctgatatgaaaaatgtacagctgaattgtagcaacattgtagtgttttcccgggcctctcacacctccagctcactctttagttcaacattggtgtgattttcgatttgtaaaactaatcagtaatcaccacatggtcaagattttgtagtatcagatagttttttctcaatacatggggctctatgcatggaagcttagtttctgaatggtactcacaatagagaaaatatacgacattgtattctgtttatgtgaaagagatgtatgttaatgtgacaagggtggttattgtgcgcacgcaccattcatttatatgggaagcgaacattatttttgcatgg

SEQ ID NO: 6001 - DNA, 3065 bp, Elaeis guineensis
gccgataccacgagagaggggaaaagaaaccacttcgtcgagatgttgcaaagcaaatccttcgtcaagaagaccaagcaagggcgagtggtcaaggtcgtgagggagcattacctgagggacgatatctactgcggcgcgctgtcgtgcaaggtctgcaacacgtccgctgcgcgcctgagctcgtccgcttgcactattcttattgtcgacaccaatgttgtactgaatcagatcgatttgctcgagaatccggcaatagaagatgtggtggtgctgtcggtggtgttggaagaggtcaggaacaagaaccttgctgtctacaatagggttaaagcgctctgcaccaattccctgaggaaattttttgtattctccaatgagcaccacagagatacatatgttaaagagatggttggagaaagcccaaatgaccgaaatgacagagcaattcgagtggctgcacgttggtatcaaagtcatttgggtggaagcatacaggttttacttattaccaatgacaaagagaataagagaaaagccattgaggagggtctttctgcagagacagttgaatcatatgtaaaatcactcggacaaccaaatttgcttgacttggttgctcttccaacctctgaagatgttggtatggcagaggttgaggatctgagaccatctaagagaaaagttatctacagtgagcacaaacctatgtcagaaattacttctggtctgcatcgtgggatataccatcaaggaaaacttcgggttaatagatacaatccttttgaggcttatgtggggagcgagagcattggtgatgaaatggttgtacatggccgggcaaacatgaatagggcttttgatggagacatagttgctgtggaggtcttgcctcaagaccagtggcatgaagagaagtcctcgatcattgctgatgatgaagatgatgaggaagaagatgtccacttggttccaagtagtgctgacgatgctccacggaatacaaatctagtacagcctgctgctgcatctgcagcttctacttctagtcgtccagctgggcgtgttgttggcattataaagcgcaattggcactcttattgtggatctttggagccaatgccaatgcctgcgggtaatggtggtatagcccatgctttatttgtttccaaagatcgcagaattccgaagattcggattcagactagacagcttgggaatcttctggataaaaggattgttgttgctgttgattcttgggattgtttgtctcgatatccatcaggacactatgtgcggaccataggagagattggtgatcgggatactgaaagtgaggtgttgttgattgagaatgacataaattcaagacctttttctgcacaagttcttgcttgcttaccgccattaccatggacattatcttctgaagatttggctaatcctaagagacaggatttgcggcatgtaagggtctttagcgtggaccctcctggatgcaaggatattgatgatgcattacattgcacatctcttccaaatggaaattttgaagtgggagttcatattgctgatgttacaaattttgttcttcctggtactcctcttgatgatgaggctgcacagaggggtacatccgtttatcttgttgagcggcggattgacatgcttcccaagcctcttactgaagacatatgttctcttcgttctgatgtggaaaggctggcattttctgtcatctgggaaatgacacctgaagcagaaattatatctacaagatacaccaagagtgtaataaaatcctgtgctgcattatcttatgtagaagctcaagccaggatggatgatagccgtttgatggatccattaaccactgatctgagaaatttgaactcattagcaaaggttatgagacaccaacgtattgaaagaggagctcttactcttgcttccgcagaagtcaaattccaaattgatactgaaactcatgatcctctagatattggcatgtatcaaattcgagaggcaaatcaaatgattgaggagtttatgctcgctgccaatgtttcagttgcagaaaagattttgaaacattttcctttgtgctccttgttaaggcgccatcctatcccaaccaaagagatgcttgaaccattattgcgcacagctgctgctgttggcctggatttggatgtttcatcttcaaaagcacttgctgattcacttgatcatgcggtgggtgatgatccatacttcaataagctgatcaggattctagctactagatgcatgactcaggcagtctacttctgtagtggagatttaagcccctctgaatatcaccattatggacttgcagcagctctttatactcatttcacctctcctatacgcagatatgcagatgtcattgttcacagattgttagctgcagctctaggaattgccaagcttccaccaatttttatggatggtccgcaacttacaagcatcgctgacaatttgaattaccgtcaccgaaatgcccagatggcaagccgagcctcagttgagctccacacactaatatatttcagaaaacggccaaccgacacagaagccaggatagtgaagataaagtccaatggttttatagttttcattcccaagtttggtatagaggggccggtatacttgatgccaaggggagagaaaggaggtgattgggtggtagatgaggtgcatcaaagagtgacgaggacagggacgaacatcagttatggtatcttgaacaccgtcaggattcacatggaagtggtggaacctcagccgagcagacccaagcttgaactcacacttatatagggatacatgtaacgttactcctctcgcttgtgttctagcatttattttttatttttaagtttataggcaacgctatttgttttcctttatttattttatcaggttattgtaagattttgattttataagaaaggatatgtaccataatattagcgaaatatagtctagttgctgtcaatgttcagatttatgctcattgaatcatgctgcactttact

SEQ ID NO: 6002 - DNA, 2520 bp, Hordeum vulgare
aaacccagacccaggttaagctcaacccggtgctagacgaccacggcacgcaccaaacctattaaaccgcttcactccttcaccgccgccgccgccattcgccgccgaaggtctgccccccacccgtcttcctcgcgccccccgccgccgccgctccccagcgcccggccgagctcgccaagatgctgcagagcaagtcgttcgtcaagaagacgaagcagggccgcgtcgtcaaggtggtccgggagcactacctccgcgacgacatcccctgcggcgccttctcctgcccctcctgcgacgcggccgcccgccgcctcaacgccgacgccgccgccatcctcgtcgtcgacaccaacgtcgtgctccaccagatcgatttgttggagaatccggcgattgaggatgtcgtggtgctgtcggtggtgctggacgaagtgaagaacaagaacctctccgtgtacaacaggctcaagacgctgtgcaccaacacggctcggaggttcttcgtgttcaccaacgagcaccacagggatacttatgtcaaggagatggttggagagagtccaaatgatcgtaatgatagagcaatccgtgttgctgctcgttggtaccagagtcaccttggtgacagtgccaaagtgttgctggtcacaaatgatagagataacaaacggaaagctactgaagaaggcctaaatgcagagacagttgagtcatatgtacgatcgcttgcgcagcctggtttgctcgatttggtggttgtcccaagtagcggagatgttgccatggaagatgtagaagatcttagaccatccaaaaggaaaatagtttacaatgagcataaacctatgtcagaaattacatctggtctgcgctgtggaatttatcatcaagggaagcttcgagttaatcgttacaatccatttgaagcatatgtcggaagtgagagcattggtgatgagattattatccgtgggcgttcaaatatgaacaggtccttcgatggagatatagttgctgtagaactgttgccacaggatcagtggcacgattcaaagtcatttattgctgatgatgatgaagatgataatgaagaggatgtcaggttggttccaaatagcgctgatgatgctccacgaaacaccacttccacgcaatcaacagctggatcatcagctgcttctgtccccagtcgtccagttggacgtgttgttggtatcatcaagaggaattggaactcgtattgtggatcattggagccaatgcccatgcctgctggtagcgggggtgttgctcatgctctttttgtgtcgaaagatcgaagaattcctaagattcggatccaaactagacaacttggtaatcttttaaataaaaggattatcgttgcagttgattcatgggatgtcatgtctcgatacccatcaggacactatgtgcggactataggagatattggcgataaggaaacagaaacagaggttgtcctaatagagaatgatattaacacaagacctttctctacacaagtccttgcttgtttgccacctttgccttggacattgtcacctgaggatgtggctaatcctaataggcaagatttgcggcatgtgagagtctttagtgtggatccaccaggttgtagggacattgatgatgcactacattgcacaccgcttccaaatgggaattttgaagttggagtacatattgctgatgtcactaattttgtccatcctggtacccctcttgacgaggaggcctctcaaagggcaacttctgtttatcttgttggacaacgaattgacatgctaccaaagcctctaactgaagatgtttgttctcttcgtgctgatgttgagaggctggcgttctccgtcatttgggaaatgacacctgatgctgatatcatatcctcaagatacacaaagagtgttatcaagtcttgtgctgcaatgtcttatgtggaagcccaagcaagaatggatgacagccgtttggttgatccactgactgtagacttgcggaacttaaattcattagcaaagataatgagaaatcggcgttgcgaaagaggggctctgactcttgcttcagcagaagtcaaattcgaaattgacagtgaaactcatgatccccttgacataggaatatatcaaattcgtgaggcaaaccaaatgattgaagagtttatgttggcagcaaatgtttctgttgctgagaagattttgcagcactaccccttgtgttcattgctacggcgtcatcctagcccaacaaaggagatgcttgagccattactccgtactgcctcctctgttggcctaagtctggacgtatcatcctcaaaagcattagctgaatcacttgataatgcgaagagagatgacccgtacttcaacaagcttatccggattttggcaactagatgcatgacacaagcagtttacttttgcagtggagatttgagcttgtctgagtattaccattatgggcttgcatctgctctgtacactc

SEQ ID NO: 6003 - DNA, 2760 bp, Musa acuminata
atgttgcagagcaaatccttcgtcaagaaaactagacaaggccgcgtcgtcaaggtcgtgagggagcactacctgagggatgacatctactgcggggcgccgtcctgcatgacctgcaacacctcggccgctcggctcagcacctccgcctccaccatcttgatcgtcgacaccaatgtcgtcctcaatcagattgatttgttggaaaaccccgccgtagacgatgtggtagtgctgtcggtggtgttggaggaggtgaggaataagaaccttgctgtgtataacaggctgaaggcgctttgtactaattcgcttaggaagtattttgtgttctccaatgagcaccacaaagatacttatgtgaaagagatggtcggagaaagcccaaatgatcggaatgacagagctataagagtggctgcacgttggtaccaaagtcatttaggtgtaaacacacaagtattactcattaccaatgatagagaaaataagagaagggccattgaggagggcatttctgcagaaactgttgaatcatatgtaagatctcttgggaaacctgatttacttgacctggttgttctttcatcatctgctgatgttagcatggaagatgttgaagatctcagaccatctaagaaaaaagttatttacagtgagcacaagcccatgtcagaaattacttcgggtctgcttcatggagtttatcatcaaggaaagcttcgtgtgaaccgttataatccatttgaggcttatgttgggagtgagagtattggtgatgaaatagttatttatggtcgatctaacatgaatagggcttttgatggagatatagttgcggttgagctattgcctcaagaccagtggcgtgatgggaagtccatgataattgctgatgatgaggatgatgaggaagaagatgttcatttggtccctagtagtgccgatgatgctccaaggaatgaaaatcttgttcaacctagtactggatctgtgcctcctgtgtcaggtcgtccggctgggagagtcgttggaattataaagcgcaattggcattcttattgtgggtctttggagccaatgcctatgcctgcaggtaatgctggtgtggcccatgctttatttgtctccaaagatcgtagaattcctaaaattcggattcaaactcgacagcttggaaatcttttggacaaaagaattattgttgctgttgatacttgggattgtttgtctcggtatccatcaggacattatgttctgttaattgagaatgacataaatacaagacctttttcatcacaagttcttgcttgcttgcctccattaccatggtcactgtcatctgaagatttagctaaagccaatagagaggatttgcggcatttgagggtcttcagtgttgaccctcccggctgcaaggatattgatgatgcattacattgcatgccacttgcaaatggaaatttcgaagtgggagttcatattgctgatgtcacaaattttgttcttgctggtacccctctggatgaagaggcttcacaaaggggtacatcagtttatcttgttgagcgtcggattgacatgcttcccaaacctctgactgaagacatttgttcccttcgctctgatgtggagaggctggctttttctgtcatctgggaaatgacacctgatacagaaataatatcaacaagatatacaaaaagtgctatcaagtcatgtgctgcactgtcctatgttgaagctcaagcaagaatggatgatagccgaatgatggatccattgactaccgacctacgaaatttgaactcattagcaaagattatgaggcttcggcgaattgagagaggagctcttacacttgcttctccagaagtcaaattccaaattgatacagaaactcatgatcctttagacataggtatgtaccaaattcgcgaggcaaaccaaatgatcgaggagtttatgttggctgctaatgtttcggttgcagaaaaaatcttgagacattttcctttgtgctctttattaaggcgtcatcctagtcccaccaaagagatgcttgaaccattactgcggacagctgcagctgttgggctggatttagatgtttcatcttcaaaagctttagctgattcacttgatcgtgcagtgggtgatgatccatactttaataagctcatcaggattctggcaactcgatgcatgacccaggcagtttacttcgctagtggagatttgagcccctctgaattttcccattatggtctagcagcacgtctttatactcatttcacttctccaatccgcagatatgcagatgtcatcgtgcaccggttgctagctgcagcactaggaattgccaagcttcctccaatttttctggatggtccacaacttacgggcattgctgacaatttgaataatcgacatcgaaatgctcagatggcaagccgagcttcagttgagcttcatacacttatatacttcaagaaacggccaacagacacccagggcaggatagtgaagatcaaatcaaatggatttattgtttttgttcccaagtttggcattgagggaccagtgtacttggtgcccaagggagataaaagagctgattgggtggtagacgaggcacatcagagagtgaccaaggcagggtcaaacatcacctatggtattcttcagacggtgaggattcacatggaggtagtagaaccacaacccaaccggccaaagctcgagctcactctcatctag

SEQ ID NO: 6004 - DNA, 3155 bp, Aquilegia formosa
agagagagagagagagagagaacacgtttgtttaagcgcggcaaagcaaagaaagatgttgcagagcaaatccttcgttcgaaaaacaaaacaaggcaaagttcttaaggttgtaagagaacactatttaagagatgatatttattgcggagcttcgatttgtaaagtttgcgatactaaagtagctcgattaagctcttcagcatcaactattcttgttctcgacactaatgttgttcttaatcagattgatttgcttgagaatccagcaattgatgatgttgttgtgctttctgttgtattggatgaagtgaagaacaagaatctttctgtttataatagacttagagctctttgtagtaacactctacgcaaatttttcgtcttttcaaatgaacatcacaaggatacatatgtcaaggctatggttggggaaagtcctaatgatagaaatgatagagcaattcgggtggcaactaattggtatcaacgccatcttggtggcggcacgagggtattacttattacaaatgacaaggagaataagagaaaagccactgatgaaggcatttttgcggaaacagttgagacgtacgtcaaatcacttggccagcccaatttgcttgatcttgttgtgcatccaacatctgaagatgtgggcatggaagatgttgaagaccttagaccatccaagaggaaggtcatttatattgagcacaagcccatgtcagagattactgctggtttgcatcgtggaatataccaccaaggaaaacttcgcgtcaatcgttataatcctttcgaggcctatgttggaagtgaaagtattggtgatgaaataataatccagggtcgaggtaacatgaatagggcttttgatggtgatgtggtggcagtggagctcttgcctaaagaacaatggcatgaagggaagtctctgtctatagcagatgatgacttttcatttatagaggatgaggaggaagaagatgttcatttagttcccaacagtgccgatgatgctcctagaaatcgggacaccattcaagattcttccagcactgtgaatcctgtttcatgtcgtccctctggtcgtgttgttggtattattaaacgtaattggcaatcttattgtggttccttagagccaatgcccatgccagcaggtaatggtggcattgctcatgctttatttgtctctaaagatcgcagaattcctaagattcggattcaaactcgacagctggggaatcttttggacaagagaatcattgttactgttgattcttgggactgtttgtctcgatatccttctggtcattatgtaagaactataggagaaattggtgacagagacactgaaactaaggcaatcttaatcgagaatgacataaactctcgacctttttctacacaagttttggcatgcttgccacctttaccgtggtcagtatctactgaagatttgatgaatcccaacagacaggatctgcgacaattgcgtgtttttagcgtggatcctccaggctgcagggatattgatgatgccctccactgcacagctcttccagatggaaattttgaagttggagttcatattgctgacgtgaccaacttcgttcattctggcactccccttgatgatgaagcttcacaaaggggcacttcagtctatcttgttgaacgccgcatcgacatgcttcctaaaccactaacagaagatatctgttctcttcgttctgatgtggagaggttggccttttctgtaatttgggtaatgacccctgaagcagagattatatctacaagatatacgaaaagtgtcatcaagtcttctgctgtaatgtcttatgttgaagctcaagctaggatggatgacagccgtctgatggatccattgactactgacttgcgtaatttgaacacattagcaaagattatgaggcagaggcgtattgacaggggagctttaacacttgcttcagcagaagtcaaatttcagatcgacacggaaactcacgatcctcttgatatcggtatgtatcaaatcagagaggccaatcaaatgattgaggagtttatgttagctgctaatgtttcggttgcagaaaaaatattaaagcatttttcaatgtgttctctattgagacgccatcccagtcctactaaagagatgcttgaacctttactgcggacagctgctgctattggtctggatttggatgtttcatcctcaaaagctctggctgattcacttgatcgtgctgtgggtgatgatccatacttcaataagctgatccgtattttggcgactagatgtatgcctcaggcagtttatttctgtagtggagatctcacccctccagaattccaccattatggtcttgcgtccccactgtatactcacttcacatctcctataaggagatatgcagatgtcatcgttcacagactgcttgctgcagctttaggaatttacaagcttccaacaatatttcaagacagaccccagctgaccagtatagctgacaatttgaattataggcatcgaaatgcccaaatggctagctgggcctcagttgagttgcatacacttattttcttcaggaaacggccaaccgacacagaagcaagaatagtgaagataagagccaatggttttatcgtttttgtgcccaagtatggtattgagggacctgtgtacttgacgcccaaaggagaaaagggaggggattgggtggtggatgaagaacatcaaaaggtcaagaagatggatggaagcatcagttacagtgttctgcagatggtgcaaattcacatggaggttgtggaaccccagccgaaccggccaaagctccagctcacccttatgtagaagatatgtgattcattccctcccttacattttaaggaaacataaaacatatctatggagaatgtcacttggaaaggtgaatttcagcaatacttcctgttatctcgtaagatgggaaggtttctcgtagtcgatcaactagtagccagtaggaataggggtgtgagagatatgcgtagatggtgcccattaggtgttctatggatatgtagcgaggatttcgttattgtcaatttctgtaattttcgtttcaatcaatgaaattttctttcttttgttc

SEQ ID NO: 6005 - DNA, 2885 bp, Phalaenopsis aphrodite
ccaaccgccaacgaaaccatgttgcagagcaaatcgttcgtgaagaagacgaagcagggaagagtcatcaaggtcgtaagagaacactacctcagggatgacatctactgtggcgctgtgatatgtaaggtctgcgacgcttcctctgctcggcttagctctgctgcctccacaatcctaatcatcgacaccaacgttgtgctccatcagatcgatttgcttgagaatccagcgataaagaatgtcatcgtgctttcggtggttctggaggaggttagaaacaaaaatgcggcggtgtacaataggatcaagactctctgcaccgatgctatgaagaattttttcgttttctcgaatgagcatcacagggatacttatgtcaaagagatggttggggagagcccaaatgacagaaatgacagagctatccgagttgccgctcattggtatcaaagccacttaggtggaagcacacaaatattactaattaccaatgatagagagaataagaaaaaagccattgaagagggactttttgcagaaacagtggagtcatatgtaagatctcttcaacagccaaatttactggacctagttgtcatcccggcagctctagacattgtaaaggaagaagtcgatgatctaagaccatcgaaacgaaaagttttctaccttgagcacaaacctatgtcagagatcacttctggccttctccatagaatttaccatcagggaaagcttcgagttaaccgatacaatccatttgaggcttatgttggaagcgaaagtgttggtgatgagatagtgatttatggtagggtgaacatgaatagggcttttgatggagatattgttgctgtggagctcttgcctcaagaccagtggactgaggagaagtccttgcttgctgtggatgatgatgaagatgaggaagatgacattcatttggttccaagcagttttgatgatgctccaaggaatgctaatcttgcaaaagtttctgctggatctgcgcctactgttacaagtcgcccaattggacgtgttgttggtattataaagcgaaattggagctcttattgtgggtctttggagccaatgccattgcctgcaggtaatggtggtgtagcccatgctttatttatctccaaagatcgtagaattcctaagatccgcattcaaactagacagctcggaaatcttctggataagagaatcattgttgcggttgattcgtgggattgctcatctaggtacccattcgggcattatgttagaactattggacagattggtgatagagagactgagagtgaggtagttttaattgaaaatgatataaattcaaggccattttcagtgcaagttcttgcttgcttgccacctcttccatggtcgttgtcatctgaagatctggctaaaccttatcgaaaggatttacggcatttgagggtttttagtgttgacccacctgggtgcaaggacattgatgatgcattgcactgcactccttttgcagatggaaattttgaagttggagttcatattgccgatgtaacgaattttgttcatcctggaactccacttgacgaggaagctgcacagaggggaacatctgtatatcttgttgaaaagagaattgacatgcttccaaaacctttaactgaagacatatgttctcttcggtcagacgtagaaagagtggccttttctgttatttgggaaatgacacctgatgcagagattatatctacgagatacacaaaaagcattatcaaatcctgtgctgcattatcttatgttgaagctcaagcccgaatggatgatagtcgcatgattgatccattaactactgacctgcgcaacttgaattcattggcaaagattatgaggcaacgaagaattgaaagaggagccttaacacttgcttcggcagaagttaaattccaaatagatacagaaactcatgatcctctggatattggaatgtatcaaattagagaggcaaatcagatgattgaggaatttatgttggctgccaatgtttctgttgcagaaaagatattgagacattttccattgtgttctttgttgagacgccaccctactccaaccaaggaaatgttggaaccattattacgcactgcagcagctgttggccttcacttagacatttcatcatcaaaagcactggctgattcacttgatcatgctgtgggtgatgatccatatttcaataaattgatcaggattttaactactaggtgcatgactcaggccgtttatttctgcagtggagatctgacctctgctgactttcaccactacggacttgcagcgcctctttatactcattttacttctcccattcggagatatgcagatgtcattgttcatagattgctcgcggctgctctcggtatagcaaaacttccaccaatttttctagatggtccgcaacttacagagattgcagacaatttgaattatcgccatagaaatgctcagatggctagccgagcctcagttgaattgcacacccttatttactttaggaacagacctacggatacagaagccagaatagtgaaaataaaggccaatggatttatagtctttgtgcccaaatttggcattgaagggcctgttcacttgacatcaaaaggagataaagggggagagtggattgtagacgaggcgcatcagacagtgacaaagacgagcacaaatatgagctaccgtcccttgcagactgtgagaattcacctggaggttgtggaacctcaggctcaccggccaaagcttgaacttagcctcataggcatgtaatgcaaccttactgttctacttctgtacatgttccatctttttaatttatttttttt

SEQ ID NO: 6006 - DNA, 3230 bp, Vitis vinifera
attaaaaagaaacacattttcttttgagtgcaaaaaaaggaaggaatgaattcggcgtagtagtggtagaagaaaagaacacagagccagtgaagtcgagagagactcaatcggagaagaaagatgctgcagagcaaatcgttcgtgaggaaaacgaagcagggaaaagtagtaaaggtggttagagagcattatcttcgagatgatatctactgcggagcgtcgatttgcaaagtgtgcgattcttcaactgctcggttgagtccgtcggcctccactattctcattctcgacactaatgtcgttctcaatcagattgatttgctggagaatccggcgattgatgacgtcgtggtgctgtctgtggtgctggaagaagttaagaacaagaatatttctgtttacaacagacttagaaccctttgcagcaactctatgaggaaattctttgttttctcaaacgaatatcacaaggatacatatgttaagcagatggctggagaaagtccaaatgatcgaaatgatagagcaattcgagtggcaactcaatggtatcagagtcatcttggtgctgcggctcgggttttgcttataacgaatgacagagaaaataagaggaaggctactgaagagggcatttctgcagagacagttgagtcatatgtgaaagcactggggcaaccaggtttgcttgacctgcttgtgcaacctgcccctgaagatgtaggcatggaggaagtggaagatctgagaccttcaaagaggaaagttatctatagtgagcataagcccatgtctgagattacttctggtttgcatcgtggaatctaccatcaaggaaaactacgggttaatcgctacaatccttttgaagcatatgttggaagtgagagcattggtgatgaaataattatctatggtcgtggaaacatgaatagggcttttgatggtgatgtagtagcagtggaacttttgcctcaagatcaatggcaagaggagaagtctttgtctatagcagatgaagaggatgaggaggaagaagatgtccatcttgttccaagcagtgctgatgatgctcctagaaatacagatctagcacagggttcagttggaggcacaaaagctgttttgtgccgtccatctgggcgtgttgttggtattataaagcggaattggcactcttattgtggatctttggagccaatgcctatgcctgcaggcaatggtggtattgcccatgctttatttgtctccaaagatcgcagaattccaaagatccggattcaaactcgacagcttgggaaccttctggacaagagaattattgtggcagttgattcatgggattgtctatcacgatatccttctggtcattatgtgcgtactataggagaaataggtgatagagatactgaaagtgaggtggtgttgatagagaatgatataaactcgagaccattttcattgcaagttttggcatgcttgccaccattaccatggtcagtgtcttctgaagacctggcaaatccatgtaggctggatttgcggcatgtgtgtgtttttagcgttgatcctccaggatgcaaagatatagacgatgcactgcattgtacaactcttccgaatggaaattttgaagtgggagttcacattgctgatgtaacaaattttgttcaccctggcactccccttgatgacgaggctgcccaaaggggcacatctgtctaccttgttgagcgcagaattgacatgcttcctaaacctttaacggaagatatatgttctcttcggtctgatgtggaaaggctagctttctctgttatttgggagatgacacctcaagcagagattatttctacaaaatatacaaaaagtatcattaaatcttgtgcagcattgtcatatattgaagctcaagctaggatggatgatagtcgcttgatggatccattaactatggatttgcgaaatatgaatgctttggcaaaggtcatgaggcttaggcgtattgagagaggagccctaactctagcttctgcagaagtcaaatttcaaattgatactgaaactcatgatcctcttgatattggaatgtaccaaattcgtgaagcaaaccaaatggttgaggagtttatgcttgctgctaatgtttcagttgcagaaaaaatcctaaagcattttccgctttgttcattattaaggcgccatcctagtccaaccagagaaatgcttgaacctttgctgcgtacagctgcagctgtgggtctcaatttggatgtttcatcatcaaaagcactggctgattcacttgatcatgctgtgggtgatgatccatacttcaataagcttattcgaatactagcgactagatgcatgacacaggcagtttacttctgtagtggggatcttagtcccccagaattccatcattatgggcttgcagcacctctctatactcatttcacctctcctataaggagatatgcagatgtcattgtacacaggctacttgctgcatctttagggttatacaaacttccgacaatattccaagacaatgcccaactcactagtactgcagacaatttgaattatcggcatagaaatgcccagatggcaggccgggcctcggtagagctgcatactctaatctatttcaggaaacggccgacagacacagaggccagaatagtgaagataagatccaatggctttattgtatttgtgcccaagtatggaatagaagggcccgtgtaccttacaccgagaggtgaaaagggaggtggtgagtgggtggtagacgagcagcagcagaaggtaaagaagatggacggtagcatttcctacagtgttctgcaaacagtaatgattcacatggaggttgtggagccccagccaaaccggcccaagctcgaacttgcccttatctgcagatgatatgtaagtaaaccagttttcaatattttatagagatgatcaatgaatagagaatgcattgtggaacagtttattctgtacaattaacatgggatgagtgctgaaatattgtaatttctatttaacttaattcttttttcaccaaggttttaataaattttgttagttattttgttttaaaatttttcctttgtttttgaagtctacatgccctgtttttcggctgctaagatgtgtacttacaaagcaattagaaaatggagtgagaattacattggacaccgatttgcttt

SEQ ID NO: 6007 - DNA, 1267 bp, Triticum aestivum
acacctcaattggaaaaccaacaagctgccgtggtgactgtaagcgaagcacacgactgcctgtcctttccccaataatgcgcggcatcgcctccgccggaacgctccgccccgggccatccgcagctgtccgatcaaaatccaacgcggcaggccgccccaccctccaccgacgacccctcctccacctccggcgatcgccggaaccctctctgccgtccatccgccgcagccgccgcctcatgcctcctcttaccgcggccgcccgggccaccagcagtggcggcgatgccttcagggagcttgcctctgccgccgacttcgccgccatcgcctctcccgacggccgcatctccgtcgtcggcttcggctcccttctctccgagcggagcgcgaggagcacgttcccggagctggaggggttccgtgtggcggcgctgcgcgggttccggcgcgtcttcgcccacgccgcccccatcttcttcgagcgcggcatcgccattgaggccactaaggagttctcaagcttaagcgtggagcattgtgagggagaaatgatagttgtcactgtgtttgaaatcaaggaggaggaggtgccagccttcatcgagagggaactcgagttcagatttcttgctgtggtccctgaaggactggatggagtgccttttccaaatccagctgttgtctgtgcacgctatagcgatgaagagtatttccaagtgagatgcaaaggaagcaaagagatatataatcagcactatggacggtacaacattgataaaatatggagggatgatatcttaccctgtcgtctatatctcaggcactgtgttcttgctgccaagaatctgggagaaccagcatatagcaacttcttagaccacacctatctgggtgaccggagaaccacaataagggaatacttggccacgaccggagctggcatcatggaagaggagccaccggagacgctaagaagccgctacggcggctaacccgacgatgactttcacggccacagccaccacagattgaaattctcacttgtgtgactgcttcctaccaaatcggcagtcgatatgaacagggatgcaccaaataatgcatgatgcttcagtgcagaatatctacgattgcgattgttttgggcgcaaattatcggcgccaaacgcggtgatgtatgaccctgttgtgattgatgtacactgataaggcaataattgtgactatttcctatcataacagagacggggccatacacaga

SEQ ID NO: 6008 - DNA, 3038 bp, Triticum aestivum
gcatcttcgtgttgcttccttgttccatgggcaaagaaggcatcttcgtgttgctgtgcaagcggacggccccgcgctgctgcctcggcctcggtctgcatgctatctgtagcttctactgcactcccgggctcttcatcccacctcttcgatcttccctccccagctctcctgtcctttaaaaagctccctccctccccagctttcacttcacaccacagctcgactcacgcctcttccttggcgccagtccaatccttgcttgcttccccactttcttccttggccaagttaaccagatcgatcgactgatcctatccatagctccagtccaagctcgtttcttcaatccaaagtcaatcgccctcatccaagaaagatccaggagaaacgatcagggcatctcccaagctaaagaaaccgtgcgtgtgtactccctgtccataactccatatccatcgccatggccggagaaggagagtgctatgtccctgcccgtgcacaccaccggcgtcgtcggtcgcgcagaaactaagagaggagggggagaagaaactctttcgggttgtttctttggggtaacgagaatgcggcagctgtcgtcgctgctgcaggggctggcccgatccatggctctgggaaaggagaggaaggaggaggagcaggggacggtgctgcggacgtcggggacgctgcggggcgagggctccgggaccttggccgccgtgtggtctcgccgcggcgagaagggcaccaaccaggactgctccgttgtctgggagggattcggatgccaggaggacaccatcttctgcggcatcttcgacggccacggccagtggggacactacgtctccaaggccgtccgggactcgctgccgccgtcgctgctgcgccgctggcaggaggccgttacgctggcgtcactcatcaacggcgagaagaagctctgcgactcccagttcgacctctggaagcagtcctacctggcggccgccgctgccgtcgacgaagagctccgccgcagccgccgtctcgacgcggtcaacagtggctccacggcgctgtccatcgtcaagaagggtgacacgatggtgatcgcgaacgtgggcgactcgcgagccgttctggggaccacgtcggacgacggcagcatcgccgccgtccagctcaccgtcgacttcaaacccaacctgcctcaggagaaggcgcgcatcgtgcagtgcaagggccgcgtgcactgccacgaggacgagcccggcgtgcaccgggtgtggctgcccgaccgggaggcgccggggctggccatgtcgcgcgcgttcggcgactactgcgtcaaggactacggcgtcatctcggcgccggaggtgacgcagaggaggatcaccgcccgggaccagttcgtcatcctggccaccgacggggtttgggacgtggtctccaacgaagaggcggtgcagatcgtggcggccacgcccgagagggagaaggcggcgaagcgcctggtccagtgggccgtccgtgcctggaggcgcaagcggcggggctacgccgtcgacgactgctcggcgatctgcctcttcttccaccactcgccgccatcgtagacggacggcttcgtccctgcattgccgtgaagaccaagcaagagaaaacgcccgtccttttcttggtagagtgagtgcagacgtcgcggtcagagaccaaaatggaagatcacagcaaatcacaacgtgcggcagtcgggacggtgggcgaactgctgccggtcgacggccggaaaatctcccccaaaatgcacgagaatcaacagcagccaacggcaagggggcaaatgcatttttgtcctcatttttggtgtatgcctccgtctctgttatgacgggaaatcgtcacaatcattgccttgttatctgtgtacatcaatcacaacagggtcatacatcaccgcctttggcgccgataatttgcgcccaaaacaatctcaatcttagatattctgcactgaagcatcatgcattatttggtgcatccctgttcatatcgactgccgattcggtaggaagcagtcacacaagtgagaatttcaatctgtggtggctgtggccgtgaaagtcatcgtcgagttagccgccgtagcgacttcttagcgtctccggtggctcctcttccatgatgccagctccggtcgtggccaagtattcccttattgtggttctccggtcacccagataggtgtggtccaggaagttgctatatgctggttctcccagattcttggcagcaagaacacagtgcctgagatatagacgacagggtaagatatcatccctccatattttatcaatgttgtaccgtccatagtgctgattatatatctctttgcttcctttgcatctcacttggaaatactcttcatcgctatagcgtgcacagacaacagctggatttggaaaaggcgctccatccagtccttcagggaccaccgcaagaaatctgaactcgagctccctctcgatgaatgctggcacctcctcctccttgatttcaaacacagtgacaactatcatttctccctcacaatgctccacgcttaagcttgagaactccttagtggcctcaatggcgatgccgcgctcgaagaagatgggggcggcgtgggcgaagacgcgccggaacccgcgcagcgccgccacacggaacccctccagctccgggaacgtgctcctcgcgctccgctcggagagaagggagccgaagccgatgacggagatgcggccgtcgggagaggcgatgccggcgaagtcggcggcagaggccagctcgctgaaggcgtcgccgacgctgctggtggcccgggcggccgcggtaagaggaggcatgaggcggcggctgcggcggatggacggcagagagggttccggcgatcgccggaggtggaggaggggtcgtcggtggagggtggggcggcctgccgcgttggattttgatcggacagctgcggatggcccggggcggagcgttccggcggaggcgat

SEQ ID NO: 6009 - DNA, 2673 bp, Secale cereale
cccacccactcgccatcgggccgctcagtgcctcacgtccttcgcctgtgcacaccaccaacagtgtcgtcggtcacccagaaactaagagagcaagggagtagagaaaggaagaaactcttcgcgccgccgaactcttttgggctagcgatcgagatcgcggcagctgtcgtcgctgctgcgaggggctcggcccggtcgatggacgggaaaagagaggaaggtggaggagccgcgaggggacggtgctgcggacgtcggggacgctccggggcgagggctctgagacgtttggccgccgtgtggtctcgccgcggcgagaagggcaccaaccaggactgctccgtcgtctgggagggattcggatgccaggatgacaccatcttctgcggcatcttcgacggccacggccagtggggccactacgtctccaaggccgtccgggactcgctgccgccgtcgctgctctgccgctggcgggaggccgtcacgctggcgtcgctcatcgacggcgagaagaggctctgcgactcccagttcgacctctggaagcagtcctacctggccgccgccgctgccgtcgacgaggagcttcgccgtagtcgccgcctggacgcggtcaacagtggctccactgctctgtccgtcgtcaagaagggtgacacgatgatgatcgccaacgtcggcgactcgcgagccgtccttggcaccacgtcggacgacggcagcatcgccgccgtccagctcaccgtcgacttcaaaccaaacctgcctcaggagaaggcgcgcatcgtgcagtgcaagggccgcgtgcactgccacgacgacgagcccggcgtgcaccgggtgtggctgcccggccgggaggcgccggggctggccatgtcgcgcgcgttcggcgactactgcgtcaaggactacggcgtcatctcggcgccggaggtgacgcagaggaggatcaccagccgggaccagttcgtcatcctggccaccgacggggtctgggacgtggtctccaacgaagaggcggtgcagatcgtggctgccacgccggacagggagaaggcggcgaagcggctggtccagtgcgccgtccgtgcttggaggcgcaagcggcgggctacgccgtcgacgactgctcggcgatctgcctcttcctccactcgccgtcatcgtagacggacagcttcgtcccagcattgccgtgaagaccaaggaagagaaagacgtccgtccttttcttggtagaagagtgagtgcaggcgtcgcggtcagaggccaaaatggcagatcacagcaaatcagaacgtgcggcagttgggctgctgatcgggacggtgggcgaactgctgccggtggatggccggaaaatctcccctaaaatgcacgagaaccaacagcagccaacggcaaggaggcacatgcatttttgtcctcattttccgtgtatggatccgtctctgttatgacgggaaatagtcacaatcattgccttattatcagtgtacatcaatcacatgagggtcatacatcaccgcgtatggcgccgataatttgcgcccaaaacaatcgcaatcttggatgttctgcactggagcatcatgcattatttggtgcatccctgttcatatcaactgccgatttggtaggcagcagtcacacaagtgagaatttccatctgtggtggctgtggccgtgagagtcatcgtcgagctagccgccgtagcggcttcttagcgtctccggtggctcctcttccatgatgccagctccggtcgtggccaagtattcccttattgtggttctccggtcacccagataggtgtggtctagaaagttgctatatgctggttctcccagattcttggcagcaagaacacagtgcctgagatatagacgacaaggtaaaatatcatccctccatattttatcaatgttgtatcgtccatagtgctgattatatatctctttgcttcctttgcatctcacttggaaatactcttcatcgctatagcgtgcacagacaacagctggatgtggaaaaggcgctccatccaggccttcagggaccaccgcaagaaatctgaactcgagctccctctcgatgaatgctggcacctcctcctccttgatttcaaacacagtgacgattatcatttctccctcacaatactccacgcttaagcttgagaactccttagtggcctcgatggcgatgccgcgctcgaagaagatggggcggagtgggcgaagacgcgccggaacccgcgcaacgccgccacacggaacccctccagctccgggaacgtgctcctcgcgctccgctcggagagaagggagccgaagccgatgacagagatgcggccttcgggagaggcgatggcggcgaagtcggcggcagaggccagctcgctgaaggcgtcgccgccgctgctggtggcccgggcggccgcggtaagaggaggcatgaggcggcggatggacggcagagagggttccggcgatcgccggaggtggaggaggggtcgtcggtggagggtggggcggcctgccgcgttggatattgatcggacagctgcggatggcccggggcggagcgatccggcggaggcgatgccgcgcattattggggaaggacaagcagtcgtgtgcttcgcttacagtcaccaagtc

SEQ ID NO: 6010 - DNA, 1438 bp, Brachypodium distachyon
cagcactgccagcacacgaccggtggccgcacgccgccacgcaccggcccaataatgcgcggcgtcgcctcccccgtaacgctccggcccagggcatccccagtggtccgatcaaaatcgaacgcgccaggcacgtccaccttccaccgacaatccctcgtccctccccgcctccacctccggctatcgccggcgccggtgccctcgcagccgcccatcagccgcagtcaccgcctcatgcctcctaccgcggccgccaccaccagcgaggccggctccttcaccgaactgacctccgctgccgacttcgccaccatcgcctctgctgacggccgcatctccgtcatcggcttcggctccctcctctccgagcggagtgcgaggagcacgttcccggagttggaggggttccgtgtggcggcgctgcgagggtttcggcgcgtctttgcccacgccgctcccatcttcttcgaccgcggtatcgccattgaggccactaaggagttctcaagcttaagcgtggagcaatgtgagggtgaaatgatagttgtcactgtgtttgaaatcaaggaggaggaggtgccagcattcattgagagggagaatgagttcagatttcttgtggtggttcctgaaggactagatcaagttccttttccaaatcctgcagttgtctgtgcacgctatagcgacgaagaatatttccaagtgagatgcaaaggaagcaaggagatatataaccaacactacggacgatacaacattgataaaatatggcgggatgatattctgccctgtcgcctatatcttaggcattgtgttcttgcggcaaaaaatctcggagaagcagcatacagtagcttcttagaccacacctatctgggtgaccggaaaaccacaataagggaatacttggccacgacgggagctggcatcatggaagaggagcctcctgaatccctaaaaagccgctacggcggctaagagcatcttcaatgcaagttgcttagggaggtgcttgcacaaaataaaccggtttttgtctaagcatgtgttctacaggacaggtgcttaattagacacctctagtatagaaataagcactggtgtttgaaaataaaccggtttaattttgtaacactatcttaagcaccttgcattgaaggtgctctaactgggctacgattctcacaagtcacagacacagccaaattgacagtccatataaatggggacgtgctaaataatgtactccctccgtcccatattaagtgacgcaatattacttgtatctggacgtcttttggatatagatacatccatatttgtgaaaatttgaatcacttatgatgtgaggcagtacgatgattcactgcaaaagatgtaagattccggcttttctctttggcggacgtactgcacgcggcatgtgtgattg

SEQ ID NO: 6011 - DNA, 1189 bp, Secale cereale
aggccgccccacccttcaccgacgacccctcctccacctccggcgatcgccggaaccctctctgccgtccatccgccgcctcatgcctcctcttaccgtggccgccctggccaccagcagtgccggcgacgccttcagcgagctggcctctgccgccgacttctccgccatcgcctctcccgaaggccgcatctccgtcatcggcttcggctcccttctctccgagcggagcgcgaggagcacgttcccggagctggaggggttccgtgtggcggcgttgcgcgggttccggcgcgtcttcgcccactccgcccccatcttcttcgagcgcggcatcgccatcgaggccactaaggagttctcaagcttaagcgtggagtattgtgagggagaaatgataatcgtcactgtgtttgaaatcaaggaggaggaggtgccagcattcatcgagagggagctcgagttcagatttcttgcggtggtccctgaaggcctggatggagcgccttttccacatccagctgttgtctgtgcacgctatagcgatgaagagtatttccaagtgagatgcaaaggaagcaaagagatatataatcagcactatggacgatacaacattgataaaatatggagggatgatattttaccttgtcgtctatatctcaggcactgtgttcttgctgccaagaatctgggagaaccagcatatagcaactttctagaccacacctatctgggtgaccggagaaccacaataagggaatacttggccacgaccggagctggcatcatggaagaggagccaccggagacgctaagaacccgctacggcggctagctcgacgacgactctcacggccacagccaccccagatggacattctcacttgtgtgactgctgcctaccaaatcggcagtcgatatgaacagggatgcaccaaataatgcatgatgctccagtgcagaacatccaagattgcgattgttttgggcgcaaattatcggcgccaaacgcggtgatgtatgaccctgatgtgattgatgtacactgattaataaggcaacgattgtgactatttcccgtcataacagagacggatccatacacggaaaatgaggacaaaaatgcatgtgcctccttgccgttggctgctgttggttctcgtgcattttaggggagattttccgg

SEQ ID NO: 6012 - DNA, 2237 bp, Zea mays
gtagctcttccccaaataaattgattgtgccgttgcaacgtatgtaatttgagaaaccgtatcttatcaagtcgtgtcttataaaaagagagagagagagagagtggaaccagtatttataagcaatatgtgatgcatcatatcgtaaacttcagatcggataggaaagcgccaagacgctcacgctgccagctcagctcgtgttcgacccatgctttccacgaagcatgggcaagaccaagacggcaggagcaggggagcagcagctgatgataagctagctagccagagtcccactccactttacctccttgtcagctgctcgcacttgcagcgtcccgttcccgcacttctcttccttctcgtttcgtcctgcacagcgcacgcaactgccaccggccaccgcgcaaactccattgcgcgcagatcaagaccgccacacccaccaccagcgcttcagcgggagacgtgacgactgacgagacgaagcctctccccacggcgcctccccctccacatggcctgggctcgccttgcctcccgctcccgtctgcgccccgcggcctccgccgccggccgatcccgacacgcctcaacaccggctccgcctccgcctccgtccccacctaccacacgcacggtacctgcggccacctccgcgccaccgctccggcgtctcctcctgcttccgcggcaccggtttgctgacgccacgccctcagcatcgaccgcgtggctgctcggtgcccgctggcgccaggggcacggcaggaggtgctttgcgagcgccgcctacccggcgcaggcgacgccgggggaggcgtctgagctggtggatgtgccactggcgcagactggggaaggcatcgccgagtgcgagcttctgcgctggttcgtcgccgagggtgaccaagtagatgaattccagccactctgtgaagtacagagtgacaaagcaactatcgagataacaagtcgtttcaaggggaaagtacataagattcactttgtccctggtgacatagtgaaggttggtgaaactttactgaaaatggttgtgggtgacagccaaattgtttccccagataatatagttccatccgctggtaagtcccttggagtagagtctgcagttttctcaagtgaaggcaatgttcctggtggaaatctctctacaccagctgttaggcatctagcaaagcagtatgggatcagcataaatgaaattgttgggacagggaaagatggtagggttttgaaagaagatgtgttgaattatgctgtcagcaaaggtgtttgcaaacaacaatcgttagcttcggaagggaacattggtcaagttgagttactagaggaagggaaagcattactcgatgaggacttctatgaagataagaaaatccttctcaggggataccagagatcaatggtcaaatcaatgagcctggcagcaaaagttccacattttcattatctagaggagataaattgtgattctcttgtgcaactaaaaaccacatttcaaaatgagaacaaggatcaaactatcaagcacactttccttccgttcctcataaagtcactttctatggcactgagtaaataccctatgttgaacagttctttcattgaggaaactaacgaagttgtgttcaaggggcctcacaacattggggtggcgatggctacaacacatggattagtcgtgccaaacatcaagaaagtgcagtcgctatcaatattggagatcacgaaggaattggcgcgattgcatgagatggcatcacaaaacaggctaagcgctgcagatattgaaggtggcactataacacttagtaacataggtgccattggtggcaagtttggctctccacttctgaacctacctgaagttgccatcattgcccttgggcggattcaaaagcttcctcgcttcgatgatgacgaaaacgtttacccttcatccataatcaatgttactgttggagccgatcaccgagttgttgacggggccacggttgcaagattctgtaatgaatggaagagcctcgtggagaagccagagctgctcttgttgcatatgcgatgacccagtaatgtaccggtacatactacgacctgaaacggaggcattttggcataaaaaaataaatccatgtattcaaataaataaccaacgtggcttctctgcctggaaacagtggaaataaattgggagttattttcggagtcctaat

SEQ ID NO: 6013 - DNA, 1982 bp, Panicum virgatum
cctcctcgttttctccccttcccctctgccccgcgcacctacgcatcgccgcctcctccactctccgtctagtcctcccaaacccagagtctggtcctcgtcttcctcccgtaactacctcggccctatccgcagcaaccattcgccgcgccgcgcgagaccagctcgatccgaccgacagcggccatggctcccctgccccgcgcggcccgcctcctccgatccgccgtcgggctgctgaggtcgccccctccgccgccggcgcggctcttctccagcgccgcggggaccgggaccgggaccgggacgggggcggggaccgggcgcgaggccgcgatcgtcgccaccgccgtggcgctggccgggtccgggctcgggctgtggctgaaaccgccctcgctcgccgactccggcgaggcggtcggcggccagatctcggtcgccggcggcggcggcgccgcggaggcccgggaggagaagggtcggttcctgttcgcagactcattccgcagaagggtgttctttaactacgagaagaggatacggcttctcagccctcctgaaaagatctttgagtactttgcatctgtgaggaacccagaaggtgaagtttacatgttgccctctgacttgatgagggcattagtccctgttttccctccatctgagtcgactgcagttcgcgaagggcgattaaggggggagcggagccctggagagttgcattgtgctccatcggaattcttcatgctgttcgacacaaatagcgatggcctcatctcctttgccgagtacatcttttttgtgacattgctcagcattcccgagtcaaatttcagtgcggctttcaaaatgttcgacgttgaccatagcgggctgatcgacaaagaggagtttaagaaaataatggcactgatgcggtcttttaatagacaaggagccacccataaggatggcttacgtattggacttaaagttggccagcctgtggaaaatggtggagtggttgagttcttctttggtaacgatggaaatgaacctctacactatgataagtttacaaaatttttgaaggacttgcatgacgagattattcgtctggagttcagtcattacgatgtcaaatcatctaaaactataccagcaaaggattttgccttgtccatggttgcttctgctgacatgaatcacatcagcatgctgcttgatagagttgatgatttggtcaataagcctgatctgaaggacatacgcatatcttttgaggagtttaaggcgtttgcttatttgcgccgaagattggagccactatcgatggccatcttcgcatatgggaaagtgaatggattgttgacaaaacaggatctaaaacgtgcggcgcagcatgtttgcggggttgacttaactgatagaatggtggacatcattttccatgtgttcgacacaaatcaggatgggaacctgagcttggaagagttcttaagagcattacaaagacgagaaactgatattcgtcaaccaacaatacctggtcctttggggttcctgtcttgctggttcggtggtaggaagtgttcttcacttcgacagatgttgttctgattggttccctctacgagcctcaatataaatgtcatgtgccttttgattgtcatgtcgtggtggagaagataaccgccaagtagtgcactgatgctgaccgttgaaacgatttagctgtaaatatcgtctgggtgggcctagtaactgtaaatagtcttgttttgtgtgtcgtctaagggtctaaggaccgagaatacgttgtgctattctcatcccatatgtaaattgaaccccatatgaccttaagaagtcattgtcaaaggtcttcccttttcacgtgcatattttagttggaatgttttctctgcttttacctgaagagaatacagaatatacgctcttacaggaaataaacgcctaatcaaatccaccatcaacaa

SEQ ID NO: 6014 - DNA, 1863 bp, Zea mays
cctccttctccttttcttcccttcgctgctctgcgcctacgtacgccggtacgcattgccgcctcctccccctctttccagtcccgacccgcagcgggcctaatcctcgtcttcctcccgtaaaccacctcgtccctatccgcagcaaccgttcgccgcgccgcgaggcccgctgatcccaccgacctccaccgctatggctcctctgtcccgcgcggctcgcctccttcgatgcgccgtcgggcggctgaggttgccgccgccggcccgggccttctccagcgccgcggcggcgaccgagacgggggcggggaacggacgcgaggccgtgatcgccgctgctgccgtggcgatggccgggtccgggcttgggctgtggctgaaaccgccgtcgcttgccgactccggcgaggcgcccggcggtcagatctcggtcacctgcgctgcttccacggaggcgcaggaggagaaggggaggttcctgttcgcagactcattccgcagaagagtattctttaactatgagaagaggatacggcttctcagccctcctgagaagatatttgagtactttgcttctgtgaggaacccagaaggggaagtttacatgttgcctggggacttgatgagagcagtagtccctgtttttcctccatcagagtccaccatagttcgtgaaggaagattaagaggggagcggagccctggagagttgcattgtgctccatcggagttctttatgctgttagacactaatagtgacggtctcatctcctttgccgagtacatcttttttgtgacattgctcagcattcctgagtcacatttcactgcggccttcaaaatgtttgacgttgaccacagtggggtgatagacagagaagagtttaagaaagtaatgtcactgatgcggtcctttaacagacaagggtccactcataaggatggtttacgtattggacttaaagttggccagcctgtggagaatggtggggtggttgagtacttctttgggagtgatgggaacgagcctctacactgtgtcaggttctcaaattttttgaaggagttgcatgacgagattattcgattggagtttagtcattatgatgtcaagtcgtctaaaactataccagcaaaggattttgcattgtccatggttgcttctgctgacatgaaccatatcaacaagctgcttgatagagctgatggtttggtcaaggagccagatctgaaggacatacgcatcacctttgaggagtttaaggcatttgctgacttgcgacaaagattggagccactgtcgatggctatctttgctcatgggaaagtgaatggattattgacaaaggaggatctaaaacgtgcaacacaacatgtttgtggtgtcaacttaactgatagagtggtagacatcattttccatgtgttcgacacaaatcaggatgggaacctgagctcggaagagttcttaagagcattagaaagaagagaaactgctattcgtcaaccaacaataccaggtccatggggttttttgtcttgctggttcagtggtaggaagtgttcacttaaacaggtggtgctctgatttggcccctacttgatcctcactgaatctgtcatccaccttcaattgtcatctcccgttgcaggaggtaatcacgaagcagtgcctagctgatcggtaaaacgactttgttgtacatgtcgtctccgagtccgaagcttgcctagcagtagcagctgtaattgtaagtagtgtcagccctaggactgaaccttgtgttattctcatatgtaaatcaaaccccatacgatttaaatatatgatatctgttggcgttgactggacgtcaatca

SEQ ID NO: 6015 - DNA, 1936 bp, Zea mays
ctgactccacagtccacaccaccaccacacccaggcttccacttgccgccgcgcccgcgcctccccctcattttctccccctccactgctttgcgcctacgcatcgccgccccgcctctagttctctctgtcctcgtcttcctactgtaaaccacctcgtccctatccgcggcaaccgttcaccgcgccgcgaggcctgctgatccgaccgaccttccaccgtcatggctcccctgcgccgcgcgtctcgcctccttcgatcagccgtctgccggctgaggtctccagcgccggctcgggccttctccagcgccgcggcgaccgagacgggtgccgtgatcgccgccgctgccgtggcggtggccagctccgggctcgggctgtggctgaaaccgccgtcgcttgccgactccggcgaggcgcccggcgaccagatctcggtcgcctgtgccggcgccacggaggcgcgggaggagaaggggtggttcctgttcgcagactcatttcgtagaagggtcttcttcaactacgagaagaggatacggcttctcagtcctcctgagaagatttttgagtactttgcgtctgtgaggaatcgagaaggggaagtttacatgttgcctgctgacttgatgagagcagtagtccctgtttttcctccatcagagtccacggtagttcgtgaaggaagattaaggggggagcggagccctggagaattgcactgtgctccatcagagttctttatgcagttcgacacaaataatgatggcctcatctcctttgctgagtacattttttttgtgacattgctcagcattcatgagtcaaatttcactgtggccttcaaaatgttcgacattgaccacattaatttatctcgccaagaaaaaagacctgctcgttatgagcatgttcaatcatctgacttgtttgttgatggtaaaagaaggggtgatagacagagaagagtttaagaaaataatggcactgatgcggtcctttaacagacaagggtcgactcataaggatggtttacgtattggacttaaagttggcaagcctgtggaaaatggtggggtggtcgagtacttctttgggagtgatgggaatgaacctctacactttgacaagttttctaaaattttgaaggaattgcatgatgagattattcaactggagttcagtcattatgatgtcaaatcgtctaaaacaataccagcaaaggattttgcattgtccatggttgcttctgctgacatgaaccatatcaacaagctgcttgatagagttgatagtttggtcaaggagccagatctgaaggacatacgcatcacctttgaggagtttaaggcatttgctgatttgcgacgaagattggagccactgtcgatggctatctttgcttacggtaaattgaatgggttattgacgaaggaggatctaaaacgtgcagcgcaacatgtttgcggggtcgacttaacagatagagtagtagacatcattttccatgtgttcgacacaaatcaggatgggaacttgagcccagaagagttcttaagagcgttacaaagaagagaaactgatattcgtgaaccaacaataccaggtccattggggttcttgtcttgctggttcagtggtaggaagtgttcttcactaaaacatgtggttatctgattgagcccctatttgatcctcacggcgcagaaggtaatcaccaagcagtgcattgctgatcgttacaacggacttcactgtatgtcgtcttggtggccgaagcttgactagcagtaacagctctaattgtaaatcgtgtcttctgtagccctaggactgagtgatatacatcgttattctcacgtgtaaattaaaccccatatggccatatggcttcaatatatgaaacattgtcatttagctttatttttagttg

SEQ ID NO: 6016 - DNA, 1404 bp, Panicum virgatum
ctcctcgcgccgttctttttggggttcccctgtccctgtccccgccgccggcacgagatggaggtcgcccccgccgccgccaagcagaagacgaagaagcacatacacctcttctactgctccgaatgcgaggagcttgcgctcaagatcgccgccagctccgacgcgatcgagctccagtccatcaactggcggagcttcgatgacgggttcccgaacctgttcatcaacaaggcgcacgacatccgggggcagcacgtggcgttcctggcctccttcagctcgccggcggtaatcttcgagcagatctccgtcatcttcgcgcttcccaagctcttcatcgcctccttcacgctcgtgctgcccttcttccccacgggctccttcgagcgcgtcgaggaggaaggggacgtcgccaccgccttcaccctcgcgcgcatcctctccatggtccccaagtcgcgcggtggacctaccagcgtcgtcatctacgacatccacgcgctccaggagaggttctacttcggggacgacgtcctgccatgcttcgagacagggatcccgctcctgctgcagcgcctccgccagctcccggacgcagacaatattacaattgccttcccagatgatggggcgtggaagcggttccacaagctcttgcaacactttccaatgatagtctgtaacaaggttcgtgaaggcgacaagagaatagttcgaataaaggaaggaaatcctgaagggcgacatgttgttattgttgacgatttagtgcaatctgggggaactcttagagagtgccagaaagttctggcttcacatggtgctgcaaaagttagtgcttatgtgactcatgctgtgttccctaagcaatcatatgaacgtttcatgacatctaattctgctgggccaggtgaccagtttgcttacttctggatcacggactcatgccctcacacagtgaaagccattgggcaaagacctccatttgaggtgctgagccttgctggctcaattgcggatgctcttcagatatgagcttgcactggtagatgggcttgaattgcccatcagattgaacttgtgctaggagatgggctgctcctgtttgaccggactttacggtttctggaaaacaaataatgtggagcaagtttactgtggaaagacctgaagcttaaggttccataaacagccctgtggtgtgataataaaatcaggagttggatgttgaaatctgtgaatttttttagtgttaactcagtttcaagggagcaatatacgtctcgactcttgagtgctgtatcctaagctttcagttaacgggcgttgctgtgaacaattagattggcgcaaataactgatcatgtgaatcattgcaatgaaaacctcctggttgccctg

SEQ ID NO: 6017 - DNA, 1251 bp, Saccharum officinarum
cgcgccgttctttttggttcccctgtccccgccgccgccgaaacccaccgatggaggtcgtcggcgccgcgaagcagaaggcgaagaagcacgagaagcacatacacctcttctactgctccgaatgcgaggagctcgccctcaaggtcgccgccagctccgacgctatcgagctccagtccatcaactggcggagcttcgatgacgggttcccgaacctgttcatcaacaaggcccacgacatccgcgggcagcacgtggcgttcctggcctccttcagctcgccggcggtcatattcgagcagatctccgtcatcttcgcgctgcccaagctcttcatcgcctcattcacgctcgtgctgcccttcttccccacgggctccttcgagcgcgttgaggaggagggcgatgtcgccaccgccttcaccctcgcgcgcatcctctccatgatccccaagtcgcgcggcgggccgaccagcgtcgtcatctacgacatccacgcgctccaggagaggttctacttcggtgacgacgtcctgccatgctttgagacagggattccgctcctgctgcagcgcctccgccagctccctgacgcagaaaatatcaccattgcctttccagatgatggagcgtggaagcggttccacaagctgttgcagcactttccaatgatagtctgtaacaaggttcgtgaaggtgacaagagaatagttcgtataaaggaaggaaatcctgaaggccgtcatgttgttattgttgatgatttagtgcaatctgggggaactcttcgagaatgccagaaagttctagcttcgcatggcgctgcaaaagttagtgcttatgtgactcatgctgtgttccctgagcgctcatatgaacgtttcatgtcgtcgaattctgctgggccaggcgaccagtttgcttacttctggatcacggactcatgcccacacacagtaaaagctattggccaaagacctccatttgaggttctgagccttgctggctcaattgctgatgctcttcagatctgagtgtacactggtagatgggcttgaatcgtggatgcccatcagattgaacttgtactatgagatgagctgctcctgcttttcctaaatgtaagagtttgtttccagttcctggaaaagcaaataatgtggagtaagttaagtacctgaaggttccataaacagcactgtgaattgataataaaatcaggcattggatactcaaaaaaaaaaaaaa

SEQ ID NO: 6018 - DNA, 1431 bp, Zea mays
ccgacatcaaaactgttccgtcgaagcagagcccgccccttcccgcgccgttctttttggttcccctgtccccgccgctgccgaaaaaccgccgatggaggtcgtcgccgccgcgaagcagaaggcgaagaagcatatacacctcttctactgctccgaatgcgaggagctcgctctcaaggtcgccgccagctccgacgtcatcgagctccagtctatcaactggcggagcttcgacgacgggttcccgaacctgttcatcaacaaggcccacgacatccgggggcagcacgtggcgttcctggcctccttcagctcgccggcggtcatattcgagcaggtctccgtcatcttcgcgctgcccaagctcttcatcgcctcgttcacgctcgtgctgcccttcttccccacgggctccttcgagcgcgtcgaggaggagggcgacgtcgccaccgccttcaccctcgcgcacatcctctccatgatccccaagtcgcgcggcgggcccaccagcgtcgtcatctacgacatccacgccctccaggagaggttctacttcggggacgacgtcctgccatgcttcgagacggggatcccgctcctgctgcagcgcctccgccagctcccggacgcagagaatatcaccattgcctttccagatgatggagcgtggaagcggttccacaagctgttgcagcactttccaatgatagtctgtaacaaggttcgtgaaggtgacaagagaatagttcgtataaaggaaggaaatcctgaaggccgtcatgttgttattgttgatgatttagtgcaatctgggggaactcttagagaatgccagaaagttctagcttcacatggcgcttcaaaagtaagtgcttatgtgacccatgctgtgttccctaagcagtcatacgaaaatttcatggcgtctaactctgctgggccaggcgaccagctcgcttacttctggatcacggactcatgcccgcacacaataaaagccatcgggcaaagacctccgtttgaggttctgagccttgctggctcgattgctgacgctcttcagatatgagcgcgtacactgactggtagacggggggcttgaaccgtgggatgcccgtcagatcgagaacttgtaccgtgagatgagctgctcctgctttttttccctaaatgtaggagtttgttccggttccttgaaaaaagcaaataatgtggagcaagttttaagtacctgaaggttccacaaacagcgctgtgaattgatgataaaatcaggcattgggatactcacatctgtgtgtacttactgtcgatgctcgcttccgtttgaagttcgcgagaccagtgcttctttcctgagtcctgaccctatgttggagtaccgttgccgtgcattcaacagaggccagtgcttctttcctgtgtcaa

SEQ ID NO: 6019 - DNA, 1716 bp, Setaria italica
gtcgccttcagccggcggcgcgctccatgccgaatccttctcggcgtagcatatccccgcgccgtcgcgtcctcctataaattgcaacatcttcttccaaaattcgcttgcctcgccgtttccgtgttcacatcacgggccgtttccggttcgtagtgcggctggggtctagggtttagagcggtaggctcccccaaaaaaaagtcgagggaaattattcgccgccctgcccgcttcgcgtctcgataaagccgacaccacctgtcccgtcagagcagagcccgcccctccccgcgccgttctttctgggattcccctgtcccggccgccgccgcggagacccgccggcacgagatggaagtcgccaccgccgccgccgccgccaagcagaagccgaagaagcacatacacctcttctactgctccgaatgcgaggagctcgccctcaagattgccgccagctctgacgccatcgagctccagtccatcaactggcggagcttcgatgacggtttcccgaacctgttcatcaacaaggcgcacgacatccgggggcagcacgtggcgttcctggcctccttcagctcgccggcggtaatcttcgagcagatctccgtcatattcgcgctgcccaagctcttcatcgcctccttcaccctcgtgctgcccttcttccccacgggctcctttgagcgcgttgaggaggaaggggacgtcgccaccgcgttcaccctcgcgcgcatcctctccatgatccccaagtcgcgcggtggaccgactagtgtcgtcatctacgacatccacgcgctccaggagaggttctactttggggacgacgtcttgccgtgcttcgagacagggatcccgctcctgctgcagcgcctccgccagctcccggacgcagacaatatcaccattgccttcccagatgatggggcttggaagcggttccacaagatgttgcaacactttccaatgatagtctgtaataaggttcgtgaaggcgacaagagaatagttcgaataaaggaaggaaatcctgaagggcgccatgttgttattgttgatgatctagtgcaatctgggggaactcttagagaatgccagaaagctctggcttcacatggtgctgcaaaagttagcgcttatgtgactcatgctgtgttccctaagcaatcatatgaacgtttcatgacgtctaattctgctgggccaggcgatcagtttgcttacttctggatcacggactcatgccctcacacagtgaaagccattggccaaagacctccatttgaggtgctgagccttgctggctcgattgcggatgctcttcagatatgagcttggaccggtagaggggtttgaattgcccatcatattaaaagggtactaggagatgggctgctcctgttttacctaaatgtaagagttcattccagtttctggaaaacaaataatgtggagtaagtttgctgtggaagtatctgaaggttccataaacagccctgtgatgtgataataaaatcaggctttggatgttcacatctgtgtatttctcagtgttaacttctgtttcaagggcgcaagatcggtgctttagttccctgatctgtctgagtactttagcctaagctttcagttactagggctttgttgtgaactacaaaattgcttcaatatacctgagcttcaactgaattaatgaatttctatcag

SEQ ID NO: 6020 - DNA, 1590 bp, Pennisetum glaucum
gggaatcccagaaagaacggcgcggggaggggcggtccctgctttgacgggacaggtgggggtctagggtttatagcggtaggctcccccaaaaagaatcgagggaaattcgccgccctgccccgcttcgcgtttcgataaagccgacacccacctgtcccgtcagagcagagaccgcccctccccgcgccgttctttctgggattcccctgtcccggccgccgccgccgccgcggagacccgccggcacgagatggaggtcacccccaccgccgccgccgccaagcagaagccgaagaagcacatacacctcttctactgctcggaatgcgaggagctcgccctcaagatcgccgccagctccgacgccatcgagctccagtccatcaattggcggagcttcgatgacgggttcccgaacctgttcatcaacaaggcgcacgacatccgggggcagcacgtggcgttccttgcctccttcagctcgccggcggtgatcttcgagcagatctccgtcatcttcgcgctgcccaagctcttcatcgcctcattcacgctcgtgctgcctttcttccccacgggctccttcgagcgcgttgaggaggaaggggacgtcgccaccgccttcaccctcgcgcgcatcctctccatgatccccaagtcgcgcggcggcccgaccagcgttgtcatctacgacatccacgcgctccaggagaggttctactttggggacgacgtcctgccctgcttcgagacagggatcccgctcctgctgcagcgcctccgccagctcccagacgcagacaatatcaccattgccttcccagatgatggggcgtggaagcggttccacaagatgttgcaacactttccaatgatagtctgtaacaaggttcgcgaaggcgacaagagaatagttcggataaaggaaggaaatcctgaagggcgccatgttgttattgttgatgatttagtgcagtctggaggaactcttagagaatgccagaaagttctggcttcacatggcgctgcaaaagtcagcgcttatgtgactcatgctgtgttccctaagcaatcgtatgaacgtttcatgacatctaattctgctgggccaggcgaccagtttgcttacttctggatcacagactcatgccctcagacagtgaaagccattggacaaagttctccatttgaggtgctgagccttgctggctcgattgcggatgctcttcagatatgagcttgcaccggtagatgggtttgaattgcccatcatattgaacttgtactatgagatgggctgctcctgttttacctaaatgcaagcaaataatgtggagtaagttgcggcggaagtacctgtaggttccatcaacagcactgtgatgaataaaaacaggcagtggatgttcacatatgtggattcctcagtgttaaacttctgtttcaagggtgcaagatcagtacttagtttccttgcctatttgattacgttagcgcaagctttcagctttgttgtgacctgcaaaattgctgcaatatacctgagcttcaagccgtcaacctaattaatgaatttccatccagtgc

SEQ ID NO: 6021 - DNA, 1593 bp, Sorghum bicolor
ccccactttgttcgcctcgccgtattttcacatcgcgggcctctttttgtttctctagcgcgtcgcggctggggtctagggtttaggctcccaaaagccaaaaatcaaggagaaatattcgcagcggcagcgcgtctcgataaaagccggcatcaactgttccgtcaaagcagagtccacccctccccgcgccgttctttttggttcccctgtccccgccgcctccgaaacccaccgatggaggtcgtcgccgccgccgccgccgccgcgaagcagaagacgaagaagcacgagaagcacatacacctcttctactgctccgaatgtgaggagctcgccctcaaggtcgccgccagctccgacgccatcgagctccagtccatcaactggcggagcttcgacgacggcttcccgaacctgttcatcaacaaggcccacgacatccgggggcagcacgtggcgttcctggcctcattcagctcgccggcggtcatattcgagcagatctccgtcatcttcgcgctgcccaagctcttcatctcctcattcacgctcgtgctgcccttcttccccacgggctccttcgagcgcgttgaggaggagggcgatgtcgccaccgcgttcaccctcgcgcgcatcctctcgatgatccccaagtcgcgcggcgggccgacaagtgtcgtcatctacgacatccacgcgctccaggagaggttctacttcggggacgacgtcctgccatgcttcgagacagggatcccgctcctgctgcagcgcctccgccagctgccggacgcaaaaaatatcaccattgcctttccagatgatggagcgtggaagcggttccacaagctgttgcagcactttccaatgatagtctgtaacaaggttcgtgaaggtgacaagagaatagtccgtataaaggaaggaaatcctgaaggccgtcatgttgttattgttgatgatttagtgcaatctgggggaactcttcgagaatgccagaaagttctagcttcgcaaggcgctgcaaaagttagtgcttatgtgactcatgctgtgttccctaagcggtcatatgaacgtttcatggcgtctaattctgttgggccaggcgaccagtttgcttacttctggatcacggactcatgcccacacacagtaaaagctattggccaaagacctccatttgaggttctgagccttgctggctcaattgctgatgctcttcagatctgagcgtacacaggtagatatgggctgatgcccatcacaatcagattgaacttgtactatgagatgagctgctgctgctttttctaaatgtaagagtttgtttccagttcctggaaaagcaaataatgtggagtaagttaagtacctgagggttccgtaaacagcactgtgaattgataataaaatcaggcattggatactcagttgttgacatctgtgtatttgtcaatattcacttctgtttgaagttcgcgagatgagtgcttctttcctgacctgttgtaccgtttagcgacttcggatactgagctttgttgtgaacaactaaatagtgcaatgtaactgagcttcaacccaatt

SEQ ID NO: 6022 - DNA, 1585 bp, Brachypodium distachyon
ggcggcggcgcactccatgccgaatcatgccgcccctgatcaaacagtcttgtccataaaaatcgcactgtcttcttccccagttcgctcgcccctctgctctgccttcaaccccacaaccaatcacacattaccaattttaatctcctaccctattgccatcacgggccgattcgtagcgcggtgggtctagggtttagagcagtagtacttggaacgaaaagaggggggaatcaatactcgaaaaatctcaatagaagccgatacccagaggagcctcttcccacgccgttctttcctgggttcccctcgcgccgctcccctgtccgcgccgccgccgccgccgccgggacgagatggaggtggccgctcctgccccgaagcacaaggtgaagaagcagataaacctcttctactgcgccgagtgcgaggagctcgccctcaaggtcgccgccagctccgacgccatccagctccagtccatcaactggaggaacttccccgatgggttcccgaacctgttcatcaacaacgcgcacgacatccgggggcagcacgtggcgttcctggcgtccttcagctcgccggcggtcatcttcgagcagatctccgtcatcttcgcgctgcccaagctcttcatcgcctccttcacgctcgtgctgcccttcttccccacggggtccttcgagcgcgtcgaggaggaaggtgacgtcgctaccgccttcacgctcgcgcgcgtcctctccatgatccccaagtcccgcggcgggccgaccagcgtcgtcatctacgacatccacgcgctccaggagaggttctactttggggacgacgtcctgccctgcttcgagaccgggataccgctcctgctgcagcgcctccgccaactcccggacgccgaaaatatcacaattgccttcccagatgatggggcgtggaagcgcttccacaagctattggtcaactttccaatggttgtctgtgcgaaggttcgtgaaggcgacaagaggatagttcggattaaagaagggaatcctgaagggcgacatgttgttattgtcgatgatttagtgcaatctggaggaactcttagagaatgccagaaagttttggctgctcatggtgctgcaaaagttagtgcctatgtgactcatgccgtgttccccaatcagtcatatgaacggttcatgactgctaattctgctggaccaggcgaccagtttgcttacttctggataacagattcgtgccctcagacagtgaaagccattagtcgacattctccatttgaggtgttgagccttgcgggctcgattgctgatgcccttcagatatgaacttgcaatgtgagatgggctggtcccatatgtaagaggagttcatttccagctccagcaaaacaaataatgtggagctagtttatctaattatgttgaatctgaagcctccataaactgccccaagacgtgatgaaataaaacctggcattattgcagtgctctcgctattctctttttgagcaagtggtcttgatcagtgttttagtttctactaatgccctgaaacttgagtgctgcatttggtt

SEQ ID NO: 6023 - DNA, 1143 bp, Cenchrus ciliaris
  misc_feature (417)..(417): n is a, c, g, or t
  misc_feature (436)..(436): n is a, c, g, or t
gaggagctcgccctcaagattgccgccagctccgacgccatcgagctccagtccatcaactggcggaacttcgatgacgggttcccgaacctgttcatcaacaaggcgcacgacatccgggggcagcacgtggcgttcctggcctccttcagctctccggcggtgatcttcgagcagatctccgtcatcttcgcgctgcccaagctcttcatcgcctcattcacgctcgtgctgcctttcttccccaccggctccttcgagcgcgttgaggaggaaggggacgtcgccaccgcgttcaccctcgcgcgcatcctctccatgatacccaagtcgcgcggcggcccgaccagcgtcgtcatctacgacatccacgcgctccaggagaggttctacttcggggacgacgtcctgccgtgnttcgagacagggatccccntcctgctgcagcgcctccgccagctcccggacgcagacaatatcaccattgccttcccagatgatggggcgtggaagcggtttcacaagatgttgcaacactttccaatgatagtctgtaacaaggttcgtgaaggtgacaagagaatagttcggataaaggaaggaaatcctgaagggcgccatgttgttattgttgatgatttagtgcagtctggaggaactcttagagaatgccagaaagttctggcttcacatggtgctgcaaaagttagtgcttatgtgactcatgctgtgttccctaagcaatcatatgaacgtttcatgacatctaattctgctgggccaggcgaccagtttgcttacttctggatcacggactcatgccctcagacagtgaaagccattggccaaagttctccatttgaggtgctgagccttgctggctcgattgcagatgctcttcagatataagcttgcatcggtagatgggtttgaattgcccatcatattaaacttgtactaggagatgggctgctcccgttttacctaaatgtaagagttcattccagtttctggaaaacaaataatgtggagtaagtttgctgtggaagtacctgaaggttccatcaacagcactgtgatgtgataataaaatcaggcgttggatgttcacatctgtggattcctcagtaagggtacaagata

SEQ ID NO: 6024 - DNA, 1456 bp, Leymus cinereus x Leymus triticoides
  misc_feature (109)..(109): n is a, c, g, or t
  misc_feature (111)..(111): n is a, c, g, or t
  misc_feature (113)..(113): n is a, c, g, or t
  misc_feature (118)..(118): n is a, c, g, or t
  misc_feature (120)..(120): n is a, c, g, or t
  misc_feature (125)..(126): n is a, c, g, or t
  misc_feature (129)..(129): n is a, c, g, or t
  misc_feature (134)..(135): n is a, c, g, or t
  misc_feature (137)..(137): n is a, c, g, or t
  misc_feature (140)..(140): n is a, c, g, or t
  misc_feature (143)..(143): n is a, c, g, or t
  misc_feature (167)..(167): n is a, c, g, or t
  misc_feature (206)..(206): n is a, c, g, or t
  misc_feature (368)..(368): n is a, c, g, or t
  misc_feature (393)..(393): n is a, c, g, or t
  misc_feature (467)..(467): n is a, c, g, or t
  misc_feature (483)..(483): n is a, c, g, or t
  misc_feature (524)..(524): n is a, c, g, or t
  misc_feature (540)..(540): n is a, c, g, or t
  misc_feature (569)..(569): n is a, c, g, or t
  misc_feature (620)..(620): n is a, c, g, or t
  misc_feature (629)..(629): n is a, c, g, or t
  misc_feature (708)..(708): n is a, c, g, or t
  misc_feature (710)..(710): n is a, c, g, or t
  misc_feature (815)..(815): n is a, c, g, or t
cgaatccatactcccggacgacctgcttggctgcgcgcgtctcgataccaccgaccccgtcaccgtcagagcctcttcccacgcgccgaaccggccgctcccctgtccncncntccgncnccgcnnccnccgcnncngcntgncgggacgagatggaggtcgccgcngccgccgccgtcccgaggcacaaggtgaagaagcagatnaacctcttctactgcgccgagtgcgaggagctcgccctcaaggtcgccgccgcctccgacgccatccagctccagtccatcaactggaggaacttccccgacgggttcccgaacctgttcatcaacaacgcgcacgacatccgggggcagcacgtcgccttnctcgcctccttcagctcgccggcgntcatcttcgagcagatctccgtcatcttcgcgctgcccaagctcttcatcgcctccttcacgctcgtgctgccnttcttccccacgggcnccttcgagcgcgtcgaggaggagggcgacgtcgccaccgcnttcacgctcgcgcgcntcctctccatgatccccaagtcgcgcggngggcccaccagcgtcgtcatctacgacatccacgcgctccaggagaggttntactttggngacgacgtcctgccctgcttcgagaccgggataccgctcctgctgcagcgcctcagccagctccccgacgccgacaatntnaccattgccttcccagatgatggggcgtggaagcgcttccacaagtcgttggccaacttcccagtggttgtctgtgcgaaggttcgtgaaggcgacaagaggatngttcggattaaagaagggaaccctgaagggcgacatgtcgttattgttgatgatttagtgcaatctggtggaactcttagagaatgccagaaagttctggcttctcagggtgctgcaaaagttagtgcctatgtgactcatgctgtgtttcccaatcagtcgtatgaacggttcatgaccgctaattctgctgggccaggtgaccagtttgcttacttctggatcacggattcgtgccctcagacggtgaaagccatcagccaaaaacctccatttgaggtgttgagccttgctacctcgattgctgatgcccttcagatatgaacatggactatgaaatgggctgctcctgaatgtagagcttacatttccagctccagcaaaacaaataatgtggagcgagttcgagttatctaattgtgtcgagtctgaagctttcataagcagcccatggtttgataataaaacaaggcattggatattcatccatgcggttctctgtattcgcttctaatgctctagaccagtccggtgttttaatttcctgacatgacatgacatgtacgaaggctgaaacctgagcgtttgcatttgattgaaattatcttgaaattctaggtcaggtttcgacctcctgctca

SEQ ID NO: 6025 - DNA, 1580 bp, Hordeum vulgare
tcgatactcccggtcccggacgacctgcttgtgcttggccgcgcgcgtctcgataccacctaccccgtcgccgtcagagcctctccccacgcgccgctcccctgtccccgcgtccgccgccgcctgctgctgccgggacgagatggaggtcgccgccgccgtcgccgtcccgaggcacaaggtgaagaagcagattaacctcttctactgcgccgagtgcgaggagctcgccctcaaggtcgccgccgcctccgacgccatccagctccagtccatcaactggaggaacttccccgacgggttcccgaacctcttcatcaacaacgcgcacgacatccgggggcagcacgtggccttcctcgcctccttcagctcgccggcgatcatcttcgagcagatctccgtcatcttcgcgctgcccaagctcttcatcgcctccttcacgctcgtgctgcccttcttccccacgggcaccttcgagcgcgtcgaggaggagggcgacgtcgccaccgcattcacgctcgcgcgcatcctctccatgatcccaaagtcgcgcggcgggcccaccagcgtcgtcatctacgacatccacgcgctccaggagaggttctacttcggggacgacgtcctgccctgcttcgagaccgggataccgctcctgctgcagcgcctcagccagcttcccgacgccgacaatgtcaccattgccttcccggatgatggggcgtggaagcgcttccacaagtcgttggccaacttcccagtggttgtctgtgcgaaggtccgtgaaggcgacaagaggatagtccggattaaagaagggaaccctgaagggcgacatgtcgttattgttgatgatttagttcaatctggtggaactcttagagagtgccagaaagttctggctgctcatggtgctacaaaagttagcgcctatgtaactcatgctgtgttccccaatcagtcatatgaacgcttcatgactgctaattctgctgagccaggtgaccagtttgcttacttctggatcacggattcatgccctcaaacggtgaaagccatcagccaacaacctccatttgaggtgttgagccttgctagctcgatcgctgatgcccttcagatatgaacatggactgtgaaatgggctgctcctgaatgtagagcttacatttccagctccagcagaacaaataatgtggagcgagttcgggttgtctaattgtgtcgagtctgaagcttttcataagcagcccatggtttgataataaaacaaggcattggatattcacctgtacggtcctctgtattcgcttctaatgctctagaccaggtcggtgttttaatttcctgacatggcatgacatgtacgaaacctgagcgtttgcattcgattgaaattgtaggtcaggtttcgacctcgtgcttaccgaattttcatcatattggcctaataggatacatcaatcgacacctgttatcttattattttcttccatcttttgctctttgaaagataaagccctttggatgtttacagttaggtgtgatgcacggaatgagagcagtgtttgtccgga

SEQ ID NO: 6026 - DNA, 1615 bp, Triticum aestivum
cgtattggactggcgccgcggctgggggtctagggtttagccgggcggcaataattgggaggccgaaaggagaatcaaatcgatactcccggccccggacgacctgcttggctgcgcgcgtctcgataccacctaccccgtcgccgtcagagcctcttcccacgcgccgctcccctgtccccgcacccgccgccgccgccgccgccgcctgccgggacgagatggaggtcgctgccgccgccgccgccgtcgccgtcccgaggcacaaggtgaagaagcagattaacctcttctactgcgccgagtgcgaggagctcgccctcaaggtcgccgccgcctccgacgccatccagctccagtccatcaactggaggaacttccccgacgggttcccgaacctcttcatcaacaacgcgcacgacatccgggggcagcacgtcgccttcctcgcctccttcagctcgccggcgatcatcttcgagcagatctccgtcatcttcgcgctgcccaagctcttcatcgcctccttcacgctcgtgctgcccttcttccccacgggcaccttcgagcgcgtcgaggaggagggcgacgtcgccaccgccttcacgctcgcgcgcatcctctccatgatccccaagtcgcgcggcgggcccaccagcgtcgtcatctacgacatccacgcgctccaggagaggttctacttcggggacgacgtcctgccctgcttcgagaccggcataccactcctgctgcagcgcctcagccagctccccgacgccgacaatgtcaccattgccttcccagatgatggggcgtggaagcgcttccacaagtcgttggccaacttcccggtggttgtctgtgcgaaggtccgtgaaggcgacaagaggatagtccggattaaagaagggaaccctgaagggcgacatgtcgttattgttgatgatttagtgcaatctggtggaactcttagagagtgccagaaagttctggctgctcatggtgctacaaaagttagcgcctatgtaactcatgctgtgttccccaatcagtcatatgaacgcttcatgactgctaattctgctgggccaggtgaccagtttgcttacttctggatcacggattcgtgccctcagacggtgaaagccatcagccaacaacctccatttgaggtgttgagccttgctagctcgatcgctgatgcccttcagatatgaacatggactgtgaaatgggctgctcctgaatgtagagcttacatttccagctccagcgaaacaaataatgtggagcgagttcgagttatctaattgtgtctagtctgaagctttcataagcagcccatggtttgataataaaacaggcattggatattcatccgtgcggttccctgtatttcgcttctaatgctgtagaccggtccggtgttttaatttcctgacatgacatgtatgaaggctgaaaacctgagcgtttaaatttggttgaaattctaggtcaggtgttttaatttactgaattttcatcatattggcgtgataggatacatcaatcggaaaatgttatcttattatttgcttcctttttctgctctttgaaagataaaaaaaaaaaa

SEQ ID NO: 6027 - DNA, 1750 bp, Triticum aestivum
actcgtattggcctggcgccgcggctgggggtctagggtttagccgggcggcaataattgggaggccgagaggagaatcgaatcgatactcccggccccggacgacctgcttggctgcgcgcgtctcgataccacctaccccgtcgccgtcagagcctcttcccacgcgccgctcccctgtccccgcgcccgccgcagccgctgccgccccctgccgggacgagatggaggtcgccgccgccgccgccgccgtcgccgtcccgaggcacaaggtgaagaagcagattaacctcttctactgcgccgagtgcgaggagctcgccctcaaggtcgccgccgcctccgacgccatccagctccagtccatcaactggaggaacttcccggacgggttcccgaacctcttcatcaacaacgcgcacgacatccgggggcagcacgtggccttcctcgcctccttcagctcgccggcgatcatcttcgagcagatctccgtcatcttcgcgctgcccaagctcttcatcgcctccttcacgctcgtgctgcccttcttccccacgggcaccttcgagcgcgtcgaggaggagggcgacgtcgccaccgccttcacgctcgcgcgcatcctctccatgatccccaagtcgcgcggcgggcccaccagcgtcgtcatctacgacatccacgcgctccaggagaggttctacttcggggacgacgtcctgccctgcttcgagaccggcataccgctcctgctgcagcgcctcagccagctccccgacgccgacaatgtcaccattgccttcccagatgatggggcgtggaagcgcttccacaagtcgttggccaacttcccagtggttgtctgtgcgaaggtccgtgaaggcgacaagaggatagtccggattaaagaagggaaccctgaagggcgacatgtcgttattgttgatgatttagtgcaatctggtggaactcttagagagtgccagaaagttctggctgctcatggtgctacaaaagtcagcgcctatgtaactcatgctgtgttccccaatcagtcatatgaacgcttcatgactgctaattctgctgggccaggtgaccagtttgcttacttctggatcacggattcgtgccctcagacagtgaaagccatcagccaacaacctccatttgaggtgttgagccttgctagctcgattgctgatgcccttcagatatgaacatggactgtgaaatgggctgctcctgaatgtagagcttacatttccagctccagcgaaacaaataatgtggagcgagttcgagttatctaattgtgtctagtctgaagctttcataagcagcccatggtttgataataaaacaaggcattggatattcatccgtgcggttctctgtattcgcttctaatgctctagaccggtctagtgttttaatttcctgacatgacatgtacgaagtctgaaaaacctgagcgtttgcatttgattgaaattttaggtcaggtttcggcctcctgcgttttaatttactgaattttcatcatattggcgtgataggatacatcaatcggaaaatgttatcttattatttgcttcctttttctgctctttgaaagataaacccttcgggtgttacagttaatcgtgatgcggggagtgagagcaatgtttccaaggaatcgaagcaaatactgtgattattacaagaatagaaattaatttaacccttgtctgtgcggtccaagctc

SEQ ID NO: 6028 - DNA, 1794 bp, Hordeum vulgare
gtcgatttcgtccatggaaatatctaaattcgctgtcttcttccctgatgattcgctcgcctcgccttaaacccgaaccaatcccatgctaccaagtgccacggcggcaaacacgtactactactactactggccaggcgccgcggcggctgggggtctagggtttagccgggcggcaataattgggagggccaaaggagaatcgaatcgatactcccggtcccggacgacctgcttgtgcttggccgcgcgcgtctcgataccacctaccccgtcgccgtcagagcctctccccacgcgccgctcccctgtccccgcgtccgccgccgcctgctgctgccgggacgagatggaggccgccgccgccgtcgccgtcccgaggcacaaggtgaagaagcagattaacctcttctactgcgccgagtgcgaggagctcgccctcaaggtcgccgccgcctccgacgccatccagctccagtccatcaactggaggaacttccccgacgggttcccgaacctcttcatcaacaacgcgcacgacatccgggggcagcacgtggccttcctcgcctccttcagctccccggcgatcatcttcgagcagatctccgtcatcttcgcgctgcccaagctcttcatcgcctccttcacgctcgtgctgcccttcttccccacgggcaccttcgagcgcgtcgaggaggagggcgacgtcgccaccgcattcacgctcgcgcgcatcctctccatgatcccaaagtcgcgcggcgggcccaccagcgtcgtcatctacgacatccacgcgctccaggagaggttctacttcggggacgacgtcctgccctgcttcgagaccgggataccgctcctgctgcagcgcctcagccagcttcccgacgccgacaatgtcaccattgccttcccggatgatggggcgtggaagcgcttccacaagtcgttggccaatttcccagtggttgtctgtgcgaaggtccgtgaaggcgacaagaggatagtccggattaaagaagggaaccctgaagggcgacatgtcgttattgttgatgatttagttcaatctggtggaactcttagagagtgccagaaagttctggctgctcatggtgctacaaaagttagcgcctatgtaactcatgctgtgttccccaatcagtcatatgaacgcttcatgactgctaattctgctgagccaggtgaccagtttgcttacttctggatcacggattcatgccctcagacggtgaaagccatcagccaacaacctccatttgaggtgttgagccttgctagctcgatcgctgatgcccttcagatatgaacatggactgtgaaatgggctgctcctgaatgtagagcttacatttccagctccagcagaacaaataatgtggagcgagttcgggttgtctaattgtgtcgagtctgaagcttttcataagcagcccatggtttgataataaaacaaggcattggatattcacctgtacggtcctctgtattcgcttctaatgctctagaccaggtcggtgttttaatttcctgacatggcatgacatgtacgaaggctgaaacctgagtgtttgcattcgattgaaattgtaggtcaggtttcgacctcttgcttaccgaattttcatcatattggcctaataggatacatcaatcgacacctgttatcttattattttcttccatcttttgctctttgaaagataaagccctttggatgtttacagttaggtgtgatgcacggaatgagagcagtgtttgtaagga

SEQ ID NO: 6029 - DNA, 1580 bp, Secale cereale
ttaaacccagctagccccatacccccaacacggcacacacgtattgggcggctgggggtctagggtttagtcgggcagcaataattgggaagctgaaagcagaatcgaatcgatactcccggacgacctgcttggctgcgggcggctccatacaattaccacctaccccgtcagcgtcagggcgccgctcgcctctccccacgcgccgacccggccgctcccctgtccccgcatccgccgccgccgccgcctgccgggacgagatggaggttgctgccgccgccgccgccgtcgccgtcccgaggcacaaggtgaagaagcagattaacctcttctactgcgccgagtgcgaggagctcgccctcaaggtcgccgccgcctccgacgccatccagctccagtccatcaactggaggaacttccccgacgggttcccgaacctgttcatcaacaacgcgcacgacatccgggggcagcacgtcgccttcctcgcctccttcagctcgccggcgatcatcttcgagcagatctccgtcatcttcgcgctgcccaagctcttcatcgcctcctttacgctcgtgctgcccttcttccccacgggcaccttcgagcgcgtcgaggaggagggcgacgtcgccaccgccttcacgctcgcgcgcatcctctccatgatccccaagtcgcgcggcgggcccaccagcgtcgtcatctacgacatccacgcgctccaggagaggttctacttcggggacgacgtcctgccctgcttcgagaccgggatacccctcctgctgcaccgcctcagcctgctccccgacgccgacaatgtcaccattgccttcccagacgatggggcgtggaagcgcttccacaagtcgttggccaacttcccagtggttgtctgtgcgaaggttcgtgaaggcgacaagaggatagttcggattaaagaagggaaccctgaagggcgacatgtcgttattgttgacgatttagtgcaatctggtggaactcttagagaatgccagaaagttctggctgctcatggtgccacaaaagttagtgcctatgtgactcatgctgtgttccccaatcagtcatatgaacggttcatgaccgctaattctgctgggccaggtgaccagtttgcttacttctggatcaccgattcgtgccctcagacggtgaaagccatcagccaacaacctccatttgaggtgttgagccttgctagctcaattgctgatgcccttcagatatgaagatggactgtgaaatgggctgctcctgaatgtagagcttacattttcagctccagcgaaacaaataatctggagcaagttcaagttagctaattgtgtcgagtcttaagctttcataagcagtccatggtttgataataaaacaaggcattggatattcatccgtgcggttatctgtatttgcgtccagagcaaatgctctagaccagtagtgttttaattccctgacatgacatgtaccaaggccctgaaacctgagtgtttgcatgtgatcgagattatcttggaattttaggtcaggtttcgacctcctgcttactc

SEQ ID NO: 6030 - DNA, 1325 bp, Panicum virgatum
aggagcttcgatgacgggttcccgaacctgttcatcaacaaggcgcacgacatccgggggcagcacgtggcgttcctggcctccttcagctcgccggcggtgatcttcgagcagatctccgtcatcttcgcgctgcccaagctcttcatcgcctccttcacgctcgtgctgcccttcttccccacgggctccttcgagcgcgtcgaggaggaaggggacgtcgccaccgccttcaccctcgcgcgcatcctctccatggtccccaagtcgcgcggtggacctaccagcgtcgtcatctacgacatccacgcgctccaggagaggttctacttcggggacgacgtcctgccatgcttcgagacagggatcccgctcctgctgcagcgcctccgccagctcccggacgcagacaatattacaattgccttcccagatgatggggcgtggaagcggttccacaagctcttgcaacactttccaatgatagtctgtaacaaggttcgtgaaggcgacaagagaatagttcgaataaaggaaggaaatcctgaagggcgacatgttgttattgttgacgatttagtgcaatctgggggaactcttagagagtgccagaaagttctggcttcacatggtgctgcaaaagttagtgcttatgtgactcatgctgtgttccctaagcaatcatatgaacgtttcatgacatctaattctgctgggccaggtgaccagtttgcttacttctggatcacggactcatgtcctcacacagtgaaagccattgggcaaagacctccatttgaggtgctgagccttgctggctcaattgcggatgctcttcagatatgagcttgcactggtagatgggcttgaattgcccatcagattgaacttgtgctaggagatgggctgctcctgtttgaccggactttacggtttctggaaaacaaataatgtggagcaagtttactgtggaaagacctgaagcttaaggttccataaacagccctgtggtgtgataataaaatcaggagttggatgttgaaatctgtgaatttttttagtgtcaactcagtttcaagggagcaatatacgtctcgactcttgagtgctgtatcctaagctttcagttaacgggcgttgctgtgaacaattagattggcgcaaataactgatcatgtgaatcattgcaatgaaaacctcctggttgccctgaaatttactgttaagagggatgcaacgaggaatttggtatgtggggctagcctgcataaacagagctacccatgctcctgcctctttcttaaggtatccaagttatcgcaaaa

SEQ ID NO: 6031 - DNA, 1270 bp, Zingiber officinale
  misc_feature (546)..(546): n is a, c, g, or t
  misc_feature (562)..(562): n is a, c, g, or t
  misc_feature (761)..(761): n is a, c, g, or t
gcgaccttggcgtcggcggtggcgttgtgggcgatggctaagagagcgaacaagcaggtaaatctcttctactgcgccgagtgcgaggagctcgccaggaaagtggccgatcactccgacgccatccagctccggactatctcttggagaaactttgatgatggattcccaaatctcttcatcaacaatgcacatgacattagaggacaacatgttgctttcctagcctctttcagctcgccaggagtcatttttgagcagatatctgcaattttcgctttacctaaactatttattgcttctttcaccttggtattaccattctttccaactggctcttttgaacgggtggaagaagaaggtgatgttgctactgcatttacaatggcaagaatattatcaatgattccgaaatccagaggtggtccaacaagtgttgtcatctatgatatacatgctttgcaggaaagattttactttggtgatgatgtcttgccctgctttgaaactggtattcctttgctgttgcagcgcctacacaaactnccagatgcagagaatntcactatagcattcccagatgatggtgcatggaagcgatttcacaagctattgttgcatttcccaatggtggtctgtgcaaaggttcgtgagggtgacaaaagaatagttcgaattaaagaaggaaaccctgaaggccggcatgttgttattgttgatgatttggtacaatctggtgggacacttattgaatgccaganggtcttggctgcacatggtgctgggaaggtcagtgcgtacgtcactcatggcgtgttcccaaacaaatcgtgggagcgatttctgcacaagggatcagaataccaatttgctcacttttggataactgactcatgcccagtgacagtgaaggccattactgataagcctccttttgaggtcctcagccttgccggctcgattgctgatgcccttcagatctaaagttcaatcaaaaccctgccagattgtagttgcaggcttgtgatcttccaagtgttcaaatgaactgactttattttcatggaatgatcctcaataaatgattttcagatcagctgatctctgtatacgatgttcaagttctatcactgtttgcactctttagtagggtgaaaagatggtttcgccagttcgtccgagttgatttgatctttttttcccttcggatcgactaatgttgttgttgttcagaattaattgagagaaaatttctggctgttgcgacttt

SEQ ID NO: 6032 - DNA, 1993 bp, Musa acuminata
cagcccagccgtgcctcccagcgatggcggcggtccttttcgggcccggtatagtgctgtcaacactagaatctgctcaccaagtattcgatataatgacctgcttgctctaggcgctagatttgagacatttcttaccaggttttggtttttgggattagctcttctcatattccatcaattgcagcatcaattcttttgtgtatgtatatcttgatcgaggtttatgtcttgaaccgaggcgattcttttgtatcatcctgcaacttgcatcattagatgccgctgctaaagggtggctgtggttgttggcctgtgttatctcgagcccagagcccaaaatgtactggaaagactccttacgactcgcccgtgtagggttcgcctgagcagggctttgcgtccgttggggggtgtcgcaaatgtcatgcttcaacagtcgccaccattgaaataaaaaagtaattttgattacaaaagtcatcagaataaagacctgccagtctttggggcatccgcagtggtgcgggggaatttattcagcctcttctttatgttgcaacccatttcctcctaaagaggcacgagaagagagtaggttttggcggcagcgggcagcggtggtgctgggagatggctaaaagagcaaagaagcagataaacctcttctactgcgctgagtccgaagagctcgccaggaaggtggccgaccactccgacgtgatccagctccagaccatcacttggaggaactttgatgatggattccccaacctttttattaacaacgcacatgatattagaggacagcatgttgcctttctagcctcattcagctcaccaggagtcatttttgagcaaatatctgcaatttttgccttgccaaaactatttatttcttctttcaccttggtgttgccattcttcccaactggttcttttgaacggatggaagaagaaggagatgtggctactgcatttacaatggcacggatattgtcaatgattcctaagtctcggggtggtccgactagtattgtcatctatgacatacatgcattgcaggaaagattttactttggggatgatgtcttgccttgctttgaaactggcattccactattgttgcagcgtcttcatgaacttcccgatgcagataatataactatagctttcccagatgatggggcatggaagcggtttcacaagctgttgatgcactttccaatggttgtttgtgcaaaggttcgtgaaggtgacaagagaatagttcgaattaaggaagggaatcctgagggtcgacatgttgtcatcgtggatgatttggtacaatctggtggcactcttattgaatgtcagaaagttttagctgctcatggtgctggaaaagtaagtgcttatgtcacccatggtgtgttccccaagagatcatgggagcgatttctacacaataatgctgagggttcagatcatcaatttgcatacttttggataaccgactcatgcccacttacggtgaaggccatagctaacaaggctccatttgaggtgctcagtcttgctggctctattgcgactgcccttcagatctagattttctatggcagctatgttatgtcgacgacattgtttgaaccatcctgactctttaaacaaactcgtgcctgccttgatcctcttaaaaattctctcatcttttccatttgtgctgttcagtgagaacatacatatcaacttcccagccgcatttttagcagtctgttcttccaaactactctggaatttgtcccttgctatgtactgacgaacctacgcaaacaaattgctgggaaaacatgtttctggtcctttgcaccaaatctggttgatcatatgctgaaggttctttgctgaaacaagattatcatgtatctgagtactctttgtggacttgcatgtgtcgacattttttgaaccttcaacacttattagcgtgttcatgatttatatgtgg

SEQ ID NO: 6033 - DNA, 1180 bp, Panicum virgatum
gttcatcaacaaggcgcacgacatccggggcagcacgtggcgttcctggcctccttcagctcgccggcggtaatcttcgagcagatctccgtcatcttcgcgcttcccaagctcttcatcgcctccttcacgctcgtgctgcccttcttccccacgggctccttcgagcgcgtcgaggaggagggggacgtcgccaccgccttcaccctcgcgcgcatcctctccatggtccccaagtcgcgcggtgggccgactagcgtcgtcatctacgacatccacgcgctccaggagaggttctacttcggggacgacgtcctgccatgcttcgagacagggatcccgctcctgctgcagcgcctccgccagctcccggacgcagaaaatattacaatcgccttcccagatgatggggcgtggaagcggttccacaagctcttgcaacactttccaatgatagtctgtaacaaggttcgtgaaggtgacaagagaatagttcgaataaaggaaggaaatcctgaagggcgccatgttgttattgttgacgatttagtgcaatctgggggaactcttagagaatgccagaaagttctggcttcacatggtgctacaaaagttagtgcttatgtgactcatgctgtgttccctaagcaatcatatgaacgtttcatgacatctaattctgctgggccaggtgaccagtttgcttacttctggatcacggactcatgccctcacacggtgaaagccattgggcaaagacctccatttgaggtgctgagccttgctggctcgattgcggatgctcttcagatatgagcttgcactggtagatgggcttgaattgcccatcagattgaacttgtgctaggaaatgggctgctcctgttttactggactttagtccattgcagtttctggaaaacaaataatgtggagtaagtttactgcagaaagaccagaaggttccataaacagccctgtggtgtgataataaaatcaggcgttggatgttcacatctatgttttttttagtgttaacttttcaagggtgtgatataagtcttgagtgctgtatccttaggagctttcagttactgggcgttgctgtgaacaattagattggcgcaatataactgatcatgcgagtcattgcaatcaaaatctcctggttgccctgaaa

SEQ ID NO: 6034 - DNA, 795 bp, Musa acuminata
catttcaccggttaatagtgttaccaccaactcctcaagactcgattcttttcttgagcacaggatatatcatcgacaactgacagatctaagtcacaaacaaatctctttcttccatcgatcggacagcatctgtgaggcgagatgcacgatttctgtttcacgatcccgtacgggctcctggtcctcgtcggcggcgtcgtcggctatgcgcggcggggcagcacggcttcactcgccggcggggcgggctccggcgtcgtcctcctccttgctgggttcctcagcctcaaggccttcgagaagcgccgcaactcctatctcgccttggccctcgagaccctttgttcccttatcttaacatttgttatgggcaaaagatacctggaaacttccaagataatgccagctggattagttgctgctctcagtgcgatgatgtctctattctatctgtacaagattgcaagcggaggtaatcatattccgaccaaggcagaatgagttaatgtcggaagcatgcatgacggatgtgtaattcagggcatgcgacaggttaacatgaatcatgtttttttcttttatgtgtaaaattcagatcaacatcagcagatatcttgttatatctcaaacagcttgtgctgcgcggctgggacgaaattgagcaagttgtgattcaataattttcacactataccttcggacattgtaatctgatatgatatgacaaatttaatgatctcagtaggaggatcatgaatgaaatttggtgagcttaatgtcaataaaattttc

SEQ ID NO: 6035 - DNA, 1199 bp, Sorghum bicolor
tttacccatctgggaaattttactgttacctataaatcatcatgatatcattacaaaatttcaacttccagcatcggtcacaaactatcacgggagaacagtgcactcaacttccgaaggatcaagcacgcaaggaagcttggaaggtgacagtctggattttaaacaaatgaaatccacaattttccctgaagaacgcagacctctgaaaaactagagaaaagattttcacataaaaaaaagaaaagagagaaaaatgtcatcttctacctccttcggtgcccttctcctccatggccgcctccattccccttcccttccgtcaaaggcgcaacttttcctagctctccccaacaaccctacccgattccggacctccgcctccgtccgggtcgacgcctatcctccccggtggcctctccgcgccgccgacggggagcgggacaatcgcgtgcaggagctgagggtgcccgattcttggctgacgcctgcaggagcagcgcaggaatctgaatggctgagggagacactacacaagtggcttgacgacgagtactgcccggagccggccaacgtggacatcagcagcaccgccgcggggtcgtaccacgagtccctgatagcggggcagtctgacctgggagagatcttgctgaagatggtgggcgacctggataagctgtcgtacagggagagcttccatggccccttctcggccgccaatgccgcggttcgtttgatcagtcagaggatggagtcactgtctctgcctgatgaatgatggtaccatggtggtgtgtgagctgcagtttctacatgacagggcacatccagtgcgactgttcatggatgtcgtcgacaggaaatggtgaaaataggctcgagacttcgtgttttctctgttggaattcgacaatgtaccattctgctatcagcttgtgaattcgcagatgaaacgagcgatgaaacgtgaacgtgatgggtggacagtgggacttaagggagtgcgtagccttttctgaagttgttttgggtgtgagttcgcagttgacgttcaattctggtgtatggaaactaatcgtttcgggggtcatatttaggccttgtttacttccaaaattttttgcaaaatatgaatagtagtactttcgtttgtatttgacaaatattgtccaattataaactaaataggattaaaa

SEQ ID NO: 6036 - DNA, 615 bp, Saccharum officinarum
aaatgtcatcttctacctcagctgcccttctcctccatggccgcctccattccccttcccctccgtcaaagccgcaacttttcctagctctccccaacaaccctactcgattcccggcctccgcctccgtccgggtcgcctatcctccccggtggcctctccgcgccgccggcggggagcaggacaaccgcgtgcaggagctgagggtgcccgattcttggctgacgcctggaggagcagcgcaggaatctgaatggctgagggagacactacacaagtggctcgacgatgagtactgcccagagccggccaacgtggacatcagcagcacagccgcggcgtcataccgagagtctctgatagcagggcagtctgacctgggagagatcttgctgaagctggtgggcgacctggataagctgtcgtacagggagagcttccatggccccttctcggccgccaacgctgcgggtcgtttgatcattcaaaggatggagtcactggctgatgaatgatggtggtgtgtgaagcgcagtttctacatgccaggactgaccaatgcgactgtccatgggtgtcgccgacaggaaatgaggaaaataggctcgagacttt

SEQ ID NO: 6037 - DNA, 1675 bp, Sorghum bicolor
gaaaagtagcccagcccttgtctatccatcggcattcggcagccttggtcgccagaaaatttcacacagccagccagaggccgcaaactcccgagactgtaccagacggacaatttcaccatggcggcgccggcgcaggcgcaggtcctgcctctcctccggtggagccggagcgcctccttcctatgcgcctcgcctcgccgcctcttctccgccctccgccgccccgctgctgctgcccgctgcgaggccggctccaaggccatgctcaaggggatggactactcggaactcgagaattgggtgcaggcgcaggggtttcggccaggccaggccatgatgctgtggaaatgcctgtacgggaacaacgtttgggctcattgttacgacgagctgacgggtttaaacaaggatttcaggaagatgataactgagcatgctgatctcaaggcattaactgtgaaggacattcatactgcatcggatggtacccgtaagatactgttctctcttgaagatggttcagtgattgaaacagttatcattccttgcgctaggggcaggacaactgtctgtgtttcaagtcaagttggttgtgccatgaactgtcagttttgcttcactggaaggatgggtttgagaaaacatctctcgacagctgaaattgttgagcaggctgtgtttgctcgtagactattctcagatgaatttggatcaattaataatgttgtatttatgggcatgggtgaaccatttcacaatattgacaatgtaataaaagcctcagcaataatggttgatgggcaaggccttcaatttagccctcgcaaggttactgtctccacaagcggtcttgtccctcagttaaaacgcttcctccaggaatccaattgctccctggccgtcagtcttaatgcaacgacagatgaggttagaaactggataatgcccataaacagaaagtacaaccttaacttgcttcttggcactttaagggaggaacttaacctcagaaaaaaacagatagtgctatttgaatatgtcatgctttctggagtgaacgacagcatggatgatgccaagaggcttatagagctagtccaagggatcccatgcaagataaacctcatctctttcaatcctcatggcggttcccaattcaagcccacaccagacgataagataattgagttccgcaacgttttaattcaaggtggcctcactgtttttgttcggctcagcagaggggatgatcagatggctgcctgcgggcagctaggagagcctggagactaccagctgcctctgctccgtgtacccgagaaatttcaggttgccttgtgatgataaacagcgcatacagtaaactggtcctgagcagcttgacgatcacacggagtaattggcttggaacgacggttcgatcgtgcaaatcttagtaagttctaccgccctcctgaagattgcctggaactctgcaatatcgtgcaaatctgaacctgggtacttatgtgacagcacattttgacatggtgttgcttctgctaatgcgtggtgtaaccaaactaaattcgataagaatatataaaatgggtattttcttgcaaatcgtctctgttagacattaacagtgtaacatgctttcacttgacactgtgatatcgtgccaaacttt

SEQ ID NO: 6038 - DNA, 1642 bp, Setaria italica
tcggcagcgactcgccagaaaattcaccacagccgtgagaggttgcaaactcgcgagaccgtacaagccaggcaaatccccatggcggcgcaagcgctgccgttcctccggtggagccggagcgcctcctccctccgcgcgcactgctccgccacagccgcgccgcgccgcctcttctccgccctccgccgccctgccgccgccgccgcccgctgcgaggccggctccaaggtcatgctcaaggggatggattactcggaactcgagaattgggtgcaggcgcaggggtttcggcccggccaggccatgatgctgtggaaatgcctatacgggaacaacgtttgggctcattgccacgacgagctaactggtttaaacaaggacttcaggaagatgataaccgagcgtgctgatctcaaggcattaactgtgaaggacattctcactgcatcagatggaacccgtaagatactgttctctcttgaagatggtccagtgattgaaacagttatcattccttgcgctaggggcagaacaactgtctgtgtttcaagtcaagttggttgcgccatgaactgtcaattttgcttcactggaaggatgggtttgagaaagcatctgtcaacagctgaaattgttgagcaggctgtgtttgctcgtagactattctctgatgaatttggagcaattactaatgttgtatttatgggcatgggtgaaccatttcacaatattgacaatgtactaaaagcctcagcaataatggttgatgatcaaggtcttcattttagtcctcgcaaggttactgtctccacaagtggtcttgtccctcagttaaaacgcttcctccatgaatccaattgctccctggctgtcagtcttaatgcaacaacagacgaggttagaaactggataatgcccataaacagaaagtacaatcttaacttgcttcttggcaccttaagggaggaagtttgcctcagaaagaattacagagttctatttgaatatgtcatgctttctggagtgaacgacagtatggatgatgcgaagaggcttatagagcttgtccaagggatcccttgcaagatcaacctcatttctttcaatccccacagtggttcccaattcaagcccacacccgatgagaagatactcgagttccgcaatgttttaattcaaggtggccttatagtttttgttcggctcagcagaggggatgatcaaatggctgcgtgcgggcagctaggagagcctggagattatcagctacctctgctccgtgtacccgagaaatttcaggtcgccgtgtgatgctaaacagtacagtcattagcaatttgatgaacacaagtaactggtccgggatgaagattcgatgatgcaggtgtagtaagtagaagttatgccatctctggagactgctctgatttcgcgaaattttatcaacgtggtgggtcttcatccgaacctggtcttcatctgagcctggatacgtaagaacacattttgacatggtgatgcttctgctgactcgtggtgtatcactgtatcctaatcgagcatttgataagaatattataaactgggtatttctcgcagctggttcagcatataagattgtactctttccgttccaaat

SEQ ID NO: 6039 - DNA, 1689 bp, Oryza sativa
cgcgagaaaaatccccagcgggagagctcacgaactgttcccttcccatggcggcgctgcctctcctccggtggggcgcttcctccctccgaggaggccactcctccgctccgccttcgagccgcctcttctccgcgctccgccgacctcccgccgccgcccgctgcgagcccggctcgagggtcatgctcaaggggatggactaccctgagctcgagaattgggtgcggtcgcagggcttccggccagggcaggccatgatgctgtggaaatgcctctacgggaacaacgtatgggcgcattgctatgacgagctggctggtttaaacaaggacttcaggaaaatgctaacagatcatgctgatcttaaggcattaactgtgaaagacattcttaacgcgtcagatgggacccgaaagatactgttctctcttgaagatggatcagtgattgaaacagttgtcattccttgcactagtggcaggacaactgtctgtgtttcaagtcaagtgggttgtgccatgaattgtcagttttgcttcactggaaggatgggcttgagaaagcatttgtctacagctgagattgttgagcaggctgtgtttgctcgtagactgttttcagatgaatttggatccatcacaaatgttgtatttatgggcatgggtgagccgttgcacaacattgacaatgtactaaaagcctcagctattatggttgatgagcagggccttcagtttagtcctcgcaaggtcactgtctccacaagcggtcttgtcccacagataaaacgcttcctacaggaatccaattgtgcgctggctgtgagtcttaatgcaacaactgatgaggtgagaaactggataatgcctattaatagaaaatacaatctcagcttgcttcttggcacattaagggaggaaattcgtttgaaaaagaagtacaaagtgttttttgaatacgtcatgcttgctggagtgaacgacagtgtggatgacgcgaagagactagtagatttagttcgcgggatcccttgcaagatcaacctcatctctttcaatccccatagcgggtcacaattcaagcccactcctgatgagaaaattattgagtttcgtaacattttaattcaagatggccttgttgtatttgttcggctcagcagaggggatgatcagatggctgcctgtggacagctaggagagcctggggactaccagctacccctgctccgtgtacctgagaaattccaggtcgctttgtgactctaaacagtaagtacggtactacaatcctcatagatattgtagaatagctttgacaaaagacatgtaactttcatgcggttcttagaggtcattctctgggccaacctgacgactgacggaatatttttgttactttctttaaggaaaatttttgttgttactacaacaagacagtgtcttcagctggcttatggcatgtaaaagaacatttaggcatagtgccgctaatctgctaagtaccaaaatccagtattttccatggatgtgtgacgcttcatctctccctatccgaattgccattggattttagcaatatatgtctgcattaatgcttccactgtgcaatacaaggagataaacctaaatcatgcaactttcaagttcatggcatttaggcactttgcatagttcctgattcggc

SEQ ID NO: 6040 - DNA, 1212 bp, Sorghum bicolor
gcctaccagccagtgccaaggcgcgataacgagcggcaggtcagggggtcaggcagaggccacagcgctagcggcacggcatagccggcgacagaaaccaaccgatgccactcgtcggctgtccccgccgcggcccgccgctttctcccgcctgccgccaccgccgcagcctgtatcgggcccgagccgtcgcgcccaaatgcgaggcctcctcctcctctcctccgccgctcctgaccaggagactgtccgctgcctcgctgcttctcgctgtcctccccgtccccgcgtcgtcgccgcaactccccgtcgcctccgcgtcgcaggcggaggcgaaggaggcggaaggagaaagcggagcttccgaggggatagaactggagcggtacactgaccaggagcagggcttcaccctcctcaagccgacctcttggcccaaggtggagaaggcgggcgcgacggcgctgtttcagcaggagggcaaagggagtaacaatatcggggtcgtcgtcaaccccgtccggctcaattcgctgacggagttcgggacgccgcagttcgtcgcggacagacttctgcaagcagagaagaaaaaggaaagtaccaagactgccgaggtgatctcagtgggagagagatcaggtcatggtggcctgacagtgtatgaaatcgagtacacactggatagcactaggggagggatgaaacggatcttctcgggtgcatttgttgcttcaaggaagctctatctgctcaacatagcctgttcagacacccaggagaagcccttggacagcgagacaagaattgttctggaaaaagttctacattcttttgattctgtatagttgatatttttttacgacagaggtatggcactttttcttgttttcggattttctctcacttgaaaatacagttgcaagtaattgtttgtttgtaaaatgagtgctaaccaaatagttgcagtgtccttttgtccaataccgtttcacctttctcagtgatgtcaggctataagtaatttcagttttcagtttagataatgaacttcgtcttccataggtaacatttgtgtcacaggcagtaaaacgttgtgatcttaattactagcctggcagtggcattactgcattcgtaatatatcttggacaaagcattgggcagtgagccagtgacagtattactccttgaaaatctgtaatgcctcat

SEQ ID NO: 6041 - DNA, 1443 bp, Sorghum bicolor
agatccttcgccacccaaatccggcgaaccgcccgctccgccgcgccagccaatccccacctcaaataacccccggcgcccgcggccccggccccacccgcccgccgaggggaaataacaagcaagcccccgcacatcaacgagaacgccaccgccgcacgaagcgaggagccgaagccagccgggagagaaaacgggcgggatccccaccgcctcgcgcgccgcggcggccgacgccgccgcggcaatggaggtcacctcctcctcctcctctccttccgcgccgccgccgggatcctcgaagccggcgctccggctcaaccccgcggcggtcctcctccgccgcctgccgaccccgaccccgaccacggcgacgcccgtcaccgcgtcagagccccctgcgcggcccggcggcgcgtccaacccgctcgccgccttcctctcctccctcatccctttctggcgcgagcggcggtggggaccgccgaaacagccggcccaccccgctgcctcctccgctgcggcgcggagggcggccgagcaggaggcggaggcggaggcgcgacagctggtggggtgtgcggtgccgctgttccggccgtacgtggcgcagctgccgtggcacggcggctacgcgggcgtggctgtcgaagctgttcccgcgctacggccactactgcggacccaactgtccagcggcaacggctccgtgctctgggaccgccgccccgtcgaccacctcgacttctgctgctactgccacgacatggcctacgacacccacgaccaggcccagctcctccgcgctgacctggccttcctccgctgcctcgagggcagccgccgcacgcccgcgcgcgacggcatcgccgccgcagtcatctaccgcgccatgtgcatcttcggactgaagacgatcctgatcccgtaccggacgaacctcgtgcggctgcagacggggccgaactacgctgatttcttcgccgattttgtgaagagggtcgcgtcgtcgtcgggcaggccgaccggcggtgagaagcagaggctgtgagcaaatttgctcgcctggtcctacatgtaaggtggtagatcgagccgtagtaatttgtctatatataaggtagctgagtttttttttttaatccacaatatggcaaggcaaactgtgtctatttgatttgtagcaaatgatgagaaacttgatgtttctactgtgaatatagcgcaaatgcgatgcccttggttgaaattgaaaagatcagggcaatactcctaagaacagcaagtcagcaaccatgctgctgcatttctctctttgatcttcatatctgggcttcgtttagttctttgctgaaattttttttgggatagcagttattttcgtttgcatttgataattattattcaatcataaactaactaggcttaaaagattcataaatt

SEQ ID NO: 6042 - DNA, 1686 bp, Panicum virgatum
attgggacgattagcaaccaccttggacgtaattttattgtgcccatcctaaataagactatcgtctgtgaatggactgagtataagagaagcataggcccagcccagaatagcagggtaaaaagcccggctcggcccgttcccaagtggatagagagagagagggactatagccgtgagccgtcgtgagcagacagagcagcgtcgtaacaaagcagggaatggccgccgcgccgccgcacgtccgcgcagcccctctcgcgcgcgccctctgcgcgcgcgcctccgccaccgccgccgccgccgtgccgcccaagcctcagtctcaggcgaattcttgccgcgcgctgctcggcctctccgagactgacctccgccagctcgccctcgacctcggccagcaaagctacagggggaagcagctgcacgacctcctctacaagtccagggccaagcaaatccaagaattcaaccacgtgcccaaggcgttccgggaggcgttgctcggcgctggctggactgtcggccgctcgccagtgcaccatgccgtgaccgcctcggatggcacggccaagatacttctcaagttggaggataaccggttgatcgagacagtagggattcctgtcaatgatgacaacaaaggatcttctaggctcactgcctgtgtttcatcgcaggtcggctgccccttgcgttgctcattttgtgccacgggcaagggagggttcgctaggaaccttcgaccacatgagattgttgaacaggtgttggccatcgaggagatgttcaaacacagggtcacaaatgttgtgttcatggggatgggtgagcccatgttgaacctcaagtcagttctagaagcacaccgatgtttcaataaggaactgaaaattgggcaaaggatgatgacaatctctacagtaggtgttcctaacacaataaaaatgctagcatctcacaagcttcagtcaacacttgcagtgagcctgcatgccccaaatcagaagctacgggaaacaattgttcctagcgcaaagtcttaccccttgggagcactaatggatgactgcaagagctacttcctcgaaactggacgcagggtatccttcgagtacactctgctagctgggaccaatgatgaaagggagcatgccgaagaacttgcagaattgcttcgcacatgtggaggtggttatcatgtgaacctaattccctataacccaattgaaggttctgaatacaagaggccatacagaaaagtggttcaagcgtttgttgatgcattagaagcaaggaagataactgtcagtgttagacagacccgggggctagatgctaacgcagcctgtggtcagctgagaaatgaattccagaagaatccgcttcttgaatcttcaacctcagagcccaatctcgcacctttatgatgaagggctggagtgcgtgtagattataacattttaaagccttttcgggcatcattttcaggcatgactgcatgaggtttctgttttactgagaaaataggtgttgtcactagaaaagtcaagcaaattatgtagacataaagctaaggaattttggaacattctgttatgccccaccaaatcatgtaaaccgagcttacatttgataccatgaatacaattcagtagtcatgcttgtctcagatcttacaaaaaa

SEQ ID NO: 6043 - DNA, 1184 bp, Triticum aestivum
gcagcagcaggaaaaagaatggccgcgccgcagcaggtccgcgccgtgcggctggcgcgcgcgctccgcctccgcacgcgcgcctccgccgccgccgcgccggagacgtcccgccgcgcgctcctcggcctcacggagcccgagctccgccagctcgccgtcgacctcggacagcaaagctaccgggggaagcagctgcacgacctcgtctacaagaacagggccaagcaggtggaggagttcgcctacgtgccaaaggtgttccgggaggcgctggtcggcgcgggatggaacgtgggccggtcgccggtgcaccacgccgtcacggccaccgatggcaccaccaagatacttctcaagctggaggacaacagactggtggagacggtggggatccccgttgacgacaggggcacgcctagactcacaacctgcgtttcatcgcaggttggctgccccttgcgttgctcgttctgtgccactgggaagggagggtttgcgagaaacctcaaggggcacgagattgtcgagcaggtattggccatagaggagtcgttcaaacacagggtgacaaatgtagttttcatgggtatgggtgagcccatgctgaacctcaaagcagttctggaggctcaccaatgcttgaataaggaactaaagattgggcaaaggatgatgacaatctcaacagtaggtgttcccaacacgataagtaagctagcatcccacaagcttcagtcgacactggcagtcagcctgcatgccccaaatcagaggctgcgcgaaacaaatgttccaagtgcaaaggcatatcctctggaagcactaatggatgattgcaagaattatttcctcgaaaatggacgcagggtatccttcgagtacactctgctagctgggattaacgatgaaaaggcgcacgctgaagaacttgcagcgctgctgcatgcatgtggaggtggttatcacgtgaacttgattccctataacccggtagaaggatctgagtacaagaggccgtacagaaaagcgattcaagcgtttgttgatgcactggaatctcggaagatcacagtcagcgttcgacagacccgtgggcttgacgctaatgcggcttgtgggcagctcaggaatgagttccagaagaatcctctgcttgagtcgtccccaccctctgagcccaa

SEQ ID NO: 6044 - DNA, 1360 bp, Pennisetum glaucum
ctccgcctccgccgcgccgcccaggtcccaatctcagggggggacttcccgccgcgcgctgctcggcctctcggagcctgagctccgccagctcgccctcgacctcggccagcaaagctacagggggaagcagctgcacgacctcctctacaagtccagggccagccaaatccaggacttcaactacgtgcccaaggcgttccgggaggcgctgctcggcgctggctggaccgttggtcgctcgccagtgcaccatgccgtcactgcctcggatggcactaccaagatacttctcaagttggaggataaccgcttgatcgagactgtagggattcctgtcgatgatgacagcaaaggctcttctaggctcaccgcctgtgtttcatcacaggtcggctgccccttgcgttgctcattctgtgccacgggcaagggaggcttcgccaggaaccttcgaccacatgagattgttgaacaggtcttggccatcgaggagatgttcaaacacagggtcacaaatgttgtcttcatggggatgggcgagcccatgttgaacctcaagtcagttctggaagcacaccggtgtttcaataaggaactcaaaattggccaaaggatgatgacaatctccacagtaggtgttcccaacacaataaaaatgctagcatctcacaagcttcagtcaacactggcggtgagcctgcatgccccgaaccagaagctgcgcgagacaattgttcctagcgcaaagtcttaccccttgggagctctgatggatgactgcaagagttacttccttgaaactggacgcagggtatccttcgagtacactctgctagctgggatcaatgatgaaaaggagcacgccgaagaacttgcagaactgcttcgtacatgtggaggtggttatcatgtgaacttaattccctataatccaattgaaggctctgaatacaagaggccatacagaaaagtggttcaagcatttgttgatgcattagaagcacggaagataactgtcagtgttcgacagacccgagggctagatgctaacgcagcctgtggtcagctgagaaatgaattccagaagaatcctctgcttgaatcttcgccctcagagcccagcctcatacctgcttgatggcaggactgaattttgaagcctaaacaattttgaagccttttcaggcatgtggggtttttgttttactgagaaaataggtgttgtaagtttgtaactattaagtcaaccaaattatgtagacatacagctatgaaattttggaacactgttgtgcctcagtaaatcatgtagactgtagacagacatcggatgtcattaattgtaattgcgattttc

SEQ ID NO: 6045 - DNA, 4005 bp, Brachypodium distachyon
tggatgaggctgctacaaatcctcagcagcttcggttcgcaacagcagtaggagaaaaagaatggccgcgccgcagcaggtccgcgccgtgccgctcgcgcgcgcgctccgcctcagcacgcgcgtctccgcctccgctccggcgaggtccgcctcgacgccgcctcgccgcgcgctgctcggcctctcagagccggagctccggcagctcgccgtcgacctcggccagcaaagctacagggggaagcagctgcatgacctcgtctacaagaacagggccacgcagattgaagcattcgcatacgtgccgaaggtgttccgggaggcgttggttggtgcggggtggagagttggccggtcgccggtgcaccacgccgtgacggccaccgatggcaccaccaagatacttctcaagttggaggataacaggttggtcgagacagtggggatccctgtcgacgacaagggctcatctcgactcaccgcctgcgtttcatcacaggtcggctgccccttgcgttgctcgttttgcgccacagggaagggagggtttgcgaggaaccttcacggacatgagatcgttgagcaggtattggccatagaggagtcgttcaaacacagggtgacaaatgtagtgttcatgggaatgggtgaacccatgttgaacctgaaagcagttttggaggcacaccgatgcttgaataaggaactaaagatcgggcaaaggatgatgacaatctccacagtaggcgttcccaacacgataaataagctagcaactcacaagcttcagtcaacactggcagtcagcctgcacgccccaaatcagaaactgcgcgaaacaattgttccaagtgcgaaggcttatcctttggaagcactgatggatgactgcaagaattatttcctggaaactggacgcagggtatccttcgagtacactctgctagctgggattaatgatgaaaaggcgcatgctgaagaactcgcagcgctgctgcatgcgtgtggaggtggttatcacgtgaatctgattccctataaccccgtagaaggttctgagtacaagaggccttaccgaaaagcgattcaagcttttgtcgatgcgctggaatctcggaagatcacagtcagcgttcgacagacccgtgggcttgatgccaacgcagcctgtggacagctcaggaatgagttccaaaagaatccactcctggaatcatctccgccatccgagaccaaccaaccgcttgaatcatctccaccctccgagcccagcctcgttactgcttaggcgcagagatttttgttcctgcttagcgtggagattttgcttgaattatgtaggaattgagctatttcctatgaaattctgcgttcaaaagcttgaataggccctgaatgacttatctaatacgtagatcatcggctcataaagtgtaagctgattagggggtcagccttttttggctaagggcgttatttatatctggcgtgagaggccctgttaattgagatattaagtgttaagtatagaacagatgtattcgatgcatgttctgtagactggtgtataatttctccatgatacgaaaactacattctgaaattctacatgggattaagagaatgtgaactgcgatcagctaataaaaaagaagattaacgcgacacttaaaagaaacaagggtgtgtgatcattagtaacttgcagaacatctctgataatgcaaaagaacaaggttggtaacagcaccagccactgcccatttatgctaaccgtcagcggctcagcgcttgcagtaatgtacaacaatttacgagttaaaagaaacaaatgtacaacaatttacagtattgacaaaatggtctgtaaaattaaatgtgcaaaacttaaaagattctcttcactcgatgattgttacaactctgttcaggaggtttaggccaaacaccgtatcttcagaattcaccttgacggtgagatccagtggtcctgaggtatgaccttccgccaagatggtaattaggcaggggtttgaagtgctcagaatctcactgctaaatcgccagcataagccggacgcgtcgtcgatgctgaaggttactggcatatccattgacactaggtgaacattggcattgctgagtacttttgatgcaagactctgcgctactagaaggtttttatcggtgtggtccgtactctcttcagtgcacccatgcttctgaagatgatctttgaaggtgcacctattgcaattccaatagatttagttattggatatatgtttgacaatcaacaacctggatctagccagtggcatcctctcaaacaaagataggatgaaactttcttaccttctagcatactcaaacactcccctcagctggttttccttgcaaagaaaagcattcaagtccatgggtagtggccgtacaaaataagcaatatcagggtgaagtttagctggatgccttttcccattgcagagaacagacagctttaggggcaagagatgatgatggaagtgaacttgaagaatcatcttcacagtctgttgtggagccaacgagcgtatctcttccacaggagcaagagttgggatgctgcaggaaaagatgatttactatgtatgagctgcgaggtaaaataagttgacaaataaaaaccatcaacaggttttcataataaacattttaatatttaacaatataaatgtttgttaaaaaataaaaatatcacagatggcgcataccttgcagatccttctgatgtttggtccatttcatccttactaatagaagcctcttcagatttaatgattatatctgtcaactggtctgttgtattattctcaacaaacaagtctatacataccagcaagcgtgatatgggggaaatctccgctgagaaggcatatataacactcagaccactagtattagaagggtctagcaatgtatgcagtttaggttttcgctcaaagctgcggttggtaaaagaaactcttgcaattgatttctgcatagattcctgaacagctggcaaagcaggagcctcgtcaagccatgactccaaggctgacttagacattaattcagtcaaatcagtagagatgagagatgacaaattgtcctcaacgtttcgacctgtctggccttgatctacattgtcatcatacatatgaaccagaggggcttcctgattatcttgtcggtgatggaggttatgtccgtcatcatttggatattggctagatccagtggcatctttgtcagataagccaccaccttcactctctgaatcataaacagagccactctcataggaagactcagattcagcattggaattattactttcagaagaattagctgtgtccctggtcagctttatggtgtgataaattaattccatactttgaggctttggaagtggtgcataaccaggagctgcatgaagaacaacttgtgacagggaaccaggaagataaatccggtagttgctgtctgaatgagatgttgtaggtatcttcccaccaaagatatgatcagctagctccttacgaatatcttgactgtgagattgacatgtggagtcattttcatttaaagaggtcttgccacatggcaaaagatttgatataaagcgtgcacgatcacggacatcataattcaagtcacatgcagccaggtcggtgatatatgccattatccttttgaattcttccaagtgttcttctgcagaatgtattataacctggaaaggcaaacttttttaccaatcccctatgtaatagcaggaaacttaagttaggatgtacctttgcagaagcatttaggatctgaagctttgtctcgagcacttcagcagcaaaagaccatgctagatacttgagaacaggtggaattatctttggaatgaggtttcctacagagctatactcgccaaatatccaaataatcaaggaccgtgctgcaggctgcttaattttatccagtctg

SEQ ID NO: 6046 - DNA, 1653 bp, Sorghum bicolor
gccctttagagaggcccaaatggctgtaccatgtgaaaaagggaaggaaaaaatcctaaagagccagccttgcctgcccccatccgtaatccaggaccaggaggaaatggctgctccccagcacgtccgcgccgctcccctcgcccgtgcgctccgcgctagcgccaccgccaccgccaccgccaccgtgtccgcctcagcccccgcccccgcccccatcaagtctcaggggacttcccgccgcgcgctgctcggcctctcggagcctcagctccgccagctcgccctcgatctcggcgaggaaagctaccggggcaagcagctgcacgacctcctctacaaatcaagagccaagcaaatccaagatttcaaccacgtgcccaaggcattccgggaggcgttgcttggcgctgggtggagtgctggccggtcaccagtgcaccacgccgtcacagcctcggatggcactaccaagatacttctcaagttggaggataaccggttgattgagacagtagggattcctgttgatgatgacaacaaaggctcttctaggctcaccgcctgtgtttcatcacaggtcggctgccccttacgttgctcattttgtgccacgggcaagggagggtttgcaaggaaccttcaaccaaatgagatcgttgagcaggtgttggccatcgaggagacgttcaaacaaagggtgacaaatgttgtgttcatggggatgggtgagcccatgatgaacctcaagtcagttctagaagcacaccgatgcttcaataaggaactaaaaattgggcaaaggatgatgacaatatctacagttggtgttcctaatacgataaaaatgctagcgtctcataagcttcagtcaacactggctgtcagtctgcatgccccaaatcagaagctgcgggagacaattgttcctagtgccaagtcttaccccttgggagcactgatggatgactgcaagaattacttccttgaaactgggcgcagagtatcctttgagtacactctgctagctgggatcaacgatgaaaaggagcatgccgaagagctagctgaactacttcgtacgtgtggaggtggttaccatgtgaacctgattccctataacccaattgaaggctccgagtacaagagaccttacagaaaagtggttcaagcatttgtggatgctttagaagctcggaagataaccgtcagcgttcgacagacccgtgggcttgatgctaacgcagcctgtgggcagctgagaaatgagttccagaagaatccactgcttgcaattgaagcgtgaccctccacagagctcagcccaccatcgtagcttcttaatgagaatacctatgaggtcgacgcagccaattcaagcatacaaaatcgccgtttaactgctggggaacaatataggtgttgtaaagtgacagcaaggtatgcataccgctagagaattttggaacattctgcgcgtgcccatctgatatcatgagctgcaattaccatgcttgtctcagatattattatagaaccgatctttgttacacggctcatttcatcactttctctgtttttccccggccggctacttttgggcgggggcctgcgttgttttgcattgcgctggtcactactgtctttgaagtc

SEQ ID NO: 6047 - DNA, 1504 bp, Triticum aestivum
gcagcagcaggaaaaaatggccgcgccgcagcaggtccgcgccgtgcccctggcgcgcgcgctccgcctccgcacgcgcgcctccgccgccgccccgccggagacgtcccgccgcgcgctcctcggcctcacggagcccgagctccgccagctcgccgttgacctcggacagcaaagctaccgggggaagcagctgcacgacctcgtctacaagaacagggccaagcaggtggaggagttcgcctacgtgccgaaggtgttccgggaggcgctggtcggcgcgggatggaacgtcggtcggtcgccggtgcaccacgccgtcacggccaccgatggcaccaccaagatacttctcaagttggaggacaacaggttggtggagacggtggggatccccgttgacgacaggggcacgcctaggctcaccgcctgtgtttcgtcacaggtcggctgccccctgcgttgctcgttctgtgccactgggaagggagggttcgcgaggaaccttaaggggcacgagattgtcgagcaggtcttggccatagaggagtcgttcaaacacagggtgacaaatgtagtgttcatggggatgggtgagcccatgctgaacctcaaagcagttctggaggcacaccaatgcttgaataaggaactaaagattgggcaaaggatgatgacaatctcaacagtaggtgttcccaacacgataagtaagctagcatctcacaagcttcagtcgacactggcagtcagcctgcatgccccaaatcagaggttgcgcgaaacaattgttccaagtgcgaaggcatatcctctggaagcactaatggatgactgcaagaattatttcctagaaactggacgcagggtatccttcgagtacactctgctagctgggattaacgatgaaaaggcacatgctgaagaacttgcagcgctgctgcatgcatgtggaggcggttatcacgtgaacctgattccctataacccggtagaaggctctgagtacaagaggccttacagaaaagcgattcaagcgtttgttgatgcgctggaatctcggaagatcacagtcagtgttcgacagacccgtgggcttgacgctaatgcggcttgtgggcagctcaggaatgagttccagaagaatcctctgctcgagtcgtccccaccctctgagcccaaccaactgctcgagtcgtctacgccctcggagcccagccttgttccggcttagtgatgaagtatatctcaattatgtagaaattgagattttgtgaatctgcattctaaagttcaaacaggccctgaattgctctgctcatacatagatcactggcttataagttataaagcttattagggggcagcctcctgtagctgatgagtttattcatatttgacgtgagaggctcctgttcagttgagatttgaaggttttttttaagctctgatgtattctgcattgagtatatgtatttgttgaaagttctgtatattgctagag

SEQ ID NO: 6048 - DNA, 1643 bp, Triticum aestivum
ggcagtgtaatcctcagcagcagcagcaggaaaaaatggccgcgccgcagcaggtccgcgccgtgcccctggcgcgcgcgctccgcctccgcacgcgcgcctccgccgccgccccgccggagacgtcccgccgcgcgctcctcggcctcacggagcccgagctccgccagctcgccgtcgacctcggccagcaaagctaccgggggaagcagctgcacgacctcgtctacaagaacagggccaagcaggtggaggagttcgcctacgtgccgaaggtgttccgggaggcgctggtcggcgcgggatggaacgtcggtcggtcgccggtgcaccacgccgtcacggccaccgatggcaccaccaagatacttctcaagttggaggacaacaggttggtggagacggtggggatccccgttgacgacaggggcacgcctaggctcaccgcctgtgtttcgtcacaggtcggctgccccctgcgttgctcgttctgtgccactgggaagggagggttcgcgaggaaccttaaggggcacgagattgtcgagcaggtcttggccatagaggagtcgttcaaacacagggtgacaaatgtagtgttcatggggatgggtgagcccatgctgaacctcaaagcagttctggaggcacaccaatgcttgaataaggaactaaagattgggcaaaggatgatgacaatctcaacagtaggtgttcccaacacgataagtaagctagcatctcacaagcttcagtcgacactggcagtcagcctgcatgccccaaatcagaggttgcgcgaaacaattgttccaagtgcgaaggcatatcctctggaagcactaatggatgactgcaagaattatttcctagaaactggacgcagggtatccttcgagtacactctgctagctgggattaacgatgaaaaggcacatgctgaagaacttgcagcgctgctgcatgcatgtggaggcggttatcacgtgaacctgattccctataacccggtagaaggctctgagtacaagaggccttacagaaaagcgattcaagcgtttgttgatgcgctggaatctcggaagatcacagtcagcgttcgacagacccgtgggcttgacgctaatgcggcttgtgggcagctcaggaatgagttccagaagaatcctctgctcgagtcgtccccaccctctgagcccaaccaactgctcgagtcgtctacgccctcggagcccagccttgttccggcttagtgatgaagtatatctcaattatgtagaaattgagattttgtgaatctgcattctaaagttcaaacaggccctgaattgctctgctcatacatagatcactggcttataagttataaagcttattagggggcagcctcctgtagctgatgagtttattcatatttgacgtgagaggctcctgttcagttgagatttgaaggttttttttaagctctgatgtattctgcattgagtatatgtatttgttgaaagttctgtatattgctagagaattttggaacaaggtagctgccaaatcttatgccacaattgtctgaatttcaatataaccgtcctccaaaatgttgaaatgtatcaaatgaataaattacaaagaatattaatgttttt

SEQ ID NO: 6049 - DNA, 1610 bp, Hordeum vulgare
cagcaggcagtgtaatcctcagcagcagcactaggaaaaagaatggccgcgccgcagcaggtccgcgccgtgccgctggcgcgcgcgctccgcctgcgcactcgcgcctccgccgccgccccgccggagacctcccgacgcgcgctcctcggcctcacggagcccgagctccgccagctcgccgtcgacctcggccagcaaagctaccgggggaagcagctgcacgacctcgtatacaagaacagggccaagcaggtcgaggagttcgcctacgtgcccaaggtgttccgggaggcgctggttggcgcgggatggaacgtcggccgatcgcccgtgcaccatgcagtcactgccaccgatggcaccaccaagatacttctcaagctggaggacaacaggttggtggagacggtagggatccccgtcgacgacaggggcacgcctaggctcaccgcctgcgtttcatcacaggtcggctgccccttgcgttgctcgttttgtgccacagggaagggagggttcgcaaggaaccttaagggccacgagatagtcgagcaggtgttggccatagaggagtcattcaaacacagggtgacaaatgtagtgttcatggggatgggcgagcccatgttgaacctcaaagcagttctggaggcacaccaatgcttgaataaggaactaaagattgggcaaaggatgatgacaatctcaacagtaggtgttcccaacacgataagtaagctagcatctcacaagcttcagtcgacactggcagtcagcctgcatgccccaaatcagaggttgcgtgaaacaattgttccaagtgcgaaggcatatcctctggaagcactaatggatgactgcaagaattatttcctcgaaactggacgcagagtatccttcgagtacaccctgctagctgggattaacgatgaaaaggcacacgctgaagaacttgcagcgctgttgcatgcatgtggaggcggttatcatgtgaacctgattccctataacccggtagaaggttctgagtacaagaggccgtacagaaaagcgattcaagcttttgttgatgcgttggaatctcggaagatcacggtcagcgtcagacagacccgtgggcttgacgctaatgcggcttgtgggcagctcagaaatgagttccagaagaatcctctgcttgagtcgtccacgccctctgagcctaaccaactgcttgagtcatcttcgccctcggagcccagccttgttcctgcttagtgatggaatatatctcaattatgtagaaattgagattgttgtgaatttctgcattctaaagttcacacaggccctgaattgctctgctcacatagatcactggcttataagttataaaagatgattcggacgaagccttttgtggctaatgagtttattaatattcggtgtgagaggctcctgttcagttgatatttgaaggatttttgttgagatatgaagtattctgcatgaagttagtatatgtatttaagtgtcaaaaaaaagttagtatatgcatttgatacaagttctgtatattggcagagaattttggaactatatatggttatggatgctgtcaaacctta

SEQ ID NO: 6050 - DNA, 1752 bp, Hordeum vulgare
gcagcaggcagtgtaatcctcagcagcagcactaggaaaaagaatggccgcgccgcagcaggtccgcgccgtgccgctggcgcgcgcgctccgcctgcgcactcgcgcctccgccgccgccccgccggagacctcccgacgcgcgctcctcggcctcacggagcccgagctccgccagctcgccgtcgacctcggccagcaaagctaccgggggaagcagctgcacgacctcgtatacaagaacagggccaagcaggtcgaggagttcgcctacgtgcccaaggtgttccgggaggcgctggttggcgcgggatggaacgtcggccgatcgcccgtgcaccatgcagtcactgccaccgatggcaccaccaagatacttctcaagctggaggacaacaggttggtggagacggtagggatccctgtcgacgacaggggcacgcctaggctcaccgcctgcgtttcatcacaggtcggctgccccttgcgttgctcgttttgtgccacagggaagggagggttcgcaaggaaccttaagggccacgagatagtcgagcaggtgttggccatagaggagtcattcaaacacagggtgacaaatgtagtgttcatggggatgggcgagcccatgttgaacctcaaagcagttctggaggcacaccaatgcttgaataaggaactaaagattgggcaaaggatgatgacaatctcaacagtaggagttcccaacacgataagtaagctagcatctcacaagcttcagtcgacactggcagtcagcctgcatgccccaaatcagaggttgcgtgaaacaattgttccaagtgcgaaggcatatcctctggaagcactaatggatgactgcaagaattatttcctcgaaactggacgcagagtatccttcgagtacactctgctagctgggattaacgatgaaaaggcacacgctgaagaacttgcagcgctgttgcatgcatgtggaggcggttatcatgtgaacctgattccctataacccggtagaaggttctgagtacaagaggccgtacagaaaagcgattcaagcttttgttgatgcgttggaatctcggaagatcacggtcagcgtcagacagacccgtgggcttgacgctaatgcggcttgtgggcagctcagaaatgagttccagaagaatcctctgcttgagtcgtccacgccctctgagcctaaccaactgcttgagtcatcttcgccctcggagcccagccttgttcctgcttagtgatggaatatatctcaattatgtagaaattgagattgttgtgaatttctgcattctaaagttcacacaggccctgaattgctctgctcacatagatcactggcttataagttataaaagatgattcggacgaagccttttgtggctaatgagtttattaatattcggtgtgagaggctcctgttcagttgatatttgaaggatttttgttgagatatgaagtattctgcatgaagttagtatatgtatttaagtgtcaaaaaaaagttagtatatgcatttgatacaagttctgtatattggcagagaattttggaactatatatggttatggatgctgtcaaaccttatgtcataattatctgaattttatataactgtcctccaaaatgttgaaataaattcataagaattaagaagaaattatcaggtaaaagaatatcaatgaaagaaaaaaatactccctctgttcacttttactgcctgcagta

SEQ ID NO: 6051 - DNA, 1565 bp, Secale cereale
gtaatcctcagcagcagcaggaaaaaatggccgcgccacagcaggtccgcgccgttcccctggcgcgcgcgctccgcctccgcacgcgcgcctccgccgccgccccgccggagacgtcccgccgcgcgctccttggcctcacggagcccgagctccgccagctcgccgtcgacctcggccagcaaagctaccgggggaagcagctgcacgacctcgtctacaagaacagggccaagcaggtcgaggagttcgcctacgtgccgaaggtgttccgggaggcgctggtcggcgcgggatggaacgtcggccggtcgccggtgcaccacgccgtcacggccaccgatggcaccaccaagatacttctcaagctcgaggacaacagattggtggagacggtggggatccccgtcgacgacaggggcacgcctagactcacagcctgcgtttcatcacaggtcggctgccccttgcgttgctcgttctgtgccactgggaagggagggtttgcgaggaaccttaaggggcacgagattgtcgagcaggtgttagccatagaggagtcattcaaacacagagtgacaaatgtagtgttcatggggatgggcgagcccatgttgaacctcaaagcagttctggaggcacaccaatgcttgaataaggaactaaagattgggcaaaggatgatgacaatctccacagtaggtgttcccaacacgataagtaagctagcatctcacaagcttcagtcgacactggcagtcagcctgcatgccccaaatcagaggttgcgcgaaacaattgttccaagtgcaaaggcatatcctctggaagcactaatggatgactgcaagaattattttcttgaaactggacgcagggtatccttcgagtacaccctgctagctgggattaatgatgaaagggcgcacgctgaggaacttgcagcgctgctgcatgcatgtggaggtggctatcacgtgaacctgattccctataacccggtagaaggttctgagtacaagaggccatacagaaaagcgattcaagcgtttgttgatgcgttggaatctcggaagatcacagtcagcgtcagacagacccgtgggcttgacgctaatgcagcttgtgggcagctcaggaatgagttccagaagaatcctctgctcgagtcatccccaccctctgagcccaaccaactgctcgagtcgtctacgccctcagagcccagccttgttcctgcttagtgatgaaatatatctcaatcatgtagaaattgagattttgtgaatttctgcattctaaagttcacacaggccctgaattgctctgctcatacatagatcactggcttataagttacaaagctgattatggggcagcctcctgtagctgatgagtttgttcatcttggatgtgagaggctcctgttcagttgagatttgaaggattttctttaagctatgatgtattctgcactaagttagtatatgtatttgatgaaatttctgtatattgctagagaattttggaacaaatagtatgtatggttatggaagctgccaaaa

SEQ ID NO: 6052 - DNA, 1614 bp, Secale cereale
gtgtaatcctcagcagcagcaggaaaaatggccgcgccgcagcaggtccgcgccgtgccgctggcgcgagcgctccgcctccgcacgcgcgcctccgccgcccccgccgccgcgccggagacgtctcgccgcgcgctcctcggcctcacggagcccgagctccgccagctcgccgtcgacctcggccagcaaagctaccgggggaagcagctgcacgacctcgtctacaagaacagggccaagcaggtcgaggagttcgcctacgtgcccaaggtgttccgggaggcgttggtcggcgcgggatggaatgtcggccggtcgccggtgcaccacgccgtcacggccaccgatggcaccaccaagatacttctgaagctggaggacaacaggttggtggagacggtggggatccccgtcgacgacaggggcacgcctagactcaccgcctgtgtttcgtcacaggtcggctgccccttgcgttgctcgttttgcgccacggggaagggagggttcgcgaggaaccttaaggggcacgagattgtcgagcaggtgttagccatagaggagtcattcaaacacagagtgacaaatgtagtgttcatggggatgggcgagcccatgttgaacctcaaagcagttctggaggcacaccaatgcttgaataaggaactaaagattgggcaaaggatgatgacaatctccacagtaggtgttcccaacacgataagtaagctagcatctcacaagcttcagtcgacactggcagtcagcctgcatgccccaaatcagaggttgcgcgaaacaattgttccaagtgcgaaggcataccctctggaagcactaatggatgactgcaagaattatttcctcgaaactggacgcagggtatccttcgagtacaccctgctagctgggattaatgatgaaaaggcgcacgctgaggaacttgcagcgctgctgcatgcatgtggaggtggttatcacgtgaacctgattccctataacccagtagaaggttctgagtacaagaggccatacagaaaagcgattcaagcgtttgttgatgcgttggaatctcggaagatcacggtcagcgtcagacagacccgtgggcttgacgctaatgcggcttgtgggcagctcaggaatgagttccagaagaatcctctgctcgagtcgtccccaccctctgagcccaaccaactgcttgagtcgtccccaccctctgagcccaaccaactgcccgaggcgtctacgccctcggagcccagccttgttcctgcttagtgatgaaatatatcccaattatgtagaaattgagattttgtgaatttctgcattctaaagttcacaggccctgaattgctctgctcatacatagatcactggcttataagttacaaagctgattagggggcagcctcctgtagctgatgagtttgttcatcttggatgtgagaggctcctgttcagttgagatttgaaggattttctttaagctatgatgtattctgcactaagttagtatatgtatttgatgaaagttctgtatattgctagagaattttggaacaaatagtatgtatggttacgaagctgccaaatcttatgcca

SEQ ID NO: 6053 - DNA, 1064 bp, Vigna unguiculata
ggatctttggttcgttcaccgtcgccactgcacccactccgtcgcgtctaccagcgctaagcaatggctccgaaaaaaggtgtgaaagctgcagtagcagcaccgaagaagaagctagggactattaaggagaaagttacgaacccgttgttcgagaagcgtccgaagcagttcgggatcggaggggcgttgcctccgaagcgggacctgactcggttcgtgaaatggccgaagaccgttcaaatccaacgcaagaaacgcatcctcaagcagaggctaaaggtccctcccgcactcaatcagttcaccaaaaccctcgacaagaatctcgcaaccaacctattcaagatgctgctgaagtacaggcctgaagacaaagcagagaagaaggagcgtttgttgaagagggctcaggctgaggctgatgggaaaagtgttgaagctaagaagcctattgttgtcaaatatggtctcaatcatgttacttaccttattgagcagaataaagcgcaacttgttgtgattgctcatgatgtggacccaatcgagcttgtggtctggcttccggcactctgcaggaagatggaaattccatactgcattgtcaagggcaaagcacgcttgggaacggttgtccacaagaaaacggcttcagttttgtgcttgacaactgtcaagaatgaagataaattggagttcagtagaatactagaagctattaaggctaacttcaatgacaagtatgatgagtacagaaagaagtggggtggtggaatcatgggttccaaatcccaagccaagaccagggccaaggagaagctcattgccaaagaagcggcccaaagaatgtcctagattcagttgttttatatttttgaggtcatttttctatattttatttaatgggagcctatacaaattaatgtgaggtttaatttcattttggtagctcgtattccattaagacccgattttgatctctgatatttgattatctctagttattgtagacttaatgaaatgcatttcttttttctgttcgggaatacaaaaaaaaaaaaaaa

SEQ ID NO: 6054 - DNA, 756 bp, Flaveria ramosissima
gtgaaggcggttgcaaccaagaagaaaacggagaaggttgtgaatccgttgttcgagaaaaggccgaagcagtttgggattgggggagcattgccccctaaaaaggatcttcacaggtttgtaagatggcctcaagttgttcgaattcaaaggaagaggaggatcctcaagcagcgtttgaaggtcccaccagctttgaaccagtttaccaagacccttgacaagaatcttgcaactactttgttcaagatgctactcaaatacagacctgaggataaagcagcaaaaaaggaacgtcttttgaaaagagcacaggccgagtcagaggggaagacagttgaagcaaagaagccgattgtcgtgaagtatggtctgaaccatgtcacttaccttattgagcagaataaggcacaattggtaatcattgctcatgatgttgatccaattgaattagttgtctggcttcctgcactttgcagaaagatggaaatcccctactgcattgtgaaagggaaatctcgattgggagccattgttcaccagaagaccgctgcagcactgtgcttgactacagtcaagaacgaagataaaatggaattcagccgaatattggaagccatcaaggcaaacttcaatgataagtatgacgagtataggaagaagtggggcggtggtataatgggatcaaaatcacaggcaaagaccaaggcaaaagagagagttcttgccaaggaggctgctcaaagaatgaattag

SEQ ID NO: 6055 - DNA, 1034 bp, Solanum tuberosum
aaaaatggctccaaagaagggtgttgcagtagcagcaaagaagaaggcggagaagacgtcgaaggtggtgaatccactgttcgagaagcggccaaagcagtttggtatcggtggggcgctgccaccgaagaaggatgtaacaaggaacgtgagatggcctcggaatgttacccttcaaaggaagaagaggattctcaagatgcgattgaaggtccctcctgctctcaaccagttcaccaaaacccttgataagaacctcgccaccaaccttttcaagatgcttcttaagtacaggcctgaggacaaagctgcaaagaaggagcgtcttgttaaaagggctcaagctgaagctgaaggaaaaacacctgaaacaaagaaacccattattgtgaagtatggccttaagcatatcacttaccttattgagcagaacaaagctcaactagtagtgattgctcatgatgtggacccaatagagttggttgtctggcttcctgcactatgcagaaagatggaaattccttactgcattgtgaaggggaaagcacgtttaggatcaatcgtgcacaagaaaactgcttcagccttgtgtttgactaccgtgaagaatgaagacaaaatggagttcagcagagttttggaggcaattaaggccaacttcaatgataagtatgaagagaacaggaagaagtggggtggcggtatcatgggctccaagtcacaggccaggaccaaggccaaagagagagttcttgctaaggaagctgcccagaggttgaactaagagcttgctgtgatatatacactgttattggattcaagagaggaactccaatttttgtgtttggttcacatgcttgacaatgttagagatattagttcgataagtaccattatgtttgccttttgcagactattgctctgtcgaagcttaaaattaaaactttatcagaagttcttgttagatgttttgttgagtgttttttatggccgcgaattgctcagttattcaagtatccacactttcactgctt

SEQ ID NO: 6056 - DNA, 992 bp, Solanum lycopersicum
agggttttgatccgtctcccgcaaaaatggctccaaagaagggtgttgcagtagcagcaaagaagaaggcggagaagacgtcgaaggtggtgaatccactgttcgagaagcggccaaaacagtttggtatcggtggggctctgccaccgaagaaggatgtaacaaggaacgtgagatggcctcggaatgttacccttcaaaggaagaagaggattctcaagatgcgattgaaggtccctcctgctctcaaccagttcaccaaaaccctagataagaatctagctaccaaccttttcaagatgcttcttaagtacaggcctgaggacaaagctgcaaagaaggagcgtcttgttaaaagggctcaagctgaagctgaaggaaaaacacctgaaacaaagaaacccattattgtgaagtatggccttaagcatatcacttaccttattgagcagaacaaagctcaactagtagtgattgctcatgatgtggacccaatagagttggttgtctggctgcctgcactatgcagaaagatggaaattccttactgcattgtgaaggggaaagcacgtttaggatctatcgtgcataagaaaactgcttcagccttgtgtttgacaaccgtgaagaatgaagacaaaatggagttcagcagagttttggaggcaattaaggccaacttcaatgacaagtatgaagagaacaggaagaagtggggtggtggtatcatgggctccaagtcacaggccaggaccaaggccaaagagagagttcttgctaaggaagctgcccagaggttgaactaagagcttgctgtgatatatacactgctattggattcaagatcaactccaatttttgtgtttggttcacatgctcgacaatgttagagatattagttcgataagttccaccattatgtttgccttttgcagattattgctctgtcgaagcttaaaattaaaactttttgacgttcttgttagatgttt

SEQ ID NO: 6057 - DNA, 1141 bp, Capsicum annuum
ccgatcatcatctccgacaacacaatggctccaaagaaaggcgtagtagctataaagaagaccgagaaattgaaggtggtcaatccgttgttcgagaagcgttcgaagcagtttggaatcggtggcgcattgcggccgaagaaggatctgtcaaggtttgtgccttggccgcaaggtgttcaaatccagaggaagaagaggatactcaagcagcgattgaaagttcctcctgctctcaatcagttctcgaagacactcgataagaatattgctacaaacctgttcaaaatgctgctcaagtacaggcctgaggacaaagccacaaagaaggagcgtctcgtaaaaagagctcaaactgaggcggaaggaaaaactcccgagacaaaaaaacctattgttgtgaagtacggtcttaagcacattacctaccttattgagcagaacaaagcacagttagttgtgattgctcatgatgtcgatccaattgagttggttgtctggcttcctgccctctgcagaaagatggagattccctattgtattgtgaaagggaaagcacgtttaggatcgattgtccataagaaaactgcttcagctctatgcttgactaccgtgaagaacgaagataaaatggagttcagcagagtattggaggcaattaaagctaacttcaacgataaatacgaggagaacaggaagaaatggggaggtggtatcatgggcgctaaatcacaagccagaacgaaggccaaagagagggtcctcgccaaggaagctgcacagagattgaactaagagcttcgggtcatacatgcttgcatttgagctagagagttacgaggcaaaaattttgtttagtttacttgctttgatcaaattttggagacctttttaagccttttcatattcatcccttctattgcaaattactgcatttttgcaaagacattttggaacattggttttggtgggaaatcaccacagcattcctagagatagcttgtccttgtagttgtcgttggatcgagttctgtcttctttcatcgagcgaaacaaacaaacatgttctgccatttgtcaaaaccagaataacatctaacgcgtaagctgaaaagcattggctccaaaaaaaacctcgtgc

SEQ ID NO: 6058 - DNA, 1377 bp, Marchantia polymorpha
cgaagaactcgctctttcccctctttcatcgtcagctcgagcagggtgtctctcagctgcacaccctagggtttcgaaaaaaatggctcctaagcggggaactatcaagactcctgtccctgctcctgtggagaagaagaaggtagtagagaaagtcgcgaaccccttgtttgagaagaggccgaagcagttcggtattggtggcgcccttccacccaagcgtgatctccaccgatttgtgaaatggcccaagtacgtccgcatccagagacaacgccgtgtcttgaaccagcgtttgaaggttccaccggcccttaaccagttcaccaagacactcgacaagaacttggctgcaagtttgttcaagatgttgttgaagtacagacccgaggacaaggctgcgaagaaggagaggcttctcaagaaggcccaggccgaagccgagggcaagactgtcgagaccaagaaaccaatagtcgtgaagtacggtatcaaccacgtgacctacctcattgagcaaggtaaggctcaattggtggtaattgcccacgatgttgaccctattgaactagttgtgtggctacccgccctctgccgcaagatgggtgttccatacgctattgtgaagggcaagtctagacttggccaaattattcacagcaagaccgccactgctttgtgccttacttcagtgaagaacgaggacaagcacgacttcagcaagattgtcgaagctgtgaaggctaacttcaacgaccgatatgatgaataccgcaagcaatggggtggaggtattatgggagtcaagtcccaggctaagactaagatcaaggagaaaattattgccaaggaagctgctcagagggctgcctagaatagtgttctctaaattagacttacttagcgaatttgaggcatatgaggggagggattctttctcggcagtacggagagctgttgtagacgatgatttctgggaggatctcatcaggaagcagcttgcgatcgggaactcatgaacacaaagctcggtatcagctcgggccatcccgagacagggatcccacacgccttgcccttactggatcctactcaatttttgactcccaaccaaagccgcactgtatgtcttgtctattataaagtggaagtacattcgaagaatcttaaggcgatttgtaccgtatttgagctcgcgaatatgttgtggaccttggcatgtgagtcagtaggctgccctccccttggatacctgttcagatgcccattgcaggtcttcgaacataggagaagtgaaagaaataaaacttgtacctctcgtttctccttttcattgctggattttggaaacttgcaaggcgcaggtcctatattgag

SEQ ID NO: 6059 - DNA, 1811 bp, Zea mays
ccatcatctccatctcagcctcgtgccagcttgagcattccactttgctagccagcatatacttacacgtagctagcttaatcaacagcaggagtaacagctagcgacgacgaccatatggcggcgaagcaggcggtcgtcgctgctgctgcctccggccaccccaagatgggggaggagaagctgatcatccggccggagaaggtgcggttcatagacgtgctgtcgatgctgctcctgaggcgccccatcaccagctacgcattcgtggaggccggcgaccggaccgccgccgacctgggcagcacgcccggcgactggctcgtcgcgctcacgcaggtcatccagaaggcgctcgccggcgcctactacccggctctcgtggtcggcgctgtcgtcgagttcctcctcaacttcgtcgcgctcaacaatggcatactcggcatctttctcaacctcttcagatgtaagctggtgatcccactgaaccgggaggcgcccaacttccggtccatgatcgggatgatcgacgggaggacggagctgaagccgctgccagccagcggcggcccagaggaccggcggctgcaggtggtgggcgtctccgccgccgccggatccggcggcgatgactactacttggacgtggagagcggcagcgcggcggtgccgctggtgcagcagcagtacgtgaacgggcggctcgtccgcctccgcaccttctccgtgttcgaggtgagcatgatggccgccaagatcgcctacgagaacgccgcctacatcgagaacgtcgtcaacaacgtctggaagttccacttcgtagggttctacaactgctggaacaagttcgtgggcgaccacacgacgcaggcgttcgtgttcaccgacaaggcagaggacgcgagcgtggtggtggtgtcgttccggggcacggagcccttcaacatgcgggactggtccacggacgtgaacctgtcgtggctgggcatgggcgagctgggccacgtccacgtcggcttcctcaaggcgctgggcctgcaggaggaggacggcaaggacgccacgcgggcgttccccaaggccgcccccaacgccgtcccgggcaagccgctggcctactacgcgctgcgcgaggaggtccagaagcagctgcagaagcacccgaacgccaacgtcgtggtcaccggccacagcctcggcgccgcgctggcggccatcttcccggcgctgctggcgttccacggggagcggggcgtcctggaccgcctgctctccgtggtcacctacgggcagccgcgcgtgggcgacaaggtgttcgcgggctacgtgcgcgccaacgtgcccgtggagccgctccgggtggtgtaccgctacgacgtggtcccgcgcgtgcccttcgacgcgccgcccgtcgccgacttcgcgcacggcggcacctgcgtctacttcgacggctggtacaagggccgcgagatcgccaagggcggcgacgcgcccaacaagaactacttcgaccccaggtacctgctgtccatgtacggcaacgcgtggggggacctcttcaagggcgccttcctgtgggccaaggagggcaaggactaccgcgagggcgccgtctcgctgctctaccgcgccaccggcctgctcgtgcccggcatcgcgtcgcacagccccagggactacgtcaacgccgtccgcctcggcagcgtcgcctcggcgtagcttttggattgcatgttcgtttccatgcatgtgtatcattgcatgcaataattggatgaaataaacagcaataagcttcatcagtatta

SEQ ID NO: 6060 - DNA, 1845 bp, Zea mays
agttgatacatttttttttgggaagcgcttcaactgttcagcaacgtgcgcggccggccaggcctcatgtatctataattctatatagagaggagaggatgcatatattcaacaacaacaataataatactgatgaagcttattgctgtttatttcatccaattattgcatgcaatgatacacatgcatggaaacgaacatgcaatccaaaagctacgccgaggcgacgctgccgaggcggacggcgttgacgtagtccctggggctgtgcgacgcgatgccgggcacgagcaggccggtggcgcggtagagcagcgagacggcgccctcgcggtagtccttgccctccttggcccacaggaaggcgcccttgaagaggtccccccacgcgttgccgtacatggacagcaggtacctggggtcgaagtagttcttgttgggcgcgtcgccgcccttggcgatctcgcggcccttgtaccagccgtcgaagtagacgcaggtgccgccgtgcgcgaagtcggcgacgggcggcgcgtcgaagggcacgcgcgggaccacgtcgtagcggtacaccacccggagcggctccacgggcacgttggcgcgcacgtagcccgcgaacaccttgtcgcccacgcgcggctgcccgtaggtgaccacggagagcaggcggtccaggacgccccgctccccgtggaacgccagcagcgccgggaagatggccgccagcgcggcgccgaggctgtggccggtgaccacgacgttggcgttcgggtgcttctgcagctgcttctggacctcctcgcgcagcgcgtagtaggccagcggcttgcccgggacggcgttgggggcggccttggggaacgcccgcgtggcgtccttgccgtcctcctcctgcaggcccagcgccttgaggaagccgacgtggacgtggcccagctcgcccatgcccagccacgacaggttcacgtccgtggaccagtcccgcatgttgaagggctccgtgccccggaacgacaccaccaccacgctcgcgtcctctgccttgtcggtgaacacgaacgcctgcgtcgtgtggtcgcccacgaactctgcatatgtacgtctgtaaaaataataatgctaccttccagacgttgttgacgacgttctcgatgtaggcggcgttctcgtaggcgatcttggcggccatcatgctcacctcgaacacggagaaggtgcggaggcggacgagccgcccgttcacgtactgctgctgcaccagcggcaccgccgcgctgccgctctccacgtccaagtagtagtcatcgccgccggatccggcggcggcggagacgcccaccacctgcagccgccggtcctctgggccgccgctggctggcagcggcttcagctccgtcctcccgtcgatcatcccgatcatggaccggaagttgggcgcctcccggttcagtgggatcaccagcttacctgtccatgcatataggttgagaaagatgccgagtatgccattgttgagcgcgacgaagttgaggaggaactcgacgacagcgccgaccacgagagccgggtagtaggcgccggcgagcgccttctggatgacctgcgtgagcgcgacgagccagtcgccgggcgtgctgcccaggtcggcggcggtccggtcgccggcctccacgaacgcgtagctggtgatggggcgcctcaggagcagcatcgacagcacgtctatgaaccgcaccttctccggccggatgatcagcttctcctcccccatcttggggtggccggaggcagcagcagcgacgaccgcctgcttcgccgccatatatatggtcgtcgtcgcta

SEQ ID NO: 6061 - DNA, 2444 bp, Panicum virgatum
tatgcatgatggatataggtcaggactcatatgaagctaatatgaacaatctcagtgcagatcccatcagctagatagctgctagcgtccagggaggtcagtaaaccaccccgggaaagcagcacaacacctgatccacgcgctgctgacttggccagtattagtaccaactcatcactgtatatgtcatacacacgtaaaaccatggaaacacatgtgtcatgtgtgtaaaccctggacagcccaccttcacctaccaaaaaaccaatcatagaaacagagatcaatcaaacaacctagcccagggcacggccctgcccagcatcggcacagcccggccgggccatgccgcccgtccagttcagcccaacccagccctctttgttgccctataaaaaggcccccccttcgctccatttcagcatcgtgccagcttgagcccttgcactttgctagctaccattcttacacgtagctagcttaatcagctagagcaccagcagctagtactcgccgccgtccgggcgatcatggtggcgttgaagcagcagcagcccgccgccggcgggccaaagatgggggcggagaagctgatcatccggacggagaaggtgcggttcatcgacatcctgtcgatgctgttcctgcggcgcccgatcaccagctacccgttcgtggaggccggcgaccagaccgccgccgacttcggcagcacgccgggggactggttcgtcgcactcacgcagctcatccagaaggcgctcgccggcgcctactacccggccctcatgatcggcgccgtcgtcgagttcctcctcaacttcatcgcgctcaacaatggcatactgggcatcttcctgaatatcttcagatgtaagctggtgatcccactgaaccgggaggcgcccaacttccggtcgatgatcgcgatgatcgacgggaggacggagctgaagccgctgccggcgggcggcggccccgacgaccaacggctgcaggtggtgggcgtctccgccggcggcggcggcaaggacgactactacgtggacgtggagagtggcgagtgcggcagcgcgtcggtgccgctcctccagcagcagtacgtgaacgggcggctcatccgcctccgcaccttctccgtcttcgaggtcaccgtcatggccgccaagatcgcctacgagaacgccgcctacatcgagaacgtcgtaaaaaacgtctggaagttcaacttcgtggggttctacagctgctggaacaagttcgttggcgagcacacgacgcaggcgttcgtgatgacggacaaggcgtcggacgcgagcgtggtggtggtctccttccggggcacggagcccttcaacatgcgcgactggtccacggacgtgaacctctcgtggctgggcatggccgacatgggccacgtccacgtcggcttcctcaaggcgctcggcctccaggaggaggacggcaaggacgccgccagggccttccccaaggacgcccccaacgccgccgccggcaagcccctcgcctactacaagctccgcgaggtggtcagggaccagctcgccaagcacccgggcgccaccctcgtggttaccggccacagcctcggcggcgcgctggccgccatcttcccggcgctgctcgcgctccacggcgagcaggacgtcctggaccgcctcctcgccgtcgtcacctacggccagccgcgcgtcggcgacaaggtgttcgccgacttcctgcgcgccaggctccgcgtcgagatgctccgggtggtgtaccggtacgacgtcgtgccgcgggtgccgttcgacgcgccgcccgtcgccgagtacgcgcacggcgggacctgcgtctacttcgacggctggtacaggggcgccgccatccccggcggcggggacgcgcccaaccccaactacttcgacccgaggttcctgctgtccatgtacggcaacgcgtggggggacctgttcaagggcgccttcctgtgggccaaggagggcagggactaccgggagggcgccgtgtcgctgctctaccgcgccgccgggctgctggtgcccggcctggcgtcgcacagccccagggactacgtcaacgccgtccgcctcggcagcatcgccgccaaggaggcctgatccatgcatgatgaacttcaatgatgatctggagagctacctactatgagcctggatggaagagatgatcaataaggttttattttcattttcccccagattttggggactagctaagctagctagctgcgagcgtgtgtcgacaagtgtgtggagatcgagggaagctgctggctgttgatgcgtgttcatttccatttccatgtgtatctctgcaacaattggaataatatgctccgatatattctgcctgcttgatctccatggacatagcaaggcaagtcactgagcagttgaagcaaa

SEQ ID NO: 6062 - DNA, 2125 bp, Setaria italica
ccttcgctccatctcagcatcgtgccagcttgagccttccactttgctagctaccacacttacacgtagctagcttaatcagctagggcgccctactactagggtggtgtagctatcatcagctgctagagctagcaccactcgccgtccggcgaccatggtggcgaagcagcagcagctcgccacaggtggcggccccaagatgggggcggagaagctgatcatccggtcggagaaggtgcggttcgtcgacatcctgtcgatgctgttcctgcgccgcccgatcaccagctacccgttcgtggaggccggcgaccagaccgccgccgacgtcggcagcacgccgggggacatgttcgtcctgctcacgcagatcatccagaaggcgctcgccgctgcctactacccggcggtgatgatcggcaccgtcgtcgagttcatcctcaacttcatcgcgctcaacaatggcatactcggcatcttcctgaacatcttcagatgtaagctggtgatcccgctgaaccgggaggcgcccaacttccggtcgatgatcgggatgatcgacgggaggacggagctgaagccgctgccggcgggcggcggccccgacgaccggcggctgcaggtggtgggcgtctccggcgccggaaaggcggcgacggtcggggaggactactacgtcgacgtggagagcggcgagtgcggcggcgcgtcggtgccgctcgtgcaccagcagtacgtgaacggccggctcatccgcctccgcaccttctccatcttcgaggtcaccgtcatggccgccaagatcgcctacgagaacgccgcctacatcgagaacgtcgtcaagaacgtctggaagttcaacttcgtgggctactacagctgctggaacaagttcgttggcgaccacacgacgcaggcgttcgtgatgacggacaaggaggcggacgcgagcgtggtggtggtgtcgttccgcggcacggagcccttcaacatgcgggactggtccacggacgtgaacctctcgtggctgggcatgggcgccatgggccacgtccacgtcggcttcctcaaggcgctgggcctccaggaggaggacggcaaggacgccgcccgggccttccccaaggcggcgcccaacgccgacgccggcaagcccctcgcctactacaagctccgcgaggtcatccaggaccagctcaagaagcaccccaaggccaacctcgtcgtcaccggccacagcctcggcggcgcgctcgccgccatcttcccggcgctcctggcgttccacggcgagcgggacgtcctcgaccgcctcatctccgtcgtcacctacggccagccgcgcgtcggggacaaggtcttcgccgccttcctccgcgccaacgtgcccgtggagctgctccgggtggtgtaccggtacgacgtcgtgccacgggtgccgttcgacgcgccgccggtggcggagttcgtgcacggcgggacatgcgtctacttcaacgggtggtacaagtgcaccgccatcgccgacggcggggacgcgcccaaccccaactatatcgacccgaggtacctgctgtccatgtacggcaacgcatggggggacctcgtcaaggccgccttcctggggatgaaggagggcaaggactaccgggagggcgccgtgtcgctgctctaccgcgccgccggcctgctcgtgcccggcctcgcgtcgcacagccccagggactacgtcaacgccgcccgcctcggcagcatgacggccaaggaggcctgatcgatcgtccatgatgatgatgaatttcactgttcgtgatcgatctagacctacctactatactatatatgagccgtggaagagatgaacaataaggttctattttattttattttttccagcttttggggattagctgcgatcgagtgtgtgtgtgtgtggactctgcagagatcgagaagctggctgctgctgcgtgttcatttccatgtgtatctttgcaaataattggaataataagcttcaatattatgcttccatcctctccatggatatggctaggcgagttgctgaacagttactcaagcgatcgaaaagtacagcaaagcagccaaacaaatccatgag

SEQ ID NO: 6063 - DNA, 1042 bp, Zea mays
cttttatgtgtttccccgtttcgttgttttcggttctcctttgcctttgtttcccttttctgttctttaggggttgagctctgaggttttcatacggggtttcatctctagcctaccccaacgtgcttgggacaaaaaggctttgttgttgttgttgttgttgttgtatatgaacggctatatcaagccaagcgcccaagccaatgtagcgctgcagataaggttttggattggaccaagcataggctcgacttgaaccaagaacaaggtacgtaggagcaatccaaagcacccattgcacgcttctgcattgcagaggtagtagcaaggaggatcagcaatgtcttcccctccgccgcctccgatgtccactctgcacaagtgctgctcgtcgccgtcgcagccatcacctaagctaccgcctaagctgcagcgacctgcggaaagcaggcacaagcctatctgcggtggagccaggctgcggatcaccaggagagcccacgccgcctccctcctcctcctcggcctggcgggcgctgcggtgccggcgccggtcagggcggcggaggacgacgggagcagcggaggggagggcgtcctcggcgccatcaagtccatcttcgatcccaacgagacgaccaaggccgggaaggtgctgcccaaggcgtacctcaaggcggccagggaggtggtgcgcacgctccgcgagtcgctggaggaggacgacggtggcgacatggccaggttccgccgcaacgccgacgccgccaaggagtccatcagggcgttcctgggcgggtggagaggccagcaggccgtcaccgacgaggagtcgtacgtcgcgctggagaaggcgatcaggtcgctggccgagttctactccaaggcagggccgtccgcctcgcttccacaggacgtcaagaacaagatcctcgatgacctcagcgccgcagacgcctacctgtagattttgcttctcctcagggacattgtattgcattgcatgcaacgcacatctcaaacgatgatatggtttcgctct

SEQ ID NO: 6064 - DNA, 1241 bp, Panicum virgatum
cagatttttgcgaatattagcattccactgaaacggatctaatgggccgttcggtactttgtgtggcttgtcacgaagcgggctccatgcgctctggggtgcaggccgagagcccatccgccaaccaggcctttccggttgtcgcaaaccttttttctttatggctccaatcatggcaggaagaagccttgatgaatgctggagataaggttctggattgtcagaagaggctcgaggcgaaccaagaacaaggtgcagcaacgatcgaagctacgctctctgctcgcgtcgatcagctcatgccatcaatccatcgccactaagagcggcacctgttgctgttgctctgccagagctcgtatctaggatcagcaatgctttcccctccgccgcctccgatgcccacgctgagcaagtgctgctgctcgtcgccgtcgccgaagctgcagcgacctgcggagaccgggaagaagcctacctgcggcggagcagcgaggctgccgatcacaaggagagcccacgccgcatccctcctcctcctcggcctcgcgggcatggcggtggcggcgccggcgccggcgagggcggacgatgcgagcaacggcggcgaggaggagggcgtcctcggcgccatcaagtccatcttcgacccgaacgagaagaccaaggccgggaaggtgctccccaaggcgtacctcaaggccgccagggaggtggtgcgcacgctccgggagtcgctggaggaggacgacggcggcgacatggccaggttccggcggaacgccgacgccgccagggagtccatccgggagttcctgggcgggtggagaggccagcaggccgtcgccgccgaggagtcgtacgttgcgttggagaaggcgatccgatcactggccgagttctactccaaagcagggccctccgctccgctcccacaggatgtcaggaacaagatcctcgatgacctcagtacagcagacgcctacctgtagattttgctttccacaacattgttcgtgcacatctcaacgatgaggaagaaattattctgctccagtatttcattctttttttacgtgcaaagctcctttttcacccaaacaatacacacattcatgaagcccagacattttagccgggcattgtggcatggtgcatgcacgcaaagcctagttcttccacaggatcgcgaggaaatttgcaaccaatttggcatgacagatcaggtgggcaatttctag

SEQ ID NO: 6065 - DNA, 1508 bp, Setaria italica
catcacaacagccaagagctccactaatttcctctcgctgagaagaaaactagcaaggcggagaaaccagagaaggaaggcatcgatcgaaggcgcgccatggcgtccaacggcaacggcagcttggcgaacggcgcctccacccatggaaagcccatcaaatgcaaagcggcggtggcgtggggccccggcgagccgctggcgatggaggaggtggaggtggcgccgccggggcggcgggaggtccgcgtcaagctgctcttcacctccatctgccacaccgatctcagcttcttgaaaggagagaacgaacagcagcgcaagtttccccgcatcctcggccatgaggcagccggagtggtggagagcgtgggcgacggagtggaggatctcgcccccggcgaccatgtggtccccatcttcaacggcgagtgcggggcgtgcgcctactgcaagtccggcaagacaaacctgtgcgggacctaccgcgtcaaccctttcaagagcaccatgacctccgacggcggcacgaggttctccgtggtggacgcgtcgtccggcgagcgccggccggtctaccacttcctcaacacgtccaccttcgccgagtacaccgtgctggacgcggcttgcgccgtcaaggtccaccccaaggcgccgctggagaagatgtgcctcctcagctgcggcatctccacaggtgttggggctgcatggaacactgcaaacgtttctacggggtccacagtggcagtatttgggcttggtgctgttggtctcgcggttgctgagggtgccaggctacgtggggcagctcggatcattggtgtagatataaaccccgaaaagttcaccaaagggaaagagatgggcgtcacggatttcatcgactcgaaggcctgtgacaaaccggtccatgaggtgatcagggagatgacggatgggggcgtcgactacagtttcgagtgtaccgggattaatgatgtgctgagagaggctttcctgtccacacatgatggttggggcctgacggtggtactggggatccatgcgacacccaagatgatgccgttgcacccgatggagctcttcgacggccgtcggatcaccggctgtgtcttcggcgacttcaagggcaagtcccagctgcctgacatcgtggacaagtgcatgagtggggagctgaaggtaaattttgatgggttcataacgcacaagatgcccttctcggacaccaacaaggccatccagcttctggaggaaggcaagtcacttaggtgcgtgctccatttctgatggagagtttagccctgtttatgttacaaaaataaatgtagagtttttttaaccagtgctgagttgtataacacatgtgcatcggtgctatctattgtaaaaatgtgtgcgatttgagacatttattcagaaggacataatatttatcatttctgatacagcttgcttcttttgtactccctccatcctgtaatcactagtagagaattggc

SEQ ID NO: 6066 - DNA, 1849 bp, Zea mays
tttgtattagtggtgttttagaattcgcagcttttactaagtatctagatataaatctagaaatattaaacgcatctgcctctaaatactgtataattaaaaaacaaaattgaagaaaccgtcggccaacgcaaggaaacgaagaagagaaaaatgaacaccattatgctttggttcctctgcctccacctgtctcgcccatcactatataaacagtccaaccggctagcctccacttgtctcgctcactagagccaagagctccatccatttcatttcctccactctctaaaaagtagaccagccaggggagagaagtgaggcatcgaaggaagcccccaccatggcggccaacggcaagagcagcttggcgaacggcgcctccaccgggggaaagcccatcaaatgcaaagcggcggtggcgtgggggcccggcgagccgcttgtgatggaggaggtggaggtggcgccgccggggcgcctggaggtgcgcgtgaagctgctcttcacctccatctgccacaccgatctcagtttcttgaagggagagaacgagctgcaccgcaagttcccccgcatcctgggccatgaggcagccggagtggtggagagcgtgggggacggggtggaggatctggccgccggcgaccatgtgatccccatcttcaacggcgagtgcggggcgtgcgcctactgcgagtccgatcggacaaacctgtgcgggacctaccgcgtggacgcttccaagagcaccatggtctctgacggcggcaccaggttctccgtagcggaccgcgtgtccggccgcaccgtgccggtctaccacttcctcaacacctcaaccttcaccgagtacaccgtgctggacgcggcctgcgccgccaaggtcaaccccgaggcaccactgcaaaagatgtgcctcctcagctgtggcatctccacaggagttggggctgtatggaacacagccaacgtttccgcgggctccaccgttgcgattttcggccttggcgctgtcgggctcgcggttgctgagggtgccaggctacgaggggcagctcggatcatcggtgttgacataaaccctgaaaagttcaccaaagggagagagatgggcgtcactgactttgtcgactccagggcctctgacaaaccggtgcacgaggtgatcagggagatgacccatggaggtgtcgactacagctttgagtgtaccgggatcaacggcgtgctgcgagaggccttcgtgtccacgcatgacggttggggcctgacggtggtgctggggatccatgcgacgcccaagatgctgccgctgcacccgatggagctcttcgacggccgtcggatcaccgcctgcgtcttcggtgacgtcaaggggaagtcccagctgccggccatcgtcgacaagtgcgtcaacggggacctggatataaaccttgacgggttcataacacacaggatgcccttctcggacatcaacaaagccatccagttgctggaggaaggcaagtcccttagatgcgtgctcaacctctgatggacatggaccgaccaccacacatgcatgcgtgggagattattgtccttggttagtttggttactacagaaataatcaaataaatatagaatccgcagtgtgtgtcgagttgtacaattcacgtgtgcaccagtgctactttattgtaaaggagggtgtgattgaagccaactagtagcagcagggcacaagtgttgtttctatcgtacatgtgctgtgatgtctcaaagttatctcggttctcacaacacaacttattgtcataaaatatgctgatctttgattttacataacaaacttgtttcgct

SEQ ID NO: 6067 - DNA, 1642 bp, Panicum virgatum
taggcacgatactgatgaggtgattaaaggccccagctccctttttgatctcgcaagaaaacaaaatgacaagagtagaaaaagatagtaatagtagcagctaggattctccttcccgtgcccctttgcctctggctacataaacactccaacaagcagccggcctgtgccttcgttgtatcgctcgccgcctcaagggagcgagagaaccaagaaggcatccatccaaggtgccatggcgtccaacggcaacggcagcttggcgaacggcgcttccaccaggggaaagcccatcaaatgcaaagctgcggtggcatggggccccagtgagccgctgacgatggaggaggtggaggtggcgccgccggggcgcctggaggtgcgtgtcaagctgctcttcacctccatctgccacaccgacctcagcttcttgaaaggagagaacgagctgcagagcaagtttccccggatcctcggccatgaggcagccggagtggtggagagcgtgggcgagggagtggaggatctcgccgccggcgaccatgtggtccccatcttcaacggcgagtgcggggcgtgcgcctactgcgagtccgacaagacaaacctgtgcgggacctaccgcgtcaaccctttcaagagcaccatggcctccgacggcggcacgaggttctccgtcgtggacgggaccggcgagcgccggccggtgtaccacttcctcaacacctccaccttcgccgagtacaccgtgctggacgcggcctgcgccgtcaaggtccacccgaaggccccgctggacaagatgtgcctgctcagctgcggcatctccacaggtgtaggggctgcatggaacactgcaaacattaacacggggtccaccgttgccgtattcgggcttggagctgttggtctcgcggttgctgagggtgccagactacgtggggcggctcggataatcggtattgacataaactccgaaaagttcaccaaagggaaagagatgggcgtcactgatttcatcgactccaaggcctgtgacaagccagtccatgaggtgatcagggagatgacggatgggggtgtcgattgcagcttcgagtgtaccgggatcaacgatgtgctgcgagaggccttcctgtccacgcatgacggttggggcctgacggtgatactagggatccatgcgacacccaagatgatgccgttgcacccaatggaactctttgacggccgtcgaatcaccggctgcgtcttcggcgacttcaagggaaagtcccagctgccggaccttgtcgacaagttcatgaatgggaggctgaacttaaactttgatgggttcataacacacaacatgtctttctcggacatcaacaaagccttccagcttctggaggaaggcaagtcccttaggagcgtgctccatttctgatggagttagccttgtttatgttacaaaaataaatgtagattcttttttcaccaatgttgggttgtataacacacgtaggacacatgtgcatcaatgttatctcttgtaaaaaaagggcgcgatttgagacaattgttcaggagtacataatatttatcatctctaatatctcatcaacgaaaaaaggacgttggaaggccttctcctgctaca

SEQ ID NO: 6068 - DNA, 1476 bp, Setaria italica
aagaactccattccctgtccccaaaagaagagtcagaagaacccagccgatggacggcaccatggcagcagcggcggccaacggcaacggcagcttggccaacggcggctccggcacccgtgggaagcccatcaaatgcaaagcggcggtggcgtggggccctggcgagccgctctccctggaggaggtggaggtggcgccgccggggcggctggaggtgcgcgtcaaggtgctcttcacctccatctgccacaccgacctcagcgcctggaagggagaaaccgagatgcatcgcaagtttcctcgcatcttcggtcacgaggcagccggggtggtggagagcgtgggcgacggagtggaagacctcgttcctggagaccacgtcatccccatcttcactggcgagtgcagggaatgtgtctactgcgggtccgacaagacgaacctgtgtgggacctaccgcgtgaaccctttcaagagcaccatgacctccgacggcggcacaaggttcgccgtggtggacgcgtcgtccggcgagcgccagccggtctaccacttcctcaacacgtccaccttcgccgagtacaccgtgctggacgcggcctgcgccgtcaaggtccaccccaaggcgccgctggagaagatgtgcctcctcagctgcggcatctccacaggtgttggggctgcatggaacactgcaaacgtttctacggggtccacagtggcagtatttgggcttggtgctgttggtctcgcggttgctgagggtgccaggctacgtggggcagctcggatcattggtgtagatataaaccccgaaaagttcaccaaagggaaagagatgggcgtcacggatttcatcgactcgaaggcctgtggcaaaccggtccatgaggtgatcagggagatgacggatgggggcgtcgactacagtttcgagtgtaccgggattaatgatgtgctgagagaggctttcctgtccacacatgatggttggggcctgacggtggtactggggatccatgcgacacccaagatgatgccgttgcacccgatggagctcttcgacggccgccggatcaccggctgcgccttcggcgacttcaagggcaagtcccagctgccggacctcgtcgataagtgcatcaacggggaggttaatatcaacttcgatggcttcataacgcacaagttgcccttctcggacatcaacaaggctttccagttgctggaggaaggcaagtcgctgaggtgcctgcttaatttctaatcagggaggtggacttcaggattactgttgattcgagtggaataataataaaagtagggaaacgttttccagtgtccacttgtataattcccatgtgcaatatgtatgtattataaaatgaatgggacttctatgaagaagaaaaacacaggtattatccagaacaaaaatgacgttaatgttggcattagtatctattttcatac

SEQ ID NO: 6069 - DNA, 1290 bp, Panicum virgatum
agctgcggtggcatggggccccagtgagccgctgacgatggaggaggtggaggtggcgccgccggggcgcctggaggtgcgcgtcaagctgctcttcacctccatctgccacaccgacctcagcttcttgaaaggagagaacgagctgcagagcaagtttccccggatcctcggccatgaggcagccggagtggtggagagcgtgggcgagggagtggaggatctcgccgccggcgaccatgtggtccccatcttcaacggcgagtgcggggcgtgcgcctactgcgagtccgacaagacaaacctgtgcgggacctaccgcgtcaaccctttcaagagcaccatggcctccgacggcggcacgaggttctccgtcgtggacgggaccggcgagcgccggccggtgtaccacttcctcaacacctccaccttcgccgagtacaccgtgctggacgcggcctgcgccgtcaaggtccacccgaaggccccgctggacaagatgtgcctgctcagctgcggcatctccacaggtgtaggggctgcatggaacactgcaaacattaacacggggtccaccgttgccgtattcgggcttggagctgttggtctcgcggttgctgagggtgccagactacgtggggcggctcggataatcggtattgacataaactccgaaaagttcaccaaagggaaagagatgggcgtcactgatttcatcgactccaaggcctgtgacaagccagtccatgaggtgatcagggagatgacggatgggggtgtcgattgcagcttcgagtgtaccgggatcaacgatgtgctgcgagaggccttcctgtccacgcatgacggttggggcctgacggtgatactagggatccatgcgacacccaagatgatgccgttgcacccaatggaactctttgacggccgtcgaatcaccggctgcgtcttcggcgacttcaagggaaagtcccagctgccggaccttgtcgacaagttcatgaatgggaggctgaacttaaactttgatgggttcataacacacaacatgtgtttctcggacatcaacaaagccttccagcttctggaggaaggcaagtcccttaggagcgtgctccatttctgatggagttagccttgtgtaggttacaaaaataaatgtagattcttttttcaccaatgttgggttgtataacacacgtaggacacatgtgcatcaatgttatctcttgtaaaaaaaaagggcgcgatttgagacaattgttcaggagtacataatatttatcatct

SEQ ID NO: 6070 - DNA, 1558 bp, Brachypodium distachyon
gtccctaggctacagtataaaagcagtccaaccgtccaagcagcctgcctcactcgctagaaccaagaacttcatctcccttgaggaaaaaaacaacaaagaaagaagttgacgccatggaagctgccaatggtttctccaacggcggaagcacccaaggaaagcccatcaaatgcaaagcggccgtggcgtggggtcccggcgagccgctggtgatggaggaggtggaggtggcgccgccggcgcccatggaggtgcgcgtcaaggtgctcttcacctccatctgccacaccgatctcagcttctggaagggagagaacgagcgtcaacgcaagtttcctcgcatcctggggcacgaggcagccggagtgattgagagtgtgggcgaaggagtgaaggaccttgcacctggagatcacgtggtccccatcttcacaggtgagtgcgggacatgcgcctattgtgagtccagcaagaccaacctgtgtgggacctatcgcgtcaaccctttcaagagcaccatggtctccgacaacggcacaaggttctccgtggtagaccggtcgagcggcgcacctcaacccgtgtaccacttcctcaacacctccacgttcgccgagtacacggtgctcgactctgcctgcgctgtcaagatcaacccccaggctcctcttgagaaaatgtgtcttctcagctgcggcatctccacgggagtgggagccgcatggaacactgcaaacgtgtccaaggaatccaccgtggctgtattcgggcttggagccgttggtctcgcggttgctgaaggcgcaaggatcagaggggcagctcgcatcatcggcgtggacattaaccctgacaagttcaccaaaggcaaggagatgggcgtcaccgatttcatcgagtccaaggcgtgtgggaagcccgtccacgagcttatcagggacatgacgggtgggggcgtcgactgcagcttcgagtgcaccggcatcgttgacgtgctccgggaggcctttctctccacacatgacggctggggcctgaccgtggcgctggggatccatccgacgcccaggatgctgccgctgcacccgatggagctcttcgacggccgtcggatcaccggctgcgtcttcggcgacttcaagggcaagtcgcagctccccctcctcgtcgaccagtgcatcaacggggaggtgaagataaacttcgacgggttcataacccacgagatgccattctcggagatcaacgaggctttccggctgctggaggagggcaagtctctccggtgtgtgctccgtctgtgatgtgaaaaaaaatgggacgggaaaaaataagcgttaatttctaataccgtgctgtaagtttgctaccttgtgggcatgctatatactctacgaccaggcccgagtcgtagagtatatagcagaattattggcttcccctcaaagaagaaaaaaattctcagaattattggcttcccctcaaaggaaaaataaatatctcagaattaacctgttccttttttctttttgtgtgtcttgtacgcctccttaga

SEQ ID NO: 6071 - DNA, 1524 bp, Pseudoroegneria spicata
ctgggaagaacttccacttccctttgatagaaaacacaaagaaaacagagaggttcaccatggcaaccaatgggtactccaatggcggcagcaccaagggaaagcccatcaaatgcaaagcggcggtggcgtggggtcccggcgagccgctggtgatggaggaggtgcaggtggcgccgccggcgcgcatggaggtgcgcgtcaaggtcctcttcacctccatctgccacactgacctcagcttcttgagaggagagaacgagcgtcaacgcaggtttcctcgcatctttggacacgaggcagccggagtggtggagagcgtcggcgaaggcgtggaggaccttgcgccgggagatcacgtcgtccccatcttcaacggggagtgcgggacgtgcgcctactgccactccagcgcgaccaacctgtgcggtacctaccgtgtggacgctttcaagagcaccatggtctccgacgacgggacgaggttctccgtggtgaacacctccggcgacacggtgccggtctaccacttcctcaacacctccaccttcgctgagtacaccgtgctcgacgccgcctgcgccgtcaagatcaaccccggcgccccgctggagaagatgtgcctcctcagctgtggtatctcgacaggagtgggagctgcatggaacactgcaaacgtgtccaagggatccaccgtcgcaatattcggacttggagctgttggtcttgcggttggtgaaggcgcaagaataagaggggcatcccggatcatcggcgtggacatcaactctgaaaagttcgccaaaggcaaagagatgggcatcacggatttcatcaactcgaaggcgtgcggcaagcctgtccacgaggtcatcagggagttgacggatgggggcgtcgactacagcttcgagtgcagtggcaacgttgatgtgcttcgagaggccttcgtttccacacacgacggttggggattgactgtggtgctggggatccatccgacgcccaggatgatgccgctgcatcccatggagctcttcgacggccgtcggatcacaggctgcgtctttggtgacttcaagggcaagtcgcagcttcccctcctcgtcgaccagtacatgcagggggaggttaagataaacttcgatggcttcataacccacgagatgccattctcggagatcaatgaagcttttcggctgctggaggaaggcaagtccctcaggtgtgtgctacgtctgtgatgaggcgcacgaggaattgcaagtgtgcgttggcgagatatactgttgttgttaataccatttactgtacatcttgtataattaaatcgaaggttatatttcactaaaagtgaagacgactatgttaggttcgcctgggtgtcgctcgactgagaactctttagtttcggttgatccacctcccgcttctgtgctctccgtttttggtttttgtttgtgttgcgccagtttatgtaattgtcagaattcatcttcgtaaatgtgagtagccattatgcta

SEQ ID NO: 6072 - DNA, 1569 bp, Hordeum vulgare
gaagaacttccacttccccttgatagaaaagtactccaatcaaaccgagaagctcacaccatggcaaccaatggctactccaatggcggcagcaccaagggcaagcccatcaaatgcaaagcggcggtggcgtggggtcccggcgagccgctggtgatggaggaggtggaggtggcgccaccggcgcgtatggaggtgcgcgtcaaggtcctcttcacctccatctgccacaccgacctcagcttctggagaggagagaacgagcgtcaacgcaggtttcctcgcatcctcggacacgaagcagccggagtagtggagagcgtcggcgaaggcgtggaggaccttgcgccgggagatcacatcgtccccatcttcaacggggagtgcgggacgtgcgcccactgccactccagcgcgaccaacctgtgcggaacctaccgtgtaaaccccttcaagagcaccatggtatccgacgacgggacgaggttctccgtggtgaacacctccggcgacacggtgccggtctatcacttcctcaacacgtccaccttcgccgagtacaccgtgctcgacgccgcctgcgccgtcaagatcaaccccgccgccccgctggagaagatgtgcctcctcagctgtggcatctcaaccggagtgggagctgcatggaacactgcaaacgtgtccaagggatccacggtcgcaatatttggacttggtgcagttggtcttgcggttggtgaaggcgcaagaataaggggggcatcccggatcatcggcgtggacatcaatcctgaaaagttcgccaaaggcaaagagatgggcatcacggatttcatcaacgcaaaggcgtgcggcaaacctgtccacgaggtgatcagggagttgacagatgggggcgtcgactacagcttcgagtgcagtggcaacgttgatgtgcttcgagaggccttcgtttccacacacgacggttggggattgaccgtggtgctggggatccatccgacccccaggatgatgccgctgcatcccatggagctcttcgacggccgtcggatcacaggatccgtctttggtgacttcaagggcaagtcgcagcttcccctcctcgtcgaccagtgcatgcagggggaggttaagataaactttgatggcttcataacccatgagatgccattctcggagattaacgaggctttccgactgttggaggaaggcaagtccctcaggtgtgtgctacgcctgtgatgagaggcgatgaggcgaagaggaattgcaagtgttcccttggcgagatacaatgttgttgttactaccatcttactgtagatcttgtaaatttaaactggaggttagatttcattcaaagtgaagacgactcataaacatgtgttgggtttgcctaggtctcgcttgaccgagaactcttaagtcttggttgatccacctcccgcttcggtgttgtccattttgttgtttttgtttgtgttgcatcagtttgtgtaattatcagaattcatctttgtaaatgtgagtgtccattatgctatgtaggcgtgtgggttgtgatcg

SEQ ID NO: 6073 - DNA, 1505 bp, Sorghum bicolor
acctcactagagccaagaagacgatttcttatccctgaaagaaaaagaggaaaaagaaaaaggcttcagggggagaatcaggataaagaagacgacgccatgacgaacgggaacggcggcgtcgccggcggcacccgtgggaagcccatcaaatgcaacgcggcggtggcgtggggtcccggagtgccgctgtcggtggaggaggtggaggtggcgccgcctgggcctctggaggtccgcgtcaaggtgctcttcacctccatctgccacactgatctcagcgcctggaagggagagaacgagatgcaccgcaagtaccctcgcatcttgggccatgaggcagccggagtggtggagagtgtgggcgaaggagtagacggtttggcccctggagaccacgtaattcccatcttcaccggggagtgcgaaaaatgcgtgtattgcaagtcggacaagacaaacctctgtggaacctaccgtgtagatcctttcaagaccaccatggtctttgacaatggcacgaggttctccctggtggaccgcaactctgggttgcggcagccggtgtaccacttcctcaacacctccaccttcaccgagtacaccgtgcttgacgccgcctgcgccgtcaagatcaaccccaaggccccgctccacaagatgtgcctcctcagctgcggcatctccacaggagtgggagctgcgtggaacagtgcagacgtttctgctggatcaacagttgcagtatttggacttggcgctgttggtcttgctgttgctgagggtgccaggctgcgaggggcagctcggatcatcggcgtggatgtaaaccctgcaaagttcagcaaaggtaaagagatgggtgtcaccgacttcgtggactctaggacctgtgacaaaccagtccatgaggtgatcagcgagatggcggatggaggtgtagactacagctttgagtgtaccgggatcagtgatgtgctgcgtgaggccttcctgtccacgcatgatggttggggcctgacggtgatgctagggatccattcaacgcccaagatggtgccgctgcacccgatggagctctacggccgtcggatcatcggctgtgtcttcggcgacttcaagggcaagtctcaactgcccaacctcgtcgacaagtgcgtcagcggggaggtcaatataaacttcgatggcttcataacgcacaagatgccattctcggacatcaacaaagctttccagttactggaggaaggcaagtcgttgaggtgcctgctcaatctctgatggacaatacctcaggaacagttttgatttcagtagcaaaataaatgtacaaggaattaatgttttccctagtactctttctgtacaaggaattctcatgttcaggtatgtcttgtaaaacgaatgctacttatttgaacaaaacaaaatgacatttattctgggatcaggtattcctaatcattgtatcgctgcttcactgccgaccaggccaacattca

SEQ ID NO: 6074 - DNA, 1613 bp, Triticum aestivum
gggaagaagaacttccacttccctttgatagaaaacaaagaaagaaaacagagaagctcacaccatggcaaccaatgggtactccaatggcggcagcaccaaaggaaagcccatcaaatgcaaagcggcggtggcgtggggtcccggcgagccgctggtgatggaggaggtgggggtggcgccgccggcgcgcatggaggtgcgcgtcagaatcctcttcacctccatctgccacaccgacctcagcttcttgagaggagagaacgagcgtcaacgcaggttccctcgcatccttggccacgaggcagccggagtggtggagagcgtcggcgaaggcgtggaagaccttgcgccgggagaccacgtcgtccccatcttcaatggggagtgcgggacgtgcgcctactgccactccagcgcgaccaacctgtgcgggacctaccgcgtcgacgctttcaagagcaccatggtttccgacaacgggacgaggttctccgtggtgaacacctccggtgacacggtgccggtctatcacttcctcaacacctccaccttcgccgagtacaccgtgctggacgccgcctgcgccgtcaagatcaaccccgccgccccgttggagaagatgtgcctcctcagctgtggcatctccacaggagtgggagctgcatggaacactgcaaacgtgtccaagggctcgaccgtagcaatattcggacttggtgctgttggtcttgcggttggcgaaggcgcaagaataagaggggcatctcggatcatcggcgtggacatcaaccccgaaaagttcgccaaaggcaaagagatgggcatcacggacttcatcaacccgaaggcgtgcggcaagcctgtccacgaggtgatcaaggagctgacagatgggggcgtcgactacagtttcgagtgcagtggcaacgttgatgtgcttcgagaggccttcgtttccacacacgacggttggggattgaccgtggtgctggggatccacccgacgcctaggatgatgccattgcatcccatggagcttttcgacggccgtcggatcaccggttgcaccttcggcgatttcaagggcaagtcccagcttcccctcctcgtcgaccaatgcatgaagggggaggttaagataaatttcgatggcttcataacccatgagatgccattctcggagattaatgaggctttccggctgctggaggaaggcaagtccctcaggtgtgtgctacgtttgtgatgaggcgcacaaggaattgcaagtgttctgttggcgagatatataccgttgttgttgctaccatttactgtacatcttgtacaattaaactggtggttatatgtcactcaaagtgaaaaaaaagacccaaagtgaagacgactcataaatatgtgttgggttcacctgggtctccctcaaccgagaactctttagtctcggtcgatccacctcccacttttgtgctctccattttttggcttttgtttgtattgtgtgactttgcgtcggtttgtttaatcttgagaattcatctttgtaaatgtcagtagccattctgctatgtaggcttgtgggtagtgatcggaataggagagctcctact

SEQ ID NO: 6075 - DNA, 1528 bp, Triticum aestivum
gggaagaagaacttccacttcccctagctttgatagaaaacaaagaaagaaaaccgagaagctctcaccatggcaaccaatgggtactccaatggcggcagcaccaagggaaagcccatcaagtgcaaagcggcggtggcgtggggtcccggcgagccgctggtgatgcaggaggtggaggtggcgccgccggcgcgcatggaggtgcgcgtcaaggtcctctacacttccatctgccacacggacctcagcttctggagaggagagaacgagcgtcaacgcaggttccctcgcatctttggacacgaggcagccggagtggtggagagcgtcggagaaggcgtggaggacctcgcgccaggagatcacgtcgtgcctatcttcaacggggagtgcgggacgtgcgcctactgccactccagcgcgaccaacctgtgcgggacctaccgtgtggacgctttcaagagcaccatggtttccgacaacgggacgaggttctccgtggtgaacacctccggtgacacagtgccggtctatcacttcctcaacacctccaccttcgccgagtacaccgtgctcgacgccgcctgcgccgtcaagatcaaccccgccgccccgctggagaagatgtgcctcctcagctgtggcatctccacaggagtgggagctgcatggaacactgcaaacgtgtccaagggctccaccgtagcaatattcggacttggtgctgttggccttgcggttggcgaaggagcaagaataagaggggcatctcagatcatcggcgtggacatcaaccctgaaaagtttgccaaaggcaaagagatgggcatcacggatttcgtcaactcgaaggcgtgcggcaagcccgtccacgaggtgatcagggagttgacggatgggggcgtcgactacagcttcgagtgcagtggcaacgttgatgtgcttcgagaggccttcgtttctacacacgacggttggggactgaccgtggtgctggggatccatccgacgccccggatgatgccgctccatcccatggagctctttgatggccgtcggatcaccgggtgcacctttggtgacttcaagggcaagtcgcagcttcccctcctcgtcgaccagtgcatgcagggggaggtgaagataaactttgatggcttcataacccatgagatgccattctcggagatcaatgaggctttccggctgctggaggaaggcaagtccctcaggtgtgtgctacgtctgtgatgaggcgcacaaggaattgcaagtgtgtgttgacgagatataccgttgttgttaataccatttactgtacatcttgtataattaaatcgaaggttatatttcactcaaaatgaagacgactatgttgggttcgcctgggtgtcactggaccgagagctctttaatctcggttgatccacctgccgcttctgtgctctcctttttttggctttgtttgtgttgcgccagtttgtgtaattatatcagaattcatcttcgtaaatgtgagtacaca

SEQ ID NO: 6076 - DNA, 1571 bp, Secale cereale
aactaagaactaggaagaagaacttccacttcccttgatagagaaacaaagaaagaaaaagagaagctcacaccatggcaaccaatgggtactccaatggcggcagcaccaaaggaaagcccatcaagtgcaaagcggcggtggtgtggggtcccggcgagccgctggtgatggaggaggtggaggtggcgccgccggcgcgcatggaggtgcgcgtcagaatcctcttcacctccatctgccacaccgacctcagcttctggagaggagagaacgagcgtcaacgcaggttccctcgcatccttggtcacgaggcagccggagtggtggagagcgtgggcgaagacgtggaagacctcgcgccgggagaccacgtcgtccccatcttcaacggggagtgcgggacgtgcgcctactgccactccagcgcgaccaacctgtgcgggacctaccgcgtcgaccctttcaagagcaccatggtctccgacgacgggacgaggttctccgtggtgaacacctccggcgacacggtgccggtctaccacttcctcaacacctccaccttcgccgagtacaccgttctggacgccgcctgcgccgtcaagatcaaccccgccgccccgttggagaagatgtgcctcctcagctgtggcatctccacaggagtgggagctgcatggaacactgcaaacgtgtccaagggatccaccgtagcaatattcggacttggtgctgttggtcttgcggttggtgaaggcgcaagaataaggggggcatctcggatcatcggcgtggacatcaaccctgaaaagttcgccaaaggcaaagagatgggcatcacggacttcatcaacccgaaggcgtgcggcaagcctgtccacgaggtgatcaaggagctgacagatgggggcgtcgactacagtttcgagtgcagtggcaacgttgatgtgcttcgagaggccttcgtttccacacacgacggttggggattgaccgtggtgctcgggatccatccgaccccccggatgatgccgctgcatcccatggagctctttgacggccgtcggatcaccggctgcacctttggtgacttcaagggcaagtcccagcttcccctcctcgtcgaccagtgcatgaagggggaggttaagatcaatttcgatggcttcataacccatgagatgccattctctgagattaatgaggctttccggctgctggaggaaggcaagtccctcaggtgtgtgctacgtttgtgatgaggcgcacaaggaattgcaagtgttctgttggcgagatatatactgttgttgttgctaccatttactgtacatcttgtataattaaactggaggttatatgtcacttaaagtggaaaaaaactagaagacgactcataaatatctgttgggttcgcctgggtctccctcaaccgagaactcttaagtcttggtcgatccacctctcacttctgtgctctccattttttggtttttgtttgtattgcttgacttgcgtcggtttgtgtaatcttgagaattcatctttgtaaatgtgagtactcattctgc

SEQ ID NO: 6077 - DNA, 1603 bp, Secale cereale
gaacttccacttcccttgatagagaaacaaagaaagaaaaagagaagctcacaccatggcaaccaatgggtactccaatggcggcagcaccaaaggaaagcccatcaagtgcaaagcggcggtggtgtgggtcccggcgagccgctggtgatggaggaggtggaggtggcgccgccggcgcgcatggaggtgcgcgtcagaatcctcttcacctccatctgccacaccgacctcagcttctggagaggagagaacgagcgtcaacgcaggttccctcgcatccttggtcacgaggcagccggagtggtggagagcatcggcgaagacgtggaggacctcgcgccgggagaccacgtcgtccccatcttcaacggggagtgcgggacgtgcgcctactgccactccagcgcgaccaacctgtgcgggacctaccgcgtcgaccctttcaagagcaccatggtctccgacgacgggacgaggttctccgtggtgaacacctccggcgacacggtgccggtctaccacttcctcaacacctccaccttcgccgagtacaccgttctggacgccgcctgcgccgtcaagatcaaccccgccgccccgttggagaagatgtgcctcctcagctgtggcatctccacaggagtgggagctgcatggaacactgcaaacgtgtccaagggatccaccgtagcaatattcggacttggtgctgttggtcttgcggttggtgaaggcgcaagaataaggggggcatctcggatcatcggcgtggacatcaaccctgaaaagttcgccaaaggcaaagagatgggcatcacggacttcatcaacccgaaggcgtgcggcaagcctgtccacgaggtgatcaaggagctgacagatgggggcgtcgactacagtttcgagtgcagtggcaacgttgatgtgcttcgagaggccttcgtttccacacacgacggttggggattgaccgtggtgctcgggatccatccgaccccccggatgatgccgctgcatcccatggagctctttgacggccgtcggatcaccggctgcacctttggtgacttcaagggcaagtcccagcttcccctcctcgtcgaccagtgcatgaagggggaggttaagatcaatttcgatggcttcataacccatgagatgccattctctgagattaatgaggctttccggctgctggaggaaggcaagtccctcaggtgtgtgctacgtttgtgatgaggcgcacaaggaattgcaaagtgttctgttggcgagatatatactgttgttgttgctaccattgactgtacatcttgtataattaaactggaggttatatgtcacttaaagtggaaaaaaagtgaagacgactcataaatatgtgttgggttcccctgggtctccctcaaccgagaactcttaagtctcgatcgatccacctcccacttttgtgctctccatttttaggcttttgtttgtattgtgtgacttgcgtcggtttgtgtaatcttgagaattcatctttgtaaatgtgagtacccattctgctatgtagacttgtggttagtgatgggaataggagagctcctactctacgcaa

SEQ ID NO: 6078 - DNA, 3321 bp, Triticum aestivum
aaatttgaagacttgtaagttggaggaattttttttcatggcatttggctttggaaagcgaccgctggcgtgccgccctgcacgcactgcatcgagaggccgcctgcactccggcccaatcctgaaaaatcccctccgctcctccgccccaaaatcttgcacactctctacgcacgtcagtccagcctcgtctcgtttcgtgtcgtctgctcgggaccaggagagatgacgccgctccatgccgccccgccgccgctctccgcgtcggccgcggtctcctcatccgcgccaccgcccctcctcgccaaagcttaccatcccaaggccgcggccctttgctcactcaccgtgaccgccgccactccatcaagaaaagcttttctcgcatgcccggatcacagcccggcggccgggcggtcgctgacgccggcgcgcggcgctcccgcctcgtccccggcgctcatctcggccgtccaggacctgtacgagttcatctgcagcgggccgctggtggacaggatcggctacacccgggagaagatcgccgagtccatcgaccggtggctgtggtgcggctcgcaggtgagccggttgttccgcatcgacgagctccggctgacggacgccgagaagtcgaggatataccacttctacatacccgtcttcctctggtgcgaggaccaggtcgccgaccacaggtccaagtacaacgacggcgacgagatcccgccattagtgattggagtcagcgctccccaaggcagcgggaagacaactcttgttttcgctcttgattatctttttcgggtttctggtaggaactctgccacattgtctatcgatgacttctatttgactgcagcagaacagggtaaactgagggaaacacatgctggaaatgctcttttagagtttcgtggaaatgccggaagccacgatctccaattctcaattgacacacttgagtcactgatcaaactaacaaaggaaggtacgaagatgaagcttccacggtatgacaagtccgcttttggtggaagaggtgaccgggctgacccttcgacatggccagaggttgaagggcctacagaggttgttctctttgaaggatggatgcttgggtttaaacctcttccaaatgaagttgtaacagcagtggatcctcagcttgaggtggttaataagaacctagaagcatactatgacgcgtgggacagattcattgagtcatggattgtcataaaaattaaggagcctaactgtgtatttcagtggagactacaggcagaggtagctatgagagctgatggtaaagcaggaatgtctgacgaggaggttatggattttgtatcgcgctacctaccagcataccatgcgtatttgcccacgctatataaagaaggaccaaatggcgcgaagaaagaccatctgctggtcattgacatagacgaagagaggactcctatctctggtagttgagtgctgagtgtacattctgaaatggatatcttgacttagtggttgagcttgggatttctgatctttctgagaccacttctgccaagcaagcaccaccgtcctcttgtttcttacagcttaaatatatcctaaacgtgtaaattcgatgtatatcaatttttgctatctatttaaagaaactggcatcccatttttcttccaaaaaaaaaaaaaaaaaactcgctcgtgccgaattcggcacgagaagaagaacttccacttccctagctttgatagaaaacaaacaaggaaaacagagaagctcacaccatggcaaccaatgggtactccaatggcggcagcaccaagggaaagcccatcaaatgcaaagcggcggtggcgtggggtcccggcgagccgctggtgatgcaggaggtggaggtggcgccgccggcgcgcatggaggtgcgcgtcaaggtcctctacacctccatctgccacaccgacctcagcttctggagaggagagaacgagcgtcaacgcaggttccctcgcatccttggacacgaggcagccggagtggtggagagcgtgggtgaaggcgtggaggaccttgcgccgggcgaccacgtcgtccccatcttcaacggggagtgcgggacgtgcgcctactgccactccagcgcgaccaacctgtgcgggacctaccgcgtggacgctttcaagagcaccatggtttccgacgacgggacgaggttctccgtggtaaacacctccggcgacacggtgccggtctaccacttcctcaacacctccaccttcgccgagtacaccgtgctcgacgccgcgtgcgccgtcaagatcaaccccgccgccccgctgcagaagatgtgcctcctcagctgtggtatctcgacaggagtgggagctgcatggaacactgcaaacgtgtccaagggctccaccgtagcaatattcggacttggtgctgttggtcttgcggttggcgaaggagcaagaataagaggggcgtctcggatcatcggcgtggacatcaaccctgaaaagtttgccaaaggcaaagagatgggcatcacggacttcatcagcccgaaggcgtgcggcaagcctgtccacgaggtgatcaaggagctgacagatgggggcgtcgactacagcttcgagtgcagtggcaacgttgatgtgcttcgagaggccttcgtttccacacacgacggttggggactgaccgtggtgctggggatccatccgacgcccaggatgatgccactgcatcccatggagctcttcgatggccgtcggatcaccgggtgcacctttggtgacttcaagggcaagtcgcagcttcccctcctcgtcgaccagtgcatgcaaggggaggttaagataaacttcgatggcttcataacccacgagatgccattctcggagatcaatgaggctttccgtttgctggaggaaggcaagtccctcaggtgtgtgctacgtctgtgatgaggcgcacgaggaattgcaagtgtgtgttggcgagatataccgttgttgttaataccatttactgtacatcttgtataattaaatcgaaggttatatttcactcaaagtgaagacgactatgttgggttcgcctgggtgtcgctcgaccgaggactttttagtctcggttgatccacctcgcgcttctgtgatctccgtcttttggcttttgtttgtgttgcgccagtttgtgtaattgttagaattcatcttcgtaaatgtgagtacccattatgccatgtaggcttgtggaatgcgatcaaaatagaagagcaccgtcgctccgcctttaatcgtgaagtgtac

SEQ ID NO: 6079 - DNA, 1530 bp, Secale cereale
ccttgatagagaaacaaagaaagaaaaagagaagctcacaccatggcaaccaatgggtactccaatggcggcagcaccaaaggaaagcccatcaagtgcaaagcggcggtggtgtggggtcccggcgagccgctggtgatggaggaggtggaggtggcgccgccggcgcgcatggaggtgcgcgtcagaatcctcttcacctccatctgccacaccgacctcagcttctggagaggagagaacgagcgtcaacgcaggttccctcgcatccttggtcacgaggcagccggagtggtggagagcgtcggcgaaggcgtggatgacctcgcgccgggagaccacgtcgtccccatcttcaacggggagtgcgggacgtgcgcctactgccactccagcgcgaccaacctgtgcgagacctaccgcgtcgacgctttcaagagcaccatggtctccgacgacgggacgaggttctccgtggtgaacacctccggcgacacggtgccggtctaccacttcctcaacacctccaccttcgccgagtacaccgttctggacgccgcctgcgccgtcaagatcaaccccgccgccccgctggagaagatgtgcctcctcagctgtggcatctccacaggagtgggagctgcatggaacactgcaaacgtgtccaagggatccaccgtagcaatattcggacttggtgctgttggtcttgcggttggtgaaggcgcaagaataaggggggcatctcggatcatcggcgtggacatcaactctgaaaagttcgccaaaggcaaagagatgggcatcacggacttcatcaacccgaaggcgtgcggcaagcctgtccacgaggtgatcaaggagctgacagatgggggcgtcgactacagtttcgagtgcagtggcaacgttgatgtgcttcgagaggccttcgtttccacacacgacggttggggattgactgtggtgctcgggatccatccgacgccccggatgatgccgctgcatcccatggagctcttcgacggccgtcggatcaccggctgcacctttggtgacttcaagggcaagtcccagcttcccctcctcgtcgaccagtgcatgcagggggaggttaagataaattttgatggattcataacccacgagatgccattctcggagatcaatgaggctttccggctgctggaggaaggcaagtccctcaggtgtgtgctgcgtttgtgatgaggcgcacaaggaattgcaagtgttttgttggcgagatatatactgttgttgttgctaccatttactgtacatcttgtgtaattaaactggaggttataagtcactcaaagtgaaaaaaaagtgaagacgactcataaatatgtgttgggttcccctgggtctccttcaaccgagaactcttaagtctcggtcgatccacctcccacttttgtgctctccatttttaggcttttgtttgtattgtgtgacttgcgtcggtttgtgtaatcttgagaattcatctttgtaaatgtgagtacc

SEQ ID NO: 6080 - DNA, 1590 bp, Triticum aestivum
gctgcgcggtgtacgccgacccacgcgtccggggaagaagaacttccacttccctagctttgatagaaaacaaacaaggaaaacagagaagctcacaccatggcaaccaatgggtactccaatggcggcagcaccaagggaaagcccatcaaatgcaaagcggcggtggcgtggggtcccggcgagccgctggtgatgcaggaggtggaggtggcgccgccggcgcacatggaggtgcgcgtcaaggtcctctacacctccatctgccacaccgacctcagcttctggagaggagagaacgagcgtcaacgcaggttccctcgcatccttggacacgaggcagccggagtggtggagagcgtgggtgaaggcgtggaggaccttgcgccgggcgaccacgtcgtccccatcttcaacggggagtgcgggacgtgcgcctactgccactccagcgcgaccaacctgtgcgggacctaccgcgtggacgctttcaagagcaccatggtttccgacgacgggacgaggttctccgtggtaaacacctccggcgacacggtgccggtctaccacttcctcaacacctccaccttcgccgagtacaccgtgctcgacgccgcgtgcgccgtcaagatcaaccccgccgccccgctggagaagatgtgcctcctcagctgtggtatctcgacaggagtgggagctgcatggaacactgcaaatgtgtccaagggctccaccgtagcaatattcggacttggtgctgttggtcttgcggttggcgaaggagcaagaataagaggggcgtctcggatcatcggcgtggacatcaaccctgaaaagtttgccaaaggcaaagagatgggcatcacggacttcatcaacccgaaggcgtgcggcaagcccgtccacgaggtgatcaaggagttgacagatgggggcgtcgactacagcttcgagtgcagtggcaacgttgatgtgcttcgagaggccttcgtttccacacacgacggttggggactgaccgtggtgctggggatccatccgacgcccaggatgatgccactgcatcccatggagctcttcgatggccgtcggatcaccgggtgcacctttggtgacttcaagggcaagtcgcagcttcccctcctcgtcgaccagtgcatgcaaggggaggttaagataaacttcgatggcttcataacccacgagatgccattctcggagatcaatgaggctttccggttgctggaggaaggcaagtccctcaggtgtgtgctacgtctgtgatgaggcgcacgaggaattgcaagtgtgtgttggcgagatataccgttgttgttaataccatttactgtacatcttgtacaattaaactggtggttatatgtcactcaaagtgaaaaaaaagacccaaagtgaagacgactcataaatatgtgttgggttcacctgggtctccctcaaccgagaactctttagtctcggtcgatccacctcccacttttgtgctctccattttttggcttttgtttgtattgtgtgactttgcgtcggtttgtttaatcttgagaattcatctttgtaaaaaaaaaa

SEQ ID NO: 6081 - DNA, 1561 bp, Triticum aestivum
ccacgcgtccggggaagaagaacttccacttcccctagctttgatagaaaacaaagaaagaaaaccgagaagctctcaccatggcaaccaatgggtactccaatggcggcagcaccaagggaaagcccatcaagtgcaaagcggcggtggcgtggggtcccggcgagccgctggtgatgcaggaggtggaggtggcgccgccggcgcgcatggaggtgcgcgtcaaggtcctctacacttccatctgccacacggacctcagcttctggagaggagagaacgagcgtcaacgcaggttccctcgcatctttggacacgaggcagccggagtggtggagagcgtcggagaaggcgtggaggacctcgcgccaggagatcacgtcgtgcctatcttcaacggggagtgcgggacgtgcgcctactgccactccagcgcgaccaacctgtgcgggacctaccgtgtggacgctttcaagagcaccatggtttccgacaacgggacgaggttctccgtggtgaacacctccggtgacacagtgccggtctatcacttcctcaacacctccaccttcgccgagtacaccgtgctcgacgccgcctgcgccgtcaagatcaaccccgccgccccgctggagaagatgtgcctcctcagctgtggcatctccacaggagtgggagctgcatggaacactgcaaacgtgtccaagggctccaccgtagcaatattcggacttggtgctgttggtcttgcggttggcgaaggagcaagaataagaggggcatctcggatcatcggcgtggacatcaaccctgaaaagtttgccaaaggcaaagagatgggcatcacggacttcatcaacccgaaggcgtgcggcaagcccgtccacgaggtgatcaaggagctgacagatgggggcgtcgactacagcttcgagtgcagtggcaacgttgatgtgcttcgagaggccttcgtttccacacacgacggttggggactgaccgtggtgctggggatccatccgacgcccaggatgatgccactgcatcccatggagctcttcgatggccgtcggatcaccgggtgcacctttggtgacttcaagggcaagtcgcagcttcccctcctcgtcgaccagtgcatgcagggggaggttaagataaacttcgatggcttcataacccatgagatgccattctcggagatcaatgaggctttccggctgctggaggaaggcaagtccctcaggtgtgtgctacgtctgtgatgaggcgcacaaggaattgcaagtgtgtgttggcgagatataccgttgttgttaataccatttactgtacatcttgtataattaaactggtggttatatgtcactcaaagtgaaaaaaaaagacccaaagtgaagacgactcataaatatgtgttgggttcacctgggtctccctcaaccgagaactctttagtctcggtcgatccacctcccacttttgtgctctccattttttggcttttgtttgtattgtgtgactttgcgtcggtttgtttaatcttgagaattcatctttg

SEQ ID NO: 6082 - DNA, 1860 bp, Oryza sativa
gagaaaccaattaaaatctcaacctatagcttcaagaaaacaaaatatttaatcccttgttggtctcctccctatcatatctacaagatatatatatatccagctaatctctctcctcatgccatctctttataaacccatcaacttgcctcacttgaagctacaatcaagaaatccacatttctcctcggaaagtcaaaggcaagaaacaccatggatgccactgccatcggcaacggcgccctgcactccaatggcgccggcgccgacaccaaagggaagccgatcaaatgcaaagcggcggtggcgcacggccccggcgaggcgctggtgatggaggaggtggaggtggcgccgccggcgaggatggaggtgcgcctcaaggtgctcttcacctctatctgccataccgacctcagcgcctggaaaggagagaacgagcttcagcgaaagtttcctcgcatattgggtcatgaggcagcaggggtggtggagagcgtgggagagggtgtggaggatcttgcccctggagatcatgttgtccccatcttcaccggcgagtgtggtgcgtgcacctactgcgagtccagcaagagcaacctatgcaaaacctaccgtgtcaacccattcaagagcaccatggtcaccgatggtggcacgaggttcaccatgatcgaccgctcctccggtgcacgcaacccggtctaccattttctcaacacttccacctttgctgagtacactgtgattgactccgcttgcgctgtcaagatcaaccctaaggctcccttggagaagatgagtctcctcagctgtggggtctccacaggagtgggagctgcatggaacactgcaaacgtctccaaggggtccacagtggcaatatttgggcttggtgccattggtcttgcggttgccgaaggtgccagattgagaggagcatctcgaatcatcggagttgacataaaccctgaaaaattctccaaaggcaaagagatgggcatcactgacttcatcaactcgaaggcatctggcaagcctgtccacgaggttatcatggagatgacagatggcggtgtcgactacagcttcgagtgcaccggcatcaccgatgttctacgggaggccttcgtttccacacatgatggatggggcctgaccgttgtgctggggatccatgcaacgcccaggatgctgccgctgcatccaatggagttatttgacggccgtcggatcactggctgcgtttttggtgacttcaagggaaagtcccagctgcctgaaatcgtggagaagtgcatgcagggtgagattaacataaattttgatgggttcataacacaagagttgcccttcgccgacatcaacaaagctttccagctgctggaagaggggaagtcactcagatgtctgctccatgtctgatgaaacttgtggattgtaaatttgaatacacaataaatgaatcataaatgttttcgcggtttcaaggtgtataattttcatatgcatgtatgttttgtacataaaatgggttgaacttcgttaaagaaaagacaaattgttaattagtagaatgcagtattaatatttgtaacaggtgagtgtgggtgtgcagtcgcgagaattgagcacacgattggttacatacatgctcgagttgctagtcagtagggccacacaccatttttatctattacatacgagttacagtctaattttattatagttacatataaatgttctctaccaaaaaaactgtctgaatgttgatatttgtaatagagttagcacaggtttcttctgtatactattatcatggtttcctacacaataattgtaaaatgttcttttgaattt

SEQ ID NO: 6083 - DNA, 1481 bp, Leymus cinereus x Leymus triticoides
  misc_feature (42)..(42): n is a, c, g, or t
  misc_feature (90)..(90): n is a, c, g, or t
  misc_feature (199)..(199): n is a, c, g, or t
  misc_feature (237)..(237): n is a, c, g, or t
  misc_feature (239)..(239): n is a, c, g, or t
  misc_feature (242)..(242): n is a, c, g, or t
  misc_feature (248)..(248): n is a, c, g, or t
  misc_feature (260)..(260): n is a, c, g, or t
  misc_feature (293)..(293): n is a, c, g, or t
  misc_feature (296)..(296): n is a, c, g, or t
  misc_feature (302)..(302): n is a, c, g, or t
  misc_feature (305)..(305): n is a, c, g, or t
  misc_feature (314)..(314): n is a, c, g, or t
  misc_feature (392)..(392): n is a, c, g, or t
  misc_feature (422)..(423): n is a, c, g, or t
  misc_feature (425)..(425): n is a, c, g, or t
  misc_feature (443)..(443): n is a, c, g, or t
  misc_feature (464)..(464): n is a, c, g, or t
  misc_feature (575)..(575): n is a, c, g, or t
  misc_feature (593)..(593): n is a, c, g, or t
  misc_feature (824)..(824): n is a, c, g, or t
  misc_feature (896)..(896): n is a, c, g, or t
  misc_feature (917)..(917): n is a, c, g, or t
  misc_feature (956)..(956): n is a, c, g, or t
  misc_feature (968)..(968): n is a, c, g, or t
  misc_feature (977)..(977): n is a, c, g, or t
  misc_feature (986)..(986): n is a, c, g, or t
  misc_feature (990)..(990): n is a, c, g, or t
  misc_feature (1001)..(1001): n is a, c, g, or t
  misc_feature (1007)..(1007): n is a, c, g, or t
  misc_feature (1014)..(1015): n is a, c, g, or t
  misc_feature (1022)..(1022): n is a, c, g, or t
  misc_feature (1025)..(1025): n is a, c, g, or t
  misc_feature (1040)..(1040): n is a, c, g, or t
  misc_feature (1055)..(1055): n is a, c, g, or t
  misc_feature (1071)..(1071): n is a, c, g, or t
  misc_feature (1094)..(1094): n is a, c, g, or t
  misc_feature (1112)..(1112): n is a, c, g, or t
  misc_feature (1154)..(1154): n is a, c, g, or t
  misc_feature (1186)..(1186): n is a, c, g, or t
  misc_feature (1197)..(1197): n is a, c, g, or t
  misc_feature (1203)..(1203): n is a, c, g, or t
  misc_feature (1222)..(1222): n is a, c, g, or t
  misc_feature (1228)..(1228): n is a, c, g, or t
  misc_feature (1236)..(1237): n is a, c, g, or t
  misc_feature (1248)..(1249): n is a, c, g, or t
  misc_feature (1254)..(1254): n is a, c, g, or t
  misc_feature (1259)..(1259): n is a, c, g, or t
  misc_feature (1261)..(1261): n is a, c, g, or t
  misc_feature (1281)..(1283): n is a, c, g, or t
  misc_feature (1303)..(1303): n is a, c, g, or t
ggttcaccatggcaaccaatgggtactccaatggcggcagcnccaaaggaaagcccatcaaatgcaaagcggcggtggcgtggggtcccngcgagccgctggtgatggaggaggtgcaggtggcgccgccggagcgcatggaggtgcgcgtcaaagtcctcttcacctccatctgccacaccgacctcagcttctgganaggagagaacgagcgtcaacgcaggtttcctcgcatcntnggncacgangcagccggagtngtggagagcgtcggcgaaggcgtggaggacctngcnccgggngancacgtcgtncccatcttcaacggggagtgcgggacgtgcgcctactgccactccagcgcgaccaacctgtgcgggacctaccgtgtngacgctttcaagagcaccatggtttccgannangggacgaggttctccgtngtaaacacctcaggtgacacngtgccggtctatcacttcctcaacacctccaccttcgccgagtacaccgtgctcgacgccgcctgcgccgtcaagatcaaccccgccgccccgctggagaagatgtgcctnctcagctgtggcatctcnacaggagtgggagctgcatggaacactgcaaacgtgtccaagggctccaccgtcgcaatattcggacttggtgctgttggtcttgcggttggtgaaggcgcaagaataaggggggcatctcggatcatcggcgtggacatcaatcctgaaaagttcgccaaaggcaaagagatgggcatcacggatttcatcaactcgaaggcttgcggcaagcctgtccacgaggtgatnaaggagttgacagatgggggcgtcgactacagtttcgagtgcagtggcaacgttgatgtgcttcgagaggcnttcgtttccacacacgacggntggggattgaccgtggtgctggggatccatccgacgccnaggatgatgccnctgcatccnatggagctnttcnacggccgtcgnatcacnggttgcnnctttggnganttcaagggcaagtcncagcttcccctcctngtcgaccagtgcatgnagggggaggttaagataaatttngatggcttcataacccangagatgccattctcggagatcaatgaggctttccggctgctngaggaaggcaagtccctcaggtgtgtgctacntctgtgatgangcgcangaggaattgcaagtgttcngttggngagatatnntgttgttgttnntaccntttantntacatcttgtataattaaannngaggttagatttcactcaangtgaagacgactcataaatatgtgatgggtttgcctgggtctcgctcaaccgagaactcttaagtctcagtcgatccacctcccacttccgtgctctccattttttgcttttgtttgtgttgcgtcggtttgtgtaatcatgagaattgatctttaaatgtgagtacccattctacta

SEQ ID NO: 6084 - DNA, 1384 bp, Secale cereale
ggaagaagaacttccacttcccttgatagagaaacaaagaaagaaaaagagaagctcacaccatggcaaccaatgggtactccaatggcggcagcaccaaaggaaagcccatcaagtgcaaagcggcggtggtgtggggtccgggcgagccgctggtgatggaggaggtggaggtggcgccgccggcgcgcatggaggtgcgcgtcaaaatcctcttcacctccatctgccacaccgacctcagcttctggagaggagagaacgagcgtcaacgcaggttccctcgcatccttggtcacgaggcagccggagtggtggagagcgtgggcgaagacgtggaagacctcgcgccgggagaccacgtcgtccccatcttcaacggggagtgcgggacgtgcgcctactgccactccagcgcgaccaacctgtgcgggacctaccgcgtcgaccctttcaagagcaccatggtctccgacgacgagacgaggttctccgtggtgaacacctccggcgacacggtgccggtctaccacttcctcaacacctccaccttcgccgagtacaccgttctggacgccgcctgcgtcgtcaagatcaaccccgccgccccgttggagaagatgtgcctcctcagctgtggcatctccacaggagtgggagctgcatggaacactgcaaacgtgtccaagggatccaccgtagcaatattcggacttggtgctgttggtcttgcggttggtgaaggcgcaagaataaggggggcatctcggatcatcggcgtggacatcaaccctgaaaagttcgccaaaggcaaagagatgggcatcacggacttcatcaacccgaaggcgtgcggcaagcctgtccacgaggtgatcaaggagctgacagatgggggcgtcgactacagtttcgagtgcagtggcaacgttgatgtgcttcgagaggccttcgtttccacacacgacggttggggattgaccgtggtgctggggatccacccgacacctaggatgatgccactgcatcccatggagctcttcgacggccgtcggatcaccggttgcaccttcggcgatttcaagggcaagtcccagcttcccctcctcgtcgaccagtgcatgaagggggaggttaagatcaatttcgatggcttcataacccatgagatgccattctcggagattaatgaggctttccggctgctggaggaaggcaagtccctcaggtgtgtgctacgtttgtgatgaggcgcacaaggaattgcaaagtgttctgttggcgagatatatactgttgttgttgctaccattgactgtacatcttgtataattaaactggaggttatatgtcacttaaagtggaaaaagtgaagacgactcaa

SEQ ID NO: 6085 - DNA, 1868 bp, Setaria italica
cgcccaccacccctcttctttgctaaagctacctccgcccgcggcccgccgacctcaccagtcaccacccaatccccacctcccaccttcgcggcggcgttctatggcctacacctcctccctccacctccccaagctcttgctcctccccaacccccgccggaccaggcacaggccctccttcgtccccgccgccgcggccaaggccagcggcgtgaacgggcacgcgccgcccgagaagccggcgcccaacggcaaggcgcacatcaacggcgtgaacggcaagaagggcgtgaacggcgtcaacggcaagaagggcgtgaacggccatgcggaccggatccacctcacggtgagcacgggcggcgggggccaggacggcaccgggctccgcgtggcgttccagggcgcgccgggcgcgtacagcgagttcgcggccaagacggcgctgccagggtgcgacacggtcccgtgccgagcgttcgcggacgcgctggcggccgtggagcgcgggggcgccgaccgcgccattctccccgtggagtccaccatggagggcaccgcgctgcggaactacgacctgctgctgcggcacgacctggtggtggcgcaggagatcaacctcttcgtgcactactgcctcctcgccatgccgggcgtccgcgccgccgaggtccgccgcgtcatcagccacccgatggcgctcgcgcactgcggccgcgcgctggcgcgcctcggggtggaccgcgagcccgtcgaggacaccgcgggcgccgtcgagatgctgcgctccaaccggatgctcgacaccgccgccatcgccagcccgcgcgccgccgacctgtacggcctcgacgtgctcgcgcacgggctccaggacgagtcctggaacgtcacgcggttcctgctcctctccaggccgccgccgcccgtggcgctccccgtggacgccgacgccaagaccagcatggtggtcgcgcaccggggcggctccatgatggtgctgctcaaggtgctctccgccttctcctcccgcaacatcaacctcaccaagctggaggtcatcaacaacgacggcgccgccgcccccgccgccgccggtgcgggtgcccgcccgccggtgatgatcctggacacgagcgcccggggcgcgccgacgctgcgcgcgttcccgcacgtcctctacgtggactgcgcgggcgccgcccacgacccgcgcgtccgcgaggccatccaggagatcgagaagttcgccgtgttcgtgcgcgtgctcggctgctacgccgccgattccaccgtctacgacctgcaatgagaaggagaggaaggcaggatcgtgatggtgcgaaccaggacagttggaatctagcaagtctgccgcaatttcgctgctataattgggcgaagctatcaggtctactagcattcagaaactagctttagcgagattaagttcctctgcttgctgctgctgctgcgtaattcttgtacagatgcaataagaatcttcctattgctgctggattatgttagctgtgtctttgtgtgtggataggttgaagcttggtgatgatgatgccagctgaagggtgtgtttgtactaagatgtcttgttgatcatgaccggatcgtttgtaatcttgttgtctagatttcggcgcaagctttcagttttgtatgtcgcagcttaggatctcacaatatccatcttgcaatgttttcagcactgaactttgtaaccgagcagtgtcttcatcctctgcttgtttgggtatgagctcactgctaactctccacgagctccacgcgtcaacgcttaattgcgtagcgagtactccggccgatccggactggagtagaagggatct

SEQ ID NO: 6086 - DNA, 1471 bp, Setaria italica
ccaatccccacctcccaccttcgcggcggcgttctatggcctacacctcctccctccacctccccaagctcttgctcctccccaacccccgccggaccaggcacaggccctccttcgtccccgccgccgcggccaaggccagcggcgtgaacgggcacgcgccgcccgagaagccggcgcccaacggcaaggcgcacatcaacggcgtgaacggcaagaagggcgtgaacggcgtcaacggcaagaagggcgtgaacggccatgcggaccggatccacctcacggtgagcacgggcggcgggggccaggacggcaccgggctccgcgtggcgttccagggcgcgccgggcgcgtacagcgagttcgcggccaagacggcgctgccagggtgcgacacggtcccgtgccgagcgttcgcggacgcgctggcggccgtggagcgcgggggcgccgaccgcgccattctccccgtggagtccaccatggagggcaccgcgctgcggaactacgacctgctgctgcggcacgacctggtggtggcgcaggagatcaacctcttcgtgcactactgcctcctcgccatgccgggcgtccgcgccgccgaggtccgccgcgtcatcagccacccgatggcgctcgcgcactgcggccgcgcgctggcgcgcctcggggtggaccgcgagcccgtcgaggacaccgcgggcgccgtcgagatgctgcgctccaaccggatgctcgacaccgccgccatcgccagcccgcgcgccgccgacctgtacggcctcgacgtgctcgcgcacgggctccaggacgagtcctggaacgtcacgcggttcctgctcctctccaggccgccgccgcccgtggcgctccccgtggacgccgacgccaagaccagcatggtggtcgcgcaccggggcggctccatgatggtgctgctcaaggtgctctccgccttctcctcccgcaacatcaacctcaccaagctggaggtcatcaacaacgacggcgccgccgcccccgccgccgccggtgcgggtgcccgcccgccggtgatgatcctggacacgagcgcccggggcgcgccgacgctgcgcgcgttcccgcacgtcctctacgtggactgcgcgggcgccgcccacgacccgcgcgtccgcgaggccatccaggagatcgagaagttcgccgtgttcgtgcgcgtgctcggctgctacgccgccgattccaccgtctacgacctgcaatgagaaggagaggaaggcaggatcgtgatggtgcgaaccaggacagttggaatctagcaagtctgccgcaatttcgctgctataattgggcgaagctatcaggtctactagcattcagaaactagctttagcgagattaagttcctctgcttgctgctgctgctgcgtaattcttgtacagatgcaataagaatcttcctattgctgctggattatgttagctgtgt

SEQ ID NO: 6087 - DNA, 1441 bp, Zea mays
tattgttagttgcagccttgcaggcagcaaagcaccgggaccaggacgccggccgcttcccgggttataaaagtcaacagcctccgcccaccaccctgtcggctaagcaagctaaaggtaaccccccccaaacctcaccgccgatcccaccgcccggcgccgcgttctatggcctacacctcctccctcaacctcccaaagcacctcctcctccccagcccccgccggacaaggcacaggccttcctccttcgtccccaccgccgcggccaaggtcaacggtgacgcgcccgagaggccggcgcccaacggcaaggcacgcatcaacggccagggcaagaagggagtgaacgggcatgcggaccggatccacctctcggtgagcacgggcggcggaggccaggacggctccggcctgcgcgtggcgttccagggcgcgccgggcgcctacagcgagttcgcggccaagacggcgctgcccggctgcgacacggtcccgtgccgcgccttcgcggacgcgctggctgccgtggagcgcggcggcgccgaccgcgccatcctccccgtggagtccaccatggaggggacggcgctgcgcaactacgacctgctcctgcggcacggcctggtggtggtgcaggagatcaacctgttcgtgcactactgcctgctggccatgcccggggtgcgcgccgccgaggtgcggcgggtgatcagccaccccatggcgctggcgcactgcgggcgcgcgctggcccgcctcggggtggaccgcgagcccgtggaggacacggcgggcgccgtggagatgctgcggtccaagcggatgctggacacagccgccatcgccagcccgcgcgccgccgacctgtacgggctccaggtcctcgcgcacgggctccaggacgagtcctggaacgtgacgcgattcctgctcctctccaggccgccgtcgcctgtggccgtggcgctgggcgtggacgccgacgccaagaccagcatggtggtcgcgcaccggggcggctccatggtggtcgtgctcaaggtgctctccgccttctcctcccgcaacatcaacctcaccaagctggaggtcatcaacaacgaaggcgctggatccggaccaggcgagcggccgccggtggtgatactggacacgagcgcccggggcgcacccacgctgcgcgccttcccgcacgtcctctacgtggactgcgagggcgccgcgcacgacccgcgcgtccgcgaggccatccaggagatggagaggttcgccgtcttcgtgcgcgtgcttggatgctacgccgccgactccaccgtctacgatctgcagtgagctctcagatatgatctagctactacttactattcagaagagaaagcagcgcgtaatttctgtacagatgcaataagaagaatcttccttcctataattatttgcc

SEQ ID NO: 6088 - DNA, 2064 bp, Panicum virgatum
cctgcccaacccccgccggaccaggcacaggtcctcctcctccgtctccttcgtccccgccgccgcggccagggccaacggcgtggacgggcgcgcgcccgagaagaagccgccgccgcccaaaggcaaggcgcgcatcaacggcgtgaacggcaagaagggggcgaacgggcacgtcaacggcaacaagggggtgaacgggcacgtcaacggcaacaagggcgtcaacgggcacgtcaacggccatgccgaccggatccacctctcggtgagcacgggcggcggcggcgcgggggcacaggacggctccgggctccgcgtggcgttccagggcgcgcccggcgcgtacagcgagttcgcggccaagacggcgctgcccgggtgcgacacggtcccgtgccggaccttcgcggacgcgctggcggccgtggagcggggcgccgccgaccgcgccatcctccccgtggagtccaccatggagggcaccacgctgcggaactacgacctgctgctgcggcacggcctggtggtggcgcaggagatcaacctcttcgtgcactactgcctcctcgccatgccgggggtgcgcgccgccgaggtgcgccgcgtcatcagccacccgatggcgctcgcgcactgcggccgcgcgctggcgcgcctcggggtggaccgcgagcccgtcgaggacaccgccggcgccgtcgagatgctgcgctccaaccggatgctcgacaccgccgccatcgccagcccgcgcgccgccgacctgtacggcctcgacgtgctcgcgcacggcctccaggacgagtcctggaacgtcacgcgcttcctgctcctctccaggccgccgtcgcccgtcgcgctgcacgtcgacgccgacgccaagaccagcatggtcgtcgcgcaccggggcggctccatgatggtcctgctcaaggtgctctccgccttctcctcccgcaacatcaacctcaccaagctggaggtcatcaacaacgacggcgacgccgccggggccggcgcccgcccgccggtcatgatcctggacacgaccgcccggggcgcgcccacgctgcgcgccttcccgcacgtcctgtacgtcgactgcgcgggcgccgcgcacgacccgcgcgtccgcgaggccatccaggagatcgagaagttcgccgtgttcgtgcgcgtgctcggctgctacgccgccgactccaccgtctacgacctgcaatgagggaggggaggaggacaggatcgccgtggtgcggatcgggactgctggaatctatagctagttgactggcggcaatctctctgttaaaattgggccaagctatcggatctaccagcactcagtaactagctccagcgagattagttgtttcgcttgctgctgctgctgcgtaatttttatacatacagatgcaataagaatcttcctattgctgctcgattatattagatgtgtgagtgtttgtgcatagattcaggcttgatgatgatgatgctagctcaagggtgtttgtactaagaagtcctgttggtcatgaccggatcgtttgtaatcttcttgtcctaaaatttcggcgcaagctttcagtttttgtattacagcctcgatcttattacagtgtcagcactggacctttgtaactgagcggtgtcttgtgcagatccacctctgtggttacaagcatcccctgcttgtttgggtatgagctcacaaactcaacgagtctctgctgagggagtacgagaccatccatctatggatggacgattttagtagtggatctaggctggagttaatcgttcttctgcccaggctcgatgaatctgaatctggatttgtgaatccaagtggggatcagggaatcagcatgccagaatctgcttgattgtcggagcacggccactctctccattctaaattatagatagttttgctaaattatagatagttttggcaaatttagatgtataatttatgtttactaagatttatagcaaaatctatgtatttagatttgtcaaaatgatctacaacttgaaatgggatagtaaaattac

SEQ ID NO: 6089 - DNA, 3376 bp, Zea mays
ttgccaacccagcaaccctgccaagccatcgcattccagctctgcctttgcaagatcgccgccactcgcagccagcaagcaaccattccaccacatacttttttcctccggtttcgtccggcggcgagcgagcgaggtagcgcttgtccatgccgcggccgtgagggtgatcgaacgaggactacttcggcctagcgcggggagccatgtcggcgtcggcgtcggcgggtaagctggcggcggcgctgcaccggaggacgcgcagggtcacgtccgcgctggcgtgcgcggccctggagtgggtcctcatcgcgctgctcctcgtcaacggcctgctggcctacgccgtcgccaggttcgcggactacttcggcctcagcccgccgtgcctcctctgctcccgcgtcgaccgcctcttccaggccgaaggcggtggcggcggcgacgctagcggcgccggcgcgcggtggctgcgggacgccctctgcgacgcccacgccgcggagatctccgcgctggggtactgcctccgccaccgccggctcgctgaggccggagagatgtgcgtgggctgccgcccgtcgtcgtggaaggagaggacaagcgacgcaggtgcgtgcgcctgctgcgaagctgctgctgtactgcgcgcttctcctgtgcgcgagctggaagatactacaagggatgcgcgtgtctcggagaaagaggtagaagatggcgaccagggctacgttctgctggctcaagatgatcacgaggaggagccggatgaggtcgaaaaccgacaacaagaaccgcagagcgaggtggatggccgacaacatctggaagacgaggtgatggctgccgttcaggacgaatccttggaattcatggatcaggtcgaagacatcacgatcgaggacgaccggttggtgtcggtggtggcgcttgacgagatgaccatcgccgatgattcgggtctccatcgggatgtagaagaggtggacggaacgaatcatgtagtagaagatgagcaggatccgagggatgtggatgtcggagcggttctggaggagaagaggatgttggattcctcggttgcaacgccggtcgatttgaccgaggactctgtcgtgcccaccagccccgtaccttgtcctgagacttcaacagacccatctcatcctgatcatagctccgtttcccaagacgatggagatgttcttgaagatacttccacggccgaggaagaacacatctttgtgcctcaagcttcagtatcggaagccgtttccgaggatgacaacagaacagctgctgaggtggacacgaactgcgaagtgtcaatcgggagcgatatatgcgaacgggaacaagatgagcatgtcgttccatttcaagatttggcagcatttgaggagctggttgctccattggcaactggagatgatctaccattgccatcggaggtcctagagccacctgaccaagtagaagcaggtgaagttgaacaggaggacgtgaccacaagcacgggattagacctccaaccaaatgaacagaacgagatcgaagaagacagagcacctgagacgccgacgaacagcgtcgccacacaacgctccgacagaatgttcttgctcgagaggaaacggtcgctgtcgctgtctctggatgggagcgtagcgagcgagatggaaggcagcgagccgtccaccgtggaccagctgaaatcagcgctgcaggccgagcggaaggcgctcggcgcgctgtacgccgagctggaggaggagcggaacgccgcggccatcgcgaccaaccagacgatggccatgatcaaccggctgcaggaagagaaggcggcgatgcagatggaggcgctgcagtaccagcggatgatggaggagcagtcggagtacgaccaggaggcgctgcagctgctgaacgagctggtcagcaagcgggcgagggagaagcaggagctggagagggagctcgagctgtacaggcagaaggtgcagcactacgaggacaaggagaggaggaggacggcgagcttcaaggccaatggggtaagccccagtggcagtggcacttccgtgtcgtccagcggcgaggacagcgacgggcactccgacgactactgcgagctcggcgactctcctgacggcggcaacgtccagagctcatcggatgctgcccttagctccatgagggaccaggacgacggcacgaagcacctagcggctctggacgattccttgacgtacttcgaggtggagagactctccatcctggaggaactcaagacgttggaggagaggctcttcacactggaagacgacgatatcaacaccagcaaagaagttactggccattcctcgagtgacatggatttaccacacgatggccttcagtcgccggagtacattctcaccggtgacaggccaagattcggaggaagggcctctatcagcagagggaagagccttctgcctctgttcgatgcagtcggcgacgaggcctgtgaccgaatgccgccatctgcaggagcaggagaggcagaccaggccgacgatgcagcaacgaagccggcatccgtgcttgtcaaagagcaggagaggctggcgatcatagaggaggtcgaccatgtctacgaaaggttgcaggcgctggaggcggacaaggaattcctgaggcactgcatcaagtccctgaagaaaggagacaagggcatggaccttctccaggagatcttgcagcaccttcgcgatctccgcagtgtggagcttcacgtcaagaatgccggtggtgccatggctgcaaattcagcctagcaagttcatctatacgcggtaacgatgaccctactagcttggtatggattcagtcgattggattgtaggactccaaagcactgcattggtgatggtccctgcaaggtactgccggagttatagggaggctctgctcattttgcctgtgggccggaagcaagccctcccttttgtgctggtccagcactgccaactttttctgtcgtggtggtcgcctggtctggtcggtcggtcgtaggaatcattagcccttccaaagctgcacaaagctgaatcacggtgacagcttctgcagcatgcacggggcaaaagaaaaaagatagccccagtggagatgtggatgtttttttttcttgtctgatttaatcttttgattaactttggatttgtttgtgcgctgaggtagggagtcctcgtgtattttttttttggtgaggttgtagcttgaacggttggtatgtgcagtttgtgctttctctatatccaggtttataatgaaaggaaaggcggtctcacgaagaaatccctgtggtaaaaaaaaacttctaacttat

SEQ ID NO: 6090 - DNA, 2165 bp, Zea mays
ctcgccgccgcggcgcgcagacgactgcgactccgcgatggacgaggaggaaagggaggaggtgggagagtacaagctgcaagggttggttgggaggggctcgttcgccgaggtgcaccgtgccgcgcaccgccgcactggcgcgcccgcggcggtcaaggcgatcgaccgccgcctcgtcgacaagcgcgtccacgacggcatcctgcaggagagggagatactcaggagcatcgaccaccccaacatcctccgcctcctcgacaccatcgacaccacgaacatgatgtacctggtgctggagtactgcgacggaggcgacctggacgcgtttctccacaagcacggccggctgccggaggccgtagccaaggacttgatgcggcagctcgcggaagggctgaaggtgctgagggggaggaacatcgtgcaccgggacctcaaaccacaggcattattttaatcacttcattcaattttcgtggttgaaccttctcctatcaaccaacggggatgacatcgtattgaaaattggtgactttgggtttgccaggtcgctggtgcatgaaaatttagctgctacaatatgtgggtcgccatattatatggcaccagaaatttggcaagggaaggactatgatgcaaagtcggacttgtggagtgttggtatcattctttttcagctagtcacagggaagttgccattcaccgggagtaatgcttttcagctgcaccaaaatgtcatggctaccgatgatcttaacttcccttcagaaattgaagctgatttatgtcctgattgcattgatttgtgcagaagactcctgcaccgtgatccaaagaagagaataagttttgaagaaatcttcaatcacaagtttttggcaacaacaaggaaatgctatgaatcctgtcatgctgtagaattaagagataactgccagacaatcacctctcctgttgtcctaaaaacaaagtctggaagtattgaatcaaaaaatccgaaagtttttgattcatgggagtggattgaacgagaatatgtgcttgttccggaaaactgtacttctatggaaatgtcttcactcaacatcaagtccacaaaggatgatatggatacaagaacggtcagctatggtaggtccactggcaaagggtctgttcagaaccaaatcagagactttactgacacagctactggtgtacaaagccatggatgtgctcctgtggtcatttcacaggagtcagccactgtggattgtagacgagggaaaccacctgattatattacaagacttcattctctgaatcaatatgttcttgttcttgcggatcttgctcgggaaaagctatctaaaggcctgtacctggaggcgttatcaattgaacttgtattattaactatctggaaagaggcacttgatgcatgtagcttgctcatggatacatcagatggtgaaaaattctctaaatcttgtcaagaacatttccttgctaagagtggccactcacctatgaatgtagtacaaggattggatttcactcggacggcttctattttttcttggcttgaaagtgggtttatgaaggcatatgatcgtgcagagaagatatcacatgtattacggaaaagtgatgataacaccgagatgccagatgcagtggatgttacattccaaactgctttgtaatatgagaagagtagagctgcgaatgaagttttaggaaatcaaagcagatccgcagagctatattcgaagtctatcatcttgctcacgtttttagtacaggaagcatctatgttgccactaaatccaccgctttccctttcgcctttggatcagcaacgcatccgtaggtacatagctaatttgaacagccatctctgcagtgctcaggttccagggcaacggcagagatcagtccaccatgttgctttttgtctaggaggtggtgttcaatgctttggtgtcatgaacctttgtaaaattgtagttgccgaacaccatgatcctgcccccttttttgtatatatatagataataacaccacatgctctatatggtcgccccttaccatatgttcaaatgactctgaactttatatatttgcaagtgccttgtttgcacatgtaaaaagaaacgggtttcgaaccttctcgcgac

SEQ ID NO: 6091 - DNA, 1316 bp, Setaria italica
cgccgcaacgacccaatggagcgcgcggtgagagagctgtgggcggaatcccgggaccttctcggcctcggctccccatcccctgacgacaccgccgccaaagcctccgccgtgccgcgcgcggacctgcccccgacgccgctcgccttcctccgcgaccacgtctccccgggccgcccgctcatcgtctccgccgcggccacccgccactggcccgccgcgtcgctctggcccaccgcctcctacctcaccgacgcgctccgctccaccaccgtctccctccacctcacccccgacggccgcgccgacgcgctcgccccgcacccggggcgccacgagtcctcctccaagtgcttcgcgtccgcgcacgtccgccgcgtcgacttccccgccgcggtccggctcatcagaggatccgacccggccgccggcctggtcgcgtacgcgcagcagcaggacgactgcctccggggggagtacgcggcggtggccggcgacgtggacgcgcacgtgccctgggccagcgaggcgctcggctgcctccccgaggccgtcaacctctggatcggcaacgcccactccgtcacctccttccacaaggaccactacgacaacatctacgccgtcgtctccggcgagaagcacttcctgctgctgccccccaccgagcaccaccgcctctacgtgcgcgactaccccgccgcccactacgtcgccgaggagaaggacgcaggaggggagcatcagatgaggcttaagctggagctggacgagcccgagaggatcgtgccgtggagcagcgtagacccgtgcccggcgtcgccggaggagttggacgctcaggcgtcgtcgttccctctctactccgacgggccggcgccgattcggtgcacggtccgcgccggcgagatgctctacctgccaagcatgtggttccaccatgtcagccagagcccagggccgaacgggctcaccattgctgtgaactactggtacgacatgcattttgacatcaagtatgcctacttcaacttcttgaggtcaatggagatcgatggttgttcatcaggcaagtctggttttttggaaggtgatcttgaggaaaagaatgattgagggtgacctattctgattacatctgatttcctcctgcctttgtctgacagagcaacagctctgcaagctttaggagtagttgccagacacatggaaactgattaaccggctttgtatgtctgtacaacatttgcagtcgtcaattggcctatcaggctcgatacagttgcaactagaacatttgatttagtggcggcaaa

SEQ ID NO: 6092 - DNA, 3048 bp, Oryza sativa
cgattttgtaactcggtgacaagttgagggacctccggtgtactttttccttaggggaatgcctaaggtctaagccattgctaaaggctaatcttcgatgtcatcaaattaaagcccatgggccatggatataggaggacttttggcccactcggccagcttccgctgcggccctgcctgcctgcctcttgaaccgcgtggcgccgccgccgccgccgggattcacaaaaccaacggagcatacggactagaatcttcgccgctcgccgccgcggggaccaatggagcgcgcagtgcgggagctgtgggcggagtcgcgggacctgctgggcctccactccccggacgacgccgccgccgccgacgccgcgatgccccgcgccgagatgcccccgacgccgctcgcgtttctccgcgaccacgtctcgccggggcgccctctcctcgtgtcctccgccgccaccagccactggccggccgcctcgctgtggccgaccgactcctacctcaccgacgcgctccgctccaccgccgtctcgctccacctcacccccgacggccgcgccgacgccctcgccccgcacccgcgcccgagccaccccggcgccaagtgcttcgcctccgcgcacgtccgccaggtcgacttccccaccgccgtgcgcctcatccggagctccgatccggcctccggcctggtggcctacgcgcagcagcaggacgactgcctgcgcggggagtacgccgccgtcgccggcgacgtggacgcgcacgtgccctgggccagcgacgcgctcggctgcctccccgaggccgtcaacctctggatcggcagcgcctgctcccagacctccttccacaaggaccactacgacaacatctacgtcgtcgtctccggcgagaagcacttcctcctcttgccccccaccgagcaccaccgcctctacgtccgcgactaccccgccgcccactacgccgcggaagatgaagcggagctgaggcttaagctggagctggaggagcccgagaggatcgtgccatggagcagcgttgacccctacccgccgtcgccggaggaggcggccgcgcaggcgtcatccttcccgctctacttcgaggggccgaggccgatccgctgcacggtgcgcgccggcgagatgctctacttgccgagcatgtggtttcaccatgtgagccagagccccgggccgaacgggctcaccattgcagtgaactactggtatgacatgcagtttgacattaagtatgcctacttcaacttcttgaggtcattggagatcgatggtagttcgtcgaaaaagacggatgctttggaagacgatctcgaggagacgaatgattgaattgaaatttttgcggtaattctggatctatgcagaatataacttgattcaattgttgtgacttgtgagcattgtcagtttaatgttttggaggcagaggtcagggcatagatcttgataacctgtgtttatgttgtaccaattttcagggccaaatggcttatcaggtttgatttagtttcagagtcaacatattgatgtcaactttaaaattttttattcagatataggaaggtgaattttgtctaagatttactctccactagtcatgcttacattatgcaggtctgagaaatggccatcttatgtgaattatgcatgttttagtgccagatggatcagatgttgacagaatgaatatcaagcaattacatcttctgaatctgtgagtgttgtgtccggtatcataaacttgatgccaactctagattgcaaatacatactatattcatctttactcctatttatgagaactagtttaatttcaattcctagacatggtcttttgtttacctgttgttgtgataacatattgtcatccttattactgaacaagtgaacatgcaatgctttctattactcaacaatcagataattcactgtgcaatttccagaactgttagttttattcccaaatgtaggatttcacgagcattccgcacaacatttccatttgttcagctagcttgtgtgatatgtaaagtacagtattacaacctcctggtttctgccgtgtgccaataataactagcaaatgaaatagctcaatccagaataagaatgcaatgacaaaattataaatagtagacatgtaaaaaaaaatattgctgcaaaactgttgtgcttcaggctgccttggccagctccctgtccacagccaccttgaggaagctgccttcctccaccaccatctgaacaggcaggaacccgagcccattggcgacggcgagcatcacctccttcatctcggcccggaactcctccaagtccaccgtgccattgccgtcgtggtcgaaccgcgcatacaagccacggtacatctccacgagttcatcggagctcatggcggcctcatcaacaccgaaatgcttctcaaggaccctgaggctcatgagctcctttgccatctccgagtaggagaggaggccgtcacggttggtgtcgagggcggcgaaccggccatcgacggaggagttgaaggcgccctcgtcctcgacgaagctcctgatggtcttgccgtcaaggatttctacactcatgttgccggctctacaaaatgtggcggtctcagagatgtttttggtgtgtagcagatgagtgctacaaaatgtggttgtatcagagatgtttgtgtctttgttctagtactttggtttgagcaaatgttgagcttgtaacttctacttatatagagaggcgtagcagctggttttggagccactatgaccggcaacatggtatggggcatttccagtgcaatgttcccaacccctactgccttcggcgttgttgatgattttacactttcaaatggaagattcggctgtgtacttgtgtgctacgccatgatttgcctctaaaccaatggatgtgttagcacctggtttcattaaaagcggcaaaaatgatggacgacgatgccttaagaagtcggtggttagatgcaccggtaaagcctagcccactg

SEQ ID NO: 6093 - DNA, 1651 bp, Hordeum vulgare
gccgccgccagaattcgcaaaattagcggcgcaacctgagatggagcgcagcgtgagggagctgtgggcggagtcgcgcgagctgctgggcctccactccccggacgccgtgccgcgcgccgacctgcccccgactccgctcgccttcctccgcgaccacgtctccccgggccgcccgctcctcgtctccgccgccgccacccgccactggcccgccgcctcgctctggcccaccgaatcctacctctccgacgcgctccgctccaccgacgtctccgtccacctcacccccgacggccgcgccgacgccctcgccgcgcacccgcgccgccccggcgccaggtgcttcgcgtcggcgcacgtccgccgggtggacttccccgccgccgtgcggcttatcagggactccgacccggaggccggcctggtcgcctacgcgcagcagcaggacgactgcctgcgcggggagtacgcggcggtggccggcgacgtggacgcgcacgtgccctgggccagcgaagcgctcggctgcctccccgaggccgtcaacctctggatcggcaactcctgctccgtcacctccttccacaaggaccactacgacaacatctacgtcgtcctctccggcgagaagcatttcctcctattgccccccaccgagcaccaccgcctccacgtccgcgagtaccccgtcgccggctacgccccggtgaaggaaggggaggaggtgccgaagctcaagctggagatggaagagcccgagagggtcgtgccgtggagcagcgtggacccgtacccggcttcgccggaggagatggcggcggaggcctcatcctgcccgctctacttcaaggggcccatgccgattcggtgcaccgtccgcgccggcgagatgctctacttgccgagcatgtggtttcaccatgtcagccagagccccggccctaacgggctcaccattgccgtcaactactggtatgacatgcagtttgacatcaagtatgcctactttaacttcctgaggtcactggagatcaaagattctccattggagaacaatgttgatgctttcgaaggtgagctcgaagagaaagacgattgagctcatgggttgtgattgtattgggatttcagacgattccgcaacagcagtatatggctcggtttttcgttgccattatcaaacggttcttcaagttttcgaagtagttatctggagcatggatctggattactggaggtgtatgttatacctgaatttaccggtgccatatgcacaccaggattggtgtatgagcaaaagaagattttggagggtgttacactttattcagaaagggcagcatggattcttctttcatccaatggtttacattctgcaggtctagaaacggcagcttgagtaaattatgcattagacatttgagtagcagatgaatcagacggaagacagcacaaaatcagttgatgagctattccgacagtgttagctctggtgctgataatgtaaagttgctaccagttctgcaatggatacatactttcttcacttaatttgtttgtagaaaaactctgttcgtactaacatgtggtgttgaattgaaatgtactttcttgaatttagatatacacggttgatttaacttgtgtt

SEQ ID NO: 6094 - DNA, 2051 bp, Hordeum vulgare
gctcgcgcaagcggaacagagcgggagaggcaacagtggcgcagcccccagtcgggtcggaagcagaccggttgaggtcgtgcgatggcgaagggggcggtcgcggggacggcggtggtggcgtgcgccgcggctgcggccgctgccgctgtcggggtggcggtggtggtgtcgcggaggaggaggaggacgcgggacgccgaggcggggaggcgcaagaaggtggccgacgtgatcggggagctggagcagacgctcgcgacgccgacgccgctgctgcgcggcatcgcggacgccatggtggaggagatggagcgcgggctgcgcgccgacccccacgcccacgccccgctcaagatgctcatcagctacgtcgacaatctgcccaccggggatgagcatgggctgttttatgcactggatcttggtgggaccaacttccgtgttcttcgggttcagcttgcaggaaaggagaaacgtgctgtccaacaatacgaagaggttcccattccacctcatctcatggttgggacatccaccgaactatttgatttcattgcggctgagctggaaagatttgttgagactgaaggagacgatttccacttgcctgagggcaggcatagggaattgggtttcacattttctttcccagtacaccaaacatcgatatcgtcaggcaccctcgttaagtggacaaagggattttgcatcaatggcacggttggggaagatgtggtggctgaattgagcagtgctatggagaggcaagggcttgatatgaaagttacagctttggttaatgatactgtaggcacattggctggcgggatatatgctgataatgatgtcgtcgctgctgtaatattgggcactgggacaaatgcagcctatgttgagcatgtagatgcaattccaaaatggaaaggaccattacctagatcaggaaacatggtaatcaacatggaatggggaaactttaagtcagacaagcttcctcgttctgactacgatattgccttggattttgaaagtttgaaccccggcgagcagatgtatgagaagatgatttcgggcatgtatcttggagaggttgtgcgaagaatcttgcttaggctggctcatgatgcttcattatttggtgatgttgttccaccaaaattggagaaactatttgtactgaggacgccggatatgtcggctatgcatcatgacacctcacatgatctcaagcaccttggtgctaagctgaaggacatcctgggggttgccgacacttccctggaagcaaggtacataactcttcacgtctgcgacaaggtcgcggagagaggcgcgcgcctggctgctgctggcatatacggcatcctgaagaagctgggcagggacagagcgccaagccacggcagtccgaagcaaaggactgtcgtagctatagacggcggtctctacgagcactacaagaagttcagctcccgcgtcgaggcgacgctcgcagagctgctcggggaggcggccgcctcgtcggtcgtcgtcaagatggccaacgacggctccggcatcggcgccgcgcttcttgcggcctcacactcccagtacaatgtcctcggatagtcctatggagagggagtgagctcgctgcgcagcttcttgctctcgcctggatcacttattttgccgtttctctccaccggtagtgcctcctgcctctagctattctgcacacacttgacgggtgcctgtgcagcggcgttactatacagcaaggcttgtgccgatgagtttcgtttgcaatagcagggaggtggaaacggaggctagaatgacgccgttcctttcctgccaattctttttcccctaatctttactgtaagtttctgttgcgatgatgcgatggcgcaaaccaaagtaacagaggagacctgcatgtcatcttctataattcagaataaggtgggccgtatatatgatcacataatccaaacgtttatcatttcttctgttttgtgatccacatatactctatgcaatacatgtacagtttttccaaa

SEQ ID NO: 6095 - DNA, 1932 bp, Triticum aestivum
ggtggtgtgcgccgcggccgcggctgcggcggcggtcggggtggcggtggtggtgtcgcggaggaggaggaggacgcgggacgcggaggcgggcaggcggaagaaggtggccgacgtgatcgaggagctggagcagacgttggccacgccgacgccgctgctgcgcggcatcgcggacgccatggtggaggagatggagcgcgggctgcgcgccgacccccacgccccgctcaagatgctcatcagctacgtcgacaatctgcccaccggggatgagcatgggctgttttatgcactggatcttggtgggaccaactttcgtgttctacgggttcagcttggaggaaaggagaaacgtgctgtccaacaatatgaagaggttcccattccacctcatctgatggttgggacttccaccgaactatttgatttcattgcggctgagctggaaagatttgttgagactgaaggagacgatttccacttgcctgagggcagacatagggaactgggtttcaccttttctttcccagtacaccaaacatcgatatcgtcaggcaccctcgttaagtggacaaagggattttgcatcaatggcacggttgggaaagatgtggtggctgaactgagcagtgctatggagaggcaggggcttgatatgaaagttacagctttggttaatgatactgtaggcacattggctggcgggatctatgctgataatgatgtcgttgctgctgtaatattgggcactgggacaaatgcagcgtatgttgagcatgtagatgcaattccaaaatggaagggaccactacctagatcaggaaacatggtaatcaacatggaatggggaaactttaagtcagacaagcttccccgttctgactacgatattgccttggattttgaaagtttgaaccccggcgagcagatgtatgagaagatgatttcgggcatgtatcttggagaggttgtgcgaaggatcttgcttaggctggctcatgatgcttccttatttggtgatgttgttccatcaaaattggagaaactatttgtactgaggacgccggatatgtcaaccatgcatcatgacacctcacatgatctcaaacaccttggtgctaagctgaaggatatcctgggggttgccgatacttcgctggaagcaagatacataacccttcacgtctgcgacaaggtcgcggagagaggcgcgcgcctggctgccgccggcatatacggcatcctgaagaagctgggcagggacagagcgccgagtgacggcagtccgaagcaaaggaccgtcgtcgccatagatggcggcctctacgagcactacaagaagttcagctcccgcgtcgaagcgacgctcgcggagctgctcggtgaggcggcagcctcgtcggtcgtcgtcaagatggccaacgacggctccggcatcggcgccgcgcttcttgcggcctcacactcccagtacaatgtcgtcgagtagtcccaaggagagggagtgagctcctggcgcggcttcttgctttcgcctcgatcacttattttgccatttctctccactgatagctagtcttgtgccaatgagtttcgtttgcaaccgcgggaaggcggaaacggagacggaggttagaatgacgccgctcctttcctgccaattctttttccctaaacctgcaagtttctgttgcgatgccatgtcgcgaaccaaacagaggagacctgcctgcatctgatcttctataattcagaataaggagggtggtatatatatgatcgcataatcgaaacatttatgatttcttctgtttcgcgatccacatactatatatgtatgcaatacatgttcagtttttctaaactgaaaatggctcctccaccatgagcagctaccatggaatgtgggtaatgtaaatcaaagaatcc

SEQ ID NO: 6096 - DNA, 1805 bp, Triticum aestivum
gggctgcagcattcggcacgaggcggcgcgggcaggcggaagaggtggccgacgtgatcgaggagctggagcagacgttggccacgccgacgccgctgctgcgcggcatcgcggacgccatggtggaggagatggagcgcgggctgcgcgccgacccccacgccccgctcaagatgctcgttagctacgtcgacaatctgcccaccggggatgagcatgggctgttttatgcactggatcttggtgggaccaactttcgtgttctacgggttcagcttggaggaaaggagaaacgtgctgtccaacaatatgaagaggtgcccattccacctcatctgatggttgggacttccaccgaactatttgatttcattgcggctgagctggaaagatttgttgagactgaaggagacgatttccacttgcctgagggcagacatagggaactgggtttcaccttttctttcccagtacaccaaacatcgatatcgtcaggcaccctcgttaagtggacaaagggattttgcatcaatggcacggttggggaagatgtggtggctgaactgagcagtgctatggagaggcaggggcttgatatgaaagttacagctttggttaatgatactgtaggcacattggctggcgggatatatgctgataatgatgtcgttgctgctgtaatattgggcactgggacaaatgcagcgtatgttgagcatgtagatgcaattccaaaatggaagggaccactacctagatcaggaaacatggtaatcaacatggaatggggaaactttaagtcagacaagcttccccgttctgactacgatattgccttggattttgaaagtttgaaccccggcgagcagatgtatgagaagatgatttcgggcatgtatcttggagaggttgtgcgaaggatcttgcttaggctggctcatgatgcttccttatttggtgatgttgttccatcaaaattggagaaactatttgtactgaggactccggatatgtcagccatgcatcatgacacctcacatgatctcaaacaccttggtgctaagctgaaggatatcctgggggttgccgatacttcgctggaagcaagatacataacccttcacgtctgcgacaaggtcgcggagagaggcgcgcgcctggctgctgccggcatatacggcatcctgaagaagctgggcagggacagagcgccgagtggcggctgtccgaagcaaaggaccgtcgtcgccatagatggaggcctctacgagcactacaagaagttcagctcccgcgtcgaagcgacgctcgcggagctgctcggtgaggcggcagcctcgtcggtcgtcgtcaagatggccaacgacggctccggcatcggcgccgcgcttcttgcggcctcacactcccagtacaatgtcgtcgagtagtcctaaggagagggagtgagctcctggcgcagcttcttgctttcgcctggatcacttattttgccatttctctccaccgatagctagtcttgtgccaatgagtttcgtttgcaaccgcgggaaggcggaaacggagacggaggttagaatgacgccgctcctttcctgccaattctttttccctaaacctgcaagtttctgttgcgatgccatgtcgcgaaccaaacagaggagacctgcctgcatgtgagatcttctataattcagaataaggagggtggtatatatgatcacataatcgaaacatttatgatttcttctgtttcgcgatccacatactatatatgtatgcaatacatgttcagtttttctaaa

SEQ ID NO: 6097 - DNA, 2792 bp, Zea mays
cgcacggccgcccgcagtgcttgaaaccagcccgctcctccattccaacgtctccacccactgctcccaatggcgacgccgttcccgctggaggccgacgagggggaggcgcgggagctcctctacgaggcgtacaacgagctgcacgcgctggcgtccgagctgggcggcgcggcggcggcgccggcggtcgtggtcgtcggccaccagacggacggcaagagcgcgctggtcgaggcgctcatggggttccagttcaaccacgtcggcggtggcaccaagacgcggcgccccgtcgcgctccacctccgcttcaacccgcgctgcgacgagccccagtgccgcctcctctctgcaaccggcgatgccgaagagcatgacgaagccggggttgccgcccgccccatgccgctcgccgacatccaggcatatattgaagctgaaaacttgaggttggagaatgacccttgccaattttcagagaaggaaatcataattaaggtagaatacaagcattcccccaatctcaccattattgacactccaggcctcatccttccagctcctggccgtaaaaacagagttttgcagagccaggcttctgctgttgagagccttgttcgtgctaaaatccagcataaagagaccattatactgtgccttgaagattgtagtgattggagtaatgcaactacacggagagtagtgatgcaggtcgatcctgatcttgcaaggactgttctagtctccacaaaactggacacaaaaataccacaatttgcccgtccctctgatgttgaagtgtttcttcacccaccaaattgtgtgctagatgtttccttattgggagattctccctttttcacatcagtaccttctggtagagttggctcttgccatgaagctgtgttcaggtcaaatggagagtttaagaaggccatcttatcaagagagttggaagatattgcatctattgaagacaagttaggaaggtcacttacaaccatggagaaagatagaattggagtgggtaacttaagattatatttggaagagttgctgcagaagaggtacattaagagtgttccattaatcattccacttcttgagaagcaacatcgaaatacaacaagtaaattgcgtgaaatcagtcatgaactcagtgatctggatgaaaccaaactgaaggagaaagctcagctattccatgacacatttttgaccaagttatctttgctattgaaaggcatggtggtggcacctcctgataaatttggagaaactttagtcaacgagaggattaatggaggaacatttactggaagtgagaatttccagctcccgaacaagatgatgccaaatggtggcatgcgtctttatggtggtgcacaataccatcgggcaatggctgaatttcgtctggtagttggtagtaccaggtgccctccaataactagggatgaaattgtcaatgcttgtggtgttgaggatattcatgatggtacaaactactccaggactgcttgtgtaattgccgtggcaaaagcacgtgacacgtttgagccattccttgatcagttgggttttaggcttttgtacatactgaagaggctgatcccaatctctgtttatctgttggagaaagatggtgagcactttagtagccatgaagtgctcataaggcgtgtccaggaagcattcaagaggtttgttgaatccactgagcaatcatgtcgtcaaaggtgtatggaagatttggagagtaccactcgttatgtcacttggtcccttcacaacaagaaccgtgctggattgagacatttcctcgattcatttgttgcaccggagcaactatcagtaaatacattgaacgagcggttttctgggttgaatgataacaaacaggataaggcaaagggtgactcgaagtcaaaccattctccagacacaaattcgtccactgctatgccagagacaaggctggttgacctattggatagcacactctggaacagacgcctggttccctcatctgaaaggcttgtttatgcgctggttcaccagatttttcatggaatcaaagagcattttcttgtcaccactgaactgaagttcaattgctttctcctcatgccgattgttgacaaactaccagcacttctaagacaagaccttgagtcagctttcgaagaggaacttgatagcatctttgatgtcactcagctgcgccagtcacttgggcagaagaagcgcgagctggagatcgaactgaagcggatcaagcgcttaaaggaaaagtttggagagataaataagaagctcaattctcttcaggttaggcagtaggccaggctcaaaatttagcagtagcttggtagtctaggactccaggtagagtgtttcaatgctgtaataaaataattggtcatctagagtgacttcttgttgtatcctatcagttgtaaatatgaagtattcctatgtcttaacgtatgttgttgctacacgggttttcggagtcttttttcccttgcatgattcgttacactgcgattccttcaggttgaagtcagccaaataggtccaaagtaacagcaagctctaatatctaataccctctatttcaatttgtaatttgtttgacttttttttaccaccgactcgtattattaaaaaatcataattatcgttaatttttaatatgatattgtttagcatagaatgtactttaagtaaggcttagaatttttttcgtttgtttgcaaaaaaattaaataaaaaaaaattaaata

SEQ ID NO: 6098 - DNA, 2567 bp, Setaria italica
cccacactccagtccactccactccaccacgcttccctccaaaccccccacgaaacccaccccggcccaaccaatcccaatggcgacgccgccgctcccgccggactcgaaggcgggcgcggaggaggaggaggaggaggaggcgcgggagctcctctacgaggcgtacaacgagctgcaggcgctggcggccgagctgggcggcgcggcgggggcgccggccgtcgtggtggtcggccaccagacggacggcaagagcgcgctggtagaggcgctcatggggttccagttcaaccacgtcgggggaggcaccaagacgcgccgccccgtcgcgctccacctccgattcaacccgcgctgcgacgcgccgcggtgccgcctgctcgccggccccggggacgaagttgaagacgccggggtcgcaggccgccccatgccgctcgccgacatccaggcatatattgaagctgaaaacatgaggttggagaatgacccttgccaattttcagagaaggaaatcataataaaggtagaatacaagcattgccccaatctcaccgttattgacactccaggcctcattcttccagctcctggccgtaaaaaccgagttttgcagagccaggcttctgctgttgagagccttgttcgtgctaaaatccagcataaagagaccataatactgtgccttgaagattgcagtgattggagtaatgcaactacacggagagtggtgatgcaggttgatcctgatcttgcaaggactgttctagtctccaccaaactggacacaaaaataccacagtttgcccggccctctgatgttgaagtgtttcttcacccaccgacttgcgtgctagatgtttccttactgggagattctccctttttcacatcagtaccttctggtagggttggttcttgccatgaagcggtgttcagatctaatgaagagtttaagaaggccatctcatcaagagagtctgaagatattgtgtctattgaagacaagttaggaaggtcacttacaacagaggagaaagaaagaattggagtgagtaacttgagactatttttggaagagttgctgaggaagaggtacattgagagtgttccactaatcattccacttcttgagaaggaacatcgaaatgcaacaaggaaactgcgtgaaatcagtcaagaaatcagtgatctggatgaagccaaactgaaggaaaaagctcagctattccatgactcatttttgaccaagttatctttgctattgaaaggcatggtggtggcacctcctgataaatttggagaaactttaattaacgagaggatcaatggaggaacatttactggaagtgagaatttccagctcccaaacaagatgatgccaaatgctggaatgcgtctttatggtggtgcacaataccatcgggcaatggctgaatttcgtctggtagttggtagtatcaagtgccctccgataactagggaggaaattgtcaatgcttgtggtgttgaggatattcatgacgggacaaactactccaggactgcttgtgtaattgctgtggcaaaagcacgtgacgcatttgagccattccttcatcagttgggttttaggcttttgtacatactgaagaggctgatcccaatatctgtttatctgctggagaaagatggtgagcgcttcagtagccatgaagtacttgtaaggcgtgtccaagcggaattcaagaggtttgctgaatcaacggagcaatcatgtcgtgaaaggtgtatggaagatttggagagtaccactcgttatgtcacttggtcccttcacaacaagaaccgtgctggattgcgacacttcctagattcatttgctgccccagagcaactatcagtaaatacactgcacgagcagttgcctgggttgaatgagaacaaacaggacaggccaaagggcgacccaaagtctaatcattcttcagacacaaattcatcgggtgctgtgccagagacaaggctggtcgatctgttggacagtacactctggaacagaaggctggttccctcatctgaaagactcgtctacgcattggttcaccagatttttcatgggatcaaagagcattttcttgtcaccactgaactgaagttcaattgctttctcctcatgccaattgttgacaaattacccgcgcttctaagacaagacctcgaattggcttttgaggacgaacttgatagcatctttgacgtcactcagatgcgccagtcgcttgggcagaagaagcgagagctggagatcgaagtgaagaggatcaagcgcttgaaggagaagtttggggagataaataagaagctcaattctcttcaggttaggcagtaggtcagtccagaactgagcagtaagcttgctaggctaggactccaggtagagtgtttctatgctgtaatagtgtgacatcttgttgtacctttctagttgtaaatatgaaggcttcctgtgtcttatgtatgatgttagtacatggttttccatatggccaataaagtgctgcatcccttgccaagttcttaaa

SEQ ID NO: 6099 - DNA, 2650 bp, Brachypodium distachyon
taacgcatgtacgcgctccttccccgcaaacttcaaaccccccccgcagttctgcgctctcttccccaacccaaaacccctcgaaaacaacccgccaatggcgacattgccgcctgagcagctcactctgggagaggaggcggaggaggcgcgtgggttgctctacgaggcttacaacgagctgcagcgcctagccgcggagcttggcggcgcggcggtgccggcgccggccgtggtggtggtcggccaccagacggacgggaagagcgcgctggtcgaggcgctgatggggttccagttcaaccacgtcggcggcggcaccaagacgcgccggcccatcgcgctccatctccgtttcaacccgcgctgcgacgtcccacactgccgtctcctcgccggctcgggcgagggggatgccgacgacgacgaagacggggccgtggaccgcccaatgccgctcgccgacatccaggaatacattgaagctgaaaacatgaggctggagaatgatccttgccagttctcagagagggaaattataataaagatagaatacaagcattgccccaatctcaccattattgacactccaggcctcatccttgcagctcctggccgtaaaaatcgggttctgcagagtcaggcttgtgctgttgaggcccttgttcgtgcgaaaattcagcataaagaaaccataattctgtgccttgaagactgtagtgattggagcaatgcaactacaagaagagtggtgatgcaggttgatcctgatcttgcgaggacagttttggtctccacaaaacttgacacgaaaattccacagttcgcacgtgcctcagatgttgaagtgtttcttcacccaccaacttgtgttctagatggttcattgttgggagattctccctttttcacatcagtgccttctggaagagttggttcttgccatgaagctgtcttcagatcaaacgaagagtttaagaaggcgatctcactgagagagtttgaagatgttgcgtctcttgaagacaagctaggaaggtcacttacaaaggaggagaagaataggataggattgagtaacttaagattatttttggaagaattgctgcagaagaggtacattgagagtgttccatcaattattccacttcttgagaaggaacatcgcgctgcaacgaggaatttgcgtaaagtcacagaagaaatcagtgatttggacgaggcaaaactgaaggaaaaagctcgcctgtttcatgattcatttttgacaaagttatctttgctattgaaaggcatggtggtggcacctcctgataagtttggagaaactgtaattaacgagaggatcaatggaggaacatttactgggagtgagaatttccagctcccgaacaagatgatgcctaatgctggaatgcgtctttatggtggtgcgcaataccatcgggcaatggctgaatttcgtctggtagttggaagtatcaagtgccctccaattaccagggaggaaattgtcaatgcttctggtgttgaagatattcatgatgggacgaattactccaggaccgcttgtgtaattgctgtcgcaaaagcacgcgacacatttgagccgttccttcatcagttgggttttaggctgttgtacatactgaagagactgagtccaatctctgtttttctgctggagaaagatggtgagcactttagcagacatgatgtacttgtgaagcgtgtccaagctgctttcaataggtttgctgaatctactgagcaatcatgtcgtgaaagatgtatggaagatttggagagcaccactcggtatgttacttggtcccttcacaataagaaccgtgccggattgcgacacttcctggattcatttgttgcaccggagcagttatctgctagcacacatacagctgccaactcagctgggctgcacgagcaatcttctgggttgaatgacaataaacaggataaaccaaaaggagacttgaaatctagtcatcctttggactcaaatccatcaagtgttgtgtcagaaactaggctggttgatctcttggacagcacactctggaacagaaggctggcgccctcatctgaacggcttgtgtatgcactggttcaccagatttttcatggaatcaaagagcatttccttgtcactacagaactgaagttcaattgtttcctcctcatgccaattgtcgacaaattggcggctcttctaagggaagaccttgaatcagctttcgaagacgatctcgacagcatcttcaacgtcaaccagctgcgccactctctggggcagaggaagcgagagctggagatcgaattgaagcggatcaagcgcttaaaagagaagttcggacagataaataagaatctcaattctctccaggttaggcagtaagtcactctggtggaagaagctagctaggactaggaaggagtcagtccaggtagaattgcaataaaccaatgtttctcctgtagtactatgacttcttgttggatcctttttcatgagtaaatatgaatcatcccctttgtgtgttctactcatcaacgtatattttgctacaatcaatccatatgatcgatgatgaacgtggttttccccagcataggttggtatccacatacc

SEQ ID NO: 6100 - DNA, 2636 bp, Triticum aestivum
ttctgataaatggcaacgccgcggccggagctgctctcgccggatgaggatgaggaggagagcgcgcgggggcttctgtatgaggcgtacaacgagctgcagcgcctggcggccgagctgggtggcgcagcggtgccggtaccagcggtggtggtggtcggccaccagacggacgggaagagcgcgctggtcgaggcgctcatggggttccaattcaaccacgtcggtggcggcaccaagacccgtcgacccatcgcgctccatcttcgcttcaacccgcgctgccattcccccaactgccgactcctcgccggctcgggcgagggggacgcagaggacgacgccggggctgctgaccgctcaatgctgctcgccgacatccaggcatatattgaagctgaaaacaagaggctggagaatgatccttcccaattttcagcgaaggaaattataataaggatagaatataaacattgccccaatctcaccattattgacactccaggtctcattcttgcagctcctggccgtaaaaaccgagttttgcagagtcaggcttgtgctgttgaggcccttgttcatgcgaaaatccatcataaagaaaccataattctgtgccttgaagattgtagtgattggagcaatgcaactacaaggagagtggtgatgcaggttgatcctgatcttgtaaggactgttctagtctccacaaaacttgacacgaaaattccacaattcgcacgtgcctctgatgttgaagtgtttcttcacccaccaacttgtgttctagatggttccttattgggagattttccctttttcacatcagtgccttctgggagagttggttcttgccatgaagctgtcttcagatcaaatgaagagtttaagaaggcgatctcactgagagaattggatgatgttacatctcttgaagacaagctaggaaggtcacttacaagggaggagaagaacaggataggagtgagtaacttaagattatttttggaagaattgctgcagaacaggtacatagagagtgttccgtcgattattccacttcttgagaaggaacatcgcgctgcatcgaggaagttgcgcaaagtcacacaagaaatcagtgatttggacgaagcaaaactaaaggagaaagctcgcctgttccatgattcatttttgacaaagttatctttgctactgaaaggcatggtggtggcacctcctgataagtttggagaaacttcagttaacgagaggatcaatggagggacatttactggaagcgagaatttccagctcccaaacaagatgatgcctaatgctggaatgcgtctttacggtggtgcacaataccatcgggcaatggctgaatttcgtctggttgttggaagtatcaagtgccccctgattactagggaggaaatagtcaacgcctgtggtgttgaagatattcatgatgggacgaattactccaggactgcttgtgtaattgctgtggcaaaagcacgcgacacatttgagcctttccttcatcagttgagttttaggctgttgtacatactgaaaagattgagtccgatatctgtttttctgctggagaaggacggtgagcactttagcagccatgatgtacttgtgaagcgtgtccaagctgctttcaacaggtttgctgaatctaccgagcaatcttgccgtgaaagatgtatggaagatttggagagcaccactcgttatgttacttggtcccttcacaacaagaaccgtgccggattgcgacattttctggattcgtttgttgcaccggagcaattatgtgctaacacacatactgcccactcagctgggctgcatgagcaatccactggtttgaatgacagtaagcaggatagaccaaagggagagctgaaatctagtcatacttcagactcaaatccatccggtggtgtgtcagaaacgagactggtggatctcttggacagtatgctgtggaaccgaaggctggcgccctcatctgagcgacttgtgtatgcactggttcaccagatttttcatgggatcaaagagcattttcttgtcactacagaactaaagttcaattgcttcctcctgatgccaattgttgacaaattagcggctcttctacgagaagaccttgaatcagcttttgaagacgatcttgacagcatcttcagcgtcacccagctgcgccgctcacttgggcagaagaagcgagagctggaaatcgaattgaagcagatgaagcgtttaaaagagaaattcacagaaataaataagaagctcaattgtctccaggttagacaacaggcctaggtagggaggtagagtattcattttgatgacaagtatttccggacggaggagtagagcatatcaaggaaatgatgattcataattacgcctgaatacaggaccggtagcaagtcacacaaggtggattatgatgacaagcatttccggacagagggagtacttgtcaacgagtgcactcgtggttcaatcattccataaaaactgtgccttgcaaatggtgtaagcttgagatgttgcttagtaacttttttgaactttagcatgccgtgaaagaaagaaaggacaatctcaactaaagcaatgcc

SEQ ID NO: 6101 - DNA, 2631 bp, Oryza sativa
gagagagagaaagaaaagggataacgcacggcgcacttcgaaacccctcctaaaccacgcgtgacccaatcgcaatggcgacgccgccggaatccctctcaccggctgcagcggcggtggaggatgattgggaggaggcgcgggggctgctgtacgaggcctacaacgagctgcagggcctggcggcggagctgggcggcgcggcggcgcccgcgccagcggtggtggtcgtcggccaccagacggacggcaagagcgcgctggtcgaggcgctgatggggttccagttcaaccacgtcggcggaggcaccaagacgcgccgccccgtcgcgctccacctccgcttcaacccgcgctgccacgccccgcgctgccgcctcctcgccggctcgggcgcgggggacgacgaggacgaagaggccggtgtcgccggccgcgcaatgccgctcgccgacatccaggcatacatagaagccgaaaacatgaggctggagaatgatccttcccaattttcagaaaaagaaattataataaggatagaatacaagcattgccctaatctcaccattattgacactccaggcctcatcctaccagctcctggccgtaaaaaccgagttttgcagagccaagcttgtgctgtagagacccttgttcgtgcgaaaataaagcataaggaaaccataatactttgccttgaagattgtagtgactggagcaatgcaactacaaggagagtggtgatgcaggttgatcctgatcttgcaaggactgttctagtctccacaaaactggacactaaaattttacagtttgcacgagcctctgatgttgaagtctttcttcaccccccgacctgtgctctagatggttccttactgggggattatccctttttcacatcagtgccttcggggagagttggctcctgccatgaagctgtattcagatcaaatgaagagttcaagaaggccatctcattgagagagttggaagatgtcgcatctcttgaggacaagttgggaaggggacttacaaaggaggagaaaaacagaataggagtgagtaacttgagactatttttggaagaattgctgaggaagaggtacattgagagtgttccattaattattccacttcttgagaaggaacatcgtggtgcaacaaggaagctgcgtgaagtcaatcaagaaatcagtgatttggatgaagcaaaaatgaaggagaaagctcgcctgttccatgattcattcttgtcgaagttatctttgctattgaaaggcatggtggtggcaccgcctgatagatttggagaaactttaattaacgagaggataaatggaggaacttttactggaagtgagaatttcctgatcccaaacaaattgatgcctaatgctggaatgcgtctctacggtggcgcacaataccatcgggcaatggctgaatttcgtctggttgttggaagtattagatgccctccaattactagggaggaaattgtcaatgcttgtggtgtggaagatattcatgatgggacaaactactccaggactgcttgtgtgttagctgtggcaaaagcacgtgacacatttgagccttatcttcaccagctgggttttaggttattatacataatgaagagactgattccgatatctgcttttctgttggagaaagatggtgagaactgtagcagccatgatgtacttgtgaagcgtgtcaaagctgtcaatttgatagagtttgcatgaatctactgagcaatcatgtcgtgaaagatgtatggaggatttggtgagcaccactcgttatgtcacttggtcccttcacaataagaaccgtgccggattgagacacttctttgattcctttgttgcacaagagcaattatccgtgaacacacttactgcccactcgactgggctgcatgagcaatcctttggcttgaatgacaataagcaggataggccaaagggagacttcaaatcaagtaattcttcagaagcaaattcacccactgttgcatcagagactaggcttgttgatctcttggacagcacactatggaacagaaggctggcaccctcatctgaaagacttgtgtatgcactggttcaccagattttccatgggatcaaagagcattttcttgtcaccacagagcttaagttcaattgctttctcctcatgccgattgttgacaaattaccggcgcttctaagagaagaccttgaatcagccttcgaagatgatcttgacagcatatttgatgttactcagctgcgccattcacttgggcagaggaagagagatctggagatcgaattgaagcggatcaaacgcttaaaggagaaattcgcagagataaacaagaagctgaattctctccaggttagacagtaagctactctaggagaagcagagcaactagctactctagtcgagttagattatttctatgctgtaataataataatcccttagtgtgtaataataatagtctagtgtgattatgacttctttgttggatcttttcatgtgtaaatatacatatattaacccttccaatgtcgtttcccttccttgcaaaccgactaacaaagaacttttacgtgatgtttactgttc

SEQ ID NO: 6102 - DNA, 668 bp, Saccharum officinarum
aaacgaatttccgggtccacccaccccttccgcgaccccgtggccgaacccgtggcctacccgccagctcggaatcatcgtcggagccactccaccaacctgctccgctcctccatggccagctaccccctgctgctgctcctgctgctggcggccacggccgcagccgcagcagcagccgccggcgaggcctcccgcggcaacgcgaccgcgacgtcgtcgtcgccgacggcgtacgagatgctggagcggtacgacttcccgcgggggatcctgccggcgggcgtgtccgggtacgagctccgcggggacggcagcttcgaggtgtacttcccgcgtccctgcgagttcctgctggcggggaggtggctggtccggtacgaggcgcgcgtgcggggctccgtcgcggccgggtcgctcacggcgctggacgggatcagcgtgaaggtgctcttcctgtggctcggcgtcggcgaggtggaccgcgccggggacacgctcagcttctacgtcggccccgtcgccacctcgttcccgctcgctgacttcgccgagagcccgcgctgccgcggctatgatgatggcgctggcgctgccgacgacgacgacgacttctttccggcggcggcggcctcgtcgtgacccggcggtgattaatatctgtacaa

SEQ ID NO: 6103 - DNA, 1158 bp, Cajanus cajan
gttttctatataaagcaaagtacccaacccaatctttgtattgagaaagagaaaaagcaaaagacatcaaacacaaccatgatgaagcgtgtcctttgtttgttagcattcctatatgcagttcatgagacacatgcagttgaatacagcgtcactaacaacgcactggcaactccaggtggtgtggctttccgtgataaaataggagcagaatacgcgaagcaaacacttgactcagccaccaaattcatatggaatgtcttccagcaaaacaaccctgccgacagaaaaaacgtgcagaaggtgagtttattcgtcgatgacatggatggggttgcatatactagcaacgatcagatccatttaagtgcaagatatgttggaaactataacggggatgtgaaaagagagatcacaggggtgctttatcatgaaatggtccatgtttggcagtggaatgggaacggtggtgctcctggtgggttaattgaaggtattgcagactacgtgaggctgaaggcaaactatgcaccaagtcactgggtaaaaccgggacaaggacaaaaatgggaccaaggttatgatgttaccgctcgttttttggactattgtgatagtctcaaaagtgggtttgtggcacaactgaacaagctgatgaggagtggttatagtgatcaattctttgttcagttactgggaaagtctgttgatcagctgtggcgagattacaaggccaagtatggtaatattgcctaagagagctttttagtttaaagaataagcgactacagatatatcgcaatcttttctgtcagattgtatcaactcttaatgtttgttatgtattaccatttaccagttattgtatactggaaacttttatgtctggcaagaaaataaaacaattccgacttcaaataaatgcatttctcttgcttagagaaaacttcacctgattgatttttatcctattcacaaatgagacccaaatggaaacaataacgtcggttttcggcctaacttcaaataatcaactagaataagtctttaagtcaagtctatttaggtttgacccattgtctatttaattatgaatagttgaaaactaagagtaatgagccaaatggcaaattttttataagagtatatttgattgtg

SEQ ID NO: 6104 - DNA, 972 bp, Phaseolus coccineus
tgtgcagtgataaaccataaacttgttcaccaaaggaacccataaggctgaaaacgcaaccatgatcaaacaggctctttgctttttagtattcttacatgcatttcatcaaacacatgcagttcagtacgctgtgactaacagggcactgacaacttctggtggtgtagctttccgtgacaaaataggagaacaatacgcgaagcaaacacttgactctgccacccagttcatatggaggatccttcagcaaagcaaccccgccgacagaaaaaacgtgcagagggtaagtttattcgtggatgacatggatggagttgcatacactagcggagatcagatccatttgagtgcaagatatgttggaaagtacaatggagatgtgaagaaagagatttcaggggtgctgtatcatgaaatggtccacgtttggcagtggaatggaaatggtcgtgttcctggggggctaattgaaggcatagcagattacgtgaggctgaaggcaaactatgcacctagccactgggtcaaaccggggcaaggtcagaaatgggaccagggttatgatgttactgctcgttttttggactattgtgaaagtctcagaagtgggtttgtggcacaattgaacaagttgtcgaggagtggttacagtgatcaatactttgtttatttactgggaaaaccagtggatcagctgtggcgagactataaggccaagtatggcaatattgcctaagagacctatagctaagagcttttcaatttaaacaataaatgactaatcactgtgtttttcaataaaattgtatcagctcttagatctgctgttgaataaatggaaacttttatccaagctagaacaagttattaaatctttgggttgttgaatcttcattccaccatgcttaattgattttcaatccaagaaactatggtgttaaaataaaaaatgaaaacatagatgatgaa

SEQ ID NO: 6105 - DNA, 1007 bp, Phaseolus coccineus
gttttctataaaaagcaagcaccaaactgaatccttgtgcagtgataaaccataaacttgttcaccaaaggaacccataaggctgaaaacgcaaccatgatcaaacaggctctttgctttttagtattcttacatgcatttcatcaaacacatgcagttcagtacgctgtgactaacagggcactgacaacttctggtggtgtagctttccgtgacaaaataggagaacaatacgcgaagcaaacacttgactctgccacccagttcatatggaggatccttcagcaaagcaaccccgccgacagaaaaaacgtgcagagggtaagtttattcgtggatgacatggatggagttgcatacactagcggagatcagatccatttgagtgcaagatatgttggaaagtacaatggagatgtgaagaaagagatttcaggggtgctgtatcatgaaatggtccacgtttggcagtggaatggaaatggtcgtgttcctggggggctaattgaaggcatagcagattacgtgaggctgaaggcaaactatgcacctagccactgggtcaaaccggggcaaggtcagaaatgggaccagggttatgatgttactgctcgttttttggactattgtgaaagtctcagaagtgggtttgtggcacaattgaacaagttgtcgaggagtggttacagtgatcaatactttgtttatttactgggaaaaccagtggatcagctgtggcgagactataaggccaagtatggcaatattgcctaagagacctatagctaagagcttttcaatttaaacaataaatgactaatcactgtgtttttcaataaaattgtatcagctcttagatctgctgttgaataaatggaaacttttatccaagctagaacaagttattaaatctttgggttgttgaatcttcattccaccatgcttaattgattttcaatccaagaaactatggtgttaaaataaaaaatgaaaacatagatgatgaa

SEQ ID NO: 6106 - DNA, 988 bp, Cajanus cajan
aagcagtggtatcaacgcagatcgtagtgtaatgaacaagcacaaacagattgactaagagaaagcaaaaggcaaccatgatcttgcatggcctttgtttcttagtattcctatccgcaacacatgcagttaaattcagtgtcactaacaacgcacttacaactcccggtggtgcggctttccgtgacaaaataggagctgcatatgcccagcgaacacttatcgctgccacccgagtcacactgaaggacatctttcagcaaaacaaccttgctgacagaaaaaacgtgcagaagataagcttatttgttgatgacatggatggagtggcttatactagcaacgatgaaattcacgtgagtgctaaatatgttggaaagtacaagggggacgtgaagacagagattacaggggtgctctatcatgaagttgtccacgtttggcagtggaatgggaatggtggtgctcctggtggattaatagaaggtattgcagactatgtgaggctgaaggcaaactatgcacctagtcactgggtaaaaccaggacaaggacagaaatgggaccagggttatgatgttactgctcattttctggactattgtgatagtctcaaaagtgggtttgtggcacaactgaacaagctgatgaggagtggttatagtgatcaattctttgttcagttactgggaaagcctgttgatcagttgtggcgagactacaaggctaagtatggcaatattgcctaagactaagagggttagcttagctagctaaaagctttagtttaaataataagcgactatatatttatcgcaatcttttctaccagattatatcaactcttggtattctcttatcatgtaatgggaagtttcatatatatggcgagaaaataaaaacaataatattccgtcttttgaatcataagcatgaaaaattaagcaggcctaattagttggaggtttgagtagtaatcataagcctc

SEQ ID NO: 6107 - DNA, 891 bp, Medicago truncatula
ggaaccacaaactcatcctccaacagaaattaaccttagagctctaagcacaagcacaaacacaaacacaatcatgcatactctctattttttcttagtactccttgctataatacatggaattcaagcagttgattacagtgtcaccaacaatgccctctctactccaggtggagtacgtttccgtgatcaactaggagcacaatatgcgacacaaacattagattctgccacacaatttatatggagagtgttccaacagaacaaccctgccgacagaaaaaatgttcaaaaggtgagtttatttgtggacgacatggatggtgtagcatatacaagcaacaatgaaattcatttgagtgcaaggtatgttaatagctatgggggtgatttgagaaaggagattacaggggtattgtatcatgaaatgacacatgtatggcagtggaatggtaatggtcaagctaatggtggattaattgaaggtatagcagattatgtaagattgaaagctaattatgcacctagtcattgggtcaaaccagggcaaggaaataagtgggaccaaggttatgatgtaactgctaggtttttggattattgtgatactttaagaagtgggtttgtggcagagttgaataagttgatgaggaatggttatagtgatcaattctttgttcaacttttggggaagacggttaatcagttgtggacagagtataaggcaaagtatggcaatatagcctaattaatcaagggatgaataaattatgtaatagtatctttatattaatgtaagaataagcgacgttttgtcgttatatctatgtaagtttgtatgatattctaaataattcaaacttatatgagttaatttatgatctataaaaa

SEQ ID NO: 6108 - DNA, 674 bp, Helianthus annuus
cgggggtggcttccttgaggagttatagggttaaatcaagctgaaatcgtgcccaaataaattcagatctaaatttgacgccgacagttgtaccaacaaccgctatcaccgtcgcaaaatggccagcaccgtcaccggttttcatcatcctcttcttaaccattgccaccgtcttcacatccaataccgaagcatcatccgtcgatttcgtcaagaaaacagtctcttctcaccccattgtcatcttctccaaatcctactgtccgtattgtaaaagggcaaaaggtgtattcaaggagttgaatgtgaaaccttatgtactcgagctcgatgagagagaggacgggtcgaaaattcaggatgcattgagtgagatagttgggaggcgtactgttccacaagtgtttatcaatgggaaacacctcggaggttcggatgatactgttgaagcttatcagagtggagaattggcaaagcttcttggcattgagagtcataaaacggacctttgagcttcaagccttagacagcctaataatgccgtaatttgtacgaatgttggtagtttaagttgacttgagtttacgattatgtcaaaatatgtaccaataaatttggatatgataccgtttgtattacatattcggcctattacctctctatataccgataaa

SEQ ID NO: 6109 - DNA, 550 bp, Flaveria ramosissima
ccttcgcccccaatttccgcagatctcttgaatcaacaccacccaaatcgccaccgtcgttgccggaaaatggccaccgtttcttcccttttcgtcctcctgttaaccatcaccaccgtcttcatatgtaacgccgaagcatcctccgtcgatttcgtcaagaagactgtttcttctcaccccatagtcatcttctccaaatcttactgcccatactgtagaagggctaagggtgtgttcaaggagttgaacaagaaaccttatgttgttgagcttgatgagagagatgatggctcggacattcaggatgccctgagtgagatggtcgggaggcgtaccgttccccaagtgtttatcaatgggaagcacctcggaggttcagatgatactgttgaagcttatcaaagtggagaactggctaagcttcttggcattgattcgagtcataagacggacctttgagctacctttaacagcgtaacgatgccattcgtcgtgtagtatgtaccaatggtagtttcagttgacttgattctttttttggttatgt

SEQ ID NO: 6110 - DNA, 646 bp, Ambrosia trifida
taggttttagtctttaaatcaagactgcccaaattcagatctaatttgaggaccaaccaccgcttatcaccgtcgcaaaatggccaaaaccgtcgctatttcttccatattaatcctcgtcctcttaaccatcttcatatctaattcccaagcagcatcctcctccgtcaagttcgtcagaaaaccatctcttctcatcccactgtcatcttctccaaatcttactgtccgtattgtaaaagggctaaaggtgtgtttaaggagttgaatgtcaagccttatgtcattgagcttgatgggagagaggatgggtcgaaaattcaggatgcactgagtgagttagtcgggaggcgtactgttccacaagtgtttatcaatgggaaacaccttggaggttctgatgatactgttgaagcttatcagactggagaattggctaagcttcttggcattgatgatagtcgtaaaacggacctttgagctttaagccatctgcagcctaataatgccgcaatatgtaccaacgggcagtagtttcagttgacttaagtatgtaccaataaatttggatatcatagcttttgtattacatattcggccttttacctctttatatctatgatagcgataaagtagtcctgaggaa

SEQ ID NO: 6111 - DNA, 667 bp, Lactuca sativa
gcgggggccaaattcaacagatctcgatttgacggccgaagttgaacaaacaatcggaatcgctgcaaaaccggtgccgaaaatggccagatccgccaccatacctttcatttgcataatcctgttaacgatcaccgccttctatatgtgtaatggagaagaatcatccgtcgatttcgtcaagaagaccgtctcttctcaccccatagtcatcttctccaaatcgtactgcccatactgtaaaagggctaaaggtgtattcaaggagttgaataagaaaccttatgtcattgagctggatgagagagaggatggagggaaaattcagaatgctctgggtgagcttgttgggaggcgtactgttccacaagtgttcattaacgggaaacatcttggaggttcagatgatactattgaagcttatgaaagtggagaactagctgagcttcttggtatttcttcaagtcataaaactgatctttgagcctcaacaacttgcagtatcttgagtgctttcttgatgttgagattaagttttttagtttttagttgatcgtttcttataggttatgttgaagtatgtagcacaaagacttgttgttaaggaccttgaaaaaatttggatgcctattttaattctatgactatgtttcaaggaatattttgt

SEQ ID NO: 6112 - DNA, 1691 bp, Ambrosia trifida
ttaggttcaggcaattcatttcccagcctatcaaattaaacataaagtggattcgggtaatgggttttggtgaacgtgttggtgccgtgtcgttggtttgtttgattactgttttataactgttggtttggagtgtaaacatcctcttggttgcgtaatctagaaattcactattggcgtgtagtggtatttgatctatgggcgagtgggtgattggagctttcatcaatctttttggcagtattgccattaactttgggactaatcttcttaaattgggtcatgatgagagagacagacacgccatgctaggtgaaggaatagatggaaagacaatattgaggcctattataagtttccagtcttggagaataggtattctatttttcgcttttggaaacgctcttaactttatttcatttggatatgctgcccagtcgcttcttgcagcattgggatctgtacaatttgtgtcaaacatcgcatttgcctactttgtcttgaacaaaacagtaactgtcaaagtattagttgccacaacttttatcgtccttggaaacacctttcttgttgcatttggcaatcaccaatcacctgtttacacacaggagcagttggcagagaagtacagtaacatcaccttccttttttactgtctatttttggtggtagtggttgtcatgcatcactatgtatacaggagaggagaattgctgcttgctattccagggaaagaactcacggcctactggaaactactgcttcccttttcatttgctgtagtttcaggggccgtaggatcgtgttcggttctttttgcaaagtcactttcaaatcttttaagattgtccatgtcaagttcatatcgcctcgatagctggttcacgtattcaattcttttattgtttctatctaccgctggattctggatggcaaggttgaatgaaggattgtcacagttcgatgccatacttatagtccccatgcttcagatagcttggacctttttctcaatttgtactggatttgtgtatttccaggaatatcaggtctttgatgccttaaggacggtgatgtttatagtgggaatgatttccgtattcataggaatttcattgctggcacctgatgactcgaaaggagcagaagtcaaggatagtccctcatcaaaagtcaacactgatgtagaaaggttgattgaagactcgtcaatcaaggatatgaagtcgtttgcaagagcaatggcaacgaaagcctcagctgcagttatcagggcaaagagtgcttgcacactgatgttgggtatgggagatgatacaatgcatgcgtcatcggtttttgcaatgcccatggtatcatcaaagatgacgggattcagaggagtcaacagtgaccggtcaaagctgttgtcattgagaagcccatcgggatggaataggattccggtggtggaagaaactgtaaatatgatggacagtatttcaagtgaagaggattagtacatgtgttttgtggatgttatatatccttctaaggagtgtgattgtagtaattggcgaaagaggaaagtgccgagcgtcaccaggaaggcgttgtatagttgtttaattagttggattgaatttggatgtatatcttctatgattcttaaaaaatttttgggccaattgtaggctgtgtttaaaaaagaa

SEQ ID NO: 6113 - DNA, 1569 bp, Flaveria ramosissima
catttgtaccaatttactctctgtaaacacattctccagatttgattaacgaaaccctcgatcgttaaagactaaattgagcagattcgtgtgtttctcacacccacggcaattcttttcccactctattgacacaaggtggactcactgatggattttggagaaagtgttggtgttgagcagttggttcttgtgattactgtctcctaactgttggtttagagtctaaacaccagcctgattacataatctagaagccccattggcacatagtgatttttaatctatgggcgagtgggtgattggagctttcattaatctttttggcagcattgccattaactttgggactaatcttcttaaattgggtcatgatgagagagacagacatgccacgctaggtgaaggaatagatggaaagacaatattgaggcctataataagcttccagtcttggagaataggtattctatttttcgcttttggaaacgctcttaactttatttcattcggatacgctgcccagtcacttcttgcggcattaggatccgtccagtttgtttcaaacatcgccttcgcctactttgtcttgaacaaaacagtaactgtcaaagtattagttgccacaacttttatcgtccttggaaacacctttcttgttgcatttggcaatcaccaatcacctgtttacacacaggaccagttggcagagaagtacagtaacatcaccttccttttttactgtctacttttggcggtggtggttatcatgcatcactatgtgtacaggaaaggagaattgctgcttgctaatgggaaagaactaatgccttactggaaattactgcttcccttttcgtttgctgtagtttcaggggccataggatcatgttcagttctttttgcaaagtccctttcaaatcttttaagattgtccatgtcaagttcatatcgcctggatagctggtttacatattcaattcttttgttgtttctatgtactgctggattttggatggcaaggctgaacgaaggattatcactgttcgatgcaatacttatagtccccatgtttcagatcgcgtggacctttttctcaatttgtactggatttgtgtatttccaggaatatcaggtgtttgatgctttgaggacagtgatgtttattctgggaatgatttcagtattcttaggaatctcattgctggcacctgatgactccaaagtgggagaagtcaaagacagtacctcatcaaaagtcaacactgatgtagaaaggttgattgaagactcatcaatcaaggatatgaagtcgtttgcacgagcaatggcaacaaaagcctcggctgcagtgatcagagcaaagagtgcttgcacactgctgttgggtatgggagatgatacaatgcatgcatcatctgttctcgcaatgcccatggtctcatcgaagatgacaggattcagaggagtcaacagcgaccggtcaaagttgttgtcgttgaaaagccagtcgggatggaataggattccgatggtggaagaaactgtaaatatgatggacagtatttc

SEQ ID NO: 6114 - DNA, 1454 bp, Cirsium arvense
gtatattctaggaatacctctgtcacatagacatttttaatctatgggcgagtgggtaattggagctttcatcaacctttttggcagcattgccattaactttgggactaatcttcttaaattgggccatgacgagagagaaaaacatgcggtgctaggtaatggaggaataaatggaaagatgttactgaagcctatcataagcttccagtcttggagaattggtattctattttttgcttttggaaacgctcttaactttatttccttcggatatgctgctcagtcacttcttgcagcattgggatctgtccagtttgtgtcgaacatcgcgtttgcctactttgtcttgcaaaaaacagtgaccgtcaaagtattggttgccacaacttttatcgtccttggcaacaccttccttgttgcgtttggcaatcatcaatcacctgtttacacacaagagcagttggcagagaagtatagcaacactactttccttttttactgtctgcttttgatcttggtggttgtcatgcatcactatgtatacaggagaggagagctgttgcttgctattccagggaaggatcttatgccttattggaagttgctgcttcccttttcatttgctgtagtttcaggagccataggatcctgttcagttctttttgcaaagtccctttcaaaccttttaagattgtccatgtcaagttcatatcggttggatagctggttcacatattccattcttttattgtttctatgcactgctggattttggatggcaaggttgaatgaaggattatcacagttcgatgcgatacttatagtccccatgtttcagatagcttggacctttttctcgatctgtactggatttgtgtatttccaggaatatcaggtatttgatgccttgaggacagcaatgtttattctgggaatgatttcagtattcataggaatttcgttgctggctcctgatgactcaaaagggggagaagtgaaggaaaataccttatcatctgtggcctcatcaaatgtcaatactgatgtagacaggttggtcaagccatgtgaagactcaccaatcaaggatttgaagtcgcttgcacgagcaatggtaacaaaagccatagctgcggctatgaaggcaaagagtacttgctcattattggtgggtatgggagatgatacaatgcatgcatcatcagttcttgcaatgccgatggtttcatcaaaaatgacagggttcagaggaggagatagatcaaagttgatatcgttaagaagcccaacgggttggagtaggattccagttgaggaaactgtaaatatgctggatactacttcaagtgaagaggattgattagttgacatcagattcattcattgattaatagccatcacaaagggagtatgtttgtttgtagtaagtaattgatttggggaaaaaagaa

SEQ ID NO: 6115 - DNA, 1769 bp, Cirsium arvense
aaaagtaattttctcagatttgattcacgatctccggcgatccttattccagcaagctctctattgttgtttctttcataataccaaatctagcttgcaggcagttcgttttccattctattaagacaaagtggactcctctgatggatgttggagaaagtgttcatgttgtgcagttgcttcctctgactgctgactcctgacttttggagatttcggaaggccgtctacattgcatattctaggaataaatacctctttcacatagacatttttaatctatgggagagtgggtaattggagctttcatcaacctttttggcagcattgccattaactttgggactaatcttcttaaattgggccatgacgagagagaaaaacacgctgtgctaggtaatggagggataaatggaaagacgatactgaagcctatcataagcttccagtcttggagaatcggtattcttttttttgcttttggaaacgctcttaactttatttcctttggatatgctgctcagtcacttcttgcagcattgggatccgtccagtttgtgtcaaacatcgcgtttgcctactttgtcttgcaaaaaacagtgaccgtcaaagtattagttgccacaacttttatcgtccttggcaacacctttcttgttgcatttggcaatcaccaatcacctgtttacacacaggagcagttggcagagaagtacagcaacactactttccttttttactgtctgcttttgatctgggtggttgtcatgcatcattatgtatacaggaaaggagaactgttgcttgctattccagggaaggatcttatgccctactggaaattgctgcttccattttcatttgctgtagtctcaggagcaataggatcctgttcagttctctttgcaaagtccctttcaaaccttttaagattgtccatgtcaagttcatatcgcctggatagctggttcacatactccattcttttattgtttctatgcactgctggattttggatggcaaggttgaatgaaggattgtcacagtttgatgcgatacttatcgttccaatgtttcagatagcttggacctttttctcgatttgtactggatttgtgtatttccaggaatatcaggtatttgatgccttgaggacagcaatgtttattctgggaatgatttcagtattcataggaatttcgttgctggctccagatgagtccaaaggtggagaagtcaaagaaaatatcttatcatccgtggcatcatcaaatgtcaacaccgatgtagaaaggtcggccaagccatgtgaagactcgccaatcaaggatttgaagtcgcttgcacgagcaatggtgataaaagctgcagctgctgctatgaaagcaaagagtgcttgctcattattggtgggcatgggagatgatacaatgcatgcttcatcagttcttgcaatgccaatggtttcatcgaaaatgacggggttcagaggaggagacagatcgaagttgatatcgttaagaagtccaacgggatggagtaggattccggtggaggatactgtaaatatgctggatactacatcaagtgaagaggattgattgattagtttgtgcttctatagccaaaccccaaagggagttgtatgtttgtagtagtaatactaactaattgggaagaggaaggaaggaaagaaagtaccactatcactgccactgccactgttgtatagttgtttgaattcattggatttggatgtatatctttga

SEQ ID NO: 6116 - DNA, 2011 bp, Centaurea maculosa
  misc_feature (168)..(168): n is a, c, g, or t
  misc_feature (792)..(792): n is a, c, g, or t
  misc_feature (846)..(846): n is a, c, g, or t
  misc_feature (918)..(918): n is a, c, g, or t
  misc_feature (924)..(924): n is a, c, g, or t
  misc_feature (930)..(930): n is a, c, g, or t
  misc_feature (933)..(933): n is a, c, g, or t
  misc_feature (950)..(950): n is a, c, g, or t
  misc_feature (962)..(962): n is a, c, g, or t
  misc_feature (990)..(990): n is a, c, g, or t
  misc_feature (1784)..(1784): n is a, c, g, or t
  misc_feature (1878)..(1878): n is a, c, g, or t
gcgggggacaaatacattaccaccctcctccttcaatccctctttccaatttcattttcaattttcattttcatttcatttctattcaattcttgtttgattcccccaaaatctcaatttcttcatcttcttcatattttcatcaatatatacatacatatctctcangtgtataattcatcatcatattaaaaagaattttctcagatttgattcacgatctccggcgatccttattccagcaagctctctattgttgtttctttcataataccaaatctagcttgcaggcagttcgttttgcatgctattaagacaaagtggacggactccctgatggatgttggagaaagtgttcatgttgtgcagttgcttcctctgactgctgactcctgacttttggagatttcggaaggccgtctacattgcatattctaggaataaatacctctttcacatagacatttttaatctatgggagagtgggtaattggagctttcatcaacctttttggcagcattgccattaattttgggactaatcttcttaaattgggccatgacgagagagaaaaacacgctgtgctaggtaatggagggataaatggaaagacgatactgaagcctatcataagcttccagtcttggagaatcggtattcttttttttgcttttggaaacgctcttaactttatttcctttggatatgctgctcagtcacttcttgcagcattgggatccgtccagtttgtgtcaaacatcgcgtttgcctactttgtcttgcaaaaaacngtgaccgtcaaagtattagttgccacaacttttatcgtccttggcaacaccttncttgttgcatttggcaatcaccaatcacctgtttacacacaggagcagttggcagagaagtacagcaacacnactttncttttntantgtctgcttttgatctnggtggttgtcangcatcattatgtatacaggagaggaganctgttgcttgctattccagggaaggatcttatgccctactggaaattgctgcttccattttcctttgctgtagtctcaggagcaataggatcctgttcagttctctttgcaaagtccctttcaaaccttttaagattgtccatgtcaagttcatatcgcctggatagctggttcacatactccattcttttattgtttctatgcactgctggattttggatggcaaggttgaatgaaggattgtcacagtttgatgcgatacttatcgttccaatgtttcagatagcttggacctttttctccatttgtactggatttgtgtatttccaggaatatcaggtatttgatgccttgaggacagcaatgtttattctgggaatgatttcagtattcataggaatttcgttgctggctccagatgagtcaaaaggtggagaagtcaaagaaaatatcttatcatccgtggcatcatcaaatgtcaacaccgatgtagaaaggtcggccaagccatgtgaagactcgccaatcaaggatttgaagtcgcttgcacgagcaatggtgataaaagctgcagctgctgctatgaaagcaaagagtgcttgctcattattggtgggcatgggagatgatacaatgcatgcttcatcagttcttgcaatgccgatggtttcatcgaaaatgacggggttcagaggaggagacagatcgaagttgatatcgttaagaagtccaacgggatggagtaggattccggtggaggatactgtaaatatgctggatactacatcaagtgnagaggattgattgattagtttgtgcttctatagccaaaccccaaagggagttgtatgtttgtagtagtaatactaactaattggggaagagganggaaggaaaagtaccactatcactgccactgccactgttgtatagttgtttgaattcattggatttggatgtatatctttgattctttaaattcttttgtttgccaaatgtaatgtagctggctcattatatc

SEQ ID NO: 6117 - DNA, 1264 bp, Arnica chamissonis
atgatgagagagacagacatagcgatgctaggtgaaggaatggatggaaagacaatattgaggcctattataagcttccaatcttggagaataggcattctatttttcacttttggaaacgctcttaactttatttcttttggatatgctgcccagtcacttcttgcagcattgggatctgtccaatttgtgtcaaacatagcatttgcctacttcgtcttgaacaaaacagtaactgtcaaagtattagttgccacaacttttatcgtccttggaaacaccttccttgttgcatttggcaatcaccaatcacctgtttacacacaggaacagttggcagagaagtacagtaacattacgttccttttttactgtctgcttctggtggttgtggttgtcatgcatcactatatgtacaggagaggagaattgctgcttgctattccagggaaagaacttatgccctactggaaattactgcttcccttttcatttgctgtagtttcaggggccgtaggatcatgttcagttctttttgcaaagtcactttcaaatcttttaaggttgtccatgtcaagttcatatcgcctggatagctggttcacatattcgattcttttattgtttctatgtactgctggattttggatggcaaggttgaatgaaggactatcacagttcgatgctatacttatagtccccatgtttcagatcacttggacctttttctcaatttgtactggatttgtgtatttccaggagtatcaggtttttgatgccttgaggacggtgatgtttattctgggaatgatttcagtattcataggaatttcattgctggcacctgatgactcgaaagggggagaagtcaaggatagtccttcatcaaaagtcaacactgatgcagaaaggttgattgaagagtcaccaatcaaggatatgaagtcgcttgcaatagcaattgcaacaaaagcctcagctgtagttatcagggcaaagagtacttgcacactggtgttgggtatgggagatgatacaatgcatgcatcatcggttcttgcaatgcccatggtttcgtcgaaaatgacgggattcagaggtggtgagcggtcaaagttgttgtcattgagaagcccatctggatggaataggattccggtggtggaagaaactgtaaatatgctggacactatttcaagtgaagaggattagtacagtacatggttgtagtagtagtaatgccacgtgaggcattgtatagctg

SEQ ID NO: 6118 - DNA, 1831 bp, Artemisia annua
tgttttaattctcaattcaaattcttgtttgattccgtactagtttccacgaataatctctattttcttgtagatcaccattttataaaatttcatctgtcattacattgtattatatcaaactcaacaaaaattcatcaatatcttctcttcaagatttaaaaattactctcaggcaattattttctgctctttttggataaggcggatatacactagcggatgggtgttggagaaggtggttctttagtgaagttgcgtatattgattacggttcaatagtagtcgtctctcgattgtatatttctaggaatacgaattccacctctttcgcatagagagttttgttatctatgggggagtgggtgatcggagcttttattaatcttttcggcagcattgctattaacttcggaactaatcttcttaaattgggtcatgatgagagagaaagacatgccgtgctaggtgaaggaataaatggaaagacaatacttaggcctattataagcttccagtcttggagaattggtatactgttttttgcttttggaaacgctcttaactttatatcattcggatatgctgctcagtcacttctcgctgcattgggttctgtccaatttgtgtcaaacatcgcatttgcctatgttgtcctgaacaaaacagtgactgtcaaagtagtagttgccacgacgtttatagtccttggtaacaccttccttgttgcttttggcaatcatcagtcacctgtttacacacaagaccagttggcagagaagtacagtaacattaccttccttttttactgtctactattggttgtggtggttatcattcatcactatatatacaggagaggagaatggctactctctattccaggaaaggatttttcgccctactggaaattaataattccattttcatatgcggtagtttcaggagccataggatcatgttcagttctttttgcaaagtccctttcaaatcttttgagattgtccatgtcaagctcatataggctggatagctggttcacgtattcaattcttttgttgtttctatgtactgctggattttggatggcaaggttaaatgaaggattagcgcagtttgatgccatacttatagtccccatgtttcagatagcttggacctttttctccattattactggatttgtgtattttcaggaatatcaggtaatggatatcttgaggacagttatgtttattttgggaatgatttcagtattcatagggatttcattgctggcacccgatgagcctaaaggtggagaagttaaagatagttccttatcatctgcggctttaccaagagtcaacaccgaagtagaaaggttgatcaagccaattgaagattcaccaatcaaggatttgaagtcatttacacgagcattggcagcaaaagcctcagctgctgttaccagggcaaagagtacttgcacattgttgcttggtatgggagatgatgccatgcatggttcatcagtttttgcgatgccaatggtttcatcaaaaatgacgggattcaggggtgtcgggggtgaccggtcaaagttgatgtcattaagaagtccaaccggttggagtaggattccggtggttgaggaaaatgtaaatatgctggagactacttcaagcggagaggattagtacatcacgtttattggttttctttgtaatggaaggtgtatgtttgttgtaattggggaaaagaggaaagaatcactgccactaggaaggtgttgtatagtttgatttgattgggattggattggaatgaatatggatgtatatgttctttg

SEQ ID NO: 6119 - DNA, 1594 bp, Ambrosia trifida
tattacttgtatgcgtttagccaccgatcccgataacgacgtcgtttaaccagctccctaaaacacgaacacacatttcttccatattcattctggttttcaatttctttcgtaattcatattcaatattaatccactttgtagaataataaataaataaatcctacacatttgtatcgatttatataaacacattttccatatttgttccacataaaaccctacatcattccacatatttcatccaacggttgcagattgggttcaggcaaactgaggcaattcataaagtggagttgcgaatgggttttggtgaacgtgttggtgtcgtgacgttggttcgtttgattactgttttgtaactattggtttggagtgtaaacatcttcttggtgacgtaatctagaaattcactaccagcgcatagtcgtatttgatctatgggcgagtgggtgattggagcttttatcaatctttttggcagtattgccattaactttggaactaatcttcttaaactgggtcatgatgagagagacagacacgccatgctaggtgaaggaatagatggaaagacaatattgaggcctattataagtttccagtcttggagaataggtattctatttttcgcttttggaaacgctcttaactttatttcattcggatatgctgcccagtcgcttcttgcagcattgggatctgtacaatttgtgtcaaacatcgcatttgcctactttgtcttgaacaaaacagtaactgtcaaagtattagtcgccacaacttttatcgtccttggaaacacctttcttgttgcatttggcaatcaccaatcacctgtttacacacaggagcagttggcagagaagtacagtaacatcaccttcctttttactgtctattttggtggtagtggttgtcatgcatcactatgtatacaggagaggagaattgctgcttgctattccagggaaagaactcacggcctactggaaactactgcttcccttttcatttgctgtagtttcaggggccgtaggatcgtgttcggtctttttgcaaagtcactttcaaatcttttaagattgtccatgtcaagttcatatcgcctggatagctggttcacatattcaattcttttattgtttctatctaccgctggattctggatggcaaggttgaatgaaggattatcacagttcgatgccatacttatagttcccatgcttcagatcgcttggacctttttctcaatttgtactggatttgtttatttccaggaatatcaggtctttgatgccttaaggacggtgatgtttatagttggaatgatttcagtattcatcggaatttcattgctggcacctgatgactcgaaaggagcagaagtcaaggatagtccctcatcaaaagtcaacactgatgtagaaaggttgattgaagactcgtcaatcaaggatatgaagtcgttcggaagagcaatggcaacaaaagcctcagctgcagttatcagggcaaagagtgcttgcacactgatgttgggtatgggagacgatacaatgcatgcgtcatcggttttcgcaatgcccatggt

SEQ ID NO: 6120 - DNA, 1920 bp, Helianthus annuus
gcagagtacgcgcgggggctgggtatgcgttggaaaatcatatgcgtttcaaaaagccacccaatgcgaccaaaataacacctcgtttacccatcatccccacaaagtccatattcaacaccttcatcttcattttcattttcatttttcaaattcttgtttgattcgcattcctacttccccctaaatctcattctgtatcgtccttcatattcaaatttcgtatcttatcaccacttgtaaacaaattcctgaaactttattcaacggctagcagattgctctgtcaccagtgagcttgcaggcaattcagtggacttgttaaaaagttttcggagatatcgtcggtgttttgcggttgcttctttgattactgtctactgactattggtttaaagtctaaacaccatcttgattacataatataaaaataccattgtcacatagatatttttaatctatgggtgactgggtgattggagctttcatcaatctttttggtagcattgcgattaactttggcactaatcttcttaaattgggccatgacgagagaggaaggcattcgatgctaggtgaaagaataaatggaaagacaatattgaagcccattataagcttccagtcctggagaattggtattctatttttcgcttttggaaacgctcttaactttatttcgttcggatatgctgctcagtcacttcttgcagcattgggatctgtccagtttgtgtcaaacatagtatttgcctactttgtgctcaacaaaacagtgactgttaaagtaatagttgctacaacttttatcgtcgttggaaacaccttccttgttgcatttggcaatcaccaatcacctgtttacacacaagaccagttggcagagaagtacagtaacattaccttccttttttactgtctacttttggtggcggtggtcgccatgcatcactatgtatacaggaggggagaattgctgcttgctatttcagggaaagaacttatgcgctactggaaattattgcttccattctcattcgcagtagtttcaggagccataggatcatgttcagttcttttcgcaaagtccctttcaaatcttttgagattgtcaatgtcaagttcgtatcgcctggatagctggttcacgtattcaattcttttaatgtttctatgcaccgctggattttggatgacaaggttgaatgaaggattagcacaatttgatgccatacttatagtccccatgtttcaaatagcttggacttttttctcaatttgtactggctttgtgtatttccaggaatatcaggtattaaatgccttgaggactgtgatgtttattctcggaatgatttcagtattcataggaattacattgctggcgcctgatgaatcaaaagggggagaagtcatggatattcccgtatcatcaaaagtcaacactgatgtagaaaggttgattgaagactcaccgatcaatgatatgaagtcgcttgcaagagcaatggcaacaaaagccttggctgcggttggtagagcaaaggttgtgcgaataataatttcatacaggaatgaaatcagaagatggaataggaatatagtttcttgatcttttttgaactttttcggtacaaagtacttgcatactgttggtgggtatgggagatgatacaatgcatttatcatcggttcttgcaatgccaatggttatataaaaaatgactggattcagaggattcaattctgagcggtcaaagttgtcgttaagaagcccatcaggatggaataggattccggtggtggcagaaagtgtatatatgttggatactacttcaagtgaagaggattgattagtacatgagatttattgtatagtttcttgattgaatttggatgtatatttttgtttgattttta

SEQ ID NO: 6121 - DNA, 2306 bp, Cichorium intybus
aactttggactcatagcaaaatttcgtgtaaacacaaaggaccaaaactataatttacttaaaattttatcttccagataggtttggcagaaagtcaattgagaaaataggaagagtagtcattagtcaatcatctttgacaatgtggggttaatttagtaatttaagccctaattggaaaatttgttgttgttgaagtcgccgacggccgcgttgggaaatcacgtgcaccttgcaaaagccacacaatggaccaaagagatcgtgtacccatcgacacaaggaccagccccaccctggtctaaaaacacctcctctctttctctttcaatttcaattcaaattcttgtttgattcgcatccttccttccccgaaaatcttaattttgtgcgtcatctgggtggtccttcatattgaaatcttggaggtgtatacttgatcatacattcgtgtcgaaattcaaaatatacctgtaaacagattccagatttgattcacggcgccccttgatcccggaagatcctattcgacatcagcagattggtctccagcaagctgtcttcttgttttctcacacctgagacgattcattccccgctcaattaacacaaagtagactcactgatggatgttagagaaagtttttgtatagtacaattgcttcgtttgactatcgactcctgattattggagattctagacgccacctcaattgcatttattaggaacacctctgtcacatagacatttttaatctatgggcgagtgggtggttggagcttttatcaacctttttggcagcattgcgattaacttcggtacaaatcttcttaaattgggccatgacgagagagaaagacatgctatattagttgaaggaattaatggaaagacactacttaggcctatcataagcttccaatcttggagaatcggtattctatttttcgcttttggaaatgcccttaactttatttcctttggatacgctgctcagtcacttcttgcagcattgggatccgtacaatttgtgtcaaatatcgcatttgcctattttgtcttgcagaaaacagtgactgtcaaagtaatagttgccacaacttttattgttcttggaaatatcttccttgttgcatttggaaatcaccaatcacctgtctacacacaagagcaattggcagaaaaatacagtaacattaccttcctgttttactgtttgcttttggtggtggtggttctcatgcatcactatgtatacaggagaggagaattgttgcttgcgattccaggaaaggatcttatgcgttattggaagttactgcttcccttttcatttgctgtagtttcaggggccataggatcatgttcagttctctttgcaaagtccctttcaatcttttaagattgtcgatgtcaagttcatatcggttggatagctggttcacatattcgattcttttattgtttctatgtaccgctggattttggatggcgaggttgaatgaaggattatcacagttcgatgcgattcttatagtccccatgtttcagatcgcttggacatttttctcaatttgtactggatttgtgtatttccaggaatatcaggtattaaacgccttgaggaccgccatgtttattctaggaatgatttcagtattcataggaatttcattgctggcacccgacgactcaaaaggagaaaccaaggaaaattccttatcatccgtggcttcatcacatgtcaaccctgaaatagaaaggtcggtgaaaccatgtgaagagtcacaaatcaaggacatgaagtcgctggcaagagcaatggcaacaaaagcatcagcagccgtagtgaaagcaaaggtttttgtccgacttttctttccagatgggcatcatcgatacaaaaagatggagtccaattttatatattcttaaaaaaatttcgaatttttgggtacagagtacttgcacacttttgcttggtatgggggatgataccatgcatgcgtcatcggttcttgcgatgcccatggcctcgtcaaaaatgacaggctttagaagtgtcggaggtgaccggtcaaagttgtcgttgagaagtccgtccgggtgggggaggattccggcggaggaggaaagtgtaaatatgctggatactacttccagtgaagaggattagaggagtgtgtttgtagtaattggggaaagggggaaggtgccactgccacgtgttgtatagtttgattggattggatttggatgtattctatatcttatcttctttcatttttaaattctttggtttgtc

SEQ ID NO: 6122 - DNA, 1522 bp, Flaveria ramosissima
gaacaaagtggactcacttgtgaatattggagagccccgctggtgtcttgcagttgcttctttttgattattgtctcctggctattggtttaaagtctaaacaccatcttgaatacatattcttgaagcaccaccgtcacatagagaattttcatctatgggtgactgggtgattggagcattcatcaatctttttggtagcgttgccattaattttggaactaatcttcttaaattgggtcatgatgagagagaaaggcattcgatgctaggtgaaggaataaacggaaagacaatattgaggcctattataagctttcagtcctggagaattggaattctgttttttgcttttggaaacgctcttaactttatttcatttggatatgctgctcagtcacttcttgcagcattaggatctgtccaatttgtgtcaaacatagcatttgcctactttgtcttgaacaaaacagtgactgttaaagtattagttgccacaacttttatcgtttttggtaaacaccttccttgtcgcatttggcaatcaccaatcaccagtttacacacaagaccagttggcagagaagtacattaacattaccttcctttttactgcctacttttggtggcggtggttgccatgcatcactatgtatacaggagaggagaattgctgcttgctattcatgggaaagaactcaggcgctactggaaattattgctacccttttcatttgctgtagtttcaggagccataggatcatgttcagttctttttgcaaagtccctttcaaatcttttaagactgtccatgtcaagttcatatcgcctggatagctggttcacgtgttcaattcttttattgtttctatgtactgctggattctggatggttaggttgaatgaaggattagcacagtttgatgcaatacttatagtccccatgtttcaaatagtttggacctttttctcaatatgtaccgggtttgtgtatttccaggaatatcaggtattgaatgccttgaggactgtaatgtttattcttggaatgatttcagtattcataggaatttcattgctggcacctgatgacacaaaaggaggagaagccatggatagtcccctatcatctataacctcatcagacgtcaacactgatgtagaaaggttgattgaagactcaccaatcaaagatatgaaatctcttgcacgcgcaatgccaacaaaatcgttagccgtggttgttagaacaaaggttgtggaaattctagttccatactggaaaggaatcaaacgatggaatcagaatatgatctcttaacttttaaaaaactctttgggtacagagtaatgcatgcatcatctgttctttcaatgccaatggtttcataaaaaataactggattcagaggagtcaattctgaccggtcaaagttgtcattgagaagccctctaggatggaataggattccagtggtggcagaaagtgtaaatatgctggatactatttcaagtgaagagg

SEQ ID NO: 6123 - DNA, 1396 bp, Flaveria ramosissima
ttttggtagcattgccattaactttggaactaatcttcttaaattggggcacgatgagagagaaaggcattcgatgctaggcgaaggaataaacggaaagacaatattgaggcctattataagctttcagtcctggagaattggaattctgttttttgcttttggaaacggtcttaactttatttcatttggatatgctgctcagtcacttcttgcagcattgggatctgtccaatttgtgtcaaacatagcatttgcctactttgtcttgaacaaaacagtgactgttaaagtattagttgccacaacttttattgtctttggaaacaccttccttgttgcatttggcaatcaccaatcacccgtttacacacaagaccagttggcagagaagtacattaacattaccttccttttttactgcctacttttggtggcggtggttgccatgcatcactatgtatacaggagaggagaattgctgcttgctattcatgggaaagaactcaggcgctactggaaattattgctacccttttcatttgctgtagtttcaggagccataggatcatgttcagttctttttgcaaagtccctttcaaatcttttaagattgtccatgtcaagttcatatcacctggatagctggttcacgtgttcaattcttttattgtttctatgtactgctggattttggatggtaaggttgaatgaaggattagcacagtttgatgcaatacttatagtccccatgtttcaaatagtttggacttttttctcaatttgtaccgggtttgtgtatttccaggaatatcaggtattgaatgccttgaggactgtgatgtttattcttggaatgatttcagtattcataggaatatcattgctggcacctgatgacacgaaaggaggagaagtcatggatagtcccttatcatctataacctcatcaaaagtcaacactgatgttgaaaggttgattgaagactcaccaatcaaggatatgaaatctcttgcacgcgcaatgccaacaaaatcgttagctgtggttgttagagcaaaggctgtggaaattctagttccatactggaaaggaatcaaacgatggaatcagaatatgatctcttaactttttaaaaaacttattaggcatgcatcatctgtttttgcaatgccaatggtttcataaaaaatgactggattcagaggagtcaattctgaccggtcaaagttgtcgttgagaagccctctaggatggaataggattccagtggtggcagaaagtgtaaatatgctggatactacttcaagtgaagaggattgattagtacatgagattttttggttatatattcttctaatagaatgattgtgcttgtagtaattggggaaaata

SEQ ID NO: 6124 - DNA, 1520 bp, Helianthus annuus
aaaatgccacccaattctctctcaccacttttccctctctctactcctctttaaaaaccacttacattcacaccttttcatatctctctgcaaaacaaacatggaggagataactaatggcggcaacaaaaacgaatcacagcttctgaagcttaaatgttccgtacagaactacgactggggacgaatcggttacgattcgcgcgtcgcaaccctgtttgagaaaaattgtggtgttcagattgatgagaagaagcattatgctgagttttggatggggactcatgtgtccggaccgtcggttgtggatgctggtgatggtgataatgtgagtttgaaggtgtggattgtgcaaaaccctaaggttttgggtgatgttgttgttgataagtggggagttgatcttccatttttgcttaaggtcctttctgtgggcaagtcattgtcaatacaagcccatccagataaggaattagcaggattccttcataagacgcaaccaaatgtgtataaagatgcaaatcacaagcccgaaatggctctggcattaacagagtttgaggcgttatgtgggtttattagttcagaggaacttgatgttgtgcttgaaactgttcccgagattaatgaagtggttggcaatgcaagtgcaaaccaaatcttaactgtcgacaaacacattggtgaactcaaagaagaacgcgctcttcagtcaatattcactaaactcatgtcagttgaccaagaggttatttctgaagcactatccaaattagtcaaccgtctaacccatgaaaaagagaaaaggcggttaactagtaaagaagaactagtgttgaagcttgaaaaagaatacccaaatgatgtcggggtgttagccgcgcttctctttaatcatgtcaaactcgaacccggtgatggtttatacatagcagcaaatgaaccacatgcgtatttgaatggtgagtgtatcgagtgcatggcagcttccgataatgtggtccgtgccggtctcactccaaaatatattgatgttaaaaccctctgctccatgctcacatataaacaggggttacctgaaatattgaaaggtgtaccgatgaaccaatatgtgagacgatacacaccgcctttcgaggaatttgaggttgaccaatgcgtgcttgaccaaggcgcgtcagttgtatttcctgcacttccgggcccgtctgtttttgtggtgatttctggagaaggaacgatggcgacggcatcacgtgaagatcgagtgtcggaaggcgatgcgttgtttgcacctgcagggaccgaggttcatgttagtactgatacagaactgcagctgtatagagctggagtgaatcacaaggtgcttttgaacccttgactgatgaggatggaagaatgggtcactagtagtttatgtaaatctgtgtgtcattctgtttacagaataacggttttaaagttatagtagttgtaatgatattcacatatattatataattatatacattttggtt

SEQ ID NO: 6125 - DNA, 1430 bp, Helianthus annuus
gatgtgatgctctaattcatatctctctctctctgcaaacaaacatggagggcggcaacaaaaacgaaccagagcttctgaagctcaaatgttccgtacaaaactacgactggggacgaatcggttacgattcgcgcgtagcaagcctgtttgagaaaaattgtggtgttcagattgatgataagaagcattatgctgagttttggatggggactcatgtgtccggaccgtcggttgtggatgctggtgatggtgataatgtgagtttgaaggtgtggattgtgcaaaaccctaaggttttgggtgatgttgttgttgataagtggggagttgatcttccatttttgcttaaggtcctttctgtgggcaagtcattgtcaatacaagcccatccagataaggaattagcaggattccttcataagacgcaaccaaatgtgtataaagatgcaaatcacaagcccgaaatggctctggcattaacagagtttgaggcgttatgtgggtttattagttcagaggaacttgatgttgtgcttgaaactgttcccgagattaacgaagtggttgtcaatgcaagtgcaaaccaaatcttaactgttgacaaacacattggtgaactcaaagaagaacgcgctcttcagtcaatattcactaaactcatgtcagttaaccaagaggttatttccaaagcactatccaaattagtcaaccgtctaacccatgaaaaagagaaaaggcggttaactagtaaagaagaactagtgttgaagcttgaaaaagaatacccaaatgatgttggggtgttagccgcgcttctccttaatcttgtcaaactcgaacccggtgatggtttatacatagcagcaaatgaaccacacgcgtatttgaatggtgagtgtatcgagtgcatggcagcttctgataatgtggtccgtgccggtctcactccaaaatatattgatgttaaaaccctctgctccatgctcacatataaacaggggttacctgaaatattgaaaggtgtaccgataaaccaatatgtgagacgatacacaccgcctttcgaggaatttgaggttgaccaatgcgtgcttgaccgaggcgcgtcggttgtatttcctgcacttccgggcccgtctgtttttgtggtgatttctggagaaggaacgatggcgacgtcatcatgtgaagatcgagtgtcggaaggagatgcgttgtttgcgcctgcagggaccgaggttcgtgttagtactgatacagaactgcagttgtatagagctggagtgaatcacaaggtgcttttgaatccttgactgatgaggatggaagaatgggtcactagtagtttatgtaaatctgtgtgtcgttatgtttaccaataacggttttacagttatagtagttgtaatgatattcacatatattat

SEQ ID NO: 6126 - DNA, 1503 bp, Ambrosia trifida
ctaaccatcaatgaacatatatattcaatctctctatcatcactttcttaaatcaaaacaaacaatgaataataatattaataataataataagaacccgggctactgaagctaaaatgcgccgtacagagctacgactggggccgaaccggccacgactcacgcgtagcaacgctgttggagaaaaactgtggtgctccgattgatgataagaagcattatgctgagttttggattgggacccacgtgtctggaccctcagttgtggatatgggtgatgataataataataataataatgtgagtttgaaggattgggttgtgcaaaatcctgaggttttgggtgatgttgttgttgataagtggggtcttgatcttccgttcttgcttaaggtactttctgtgggcaagtcattgtcaatacaagcccatccagataaggaattagcagggttccttcataagacgcaaccaaacgtgtataaagatgcaaatcacaagcccgaaatggctctggcattaacggagtttgaggcgttatgtgggttcattagttcagaggaacttgatgctgtgctcgaaactgtgcccgagattgctgacgtggttggcaatgcaaatgcagaccaactcttagatgtcgacaaacacaatggtgaggtcaaagaagaacggaatcttcagtcgatattcactaaactcatgtcagttgacaaagaggtgatttccaaagcactatccagattagtcaaccgtctaacccgtgaaaatgagacaaggcagttaactagcaaagaagaactagtgttgaagcttgaaaaacagtacccaaatgatgttggggtgttagctgcactgctccttaatcttgtcaaactcgaacctggcgatggtttatacatagcagcaaatgaaccacacgcgtatttaaatggcgagtgcattgagtgcatggcagcttcagataacgtggtccgtgctggcctcacaccaaaatacattgatgttaaaaccctctgctcaatgctcacatataaacaggggttacctgaaatcttgaaaggtgtaccaataaaccaatatgtgagacgatacacgccgccttttgaggaatttgaggttgaccaatgcgtgcttgaccaagcagcgtccgttgtatttcctgcacttcctggcccgtctgtgtttgtggttatttcgggagaaggaactatgctaacgtcatcatgtgaagatcgagtgtcggaaggagctgcattgtttgcacctgcagggactgaggttcgggttagtactgaatcagagctgcagttgtatagagctggagtgaatcacaaggttcttatgaacccttgacatgatgaggatggatgaaatgggtcactagtagtttatgtaaatccatatatgttttgttatgtttacagaataacagttttaccgttatatgctagttgtaatgatattaacatatggtctataactatatacagtttggttcaa

SEQ ID NO: 6127 - DNA, 1432 bp, Ambrosia trifida
taatattaataataataacgaacccgggctactgaagctaaaatagcgccgtacagagctacgactggggcggaaccggctacgactcacgcgtagcaacgctgttggagaaaaactatggtgctccgattgatgataagaagcattatgctgagttttggattgggacccacgtgtctggaccctcagttgtggatatgggtgatgataataataataataataatgtgagtttgaaggattgggttgtccaaaatcctgaggttttgggtgatgttgttgttgataagtggggtcttgatcttccgttcttgcttaaggtactttctgtgggcaagtcattgtcaatacaagcccatccagataaggaattggcagggttccttcataagacgcaaccaaacgtgtataaagatgcaaatcacaagcccgaaatggctctggcattaacggagtttgaggcattatgtgggttcattagttcagaggaacttgatgctgtgctcgaaactgtgcccgagattgctgacgtggttggcaatgcaaatgcagaccaactcttagatgtcgacaaacacaatggtgtggtcaaagaagaacggaatcttcagtcgatattcactaaactcatgtcagttgacaaagaggtgatttccaaagcactaaccagattagtcaaccgtctaacccgtgaaaatgagacaaggcagttaactaggcaaagaagaactagtgttgaagcttgaaaaacagtacccaaatgatgttggggtgttagctgcactgctccttaatcttgtcaaactcgaacctggcgatggtttatacatagcagcaaatgaaccacacgcgtatttaaatggcgagtgcatcgagtgcatggcagcttcagataatgtggtccgtgctggcctcacaccaaaatacattgatgttaaaaccctctgctcaatgctcacatataaacaggggttacctgaaatcttgaaaggtgtaccaataaaccaatatgtgagacgatacacaccgccttttgaggaatttgaggttgaccaatgcgtgcttgaccaagcagcgtctgttgtatttcctgcacttcctggaccgtctgtttttgttcgtaatttcaggagaaggaacgatgctgacatcatcatgtgaagatcgagtgtcggaaggagctgcattgtttgcacctgcagggaccgaggttcgggttagtactgaatcagagctgcagttgtatagagctggagtgaatcacaaggtccttatgaacccttgacatgatgaggatggatgaaatgggtcactagtagtttatgtaaatccatatatgttttgttatgtttacagaataacagttttaccgttatatacaagttgtaatgatattaacatatgctctataactatatacagtttggttcaa

SEQ ID NO: 6128 - DNA, 1482 bp, Flaveria ramosissima
aatgttagtttcacttttctctctctctactcctctttaaaaagcggttactcccctcattcttcatatcacaatctccatatcatctcatctcatctcatggagtctaacggtgatccaaatcaccaatcacccctcctcaaactcaaatgttccgttcagaattacgattggggtcgaattggccacgattcacgagtcgccaggctgtttcagagcaactctggggctcaaattgacgacaacaagcattatgcggagttttggattggaacccatgtgtctggaccctcgtttgttgatgggtttcttgatttgagtttgaagtcgtggattctgcaaaaccctaaggttttgggtgatgttgttgtggataagtgggggaatgatcttccgttcttgcttaaggttctttctgtgggcaggtcattgtcaatacaggcccatccggataaggaattggcgggcttccttcataagttgcagccgaacgtgtataaagatgcaaatcacaagcccgaaatggcgctggcgttaacagagtttgaggccttatgtgggtttattagttcagaggaacttgatgttgtgcttgaaactgttcctgagataaaagaagtggtgggcaatgcatgtgcagaccaaatcttaaccgtcaacaaccacaacggtgagctcaaagaagaaagtcttcttcggtcaatattcactaaactcatgtcagctgaccgcgaggtgatttctaaagcactaaccaaattaatcaaccgtctaaccagggaaaatgagacaaggcagttaactactaaagaagaactagtgttgaagcttgaaaaacaatacccaaatgacgtcggggtgttagccgcccttctccttaatcttgtcaaactcgaaccaggtgatggtttatacatagcagcaaatgagccacacgcatacttaaatggcgagtgtatcgagtgtatggcggcttcagataacgtggtccgtgctggcctcactcccaaatacatggatgttaaaatcctctgttccatgctcacatataaacaagggttacctgaaatcttgaaaggtgtacctctaaaccaatatgtgagaagatacacgccgcctttcgaggaatttgaggttgatcaatgcgtgcttgaccaaggtgcatcggttgtatttcctgggcttccgggcccatctgtatttgtggttatatcaggagaagggacgatgcgggcatcatcttgtgaagctcaagtgtcggaaggagctgcattattcgcacctgcggggactgaagtttgtgttagcactgattcagagctgcagttatatagagctggagtgaatagcaaggtgcttttgaacccttgactgacatgatgaggatacaagaatgggacactagtttatgtacatccatgtattgtttttgtcctaatagtaatttgctgcctgttttatacacaacaatagttataataa

SEQ ID NO: 6129 - DNA, 1409 bp, Ambrosia trifida
cgaacccgggctactgaagctaaatgcgccgtacagagctacgactgggccgaaccggctacgactcgcgcgttgcaagtttgctaagaaaaaaactgtggtgctccgattgatgataagaagcattatgctgagttttggattgggacccacgtgtctggaccatctgttgtggatatgggtcatgatggtaataataataataataatgtgagtttgaaggattgggttgtgcaaaatcctgaggttttgggtgatgttgttgttgataagtgggtcttgatcttccgttcttgcttaaggtactttctgtgggcaagtcattgtcaatacaagcccatccagataaggaattagcagggttccttcataagacgcaaccaaacgtgtataaagatgcaaatcacaagcccgaaatggctctggcattaacggaatttgaggcgttatgtgggttcattagttcagaggaacttgatgctgtgctcgaaactgtgcccgagattgctgacgtggttggcaatgcaaatgcagaccaactcttagatgtcgacaaacacaatggtgaggtcaaagaagaacggaatcttcagtcgatattcactaaactcatgtcagttgacaaagaggtgatttccaaagcactatccagattagtcaaccgtctaacccgtgaaaatgagacaaggcagttaactagcaaagaagaactagtgttgaagcttgaaaaacagtacccaaatgatgttggggttttagctgcactgctccttaatcttgtcaaactcgaacctggcgatggtttatacatagcagcaaatgaaccacacgcgtatttaaatggcgagtgcattgagtgcatggcatcttcagataacgtggtccgtgctggcctcacaccaaaatacattgatgttaacaccctctgctccatgctaacatataaacaggggttacctgaaatcttgaaaggtgtaccaataaaccaatatgtgagacgatacacaccgccttttgaggaatttgaggttgaccaatgcgtgcttgaccaagcagcgtccgttgtatttcctgcacttcctggaccgtctgtttttgtcgtaatttcaggagaaggaacgatgctgacatcatcatgtgaagatcgagtgtcggaaggagctgcattgtttgcacctgcagggaccgaggttcgggttagtactgaatcagagctgcagttgtatagagctggagtgaatcacaaggtcctaatgaacccttgacatgatgaggatggatgaaatgggtcacttgtagtttatgtaaatccatatatgttttgttatgtttacagaataacagttttaccgttatatacaagttgtaatgatattaacatatgctctataactatatacagtttggtt

SEQ ID NO: 6130 - DNA, 1182 bp, Ambrosia trifida
taatattaataataataacaacccgggctactgaagctaaaatgcgccgtacagagctacgactggggccgaaccggctacgactcacgcgtagcaacgctgttggagaaaaactgtggtgctctgattgatgataagaagcattatgctgagttttggattgggacccacgtgtctggaccctcagttgtggatatgggtgatgatataataatatatgtgagtttgaaggattgggttgtccaaaatcctgaggttttgggtgatgttgttgttgataagtggggtcttgatcttcccttcttgcttaaggtactttctgtgggcaagtcattgtcaatacaagcccatccagataaggaattggcagggttccttcataagacgcaaccaaacgtgtataaagatgcaaatcacaagcccgaaatggctctggcgttaacggagtttgaggcgttatgtgggttcattagtttagaggaacttgatgttgtgctcgaaactgttcccgagattaatgaagtgattggcaatgcaagtgcagaccaaatcttaactgtagacaaacacaatggtgaggtcaaagaagaaagcgttcttcggtcaatattcactaaactcatgtcagctgaccgagaggtgatctccaatgcactatcgagattagtcaaccgtctaacccacgaaaatgagacaaggcagttaactagtaaagaagaactagtgttgaggcttgaaaaacagtacccaaatgatgttgggttgttagctgcactgctccttaatcttgtcaaactcgaacctggtgatggtttatacatagcagctaacgagccacacgcgtatttaaatggcgagtgcattgagtgcatggcagcttcagataacgtggtccgggctggcctcacaccaaaatacattgatgttaaaaccctctgctccatgctcacatataaacaggggttacctgaaatcttgaaaggtgtaccaataaaccaatatgtgagacgatacacgccgccttttgaggaatttgaggttgaccaatgcgtgcttgaccaaggcgcgtccgttgtatttcctgcacttccaggcccgtctgtttttgtggtaatttcaggagaaggaacgatggtgacatcatcatgtgaagatcgagtgtcggaaggagctgcattgttt

SEQ ID NO: 6131 - DNA, 1332 bp, Ambrosia trifida
gccttgaaggtgtttcggcgaaatgctttacagggaaaggtctttgaaggttctttttttgctttttatttatccgttagtttgtaaagagagaatcagattccagatattacaacggtctgaggttctttagctttctttttgagtgtttgtggtacagaattttgtaaaagtttcatcttggctgtttcttggatcatatctgcatatttgtgtcatcattttgaaggactgtgtgcagtttgatttgatttcggcgaatttatgcatcgatggggcttcagtttcgaagtctcacgatgcttgtgctactgatttggctcttttggtggtcaagacttgaggctcaaacacttggtcctgaatttgagtctgctagggctcttgatggtattctccaggactatgcgtatcgtgcatttgatcggccgagaactggccgtgtatatgatggggttccccctgcaaatttgtctggagttcagatatcagcaatgaggcttagaagtggtagtttgtttactcgaggggttcgacagtataaagagttcacaattccagttggtgttattggaacgccttatgtcgagaggctggttttggtgtatcaaaaccttggtaattggtccacgacgtattaccctttgcccgggtacgtgtatctagcgcctgtattgggtctacttgcttatgatgcaacgaacttatcagctacaaatttggaagaactggatattcgtgcctctgaagatcccatctcgatagagtttagacaagtgcaaccagtgcctgatggttcagtagcacggtgcgtgtggtttgatctagagggtcataaaaatttcacaaatgtggtgtctggcaacaagtgtgtgacgtatgaccaagggcatttctctattgtagtcgaatccacagccccactcgcctgcaccagtggcgcaaccaccaccaccaccgcatcatggcggtgagggaacagttctaagggttggattatcgtgggtctgtgctcggtggggttgcattgttggtgttgttggcattgctgatactgtgggtgtggagattcaacaaaaggaagaaaatgcataaaatggaaaaggctgcagatgctggtgaagcactgcatatgacgacggttgggaacacaaaagcgccagcggctacaaccactagaacgcagccaaatttggaaaccgaatacgttccatgaagttcgttcatattcttggttgatttaatgcaaggtattcgtccaaacactacattctttggtaaagtcgtgggtccgctttgtgtggttcttcttgtgtgaataattacgtattc

SEQ ID NO: 6132 - DNA, 951 bp, Solanum phureja
aacatcttctttcttctcttccatcaaaatgaggtgtttcactattctcttctttttttcagctatagtggttgtggcattggcctctaatgtcgaagaggtcattagccaagtagtagaaattcaccgtctaagaccacaaactggttccgctggttataccgtcccacaattagactgtcttagctggcgcctcgcggtggagacgaacaacctccaaaactggaaattggtgcctaaagaatgtacaaactatgtaggtcattacatgttaggcaaacaatatcgacgtgactgtgagtatgttgccaaacaggctattgagtatgccaaaaccctcaaacttggcggagatggaaaggatgtttgggtatttgatattgatgagaccactctctcaaattctccttactacgctcgatccgacgttgcttttggggctatagcgtacaacaacacaaagtttagtgcgtggctagcggagggaaaagcaccagccattccatcgatactgggtgtatacaagactgtgttgtctttggggatcaagcccgttttcattacagggaccagagagaatttcaaacaagttaggattgtcaatctcaagaaagttggttatagcaactgggcagcgcttatactaaagggagaaaatgattcgggatcagcagtgcaatttaaatcaagcaagagaacagaattggttaaagctggatatagaattgttggtaatattggagatcaatggactgatttgatcggagaaaacgttggagctcgtacattcaaagtccctgaccctatgtattacattagttgattctaagcaaattttaatcatcaagcaagctaattaattaacaaaggggggtagcttttttatttcatgttttatgtctttcgacttttcctattcaccctcactttgctataataacgacttgcttc

SEQ ID NO: 6133 - DNA, 999 bp, Solanum melongena
ctcaacatacactttctcttcttctcttccataatatgaggcctttcacaattctcttctttttttcggctatagtagccgtggcattggcctctaatgtggaagatcaagtcataagccaagtggtggaaattcaccgcctaaggccacagaccggtgctgctggttatcccgtcccacaattggactgtcttagctggcgccttgccgtagagactaacaaccttagggactggaaattagtgcctgaagaatgtaaaaattatgtaggacactatatgttgggcaaacaatatcgacaggactgtgagtatgtagccaaccaggctattgagtatgctaaaagcctcaaacttagcggggatggaaaggacgtttgggtatttgatattgatgagactacactctcaaatctcccttactatgctcgatccgacgttgcttttggggctataccttacaacaacacaaagtttaacgcgtggatcgctgagggaaaagcgccagccattccatcgatactgggtgtatacaagactgtgttgtctctggggatcaagcctgttttcattacagggactcgagagaatttcaaacaaataaggattaccaatctcaagaaagttggttatagcaactgggcagcgctcatactaaagggagaaaatgattcaggatcagcagtgcaatttaaatctagcaagagaacagagttagtgaaggctggatatagaattgttgggaatatcggtgaccaatggactgatctgatcggagaaaacgttggagctcgcactttcaaagtccctgaccctatgtactacattggttaatgtagactccttattgtattttccttgttcgttctcagcatgctaattaatcgaaggagataaagtaaaaaatttattttgacatgtgaaacgatgttataagctcactgttccattatcatgattcacgtcttttgacttttgttcaataataatgacttgcttc

SEQ ID NO: 6134 - DNA, 1020 bp, Solanum melongena
atcttctcttcttctatcaattttgtataacatgaggcctttcacatttctcttctttttttcggctatagtagccatggcattggcttctaatgcggaagatcaagtcataagccaagtggtggaaattcaccgcctaaggccacagaccggtgctgctggttatcccgtcccacaattggactgtcttagctggcgccttgccgtagagactaacaaccttagggactggaaattagtgcctaaagaatgtaaaaattatgtaggacactatatgttgggcaaacaatatcgacaggactgtgagtatgtagccaaccaggctattgagtatgctaaaagcctcaaacttagcggggatggaaaggacgtttgggtatttgatattgatgagaccacactctcaaatcttccttactacgctcgatccgacgtcgcttttggggctataccttacaacaacacaaagtttaacgcgtggaccgctgagggaaaagcgccagccattccatcgatgctgggtgtatacgagactgtgttgtctctggggatcaagcctgttttcattacagggactcgagagaatttcaaacaagtaaggattaccaatctcaataaagctggttatagcaactgggcagcgctcatactaaagggagaaaatgattcgggatcagcagtgcaatttaaatctagcaagagaacagatttagtgaaggctggatatagaattgttgggaatattggtgaccaatggactgatctgatcggagaaaacgttggagctcgcactttcaaagtccctgatcctatgtactacattggttaatgtagactccttatggtattttccttgttcgattttaagcatgctaattaatcgaagggaataaaataaaatttttatttggacatgtgaaacgatgttataagctcactgttccagtatcgtgattcacgtcttttgacttttgttgttccccctcactttgctataataatgacttgcttcaacatttt

SEQ ID NO: 6135 - DNA, 991 bp, Nicotiana tabacum
tcttctttgttctcccatttctccttcatatcatattctgttaaaaccataatatgaggtgttttcctttgcttttcttaatttcaactatagtagcggtgactgcagtggcctctacttccaataatgtagaggttattagccaagtggtagaaatccaccgtctaaggccacagactggctctgctggttatcgcgtcccacaattggactgtcttagttggcgtcttgctgtagagactaacaaccttcaaaattggaaattggtgccaagcgcatgcgaaaactatataggtcattacatattaggcaaacaatatcgtcatgactgtgaggctgtggccaatgccgctattgagtacgctaagagtctcaaactaggcggagacggaaaggacgtttgggtctttgatattgatgagaccactctctctaatcttccttactacgctcgatctgatgttgcttttggggctataccttacaacaatacaaagtttaatgcgtgggtggccgaggggaaagcacctgccattccttcgatacttggagtatacaaaacagtgctgtctcttggaatcaagccagttttcataacagggactcgagagtctttcaaacaagtaaggatcgccaatctcaagaaagctggttacagtaactgggcaaagcttgcactaaagggagataacgactcggcaacagcagtggagtttaaatcaagcaagagaacagagctagtgaaagctggatacagaattgttggcaacattggagaccaatggagtgatctgatcggagaaaacgtgggttctcgtacttttaaagtccctgaccctatgtactacattggttgatgtatccaaacccctgatattttctttcttgattctcagtaattttaacttaagcagttacctaattaacaaagggactagctttctttgttgtgacatgtgagacgtacgctaagctcgctgttacagtatga

SEQ ID NO: 6136 - DNA, 1473 bp, Vaccinium corymbosum
ggggaagaagaagatacgcagaggctgaagaagatagcggcggcagcgtacgactacgaaaacgacccaagatgggcggactactggtcaaacatactcatccctcctcacctggcttctcgctccgacgtcgtcgaccactacaagcgcaagttttaccagcgttacatcgatcctgatcttgttgttgaggcaattgcttctggtagttcctctcagtcagcaaggccagcgccatcatcatcttcaactccaaatggccaagcacgacaacgtaactcaggatcaactactagaacatcagggtcatcaacaactacagctccaactccaacttctttgcgctgggatcggcaaaccattcatttttctgtcaatgcttgggtatttgtggtggctgtgcttgctataattcctcttgtaccaaaaaatctttcaaacagggcgtaccggctttcctttatgggcacagcatgttcttctctgtattcgttgtactctctctatgggaaacctagggcatggaatttgcaggctctgcaagtatggtttcagtctgtgatagcaacgaaggactttatctacttcatttactgtcttacttttgtcacttcacatcttcgcctcaaatttgctttgattcccgtattatgctgggctttggaacatgttgccaagttccttagacgtaactttagccgttcttccttgtacaggaagtatttggaagagccatgtgtctgggtagagtcaaacaccactacactcggcattctttcttcacaagctgagattggacttggatttcttctagttcttgctctgttctcgtggcagcgcaacataatacagacattcatgtactggcagctattaaagctcatgtatcatgccccggtgactgccggttaccatcagagcgtatgggctaagattgggaggattgttgatccactggtgcaacgttatgcaccctttctgaacactccactttctgcggttcagagatggtggttcaggtaactgcccatagggacagaagagctctccggtagaatggcagcaacgtcggattttgcagaatcacgagatttttaacgaaaaccttaagtaatgcagctgtactgtttataaatgatagatattgaactttcgtttcgaaaagcttaacagggaaactggtctatttgcaacttaatgtgtgtgtgggagctgatttccaattgcacatggaaattgtgcagtttctccaatccaatggaccggctaattcggcccaacagaagaacttgtagcacgtatacgggagtcgaattctaaaccaaaagcttgttgagacccttagttttttgttttcaaactttaaaggatttaagagatgatgtaggacaagatattaagggctatcgtttatggaaactttctctggtctcatgccttcaaagcaacaaataaatggaagaatattaagcc

SEQ ID NO: 6137 - DNA, 910 bp, Secale cereale
gcccccccccccgactagctcagcgacacaggcacgtagcagcaacacccactgcaaaatgaagcttcaggcagccacggtcgcctccttcctcctgttggccttggccgccacggcccaggccgtgacgttcgacgcttcgaacaaggcgtcgggcacctccggcggccggcggttcaaccaggccgtcggcctcccatactccaagaaggtcctctccgacgcctccgccttcatctggaaaaccttcaaccagcgcgccgccggtgaccgcaagcctgttgatgccgtcaccctcgtggtcgaggacatcagcggcgtcgccttcaccagcgccaacggcatccacctcagcgcccagtacgtcggcggcatctccggcgacgtcaagaaggaggtgaccggcgtgctgtaccacgaggcgacgcacgtgtggcagtggaacgggcagggcagggcgaacggcgggctcatcgagggcatcgccgactacgtgcggctcaaggccgggttcgcgccggggcactgggtgcggccggggcagggcgaccggtgggatcaggggtacgacgtcacggcgaggttcctcgactactgcgactcgctcaagcccgggttcgtcgcgcagctcaacgccaagatgaaaagtgggtacaccgacgacttcttcgcgcagattctcggcaagaacgtgcagcagctgtggaaggactacaaagccaagtttagaggctgaacgcacgataagttgatgggtccttcacggtgtgatggcataacgcactacttcgaataagacgtgtgttttacgtctgtaataaaagacagataaataaaggacaacgctaggcgtcggtgcgccggccgaaatatcggccagtcgcaccagatccacccgatgtgctgcaat

SEQ ID NO: 6138 - DNA, 841 bp, Hordeum vulgare
tagctcagcgacacaggcacgtagtagcaacacccactacaaaatgaagcttcaggtagccacggtcgcctccttcctcctggtggccttggccgcgacggcccaggcagtgacgttcgacgcgtcgaacaaggcgtcgggcacctccggcggccggcggttcgagcaggccgtcggcctcccatactccaagaaggtcctctccgaggcctccgccttcatctggaaaaccttcaaccagcgtgccgtcggcgaccgcaagcctgtcaacgcagtcaccctcgtcgtcgaggacatcagcggcgtcgccttcaccagcgccaacggcatccacctcagcgcccagtacgtcgccagcatctccggcgacgtcaagaaggaggtgaccggcgtgctgtaccacgaggcgacgcacgtgtggcagtggaacgggcagggcaaggcgaacggcgggctcatcgaggggatcgccgactacgtgcggctcaaggccgggttcgcgccggggcactgggtgaagccggggcagggcgaccggtgggatcaggggtacgacgtcacggcgaggttcctcgactactgcgactcactgaagcccgggttcgtcgcgcagctcaacgccaagatgaagagtgggtacaccgacgacttcttcgcgcagattctcggcaagaacgtgcagcagctgtggcgggactacaaatccaagtttggagcctgaatacacgattagcctacttgacggtgtgatggcatagcacactatatatatcgaaatgatcaacaaaacaagtgctttatgccctgtataataaataaaagataaataaaacgactttgg

SEQ ID NO: 6139 - DNA, 1043 bp, Hordeum vulgare
acatctaccactagctcagcgacacaggcacgtagtagcaacacccactacaaaatgaagcttcaggtagccacggtcgcctccttcctcctggtggccttggccgcgacggcccaggcagtgacgttcgacgcgtcgaacaaggcgtcgggcacctccggcggccggcggttcgagcaggccgtcggcctcccatactccaagaaggtcctctccgaggcctccgccttcatctggaaaaccttcaaccagcgtgccgtcggcgaccgcaagcctgtcaacgcagtcaccctcgtcgtcgaggacatcagcggcgtcgccttcaccagcgccaacggcatccacctcagcgcccagtacgtcgccagcatctccggcgacgtcaagaaggaggtgaccggcgtgctgtaccacgaggcgacgcacgtgtggcagtggaacgggcagggcaaggcgaacggcgggctcatcgaggggatcgccgactacgtgcggctcaaggccgggttcgcgccggggcactgggtgaagccggggcagggcgaccggtgggatcaggggtacgacgtcacggcgaggttcctcgactactgcgactcactgaagcccgggttcgtcgcgcagctcaacgccaagatgaagagtgggtacaccgacgacttcttcgcgcagattctcggcaagaacgtgcagcagctgtggcgggactacaaatccaagtttggagcctgaatacacgattagcctacttgacggtgtgatggcatagcacactatatatatcgaaatgatcaacaaaacaagtgctttatgccctgtataataaataaaagataaataaaacgactttggtaattcaaaatcgacgccgagttacatgttgcctactttgaatataagacctattagaattttttatgaactatatacaaaataaaataaataaatttatattttaaaatatgtctatatatattcgtgtgtaatttatagttaatttgttgagtttttttatatttaagaatggatggagtagtaccaac

SEQ ID NO: 6140 - DNA, 917 bp, Secale cereale
gccgccacggcccaggccgtgacgttcgacgcttcgaacaaggcgtcgggcacctccggcggccggcggttcaaccaggccgtcggcctcccatactccaagaaggtcctctccgacgcctccgccttcatctggaaaaccttcaaccagcgcgccgccggtgaccgcaagcctgttgatgccgtcaccctcgtggtcgaggacatcagcggcgtcgccttcaccagcgccaacggcatccacctcagcgcccagtacgtcggcggcatctccggcgacgtcaagaaggaggtgaccggcgtgctgtaccacgaggcgacgcacgtgtggcagtggaacgggcagggcagggcgaacggcgggctcatcgagggcatcgccgactacgtgcggctcaaggccgggttcgcgccggggcactgggtgcggccggggcagggcgaccggtgggatcaggggtacgacgtcacggcgaggttcctcgactactgcgactcgctcaagcccgggttcgtcgcgcagctcaacgccaagatgaaaagtgggtacaccgacgacttcttcgcgcagattctcggcaagaacgtgcagcagctgtggaaggactacaaagccaagtttagaggctgaacgcacgataagttgatgggtccttcacggtgtgatggcataacgcactacttcgaataagacgtgtgttttacgtctgtaataaaagacagataaataaagggcaacgctaggcgtcggtgcgccggccaaaatttcggccggtcgcaccagatccacccgatgtgctgcaatggaacttttttataaacggttgtagcatttatgtcaatgttgtagcatttgttgtatgtcatggttgtagcatttttaatgtcaaaaaaaaaactaagcgactgtcaacgaga

SEQ ID NO: 6141 - DNA, 872 bp, Pseudoroegneria spicata
  misc_feature (45)..(45): n is a, c, g, or t
agcccattgacgtccaccacaaaatgaagcttcaggtagccacgnctgccttcttcctcctggtgaccatggccgcgacggcgcgggccgtgacgttcgacgcgtcgaacacggcgtcgggcaccgccggcggccagcgcttcgaccaggccgtaggcctcgcgtactcaaagcaggtcctctccgacgcctccaccttcatctggaacaccttcaaccagcgcgccgctgccgaccgcaagcctgtcgacgccgtcaccctggtcgtggaggacatcgacggcgtcgccttcaccagcggcaacggcatccacctcagcgccaagtacgtcggcggctactccggcgacgtcaagaaggaggtgaccggcgtgctgtaccacgaggcgacgcacgtgtggcagtggaacgggcagggcgcggcgaacggcgggctcatcgaggggatcgccgactacgtgcggctcaaggccgggctcgcgcctggccactggaggccgcaggggagcggcgaccggtgggatgagggatacgacatcacggcgaggttcctcgactactgcgactcgctcaagcccgggttcgtcgcgcagctcaacgccaagatgaagagtgggtacagcgacgacttcttcgcgcagattctcgggaagaacgtacagcagctgtggcaggactacaaagccaagtttcgaggctgaatgggacttggtcattcctcctccacggtgtgatggcatagcacactatacatattgaaatactagtaaataaacgatttcagacaccggcacactgatgtcggacaccggcacaagacatgtggtttacgttgtagtaaggcaatttcaataaacgatttcgctaattca

SEQ ID NO: 6142 - DNA, 1325 bp, Hordeum vulgare
cacccaccccaaaatgaagcctcaggtagccacggtagccttcctcctcctggtgaccatggccgcgacggcgcgcgccgtgacgttcgacgcgtcgaacacggcgtcgggcaccgccggcggccagcgcttcgacaacgccgtcggcctcgcctactcgaagcaggtcctctccgacgcctccaccttcatctggaacaccttcaaccagcgcgccgctgcggaccgcaagcccgtcgacgccgtcaccctcgtcgtggaggacatcggcggcgtcgccttcgccagcggcaacggcatccacctcagcgccaagtacgtcggcggctactccggcgacgtcaagaaggaggtgaccggcgtgctgtaccacgaggcgacccacgtgtggcagtggaacgggcggggcacggcgaacggcgggctcatcgaggggatcgccgactacgtgcggctcaaggccgggctggcgccggggcactggaggccgcaggggagcggcgaccggtgggatcagggatacgacatcacggcgaggttcctcgactactgcgactcgctcatgcccgggttcgtcgcgcagctcaacgccaagatgaagagcgggtacagcgatgatttcttcgcgcagattctcgggaagaacgtccagcagctgtggaaggactacaaagccaagttcggaggctgaatgtgatttactcattcattccttcttcacggtgtgatggcacaacacactatacgtattgaaataatcaacaaggcatgagctttacgttgtaataaaatttaaataaatgatttgtgtactccctctatccatatatatatatatataggacctaatgcatttttcgagactaactttgaccatatgttatacttcctccgtcacaatttataaggcgtgcacgtatacctaggtcgtcaatttaacttatatatcaaaagtcaatacacgctaacattgcacatcacaaacgaataaccaaatacaatgaaaatatagaaatgttttaatagaaaaacaacctaaaacatattgataatgaagctttcaatgacgactaaaagaccccgacaatggcagtgtcctaccatcctgcaattcataatttcacacaattaaattatcactacattgcattgctttcaagatgtcaaaaaatgatacccaaaattgattttaaattcagaaattatacatgcatctaatctgaataattataggccatacagtaccaaaaattatttccatttgcaatagaagagataaattattggaattggaactactaattgctgcaaattacaaagtatcg

SEQ ID NO: 6143 - DNA, 1273 bp, Hordeum vulgare
ggagacaaatacgtgactttttcatatgaagacaagatgaccctgcgaactttcttgcatcacatttatgcagagattgcgaccactacaaaaacggacgaagtacaagtccatgcctttgactgaacccaacacgtatactattactaccatcagcaccctatttgatactatatatagcccactaccacaggcagcaaactcacacccacaccgagatagagctccaacacccaccacaaaatgaagcctcaggtagccacggtatccttcctcctcctggtgaccatggccgcgacggcgcgcgccgtgacgttcgacgcgtcgaacacggcgtcgggcaccgccggcggccagcgcttcgacaacgccgtcggcctcgcctactcgaagcaggtcctctccgacgcctccaccttcatctggaacaccttcaaccagcgcgccgctgcggaccgcaagcccgtcgacgccgtcaccctcgtcgtggaggacatcggcggcgtcgcgttcgccagcggcaacggcatccacctcagcgccaagtacgtcggcggctactccggcgacgtcaagaaggaggtgaccggcgtgctgtaccacgaggcgacccatgtgtggcagtggaacgggcggggcacggcgaacggcgggctcatcgaggggatcgccgactacgtgcggctcaaggccgggctggcgccggggcactggaggccgcaggggagcggcgaccggtgggatcagggatacgacatcacggcgaggttcctcgactactgcgactcgctcatgcccgggttcgtcgcgcagctcaacgccaagatgaagagcgggtacagcgatgatttcttcgcgcagattctcgggaagaacgtccagcagctgtggaaggactacaaagccaagttcggaggctgaatgtgatttactcattcattccttcttcacggtgtgatggcacaacgcactatacgtattgaaataatcaacaaggcatgagctttacgttgtaataaaatttaaataaatgatttgtgtactccctctatccatatatatatatataggacctaatgcgtttttcgagactaactttaaccatatgttatacttcctccgtcacagtttataaggcgtgcacgtatacctaagtcgtcaatttaacttatataccaaaagtcaatacatgctaacattgcacatcacaaacgaataaccaaatacaatgaaaatatagaaatgttttaatagaaaaacaacctaaaacata

SEQ ID NO: 6144 - DNA, 893 bp, Pennisetum glaucum
gctgtgtgtaggtagctgatcaccaagcagcagcttgcagcaccactagcagcacaagatgaagcttcacgccgccgccgcggtcgtttccctcctggccgtggccctggccgcgtcgacggccggcgccgtcacgttcgacgcgacgaacacggcgtccagcacccccggcggacagcggttcgaccaggccgtcggcctcgactacgccaagcgggtcctctccgacgcgtccaccttcatctggaacaccttcaaccagcgcgccgctgccgaccggaagcccgtcgacaaggtcaccctcgtcgtcgagaacatcgacggcgtcgccttcaccagcgccaacggcatccacctcagcgccaagtacgtcggcggctactccggcgacgtcaagaaggaggtgaccggcgtgctgtaccacgaggtcacacacgtgtggcagtggaacgggcagggccgggcgaacggcggcctcatcgagggcatcgccgactacgtccgcctcaaggcgggctacgcgccggggcactgggtgaagccggggcagggagaccggtgggatcagggctacgacgtcacggcgaggttccttgactactgcgagtcgctcaagccgggcttcgtggcgcagctcaacgccaagatgaaggacgggtacaccgacgatttcttcgctcagatcctgggcaagagcgtgcagcagctgtggcaggactacaaggccaagtacgggggctgaagaggacaggcgcaccccgtcggtgatctagcatgatgtgacagaatttaataaggtgttcgttggccatctcaggaaactattgcgtaatgtagtgaataatgttcaaaatcttaataagaaatgcttttccgataaaaaaaaaaaaaaa

SEQ ID NO: 6145 - DNA, 932 bp, Triticum aestivum
gatagcaacaaacatccacctaaaatgaagctgcacgtagccttcttcctcctggtagccatggccgcgacggcccgggccgtgacgttcgacgcgtcgaacacggcgtcgggcaccaccggcggcaagcgcttcgacaacgccgtcggcctcgcgtactcaaagcaggtcctctccgacgcctccaccttcatctggagcaccttcaaccagcgcgccgctgccgaccgcaagcccgtcgacgcggtcaccctcgtcgtggaggacatcgacggcgtcgccttcaccagcggcaacggcatccacctcagcgctagctacgtcggcggctacacctccggcgacgtcaagaaggaggtgaccggcgtgctgtaccacgaggcgacgcacgtgtggcagtggaacgggcagggcgcggcgaacggcggcctcatcgaggggatcgccgactacgtgcggctcaaggccgggctcgcgcctgggcactggaggccgcgggggagcggcagccggtgggatgaggggtacgacatcacggcgaggttcctcgactactgcgactcgctcaagcctgggttcgtcgcgcagctcaacgccaagatgaagagcgggtacagcgacgacttcttcgcgcagattctcggcaagaacgtgcagcagctgtggcaggactacaaagccaagttcggaggctgaatgggcttttgccttttagtcatctctcttgcacggtgtgatggcatagcaccctatacatattgaaataatcaacaagacatgtgctttacgttgtaatgaaatttaaataaaggattttgctaattcgaattgacgcgattttttctctctcacgtggacgtcttttcctctctcatgcaaagggcatactgattgtggacatcggcacacggttattgatggacaggaaaatg

SEQ ID NO: 6146 - DNA, 1048 bp, Triticum aestivum
ttttttttttggagacaaatacgtgacttttttataaggagacaaggtaacccctaggaactttcttgcatcacatttatacggagatggcaaccaccaaagcagacggagtaccagtcaatgcttttgactgaacctaacacgtatactaccatcaacacccgatttgggtactatatagccactaccacagtccacaggtagcaaatcacacccacaccgatagctgcaaacatccaccacaaaatgaagcttcacgtagccttcttcctcctggtgaccatggccgcgacggcgcgggccgtgacgttcgacgcgtccaacacggcgtcgggcaccactggcggcaagcgcttcgacaacgccgtcggcctcgtgtactcaaagcaggtcctctccgacgcctccaccttcatctggagcaccttcaaccagcgcgccgctgccgaccgcaagcctgtggacgccgtcaccctcgtcgtggaggacatcgacggcgtcgccttcaccagcggcaacggcatccacctcagcgccagctacgtcggcggctacacctccggcgacgtcaagaaggaggtgaccggcgtgctgtaccacgaggcgacgcacgtgtggcagtggaacgggcagggcgcggccaacggcgggctcatcgaggggatcgctgactacgtgcggctcaaggccgggctcgcgcccgggcactggaggccgcaggggagcggcagccggtgggatgaggggtacgacatcacggcgaggttcctcgactactgcgactcgctcaagcccgggttcgtcgcgcagctcaacgccaagatgaagagcgggtacagtgacgacttcttcgcgcagattctcggcaagaacgtgcagcagctgtggcaggactacaaagccaagttcggaggctgaatgggcttttgcctcttagtcatctctcttgcacggtgtgatggcatagcacactatacatattgaaataatcaacaagacatgtgctttacgttgtaatgaaatttaaataaaggattttgctaattcg

SEQ ID NO: 6147 - DNA, 804 bp, Triticum aestivum
caaacatccacctaaaatgaagctgcacgtagccttcttcctcctggtagccatggccgcgacggcccgggccgtgacgttcgacgcgtcgaacacggcgtcgggcaccaccggcggcaagcgcttcgacaacgccgtcggcctcgcgtactcaaagcaggtcctctccgacgcctccaccttcatctggagcaccttcaaccagcgcgccgctgccgaccgcaagcccgtcgacgccgtcaccctcgtcgtggaggacatcgacggcgtcgccttcaccagtgccaacggcatccacctcagcgccagctacgtcggcggctacaccgccggcgacgtcaagaaggaggtgaccggcgtgctgtaccacgaggcgacgcacgtgtggcagtggaacgggcagggcgcggcgaacggcggcctcatcgaggggatcgccgactacgtgcgactcaaggccgggctcgcgcccgggcactggaggccgcaggggagcggcagccggtgggacgaggggtacgacatcacggcgaggttcctcgactactgcgactcgctcaagcccgggttcgtcgcgcagctcaacgccaagatgaagagcgggtacagcgacgacttcccagattctcgggaagaacgtgcagcagctgtggcaggactacaaagccaagttcggaggctaaatggacttttagtcatctctctttcaccgtgagatggcataccacactatatgtattgaaataatcaacacaacatgtgctttaccttgtaatgaaatttcaataaatgatttccctaatt

SEQ ID NO: 6148 - DNA, 1083 bp, Sorghum bicolor
gtcagtctagctatttgaccggaccaaaccctacgtaaggttcaatcttttctttctacacaaacatatcatcacctaccatcgccaaaaaacataaaaaatctcgtcacatctttacctattacgctctatataataaactcccaaccacagcaaagtagctaaccaacttagcaacaagaagccccagcagcagctccagctgcacaagagatgaacaagcttcacgtcgccacggtggcttccctcctggcgctggccgccgcaacggccggcgccgtcacgttcgatgcgacgaacacagcgtccaacacccccggcgggcagcggttcgaccaggccgtcggcgtcaactacgccaagcaggtcctctccgacgcgtccacattcatctggaacaccttcaaccagcgcagccccgccgatcgcaagcccgtcgacgccatcaccctcgtcgtcgaggacatcggcggcgtggccttcacgagcgccaaccggatccacctcagcacccagtacgtcggtaactactccggcgacgtcaagacggaggtcaccggcgtgctgtaccacgagacgacgcacgtgtggcagtgggacgggcagggcaaggcgaacggcggcctcatcgagggcatcgccgactacgtgcggctgaaggccgggtacgcaccgtcgcactgggtgaagccggggcagggagatcggtgggatcaggggtatgatgtgacggcgaggttcctggactactgcgactcgctgaagccgggcttcgtcgcgctgctcaacgccaagatgaagggcggctacaccgacgatttcttcgcgcagatcctggggaagaccgtgcagcagctgtggaaggattacaaggccaagtacggaggctgatgatgcaaataggtggtgcgaagtcaacacgtcaatgcttttattagtctgatataagatgagataattgaataaggtgtttgttcatcatcgcaaggtagtgttgcttactgttgatgcaaaactgatctgcaaacacaaagggctaatacccgattcaaacgttaaggcgtgccagccgatttgaccttg

SEQ ID NO: 6149 - DNA, 979 bp, Brachypodium distachyon
gcccttaccagaggcaccgagtgatatccacacgaccacacccatagctaacagtctgtcttacgctgttacacacgtacgtatagctagcttgcacaagatgaagcttcagcaggtagccgcacttctgctggcccttgctgcgtcggccagcgccgtgacgttcgacgcatccaacacggcgtcgagcactgcaggagggcagcggttcaaccaggccgtcggcctcgattactcgaagcaggtcctctcagacgcctccaccttcatctggaccaccttcaaccagcgttccaccgctaaccgcaagccggtggacgccgtgaccctcgtcgtggagaacatcgacggcgtcgccttcgccagcaacaacaggatccacctcagctccaagtatgtcggcggctactccggcaatgtgaaggccgaggtcaccggcgtgctgtaccacgaggcaacgcacgtgtggcagtggaacgggcaagggaaggccaacggcgggctcatcgaggggatcgccgactacgtgcggctcaaggcaggcttcgcaccggcgcactggcggaaggccggcgagggcgaccggtgggatcaggggtatgatgtgacggcgaggttcctcgactactgcgattcgctcaagccagggtttgtcgcggaattaaacggcaagatgaagggtgggtacaccgacgatttcttcgcgcagattctcggtaagagcgtgcagcagctgtggaaggattacaaggccaagtacggaggctgaatagtttactgattcataataagtataacaagtgtcttgaatctaatacaaaattattacggattggatggactatattattcatgcactgtttgatgtaataattaagagactgtactgaaacgatcaaaaagacagatgtttacatctgtatcttttattgaaaaaggatgaaatggtacaaataaacgattctcctatctttttact

SEQ ID NO: 6150 - DNA, 904 bp, Zea mays
aaccaactgagctgagcaagaaggcaagcaccaatcagccagcagtccagcacaatatcatgaacaagcgtcaggtcgccgcggcggtggctgccctcctggcgctgctagccgcatcatcgacggccggcgccgtgacgttcgacgcgacgaacacggcgtccgatacccccggcgggcagcggttcgaccaggccgtcggcctcgactacgccaagcaggtcctggccgacgcgtccacgttcatctggaacaccttcgaccagcccagccccgccgaccgcaagcccgtcgacgcggtgaccctcgtcgtcgaggacatcggcggcgtggccttcacgagcgccaacgggatccacctcagcgcgcagtacgtcggcggctactccggcgacgtcaagaccgaagtcaccggcgtgctgtaccacgagacaacgcacgtgtggcagtgggacgggcagggccaggcgaacggcggcctcatcgagggcatcgccgactacgtccggctgaaggcggggtacgcgccgggccactgggtgcagccggggcagggggaccggtgggaccaggggtacgacgtcacggcgaggttcctggactactgcgactcgctcaagccgggcttcgtcgcgctgctcaacgccaagatgaaggacggctacaccgacgacttcttcgcccagatcctgggcaagaccgtgcagcagctgtggcaggactacaaggctaagtacgggggctgatgatggtgatgcaaattggtggcggtgcgaagtcaacgcgtcaatggctcaatgcgtttggtatgagatgctattatgtgctagtacgtacactctgtgtgtaaaatatatagagaaaataaaagggatcggataattaaagcaattcggaaaaaaaa

SEQ ID NO: 6151 - DNA, 745 bp, Setaria italica
caagtaagcgaatcatcggagcaacaagagcttgcagcaccagcacaagatgaagcagcctcacgtcgccacggtcgcttccctcctggccctggccgcggccgcgacgacggccgccgccgtcacgttcgacgcgacgaactcggcgtccaacacccccggcggccagcggttcgaccaggccgtcggcctcgactacgccaagcgggtcctctccgacgcgtccaccttcatctggaacaccttcaaccagcccagccccgacgaccgcaagcccgtcgacaaggtcaccctcgtcgtcgaggacatcgacggcgtggccttcaccagcgccaacggcatccacctcagcgccaagtacgtcggcggctactccggcgacgtcaagaaggaggtgaccggcgtgctgtaccacgaggtgacacacgtgtggcagtggaacgggcagggccgggcgaacggcggcctcatcgagggcatcgccgactacgtccagctgaaggcgggctacgcgccggggagctgggttctcccggggcagggacgcaggtgggatcagggctacgacgtgacagcgaggttcctggactactgcgactcgctcaagccggggttcgtggcgcagctcaacgccaagatgaaggatggctacaccgacgatttcttcgctcagatcctggggaagagcgtgcagcagctgtggcaggactacaaggcagcaagtaaggaacaacggagccccctt

SEQ ID NO: 6152 - DNA, 1765 bp, Hordeum vulgare
cccaagctgtaaacaaacacctacgcgcgcccgctccggcgagatgaagctcccgctgtcggccgggtcgcccgacgcggcgcccgagctggccaagccgtcgctgccgacgacgtggctcatcctgcacgcgctcttctgcgccacctccatggccgtcggcttccgcttctcccgcctcgtcgtcttcctcctcttcctgcccacgccgcccatgaacccctccgcccacctcgtctccctcgtcaccccgcccctcatgctcgccagctccaacgccaccgccaccatcaccaccaccaccaccaccaccacaaccgtcaccaccaccaccaccgtggccgagaccgacgccggcgccaacgcgcaccaccacggcccggtcttcgtcggccgccacgccatccgcgtccgcaagtggccccaccccgaccccagcgagctcctcaaggcgcacggcatcctcgccgccgtccaggaagcgcagcgccgcagccgtagccgcggggccgacccgcccaggcccgtgattgccgtcaccccgaccaccacctccgcgctccaggtaccgtcgctgatttccctcgcgcacaccctccgcctcgtcgacggcccgctgcggtggatcgtcgtcgagcctggccaccgcaccgacgccgtcgccgccgtgctcgcccgctccaacctcgacttcatccacctcgtcgcctccgacggcgcctccaccgcgcgcctgcgaatgcacgctctcagggaggtacggaaggagaagatggacggcgtcgtggtgttcgccgacgagaacggcatcctccggacggagctgttcgacgaggcgcagaaggtgaaatcagtcggcgccctgccagtcggcattctgggcgaggacgaaggcaccaaggagtccttcctccaggcgccggcctgcgacgaggccgggaagctggtgggctaccacgtctcagacgagacgctgctgccggcggctcggagcgacatgctgctgtccacccggctggagtgggccgggttcgtgctgaacgcgcgcgtgctctgggacggcgcggcggagcggcccgagtgggtgcgcgacctggacgccgtggacggcggcgcccacctggacagcccgctcgcgctggtcaccgacgccggccaggtcgagccgctcgccaaatgcgcccaggcggcgctcgcgtggtcgctccggtcagacgccctgcgcgaagtcaagttcccacacgagtggaaatttgaagctcctctagtaagcgctgcttcgcgtcaacagagcagcgtagtaaatactgaagatggtcactagagcagcaaaaattttgtgggcaatagaaatcagggcaaatcagactctgctacggctggtctgatctgtgtgagtctcctctgatgcatccttgtaccaagacatctcaactcttgagtaacataaggcagctcagctcatttgttgggaccctacagaaagtcacagacgatacatctgaatccatgttctgtatcatcctgtaaaatagataagaaaaaagtttaattatatgcaccattcatcgtcccttctctggtaggaagaattctcctaggcgcattgctttcgtgtaatataggtcagagcagatgggctcgccaaattggtctggggttaagacatttgtttgtgtaagtgtgaaataataacaatccagctctcagttttctaatactgtacacaattttttttaaagaggaggtgaaagatctgcctgct

SEQ ID NO: 6153 - DNA, 1980 bp, Hordeum vulgare
cccaccccacgccaccctccacctccacctctcttatatcactcgccaccgccgcccacctcgccctctactgctcccagctcgctcgctccatcccaagctgtaaacaaacacctacgcgcgcccgctccggcgagatgaagctcccgctgtcggccgggtcgcccgacgcggcgcccgagctggccaagccgtcgctgccgacgacgtggctcatcctgcacgcgctcttctgcgccacctccatggccgtcggcttccgcttctcccgcctcgtcgtcttcctcctcttcctgcccacgccgcccatgaacccctccgcccacctcgtctccctcgtcaccccgcccctcatgctcgccagctccaacgccaccgccaccatcaccaccaccaccaccaccaccacaaccgtcaccaccaccaccacggtggccgagaccgacgccggcgccaacgcgcaccaccacggcccggtcttcgtcggccgccacgccatccgggtccgcaagtggccccaccccgaccccagcgagctcctcaaggcgcacggcatcctcgccgccgtccaggaagcgcagcgccgcagccgtagccgcggggccgacccgcccaggcccgtgattgccgtcaccccgaccaccacctccgcgctccaggtaccgtcgctgattaccctcgcgcacaccctccgcctcgtcgacggcccgctgcggtggatcgtcgtcgagcctggccaccgcaccgacgccgtcgccgccgtgctcgcccgctccaacctcgacttcatccacctcgtcgcctccgacggcgcctccaccgcgcgcctgcgaatgcacgctctcagggaggtacggaaggagaagatggacggcgtcgtggtgttcgccgacgagaacggcatcctccggacggagctgttcgacgaggcgcagaaggtgaaatcagtcggcgccgtgccagtcggcattctgggcgaggacgaaggcaccaaggagtccttcctccaggcgccggcctgcgacgaggccgggaagctggtgggctaccacgtctcagacgagacgctgctgccggcggctcggagcgacatgctgctgtccacccggctggagtgggccgggttcgtgctgaacgcgcgcgtgctctgggacggcgcggcggagcggcccgagtgggtgcgcgacctggacgccgtggacggcggcgcccacctggacagcccgctcgcgctggtcaccgacgccggccaggtcgagccgctcgccaaatgcgcccaggcggcgctcgcgtggtcgctccggtcagacgccctgcgcgaagtcaagttcccacacgagtggaaatttgaagctcctctagtaagcgctgcttcgcgtcaacagagcagcgtagtaaatactgaagatggtcactagagcagcaaaaattttgtgggcaatagaaatcagggcaaatcagactctgctacggctggtctgatctgtgtgagtctcctctgatgcatccttgtaccaagacatctcaactcttgagtaacataaggcagctcagctcatttgttgggaccctacagaaagtcacagacgatacatctgaatccatgttctgtatcatcctgtaaaatagataagaaaaaagtttaattatatgcaccattcatcgtcccttctctggtaggaagaattctcctaggcgcattgctttcgtgtaatataggtcagagcagatgggctcgccaaattggtctggggttaagacatttgtttgtgtaagtgtgaaataataacaatccagctctcagttttctaatactgtacacaatttttttttaaagaggaggtgaaagatctgcctgcttttcattagttaagtatcagttaaagagagtgaaatagagtttcaagagttgaacacattggaggttgtataattctatttgagagaattccatatttcaatcgcgcattgtcaccaaag

SEQ ID NO: 6154 - DNA, 2759 bp, Hordeum vulgare
accgcagcgagacaaggacccgggaacccagagacaggaagcggatgggggagagggaccaatccttgccgacgccgcactgcatcccccgcccactgcctcgagcaagcatggcatcgagcactcctttctatattaactggcctcggatagacagataagaggggccgtcggcaatggtgaattggtgatcaccgcggccaggtcgtgtcagccgagaagatagccgcgaagaggggtttcctagcggagagagggccaagaatggcggcgctggccgccgccatcgctctcgccagcctcctcctcgcccttgcgccggtggtcggggccgataccgacgccgccggcgttgcggctctggggaacctctacacctcctggaacagcccggctcagctcgtcggttggtcggcggccggcggcggcgacccctgcggcgccgcatggacgggcgtctcctgctcaggctccgccatcacctcaatcaacctttctggtatgggactgaatggtactcttggataccaactggccagtctagtggcactgacaacgatggacttgagtaacaacagcttgcatgatgtaattccgtatcagctgccaccaaatctgatccatctgaatttggcgagaaataatttttccggtgacctcccatactctatatccaacatcttatcgcttggctacctcaatgtcagtcacaactctctgttccaggaaatcggcgaactatttggtggcctcaattcgctttctgtattggatttatctttcaacaacttgtcagggaatctgccagtttcttttgtctctttgtcaaatctttctagcctctatatgcaaaataatcaactaacaggcaccgtcaatgtcctcagcaacctaagccttactacactaaatatagcaaacaacaacttcagcggctcgatacccggggagctcagctcggttccagacttgactgctggagggaactcatttatcaatatgcctgcatctccaccgccaattatcatgccaccatctgggagtccacttgctcagccagaccgtcctcgagtaccaataacttttccaaatggccctgaggatgagatccctatcgatgaaggtgacaagaagcaaggccggcaaacaggtctgcttgtagggttggctgttggctcagtggctgctgcttcatgtatacttttcgcgttggtgttctgtcttcacaatctccataaaagaaaggatggtggtaccagtgaaccgaaagactttgtaggtgctcttgcagtaaacatagacagagattctaacaacaacatccatcaagactctcctgtagcaacttcagtgctccagcggcctatcgggactcctgagagggcatatggtataaatagttctccagcaaagaagataaaggttcccggtgcggccacttcttatactgttgcttcactccaagttgctacaaacagcttctgtcaagattccctcctaggtgagggttcacttggtcgtgtttacaaggctgatttccccaatggaaaggtacttgcggtgaaaaagatagacagtgctgccctttccttgtatgaagaggatcatttccttgaggttgtatcaaacatttctcggcttaggcacccaaacatcgtatcgcttacgggctattgcgctgaccatgggcaaaggcttcttgtatatgagcacatcggaaacggaacgctgcatgatatgttgcacttttccgatgaagcgagcaagaaccttacatggaacgcccgcgtgaggattgcgctaggcactgctcgagctttggagtacctgcatgaggtgtgccttccccctgttgtacatagaaacctgaagtcatcaaatatcctgcttgatgaagagtgcagcccgcatctgtctgactgtgggcttgccgccttttcgccaaatcctgagagagaggtttcaacggaggtgcttggctcacttggatacagtgccccagaattcgccatgtcaggaacatatactgtaaagagtgacgtgtacagttttggagtagtgatgttagagctacttacgggccgtaagccgctagacagatccagggagaggtcagagcagtctcttgtcgggtgggcaaccccgcagcttcacgacatcgatgcgctcgccaagatggttgacccagcaatggatggcatgtaccctgcaaaatcgctctcccgtttcgccgacataatcgcgttgtctgtccagccggaaccggagttccgtccaccgatctccgaggtcgtccagcaacttgtgcgtctgatgcagagggctagcatgttaagacggcagtcgggagacgatctagggtcttcgtaccgtgccccggagcgtgaaggaggcgcgtcggacgccttgtgaggccaaaccctcctgccagctataaaccagagctgtattatcagaacataccattttgtgagtattagtatgtgtcactttttactcaattttctgtctggtatttctggatcttccggttatctgtttgtaccgaatatgctggggattttgtcaatggcttgtatagatatagatataggattctgttatgttgatcagttttagataaaaaaggaaaggaaagggagagaaatggatttgtgacaagttgaatgcgcacgcctctgtcagacggcgacctgtgtgtgccttgccagcgtgggaaacctcactgattcgcggcgaagcacacgtcgctagtaata

SEQ ID NO: 6155 - DNA, 670 bp, Triticum aestivum
ttccacccacccacccacctgcgccagctctgaaggaggaggcggcggcggcggcgggtgagctcgcgcataacggatcgatcccagctctagaggggagcagccatggcgggggacggcgacgaggagccgccggcgacgggcggcgacaagctgatcctgcggggcctgcagttccacgggttccacggcgtgaagcaggaggagaagaagctgggccagaagttcgtggtcgacgtggacgcctggatggacctcgccgccgccggggactcggacgacatcgcccacaccgtcagctacaccgacatctacaggatagccaagggcgtggtggaaggcccgtcgcgcaacctcttggagtcggtggctcagtcgatcgccggctccacgctgctcgagttcccccagatctccgccgtccgggtgaaggtcgggaagccccacgtcgcggtgcagggcatcgtcgactacctgggtgtggagatactgaggcgcagaggggcatgagcacaagaactgaacagaattcatctcagttgagccgatcgatctctgtctcttatacctatgtgtgaatgaacatatgttgattgcgctcatgaaacaagaatcacgaacagaataatttctgaaatggggatcatgttcttgcctgacaaaaaaaaaa

SEQ ID NO: 6156 - DNA, 986 bp, Hordeum vulgare
gaccaaccgctgtgcggccttcctccaccctgctgcgccgcacgcccacgcctcgttccccctgacagctccgcatcccaggcgcgcatcgccatctcaagccgccgacgccctagcggctgctcgtccctaccggattttccccttcccgctatctgaaattgcagaaacaccgattttctaccgaacgcgcagacctcacctgcaggctccctgctccggccgcccgaatcttacccaaccctccacccacccacatgcgccagctctagagaaggaggcggcgggtgagcgcacgatcgatcgagtccgctagtacgggagcaggcatggcgggggacggggaggagccgccagcgatgggcggcgacaagctgatactgcgggggctgcagttccacgggttccacggcgtgaagcaggaggagaagaagctcggccagaagttcgtcattgacgtcgacgcctggatggacctcgccaccgccggggactccgacgacatctcccacaccgtcagctacagcgacatctacaggatagccaagggtgtggtagaaggtccgtcgcataaccttttggagtcagtggctcaatcgattgccaacaccacgctgctcaagttccctccgatctctgctgttcgagtgaaggtggggaaacctcatgtcgcggtgcaaggcgtcgtggactacttgggagtggagatactgaggcacagaaaggcatgagcacaacttcatatgagaaagccggaccaatgctccctcagaatcgcaattgacctgatttctgtgtcttatttgtaaaatgtggtgttgattgtgttcttactctcggctgttgctgaaattgccgcagtcacggacaaaaagtttgatagtgctactaggttttgcgcagactgaaacaaaaataatcttgcagagagaaaagttgctttcatttattaacttatctttttgagaaccaaaaaaaaaaaaaaa

SEQ ID NO: 6157 - DNA, 697 bp, Hordeum vulgare
cggcggcggcgggtgagctcaagcacagccgatcgatcccaagagagcagccatggcgggggacggcgaggaggagccgccggcgacgggcggcggcggcgacaagctggtcctgcgcgggctgcagttccacggcttccacggcgtgaagcaggaggagaagaagctgggccagaagttcgtggtcgacatcgacgcctggacggacctcgccgccgccggggactccgacgacatctcccacaccgtcagctacaccgacatctacaggatagccaagggcgtggtggaaggcccgtcgcggaacctgctggagtcggtggctcagtcgatcgccgcctccacgctgctcgagttcccccggatctccgccgtccgggtcaaggtcggcaagccccacgtcgccgtgcagggcgtcgtcgactacctcggggtggagatactcaggcgcagacaagcgtgagcacaagagcctcatacgacaagcctcagcagaattaatctcagctgagccgatccatctccttgtcctcctatatctatgtatatgaacaacatgtgttgattgcgcaagtggaacaagaatcatgagcaaaataatttctgaactgggatccatcttcttgcctgctggtggtaagatttgatgtcttaccttttatgaaagtttagttgaatctaaaaaaaaaaaaaaaaa

SEQ ID NO: 6158 - DNA, 764 bp, Secale cereale
cccaagctggctgctcgaccgtccgggatttcccctttctaccgaacgcccggacctcacctgcaggcccccgcctccagccgcccaaatctcacctaaccctccactcacccacctgcgccagctctagagaaggaggcggcgggtgggcgcacgatcgatcgagtccgctccgctagaaggagagcagccatggcgggggacagggaggaggagccgccgcggacgggcaagggcggcggcgacaagctgatactgcgggggctgcagttccacgggttccacggcgtgaagcaggaggagaagaagctcggccagaagttcgtcattgacgtggacgcctggatggacctcgccgccgccggggactccgacgacatctcccacaccgtgagctacagcgacatctacaggatagccaagggtgtggtagaaggtccgtcgcataaccttttggagtcggtggctcaatcgattgccagcgccacgctgctcaagttccctcagatatctgctgttcgggtgaaggtcggaaaacctcatgtcgcggtgcaaggcgtcgtggactacttgggagtggagatactgaggcacagaaaagcatgagcagaacaaagcctgaccaaaatgctgcctcggaatcgcagtttaagctgatttctgtgtcctatctataaacgtggtgttgattgtcttcttactcccggctgttgctgaaattgccgcaatcacagacaaaaaatttgatagtggactaggttttg

SEQ ID NO: 6159 - DNA, 833 bp, Triticum aestivum
ccggacgcccacgcctcccctgaccgctccgaatctcaggcacgcagcagctcgccatcccaattcccaaatcgccgacgcccaagcggctgctcgttcgtccaggattttccccttcccgctatctgaaattgcaaaatcatcgagtttctaccgaacgcccggacctcacctgcacgcccccggctccagccgcccaaatctcacctaaccctccacccacccacctgcgccagctctagagaaggaggcgccggtgagcgcacgatcgatcgagtccgttaggtggggagcagccatggcggggggcggtgacaagctgatactgcgggggctgcagttccacgggttccacggcgtgaagcaggaggagaagaagctcggccagaagttcgtcattgacgtcgacgcctggatggacctcgccgccgccggggactccgacgacatctcccacaccgtcagctacagcgacatctacaggatagccaagggtgtagtagaaggtccgtcgcgtaaccttttggagtcggtggctcaatcgattgccaacaccacgctgctcaagttccctcagatctctgctgttcgagtgaaggtcgggaaacctcatgtcgcggtgcaaggcgtcgtggactacttgggagtggagatactgaggcacagaaatgcatgagcagaacttcatcatatgagaaagcctgaccaaaatgctccctcagaatcgcagtttctgtgtcttgtctataattataaacgtggtgttgattgtggtcttactctcggctgttgctgaaattgccgcaatcatggatttttttttatagtgctac

SEQ ID NO: 6160 - DNA, 674 bp, Avena sativa
ctgcccaagaaaatctcacccaccaccagctcccacggcgggtgggtgagcgcacggcggcgtcaggagggggagcagccatggcgggggacgggaaggaggagcccaaggcgatgggcacgggcggaggcgacaagctgatcctgcgggggatgcagttccacgggttccacggcgtgaagcaggaggagaagacgctcggccagaagttcgtcatcgacgtcgacgcctggatggacctcgccgccgccggggactccgacgacatctcccacaccatcagctacaccgaaatctacaggatagcgaagggtatagtagaaggcccgtcacataatcttttggagtcggtggctcagtcgattgccaactccacactgctccagttccctcagatctcctccgttcgagtgaaggtcgagaaacctcatgtcgcggtgcaaggcgtcgtcgactacttgggagtggagatactgaggtgcagaaaagcatgagcagaacacttgatctgaggagacctgagcaatgctctctcagaatcttagttgtgctgatttatgtgtcttgtgtataaacatggcgttgattgcacgcttcctctatgtactgtatgttgctggaagttgtgcaccatgagctggattatttgtggctatgttcttcacaaactgaaa

SEQ ID NO: 6161 - DNA, 802 bp, Avena sativa
aaatctctcacccaatcatccaccagctcccacttgcgccagctctgaaggaggcggcaggtgagcgcgcggcggcgctcgatcgaccgagaccgtcaggagggggagcagccatggcgggggccggggaggaggagcccaaggagatgggcacgggtggaggcgacaagctgatcctgcgggggatgcagttccacgggttccacggcgtgaagcaggaggagaagaagctcgggcagaagttcgtcatcgacgtcgacgcctggatggacctcgcggccgccggggactccgacgacatttcgcacaccatcagctacaccgacatctacaggatagcgaagggtatagtagaaggcccgccacataatcttttggagtcggtggctcagtcgatcgccaactccacgctgctcaagttccctcagatctcctccgttcgagtgaaggtcgagaaacctcatgtggcggtgcaaggcgtcgtcgactacttgggagtggagatactgaggtgcagaaaagcatgagcagaacacttgatctgaggaggcctgagcaatgctctctcagaatctcagttgtgccaattcctctatgcactgtttgttgctggaattgcgcaatcatgagctggatttatttcgcggctatgttcttcacaaactgaaataagaacgtgttttgttcaggctattgtaaagttactcgattacggtggtgactgttacctttaaaacgtgtttggttcaatttaactggaaacgtgtttggattatctccaagcttgaggcacgtactaaaa

SEQ ID NO: 6162 - DNA, 1074 bp, Brachypodium distachyon
aatggacccagcagaagatggaaagccgccgccgctgctgcagccgcccaaatcccacccaaatcatcctccaccaaccccttccactcccggctccggcgatcgatcgagcgagctatggcggaggaggaggcgccggcggcgggcaagctcggcggcgacaaactggtcctgcgtgggatgcagttccacgggttccacggcgtgaagcaggaggagaagaagttgggccagaagttcgtcgtcgacgtcgacgcctggaccgacctcgccgccgcaggggactccgacgacatctccgacaccgtcagctacaccgacatctacaggatagccaagggtgtcgtagaaggcccgccacacaatcttctggagtcggtggctcaatcgattgccagctccacgctgctcaagttccctcagatctccgccgttcgagtgaaggtcgggaagcctcatgtcgcggtacaaggcgtcgtcgactacttgggggtggagatactgaggtacaggaaagcatagtcagaatgcttcacaagagaagcctgagcaatgatccctcaggatctctctgttgagctggtctttgtgtcttgccaatgcactttgagccaatctggtgttagattgcgctcggattcgcaacaccgttgctgagattcacgcaaccatgaacaggagaatgttggtgctgctgctagggttttccacaaactgaaataagaattgtgttcttgcatgcatatatatgatttctgaatccccctcgagtcagttcaaaacctataacggagcaaatgggttctctccgaggaagcaaagttcctctgtcctggctttatacattttaaggttctgcattgtccgcttgattgtaataaaccagctcacaagttggcggatttagatgcaggggatgtttgccataagacatttgacagactatcctgactatgtgagcattttggttcctttgaatctttgatttatggtcgtgcattaatggaatagaatacgagtattcctattgaaaaaaaaggagggcatcctttctcaataaaagaacagaaaaat

SEQ ID NO: 6163 - DNA, 1446 bp, Oryza sativa
aatctgtttgtctctgtctgcaacaactccaccaccaccaccaaccggaggcgcctccgcctccacggccactataagagcgcggcggcggcggcggcgggggcggggggccatggcggggaagaaggaggaggaggaggctgttgtgtacaggggcgacaagctgatcctgcgggggctgcggttccatggcacccacggggtgaagccagaggagaagaagctgggccagaagttcgtcatcgacgtcgacgcctggatggatctcgccgccgccggggactccgacgacatctccgacaccgtcagctacaccgaaatctacaggatagccaagaatgtagtcgaaggcccgtcgcacaatctgttggaatcggtggctcagtcgattgcaaactcaaccctgctcaagttccctcagatttctgcagttcgagtgaaggttgagaaacctcatgttgctgttcagggagtcctcgactatttgggcgtggagatattcaggcagagaaaagcatgaacaacacctatacttgttcagaacctcattcgaacagatacgtacttagtgtacttgtcttatctttattgctcgttatcataccaatattattcactcagtatccatgtcaagaactagaaaattccctgtttaatttgcacgaagaggaatatatatgtaacgtagattgttgtggtactattaattaatactccctccgtttcaaaatgtttgatgccgttgactttttagcacatgtttgaccattcgtcttatttaaaaaaaattgtgaaatatgtaaaactatatgtgtacatgaaaggttatttaacaatgaatcaaatgagatgaaaagaataaataattacttaaattttttgaataagacgaatggttaaacacgtgctaaaaagtcaacggtgtcaaatattttgaaacggagggagtactagcatgcttgtgaagtgtcatccgtccgtcctgtcctaacgattttattctgatgcagttggtcgatctaatcttccctttcaataattaaatctacaatataatagtatccattattgtcagtcacagaagtatcttcagtcagcattcagagcaaaaatgttgaccaccattctgtcttctgaggcgacaggaaagttttactaccttatttcattgataaaagaagaggaaaaacaccatgttgtactgcatatatactgtaggtccagaagaccataggcagagtataagtaaatattaatactacattattattgaccaccgttcgcatagtctgcagataattaagcatccctgttgcatgatgtgtgaatgacagacttcagaaatccgcgctgacgcctctggaggcgaatagctcgtcgatgtagctgatgatcccgttggctgcatcgatgtacttttgcatctctgcagccgcagattcatct

SEQ ID NO: 6164 - DNA, 1330 bp, Triticum aestivum
cgctcggaaggccacagagaggtcacagccccgatccagtccatcgtccacatcggtcctgctcctccctcccgtctccggcgaccgtgatctgctctgctcctccggtggtctccgccccaccgccacggaacttatacacacctgcagcagacctcatgagcgggggcaccgcggcgagcggcagcctgcggacggccctctcgtactgcgtccagcaggtgcgcagctacgactaccacaactacctctgcctgctccacctgccgccggccatgcgcaaggccgcgttcaccttccgggccttcaacgtcgagacggccaaggccatggacgtcgtgtccgacccccgcaagggcctcatgcgcctcctctggtggaaggacgtggtcgacaaggtctgcgccggcaagaaggtcgagcaccccgtcgcgctcgcgctctcctcggtgctctccgagcacaaggtcagcaagcactggctcaagcggtcgctggaggccaggatcaacgacgggaaccgggatgacgacgccatccctgagaacgtcccggagctggagaggtacgcggaggacacccagtcgaccatcctgtacatgacgctgcaggccggtgggatacagtccactgttgctgatcatgccgcgtcgcacatcggcaaggcgagtgggctgctgctgctgctcaaggcgctgcctcaccatgtgagcaagcaagggaagataccgtacatcccggcgagtgtggccgaggagtgcgggctgcttgcgcgggagggtggccggacagaggtcaggatgggcgacgcgctcccggatgcagttttcaaggttgcgtctgttgccgaagctcacctgcagaaggcgcgggagctggccacgtctgtgccggcagaggcggtccccgtgctcctcccagccgtgccggcccaagtccttctggattccctgcgacgccgcgaattcaatgtcttcgactcgcgcttgtccagtggagtccatggcatatcccctctgtggtaccagctgaagctcaactggcacgcgtggcgaaacaagtactgaattcatccatgccgtgtgaaccgtgtttgttgaaagcgcggttcagcatgcgttttagcccagactaaacctggggtatccatttactgaaatgtaataagcttgatgatcaagaaaggctctgctacctgctgcagctggctgtttctgagcaattttgatgtagcttcctttttcattgggtacatgctttgttgagggttgtttgtttcgtttgtattcgagtatcgacatgaggtggatgaatgttatttgttgagctt

SEQ ID NO: 6165 - DNA, 1371 bp, Triticum aestivum
atccccatcggtgtcctgctcctccttcctgtccggctacccgtctccggcggccgtgatctgctctgctccggcgctctccgccccgccgccacgtatcttgtacaactccgaagcagacctcatgagcaggggcaacgtggcgagcggcggcctgcggacagccctctcgtactgcgtccagcaggtccgaagctacgactaccacaactacctctgcctgctccacctgccgccggcgatgcgcagggcggcgttcaccttccgggccttcaacgtcgagacggccaaggccatggacgtcgtctccgacccccgcaagggcctcatgcgcctgctctggtggaaggacgtggtcgacaaggtctgcgcgggcaagacggtcgagcaccccgtcgcgctcgcgctctcctcggtgctctccgagcacaaggtcagcaagcactggctcaagcggtcgctggaggccaggatcaacgacgggaaccgggaggaggacgccatccctgagaacgtcccggagctggagaggtacgcggaggacacgcagtcgaccatcctgtacatgacgctgcaggccggcgggatacagtccactgttgctgatcatgcggcctcgcacatcggcaaggcgagtgggctgctgctgctgctcaaggcgctgccccaccatgtgagcaagcaagggaagataccatacatcccggccagtgtggcggaggagtgcgggctgcttgcccgggagggtggccggacagaggtcaggatgggcgatgcgctcccggacgcagttttcaaggtcgcgtctgttgccgaagctcacctgcagaaggcgcgggagcttgccgcgtctgtgccagcagaggcgctccctgtgctcctcccagctgtgccggcccaggtccttctggactccctgcggcgccgcgaattcaacgtcttcgactcacgcttgtccagtggagtccatggcatatcccctctgtggtaccagctaaagctaaactggcacgcttggcgaaacaagtactgaattttcatccatgctgtgggaagcgtgtttgttgaaagcgcggatcagcatgcgttttagcccagactaaacctggggtatccatttaccggaatgtaataagcttgatgatgaagaaaagctctgctacctgctccaactggctgtttctgagcaattttgatgtagcttcctttttcattgggtacatgctttgttgagggttgtttgtttcgtttgtattcgagtatcgacatgaggtggatgaatgttatctgttgagcttgtcctttcagttgttccttgcccagattgttccaatacaaggggggtcggtggatcctctgggatgtggggct

SEQ ID NO: 6166 - DNA, 1253 bp, Hordeum vulgare
tttgctgcagtgtcttatacacgcctggagcggaactcatgagcgggggcaccgcagttagtgccagcctgcggacagccctgtcgtactgcgtccagcaggtccggagctatgactaccacaactacctctgcctgctccacctgccgcccgcgatgcgcaaggccgcgttcaccttccgggccttcaacgtcgagacggccaaggccatggacgtcgtctccgacccccgcaagggcctcatgcgcctcctctggtggaaggatgtggtcgacaaggtctacgccaacaagacggtcgagcaccctgtcgccctcgcgctctcctcgctcctctccgagcagaaggtcagcaagcactggctcaagcggtcgctggaggcaaggataaacgacgggaaccgggacgacgacgccattcctgagaacatcccggagctggagaggtacgcggaggacacccagtcgaccatcctgtacatgacgctgcaggctggtgggatacagtccactattgctgatcatgccgcctcgcacatcggtaaggccagtgggctgctgctgctgctcaaggcgctgcctcaccatgtgagcaagcaagggaagataccgtacatcccggccagtgtggccgaggagtgcgggctgcttgcacgggagggtggccggacagaggtcaggatgggcgatgcgctcccggatgcagttttcaaggttgcgtctgttgccgaagctcacctgcagaaggcacgggagctggcagcgtctgtgccagcagaggcggttcccgtgctccttccagccgtgccggcccaggtccttctggactccctgaggcgccgagaattcaacgtcttcgactcgcgcttgtctagtggagtccatggcatatcccctctgtggtaccagctaaagctaaactggcatgcgtggcgaaacaagtactgaattcatccatactgtgcgaaccgtgtttgttgaaagcgcaggtcagcgtgcgttttagctcagactgaacccagggtatccatttactggaatgtaataagcttgataatgaagaaaggctctgctgcctgctccaactggctgtttctgagcaattttgataattgatatagcttcctttttcattggatacatgcattgttgggggttgtttgttttgtttgtattcgagtatagacatgaggtggatgaatgttatctgttgcatttgtcctttcagttgttgcttgtccagactgttccaat

SEQ ID NO: 6167 - DNA, 1032 bp, Hordeum vulgare
gcagcgagcgccagcctgcggacagccctgtcgtactgcgtgcagcaggtccggagctatgactaccacaactacctctgcctgctccacctgccgcccgcgatgcgcaaggccgcgttcaccttccgggccttcaacgtcgagacggccaaggccatggacgtcgtctccgacccccgcaagggcctcatgcgcctcctctggtggaaggatgtggtcgacaaggtctacgccaacaagacggtcgagcaccccgtcgccctcgcgctctcctcgctcctctccgagcagaaggtcagcaagcactggctcaagcggtcgctggaggcaaggataaacgacgggaaccgggacgacgacgccattcctgagaacatcccggagctggagaggtacgcggaggacacccagtcgaccatcctgtacatgacgctgcaggctggtgggatacagtccactattgctgatcatgccgcctcgcacatcggtaaggccagtgggctgctgctgctgctcaaggcgctgcctcaccatgtcagcaagcaagggaagataccgtacatcccggccagtgtggccgaggagtgcgggctgcttgcacgggagggtggccggacagaggtcaggatgggcgatgcgctcccggatgcagttttcaaggttgcgtctgttgccgaagctcacctgcagaaggcacgggagctggcagcgtctgtgccagcagaggcggttcccgtgctccttccagccgtgccggcccaggtccttctggactccctgaggcgccgagaattcaacgtcttcgactcgcgcttgtctagtggagtccatggcatatcccctctgtggtaccagctaaagctaaactggcatgcgtggcgaaacaagtactgaattcatccatactgtgcgaaccgtgtttgttgaaagcgcaggtcagcgggcgttttagctcagactgaacccagggtatccatttactggaatgtaataagcttgataatgaagaaaggctctgctgcctgctccaac

SEQ ID NO: 6168 - DNA, 1129 bp, Leymus cinereus x Leymus triticoides
gaccgtgatctgctctgctggtttccgccgccacgtgtcttatacacacctggttcggaactcatgagcgggggcaccgcagcgagcggcagcctgcggacagccctctcgtactgcgtccagcaggtccgcagctatgactaccacaactacctctgcctgctccacctgccacccgccatgcgcaaggccgcgttcaccttccgggccttcaacgtcgagacggccaaggccatggacgtcgtgtcggaccccaggaagggcctcgtgcgcctcctctggtggaaggacgtggtcgacaagatctacgccaacaacacggtcgagcaccccgtcgccctcgcactctcctcggtcctctccgagcagaaggtcagcaagcactggctcaagaggtcgctggaggccaggataaacgacgggaaccgggatgaggacgccatccctgagaacatcccggagctggagaggtatgcggaggacacccagtcgaccatcctttacatgacgctgcaagccggtggaatacagtccactgttgctgatcatgccgcctcgcacatcggcaaggctagtgggctgctgctgctgctcaaggcgctgcctcaccatgtgagcaagcatgggaagataccgtacatcctggccagtgtggccgaggagtgcgggctgcttgcgcgggagggtggccggtcggaggtcaggatgggcgatgcgctcccggatgcagttttcaaggttgcgtctgttgccgaagctgacctgcagaaggcccgagagctggccacgtctgtgccagcagaggcgctccccgtgctcctcccagccttgccggcccaggtccttctggactccctgcggcgccgcgaattcaacgtctttgactcgcgcttgtccagtggagtccatggcatatcccctctgtggtaccagttaaagctaaactggcacgcgtggcgaaacaagtactgaattcatccatacggtgtgaagtgtgtttgttgaaagcgcgggtcagtgtgcgttttagctcaagactaaacccggagtatccatttaccgaaatgtaataatcttgatatgatgaagaaaggctctgctacctgctgcagctggctgtttctgagca

SEQ ID NO: 6169 - DNA, 1615 bp, Brachypodium distachyon
atgctctggtggaaaggccagagagaggcccagagccagagggcatccacttcttctgttccgtcgtcggctccaggctccggcgggccgcaccggcgatctgatctgctctccgccggccgcgctccctccatcgccgagggccttgcttcacatctcaagtaggattcatgagtggcggccctgcagcaagcggtggcctacgagcagcgctctcgtactgtgtccagcaagtccgcagctatgactaccacaactatctctgcctcctccacctgcctccatccatgcgcagggctgcattcaccttcagggccttcaatgtcgagacagcaaaggccatggacgtcgtgtcggaccctaggaaaggcctcatgcgcctcctgtggtggaaggatgtgatcgataagatctacgcaaacaagctggtcgagcaccccgttgccctggcgctctcttcagttctctccgagcagaagatcagcaagcattggctcaagaggtcgctggaggcaaggatcaatgatggaaaccgggatgagtatgccattccagagacaattgcagagttggagaggtattcggaagacacccaatctaccatcctttacatgacattgcaagctggtgggatacagtccaccattgctgatcacgccgcctcgcacattggtaaagctagtgggttgctgttgcttctcaaggcactgcctcaccatgtaaacaagcaagggaagataccatacatacctgcaagtgtggctgaggagtgcggtctgcttaggcaggagggtgatcgatcagaggtcagaatgggcgatgcactcccggatgcagttttcaaggttgcatctgttgccgaagctcacctgcagaaagcgcgggagctggcctcatctttgccagcacaggcagccccagtgctcctcccagccgtgccgacccaagttcttctggactccctacgatgccgtgaattcaacgtcttcgattcacgcttgtccaagggagtccatggcatatctcctctgtggtaccagctaaagctcagctggcacgcatggcgaaacaagtactgaattcatccatagagtgcaagttgtgtttgtcaaaagctcggatcagtgtgttttagctcagactaaatccggagtatcagtttaccaaaatgtaataaggttggtggaagaaaaaaagactctgcattgccattgctgcaactttctgtctctgagaaattatgtagtggcttcttccttcttgtgattgtttgttttgtttgtaacccaaattttacatgaggtggatgcatgtcttctgttgagtttgttcttcagttctttcccttgcccagattaagtatactcaattacttgttgctgatgattaagcgagtaatttaatttaggcaaggaaaacaagttcctcattgtaacaataactagtgtatataccaagttaccaacctcatatttggcttgcagcaactatatttgacttcattatgtcagctacagttaggtaggatggcacatctcactttgctttttctatgttgcttctatttgcatatttgtatgcctcagaaataagtaaataacgacaagttttgcac

SEQ ID NO: 6170 - DNA, 1188 bp, Setaria italica
tgtcctgcaggactacaggactcatgagccgcgcacctgcagcaagcagtagcctacaagcagctctctcatactgcgttaggcaagtccgcagctatgactaccacaactatctatgccttctccacctgcctccagcaatgcgcaaggctgcgttcaccttccgggccttcaacgtcgagacagcaaaggccatggacgttgtgtctgaccctaagactggcctcatgcgcctcctctggtggaaggacgtgattgacaaggtctttgccaacaagctggttgagcacccagttgcccaggcactctcttcggtcgtctcagaccacaaggttagcaagcactggctcaagagatccgtggaggcaaggataaacgacgccaaccgggatgagggtgccattcctgagacaagtgccgagttggagaggtacgcagaagacacccagtccaccatcctttacatgacgctgcaggctggtgggatacagtccactgccgctgatcacgccgcctcgcacatcggcaaagccagtgggctcttgttactgctcaaggcactgcctcaccatgtaaataagcaaggggtgataccatatatcccggctaatgtcgccgaggagtgcggcctgcttacacgggagggtggccgatcggaggtcaggatggatgagaggctgcctgatgcagttttcaaggttgcatctgttgccgaggctcacctgctcaaggcgcgggagctggcctcatctgtgccaagggaggcgatcccagtgctccttccggccttgccggcccaggtcctcctggattccctgcgaagatgcgagttcaatgtctttgattcgcgggtgtcaaggggagtccatggggtctctcccctgtggtatcagctgaagcttaactggtacgcgtggcgaaacaagtactgaagccggccaacattgttgttcttggaaattggaacgaactgcagatttgttgtgttccatttagcaaagctgcactcatggtttcgctgtaagaagatgagcagcagtgtcctgctagttgcaccaactgggcgcctttgagcaattttgctgtatcttgctctgtacaatcccccacactctgttgggaagtttatgttgtttgcagtaccccatttttacatgaagatgatgaatacgtgttgtgttctactgc

SEQ ID NO: 6171 - DNA, 3293 bp, Oryza sativa
ggaaagattaactgacctcattgagccatttccccagcttcctcaagggcttggagaagccaaagaagatattttgcaagagtttagactgtaggtaatcaagcttttcaaccaacagtaggcccttctgcctctccgttgcatacccacgcctgtgaagaaaaagggttatatattcattcgtaccatggtgagttacatgtgtagataggctatcaggttgcaaaaaggaaacaagaggggttacctgaatatgatagcattggactcagctgcctttttccaatcgacataaatgggcaaagtcaagaggtaatcggtgtttagggcgtatgtcaagagcaggtcttgcgcagagagctcttcaaattgagcattgcgcagaaggttcatgaaggagcgctggaaatgagttgcaaaagcaattctggaaacaagtgcgtgttgagttgagttatcagcataggcacagtatatagtactagtaagtggaagtgaagaggatccgattaattgttacctgttgtgtgaatcagggtctggtgacaatcccaggagtgttctgagacccaagcttctggtaagaagcaaggttccgttgtctgtaatgccaaaaaaaccagcagtggtgttggcgttgccgttgagcacggattggtcatcgtcatcgtcatcagcggcagcggtgtgttggtgatggttgtgggtgagcatgtaataggttcgcatttcctcgagcatctccttgtgctctgcgtggaggagggcgtccaggcatctgccatgcatgtatcattgaattgaattgaattggacttgaagtgaggagcggagaagatgagcaacgaaccttgcaaagcgcttgaagtcagcagccgcagcagaggtgggagagggagtgggaggttgggatgggaagagggagaggagagcgtcgaggagggcgggcttggagacggcgatgtagcgttggcgcgggacgtggatgccggggatggccttcctccccttcaagtcgaagtcgccgtcgtcatcaacagtgggttggttccatgggtcggagtcggagcggaattggacggtggcggaggagagctttggggaagaggaagaggagcagcgcgtggccgtggtgggtggtctgctgcttattcggacatccccaggaggcggaggcacggagaaggagagtggtggcttggcgccggcgccggcacgcagtagaaggaggggcatcgccggcgccgacgacgacgcacagcacagggggggataacctgggcgcgcaatggcaggcaagagcaagaggataacccgcccaaccatgggtttcctgccacgtcgtggtatcttcatgggccgggccgggccgtggcacgtggcaacaacgaacgaacgaacggcccagtctgtctgatcccatccgatttccgatgggatcccaacatcgatctcccccgccgccgccgccttctggcttctccctccgactccgatccgccgccgccgcctccctacctccatctccatctccatgaccgcctgcgcctcctcctactcaagtccggtccggcaacaacctccttcactcataaagcccggaaactactgagacctcctctttcacatctcaaacagagttcatgggtagtacagctgcagcgggtggtaacctgcgaaccgccctctcgtactgtgtgcagcaagttcgcaactatgattatcaccactatctctgccttctccacctacctccagctatgcgcaaggctgcattcgccttccgagccttcaacattgagacggcaaaggccatggatgttgtctcggaccctaagactggccttatgcgcctcctctggtggaaagatgtagtcgacaaggtctttgcaaacaagctggttgagcaccctgttgcccaggtgctctcttctgttgtgtccgagcacaagattagcaagcattggctcaagaggtctgtggaggcaaggataaacgatgcaaaccgggatgattatgccattcctgagacaatttctgaattggagaggtatgcagaggacacccaatctaccatcctttacatgacgttgcaagctggtgggatacagtcaactatcgctgatcatgccgcctcacacataggcaaagctagtgggctgctactgctactcaaggctttgcctcaccatgtgagtaagcaagggaggataccgtatatcccagcaagtatagctgaggagtgcggtctgcttacacgggaaggtggccgatcagaggtcaggatgggagatgagctcccagatgcagttttcaaggttgcatctgttgctgatgctcacctgcagaaggcgcgggagctggcctcttctgtgccagcggaagcaatccctgtactcctcccaggggtaccagcccaggtccttctggactccttacgacgccgtgaattcaacgtctttgattcacggttgtcaaggggagttcatgggatatctcctttgtggtaccagataaagctcatctggcactcggtgcggaagaagtactgactaactcatccacacaagcacccataaagagctcgggttagttgtgtgtctttttttttaccaaaatgcaataaggttgataaacagattgaaaaactctgacttgttggttggtgcatgtatctgagcaatgtcgatgtacgttcctctctaggatacacaagtgttgttcgaattgttcgttttgtttgcgatccgtttttgcacgaagcagaggaatgtaacagggtggatgctgtttttttctttctgttgagtttgttgtgcaattgcttgccaacgagctactggctttttatgcttgctaagcattggtcatattcacctagattggttggttgatgggcattgggcctatttggtgatggcagtccattatattggggcccaagagcagaaggcaaccgggctccagtgcaatgtcattgcattgcgtgatgcttaagcctgatattatggacgtgatgtttaagtcagttcagctcaacaagttggacatgctcatctccccgtgcaagaaaacaccatcatcatcctctctttgacggactttcatctgcttttccattcctcaggtaattgcagtatggaacagcaatatttgtttactaatactcatatgtttgctgcaaaaaccttgtgtgctgtttttctgcatcatttcgggcttgttgcttctgcaggatctgatcaatgtcttctttttttccacgacaaaaagaacagatttgttattaaaaa

SEQ ID NO: 6172 - DNA, 1485 bp, Sorghum bicolor
cgccgccgcccgtctccggtacgacggcgacgcacaggtgtcgtgcagggacctttccttcctgatacaggaaggcagggctcatgagtggcacgccagcagcaagcagtagcctacaggcagccctctcatactgcgtcaggcaagtccgcgcctatgactaccaccactacctatgccttctccacctgcctccggccatgcgcaaggcagcgttcaccttccgtgccttcaacgtcgagacagcaaaggccatggacgtcgtgtccgaccctcggactggcctcatgcgcctcctctggtggaaggacgccgtcgacaaggtctttgccaacaagctggtcgagcacccggttgcccaggcgctctcttcggtcgtcgcagaccacaaggttagcaagcactggctcaagcggtccgtggaggcgaggataaacgacgccaaccatgacgagggcaccattcctgagacgagcactgagttggagaggtacgcggaagacacccagtccaccatcctttacatgaccctgcaggctggtggcatacagtccactgtcgctgatcatgccgcctctcacatcggcaaagccagtgggcttctgttactgctcaaggcactgcctcaccatgtaaataagcaagggacggtaccttatatcccagctagtgtggctgaggaatgtggcctactcacacgggagggtggcagatcggaggtcaggatggacgagaggcttccagatgcagttttcaaggttgcatctgttgccgaggctcacctgcacaaggcgcgggagctggcatcgtccgtgcctaaaaaggcgatccctgtgctcctcccagccgtgccagcccaggtcctcctggataccttgcgaagatgtgagttcaatgtgtttgattctcggttgtcgaggggagtccacggggtctctcctctgtggtatcagctcaagcttaactggaatgcgtggcgaaacaagtactgatgaagaaccgagcaagtttaacctgttcaaccatgggaagaactgcactgaactgcaggctgctgctgttccttttagcaaagctttattgagcttccgatgaggttttgctgaaacacttcgttatataaccaagattgaataagatgagtagggtctgctacttgtgccaaacttggcgactttgagcaatttttgctgtggcttctggcttgggaggtttatttatttgtttggagtgcctcttttacatacatgaagctgttgaatttgtgttgtgctgtacgtaccacagtattatgtggagtctgttgtgcttctggctgggctccattttgacacttacaacatgagctcctttatttgaggaaggggattatatatagccttgctaattgattgattgattaactcccgtgttattattatgaatctggatggaggaaggctacttgaatgatacgttacggaacaacaattgtgagttgggcct

SEQ ID NO: 6173 - DNA, 1358 bp, Panicum virgatum
agatccatccataccatactccatcatcatctctctccgtctcggcgatcgccgccgccgccgccgcccgaccgccgtctccgcggaccttgttcacacctgacaacaggattcatgagcgccacgcctgcagcaagcgctagcctacgagcagctctctcatactgcgttaggcaagtccgcagctatgactaccaccactatctgtgccttctccacctgcccccagccgtgcgcaaggctgcattcacctttcgggccttcaacgtcgagacggcaaaagccatggatgttgtgtcggaccctaagactggcctcatgcgcctactctggtggaaggacgtgatcgacaaggtctttgccaacaagctggttgagcaccccgttgcccaggcactctcttcagttgtttcggaccacaaggttagcaagcattggctcaagaggtccgtggatgcaaggataaacgacgcaaaccgtgatgagggtgccattcctgagacaagtgctgagctggagaggtatgctgaagacacccagtccaccatcctttacatgacgctgcaggctggtggtatacagtccactgtcgctgatcacgccgcctcgcacatcggcaaagccagcggtctcttgttactgctcaaggcactccctcaccatgtaaataagcaaggggtgataccgtatatcccagctaatatcgccaaggagtgcggcctgcttacacgggagggtggccggtcagaggtcaggatggacgagaggctgcctgatgcagttttcaaggttgcatctgttgctgaagctcacctgcacaaggcgcgcgagttggcctcatctgtgccaagagaggcaatcccagtgctccttccggccttgccagcccaggtcctcctagattccctgcggagatgtgagttcaatgtctttgattcgcgggtgtcgaggggagtccacggggtctctcccctctggtatcagctgaagcttaactggtactcgtggcgaaacaagtactgaatccggtcaccgttgttctttgaacgaactgctggttgttgtcgttccttgtagcaaagctgacctcatggttttgctgtaagattgaagaagatgagcagtgtctgctaatcgctccaaccggtcacctttgagcattttttttaagcttgctgtacaatctcccacacactgttgggaagtttatgttgtttccaaaataccgtttttacatgaagcagatgaatctgtgttgtttactactggtactgaggatccgttgtgcttctggtctcctttcacaatacatgtatccttcgatatttatattttatatgaccctctagccttgctaa

SEQ ID NO: 6174 - DNA, 1263 bp, Panicum virgatum
  misc_feature (1037)..(1037): n is a, c, g, or t
gagatccatccataccatactccatcatcatctctctccgtctcggcgatcgccgccgccgccgccgtctccgcggaccttgttcgcacctgacaacaggattcatgagcgccacgcctgcagcaagcgctagcctacgagcagctctctcatactgcgttaggcaagtccgcagctatgactaccaccactatctgtgccttctccacctgcccccagccgtgcgcaaggctgcattcacctttcgggccttcaacgtcgagacggcaaaagccatggatgttgtgtcggaccctaagactggcctcatgcgcctactctggtggaaggacgtgatcgacaaggtctttgccaacaagctggttgagcaccccgttgcccaggcactctcttcagttgtttcggaccacaaggttagcaagcattggctcaagaggtccgtggatgcaaggataaacgacgcaaccgtgatgagggtgccattcctgagacaagtgctgagctggagaggtatgctgaagacacccagtccaccatcctttacatgacgctgcaggctggtggtatacagtccactgtcgctgatcacgccgcctcgcacatcggcaaagccagcggtctcttgttactgctcaaggcactccctcaccatgtaaataagcaaggggtgataccgtatatcccagctaatatcgccaaggagtgcggcctgcttacacgggagggtggccggtcggaggtcaggatggacgagaggctgcctgatgcagttttcaaggttgcatctgttgctgaagctcacctgcacaaggcgcgcgagttggcctcatctgtgccaagagaggcaatcccagtgctccttccggccttgccagcccaggtcctcctagattccctgcggagatgtgagttcaatgtctttgattcgcgggtgtcgaggggagtccacggggtctctcccctctggtatcagctgaagcttaactggtactcgtggcgaaacaagtactgaatccggtcaccgttgttctttgaangaactgctggttgttgtcgttccttgtagcaaagctgacctcatggttttgctgtaagattgaagaagatgagcagtgtctgctaatcgctctaaccggtcacctttgagcattttttttaagcttgctgtacaatctcccacacactgttgggaagtttatgttgtttccaaaataccgtttttacgtgaagcagatgaatctgtgttgtttactactggtactg

SEQ ID NO: 6175 - DNA, 1266 bp, Panicum virgatum
  misc_feature (1183)..(1183): n is a, c, g, or t
gtctcaaaaaaaaaaaaaaaaaaatctctccccgtctcgccgccgccgcccgaccgccgtctccggcgacgcaccggaccttattcacacctgatacaggattcatgagcgccacacctgcagcaagcagtagcctacaagcagctctctcatactgtgttaagcaagtccgcagctatgactaccaccactatctgtgccttctccacctgcccccagccatgcgcaaggctgcattcacctttcgggccttcaacgtcgagacagcaaaagccatggacgttgtgtcggaccctaagactggcctcatgcgcctcctctggtggaaggaagtgatcgacaaggtctttgccaacaagctggttgagcaccccgttgcccaggcactctcttcggttatttcggagcacaaggttagcaagcattggctcaagaggtctgtggaggcaaggataaatgacgcaacggtgatgagggtgccattcctgagacaagtgctgagttggagaggtatgctgaagacacccagtccaccatcctttacatgacgctgcaggctggtggtatacagtccactgtcgctgatcacgccgcctcgcacatcggcaaagccagtggtctcttgttactgctcaaggcactgcctcaccatgtaaataagcaaggggtgattccgtatatcccagctaatatcgccgaggagtgcggcctgcttacacgggatggtggccggtcggaggtcaggatggacgagaggctgcctgatgcagttttcaaggttgcatctgttgccgaggctcacctgcacagggcacgggacctggcctcgtctgtgccaagagaggcaatcccagtgctccttccagccttgccagcccaggtcctcctagattccctgcggagatgtgagttcaatgtctttgattcgcgggtgtcgaggggagtccacggggtctctcccctgtggtatcagctgaagcttaactggtatgcatggcgaaacaagtactgaatccagccatctttgttctttggaatgaactgctggttgttgttccttgtagcaaagcttccctcatggttttgctgtaagattcaagaagatgaacagtgtgtgctaattgctccaaccgatcacctttgagcattcttttttttttgcttgctgtacaatctcccacanactgttgggaagtttttgttgtttccagtaccgtttttacatgaagcaggtgaatctgtggtgtgtactactggtactgagga

SEQ ID NO: 6176 - DNA, 1534 bp, Panicum virgatum
gtacagaccgtcgaactccccgtctcaaaaaaaaaaaaatctctccccgtctcgccgccgccgcccgaccgccgtctccggcgacgcaccggaccttattcacacctgatacaggattcatgagcgccacacctgcagcaagcagtagcctacaagcagctctctcatactgcgttaagcaagtccgcagctatgactaccaccactatctgtgccttctccacctgcccccagccatgcgcaaggctgcattcacctttcgggccttcaacgtcgagacagcaaaagccatggacgttgtgtcggaccctaagactggcctcatgcgcctcctctggtggaaggaagtgatcgacaaggtctttgccaacaagctggttgagcaccccgttgcccaggcactctcttcggttatttcggagcacaaggtaagcaagcattggctcaagaggtctgtggaggcaaggataaatgacgcaaacggtgatgagggtgccattcctgagacaagtgctgagttggagaggtatgctgaagacacccagtccaccatcctttacatgacgctgcaggctggtggtatacagtccactgtcgctgatcacgccgcctcgcacatcggcaaagccagtggtctcttgttactgctcaaggcactgcctcaccatgtaaataagcaaggggtgattccgtatatcccagctaatatcgccgaggagtgcggcctgcttacacgggatggtggccggtcggaggtcaggatggacgagaggctgcctgatgcagttttcaaggttgcatctgttgccgaggctcacctgcacagggcacgggacctggcctcgtctgtgccaagagaggcaatcccagtgctccttccagccttgccagcccaggtcctcctagattccctgcggagatgtgagttcaatgtctttgattcgcgggtgtcgaggggagtccacggggtctctcccctgtggtatcagctgaagcttaactggtatgcatggcgaaacaagtactgaatccagccatctttgttctttggaatgaactgctggttgttgttccttgtagcaaagcttccctcatggttttgctgtaagattcaagaagatgagcagtgtgtgctaattgctccaaccgatcacctttgagcattcttttttttgcttgctgtacaatctcccacacactgttgggaagtttttgttgtttccagtaccgtttttacatgaagcaggtgaatctgtggtgtgtactactggtactgaggatacgttgcgcttctgggctcctttcacattacgtgtatccttcgacatttattttatgttatggccatctagccttgctaattgattattatgctctgcaaggcttgcttgaacgttacgaatacagtttgtgattttcccaatcgattgaggctccaggagtggagtcggccggcggcggcttagcaggacacaggagcaggcgattctgcctgtgatgtgatcgcgctcccctacacagcctgcaggggccg

SEQ ID NO: 6177 - DNA, 4096 bp, Panicum virgatum
cggaggcccacgtccgctcttctggccctcttcttcaaccccgttcgtcttccttcccgtctgtctgcttccggagggatgtctgcgccccgaaccaaaaccctaggtatcccagttcttgaagcccgaggggaggagatggcggcggcggatgggcgcagcagcgacggtggcggtggtcggatccaccggctggaggtggagaacttcaagtcgtacaagggtacgcagacgattggacccttcttcgatttcacggccatcatcggccccaacggcgccggcaagtcgaatcttatggacgccatcagcttcgtgcttggcatgcgcacagcgcaactccgcggcgcgcagctcaaggacctcatctacgccctcgacgaccgcgacaaggaggctaagggccgcagggcttccgtcggcctcgtctaccgccaacccaaccaggaggagctccacttcacccgcaccatcaccggcgcaggcggcagtgagtaccgcatcgacggccgccttgtcacctgggacgagtataacgccaagctcagatccctcggcatcctcgtcaaggcccgcaatttcctcgtcttccagggtgatgtggaatccatcgcctccaagaaccccaaggagctcactgcgcttctggagcagatctcaggctccgatgagcttaggagggagtatgacgaactcgaggagcagaaagccagggccgaagagaactctgcgcttgtctatcaagagaaaaggaccattgtcatggagcggaagcagaagaaggcgcaaaaagaagaggcagagaagcacctacgcctccagcaggacctgaaacggttgaagacagagcattccctgtggcaactctataccatcgagaaagacagagagaaattggaggctgagcttgcagaggacagagagtcccttcagcaagtgcaggaagagaatcaatctgctgaaaatgaactaactgcaaaaaagaaggagcaaagtgcttttctcaagaaaatgacattgtgcgaaaagagtatagccaagaaaaagcttgaactagacaagaagctacctgagcttcttaaattgaaagaacaaatctctcggctcaaatcaaaaatcaaaagttgcaagaaagagattgacaaaaagaaggatgataacaagaagcatctggaagagatgagaaggctgcagagtgctctagttgatgtcacaaaagctattgaggaattgaatgagcaaggacaagataaaagtggaaaactgcagttagctgacgaccaactccaggagtatcatagaattaaggaggatgcaggaatgaagacagcaaagctaagagatgagaaggaagtcatagacaaaaagttaaatgctgatgttgaagcaaaaaagaatttagaggagaacatgcagcagctgcgtagccgtgaggatgagatatcgtcacaggagactgaattgcagacaagacttgacaagattcttcattccatccccaaacatgaaaatgagctcacacacttgcgtgaggaacataccagaattgcaaaggaacgccaatcatcaggatctaggtaccaaacactgaagcaaagggtggatgaaatagatacacaactacgagagcttaaagctgataagcatgaaagtgagcgtgacgctcgattaaaggaaactgttggaagtctaaagcggctattccctggagtccatggtcgcatgcacgaactttgtaggccctcacaaaagaaatataatcttgcagttactgttgccatggggaaattcatggatgcagttgtagtggaagatgaaaacaccggaaaggaatgcattaagtatctgaaggagcagcgtcttcctccacagacatttattcccttgcaatctgtccgtgtgaagccaatagttgagaagctgcgaacccttggtggatctgcacagttggtttttgatgtcattcaatttgatcgagctttggagaaagcagttctgtatgcggttggaaatacacttgtctgtgataaacttgatgaagctaaaaccttaagttggagtggtgaaaggtataaagttgttactgtcgatgggattctgctgacaaaatctggcacgatgactggtggaataagtgggggaatggaagctagatcaaacaaatgggatgatagcagaatagaatctttgaagaagaaaaagaatcatctggaatctgaaatgtcagaacttgggtcgcccagggagttgcagagaaaggagcttgccatatctgagaaaataactggacttgagaaaaagttgcattacttgaatgttgaacagaataacctcagagctaagctactcaaattggcatctgagaggagtaatattgaggaagagattaatcgtctggagcctggaaaggaggagctcgagacccgtctagctgagaaagaagcagaagtaagaaagcttgagaaaaaaatcaatgagatcgtggacaaggtgtacagagactttagcatttcagttggtgttaagaatatccgcgagtatgaagaaaggcaactaaaagatgctcaagcactgcaggagaggaagctgagcctaagtaatcagatgtcaaaattgaaatatcagcttgaatatgaacaaaagcgagatatgcaggcaccaattatgaagttaagggagacatttgagtccctagaaaaagagcttaagggcttacaggagagagagtctggtgctaaggctgaagctgaagaaatttcgactcagatggatgaactgaaagctgaggctgaagactggaaatccaagtcagacgaatgtgagaaggttattgatgaattgaaggagcagaatggtaacgttacatctacattggcaaagttggatcgccaagtgaagtcaaaggagggacaagtcgtgcaacttatatcacgccaacgggagattcatgagaagtgtgaactggagcagttgaagcttcctacagtgaatgatccaatggataccgggtcatcctcagaagaaccagtttttgattacagtcagcttaaagaaatctatctgcaggatatgcgaccatctgaacgtgacaaacatgaggcagagttcaaacaaagaacaggtgcacttttagctgatattgagcgcactgctcccaatctaaaagcactagatcaatatgatgcgctccaaagaaaggaaaaggaggttacggagaagtttgaggcagctaggaaagaagagcgagagatatctgataaatataactctgtcaagcaaaggaggtatgaactgttcatgaaggcctttgatcacatatctaaaggcatagacagaatctataagcagttgacaaaaagtcacacacatccacttggaggaacagcgtatttaaacctagaaaatgaagacgaaccatttctacatggaatcaagtacacagctatgccaccaaccaaacggtttagagatatggaacagttgtccggtggggagaagactgtcgcagcactggctttgctttttgccattcacagtttcaggccatcacccttcttcatattggatgaagtagacgcagctctggacaatttaaatgttgccaaggttgctgggtttatcagatcaaagtcatgtgagcgtgtgactggtgaacaaggtgggggtggagaatctggattccagagtatagtcatatcgctgaaggatagtttctatgacaaagctgaagcactggttggtgtttatagagactcagaacgaagctgctcgagaactctcaccttcgacctgactaagtatagggaagcgtgaagcaacgttctttggatgcatctgcttgttagctctcctgaacaacgctttaacttttgccctaaaaaaacaacaacgccgctttaacttgtgtacataagtgattagtcatcagatgtattttttttaataaacctcgttgtgtgcagttgactcagaaacattagattgctgtatgagctggaaatgtctttgtggattgtgatgtttgtttgtacataagccatttgctgaaaaagcacccttgtatttttgattcatgtggccaggcttaactgtttac

SEQ ID NO: 6178 - DNA, 4088 bp, Setaria italica
accgaaaccctagcttgaaggtggagggaagaagatggcggcggcggcggctgaggatgggcgcaccagcgacatccggtccaggggcgacggtggcggcggtcggatccaccggctggaggtggagaacttcaagtcgtacaagggtacgcagacgattgggcccttcttcgatttcacggccatcatcggccccaatggcgccggcaagtcgaacctgatggatgccatcagcttcgtgctcggcgtgcgctcagcgcacctccgcggcgcgcagctcaaggacctcatctacgccctcgacgaccgcgacaaggaggccaagggtcgcagggcttccgtccgcctcgtctaccgccaacccaaccaggaggagctccacttcacccgcaccatcaccggcgccggcggcagtgagtaccgcatcgacggccgccttgtctcctgggacgactacaacgccaagctcagatccctcggcatcctcgtaaaggctcgcaacttcctcgtcttccagggtgatgtggaatccatcgcctccaagaaccccaaggagctcaccgcgcttctggagcagatctcaggctccgatgagcttaggagggagtacgacgagctcgaggagcagaaagccagggccgaagagaactctgcgcttgtctatcaagagaaaaggaccattgtcatggagcggaagcagaagaaggcgcaaaaagaagaggcagagaatcatctacgccaccagcaggacctgaaactgttgaagacagagcattccctgtggcaactctataccatcgaaaaagacagagagaaaatggaggctgagcttgctgaggacagagagtctcttcagcaagtgcaggaagagaatcaatctgctgaaaatgaactaactgcaaaaaagaaggagcaaagtgcttttctgaagaaaatgacattgtgcgagaagagtatagccaagaaaaagcttgaactcgacaagaagcaacctgagcttcttaaattgaaagagcaaatatctcggctcaaatcaaaaatcaaaagttgcaagaaagagattgacaaaaagaaggatgatagcaagaagcatctggaagagatgagaaggctggaaagtgctctagttgatgtcagaaaagctcttgaggaattgaatgagaaaggacaagataaaagtggaaaactgcagttagctgacgaccagctccaggagtatcatagaattaaggaggacgcaggaatgaagacagcaaagttgagagatgaaaaggaagttatagacaaaaaattaaatgcttacgttgaagcaaaaaagaatttagaggagaacatgcagcagctgcatagccgtgaggaagagctatcatcacaagagcgtgaattgcagacaagaattaacaagattcttcattccatcccgaaacatgaaaatgagcttgcacaattgcgtgaggaacataacagaattgcaaaggaacgccaatcttcaggatctaggtaccaaacactgaagcagagggtggatgaaattgatacacaactacgggagcttaaagctgacaagcatgaaagtgagcgcgatgctcgattgaaggaaactgttggtagtctaaagcggttattccctggagtccatggtcgcatgcatgaactttgtaggccctcacagaagaaatataatcttgctgttaccgttgccatggggaaattcatggatgcagttgtagtggaagatgaaaacacgggaaaggaatgcattaagtacctgaaggagcagcggcttcctcctcagacatttattcccttgcaatcagttcgcgtgaagccaataattgagaagctgcgaacccttggtggatctgcgcagttggtttttgatgtcattcagtttgaccgagctttggagaaagcagttctgtatgctgttggaaatacacttgtctgtgataaacttgacgaagccaaaaccttaagttggagtggtgaaaggtataaagttgttaccgttgatgggattctgctgactaaatctggcactatgactggtggaataagtgggggaatggaagcaagatcaaacaaatgggatgatagcagaatagaatctttgaagaagaagaaaaatcagctggaatctgaaatgtcagagcttgggtctcccagggagttgcagagaaaggagcttgccatatctgagaaaataactggacttgagaaaaagttgcagtacttgaatgttgaacatagtaacctcacagcgaagctactcaaagtggcatcggagaggaataatattgaggaagagattaatcgtctggagcctgaaaaggaggagctcgagatccgtcttgctgagaaagaagcagaagtaaccaagcttgagaaaaaaatcaatgagattgtggacaaggtgtacagagattttagcatttcagttggtgtgaagaatatccgcgagtatgaagaaaggcaactaaaagatgctcaagcactgcaggagaggaagctgaccctaaacacccaaatgtcaaaattgaaatatcagcttgaatatgaacaaaagcgagatatgcaagcaccaattgtgaagttaagggagacatatgagtctctagagaaagagcttaagggcttacaggagagagagtctggtgctaaggttgaagctgaagaaattttgactcagatggatgaactgaaagctgaggctgaagactggaaatccaagtcagatgaatgtgagaaggttattgatgaactaaaggagcagaatggtagtattgcatctacattggcaaagctggatcgccaagtgaagtcaaaggaggggcaactcctgcaactcatgtcacgccaacgggatatttatgagaagtgtgaactggagcagttgaagcttcctacagtgaatgatccaatggataccgggccatcctcccaagaaccggtccttgattacagccagctcagcgaaatctatctgcaggatatgcggccgtctgaacgtgacaaacatgaggcagtgttcaaacaaaaaacaggtgcgcttttagctgaaatcgagcgcactgctcccaatctaaaagcactggatcaatatgatgcactccaaagaaaggaaaaggagattacagaaaagtttgaggcaactaggaaagaagagcgagagatatctgataaatataactccatcaagcaaaggaggtatgaactgttcatggaggcctttgatcacatatctaaaggcatagacaaaatctataagcagctgacaaaaagtcatacgcatccacttggaggaacagcatatttgaacctagaaaatgaagacgaaccatttctacatggaatcaagtacacagcaatgccacctaccaaacggtttagagatatggaacagttatccggtggggagaagactgtcgcagcactggctttgctttttgctattcacagtttcaggccatcacccttcttcatattggatgaagtagatgctgctctggacaatttaaatgttgccaaggttgctgggtttatcagatcaaagtcatgtgagcgtgttgctgatgaacaaggtaggaatggagaatgtggattccagagtatagtcatatcgctgaaggatagtttctatgacaaagctgaagcactggtcggcgtttatagggactcagaacgaagttgctcgagaactctcaccttcgatctgactaagtacagggaagcgtgaagcaacatgtaattgcctatctgcttgctagctgtccagaataacgctgtaacttgtgtacataagtgattagtcatctcatgtagtgttttttttttcttttaaaacctcgtcgcgtgtagttagactcaaacatgaaggttgctgtatgggctgatgtctttgtgaattgtgatgctgtccataagctatttgctgggaaagaaacatttacaggtcatggttgagggaatggccaccaaatatggtgatagtagattggggcaaacaaacataaccgctaggttatgctggaggccaaataacatctgaattttaaattttcatagcaaacatgagatatctatgagtg

SEQ ID NO: 6179 - protein, 588 aa, Arabidopsis lyrata
MKIFPCFAGLIRRKKNKGNSKPLPPKTQRILQIRLEEPVKPLENDEPNIAGYDKGSPIKHEPYDGEDERDDKDSTNREFPEFQVHERAVESLKSKEEVTDTSENGDDDDDEGGHVSDPGLGRATSWVTSPKLKRSCSTLSKFNGRFHGSDLHDLRETVPVSNESVKSHKSADRVMLKKHSSMQILPSGSRRLWWKLFLWSHRNLHKHRVSLKSQPLNKHHQSGYTSDFAEHNQSSHEEESTNNCADFTNQSSNLWPRHNQWVAFSAESSSMKRVDEWVRGLDVETAAVPINEDRDVLASFPTSPNTERSPFGNVVQSGNVTEAIVHANSLIQSMSKSSSVAHISSIGLKAIPCISHFTSLKSIDLSNNFIVQITPASLPKGLHALNLSKNKISVIEGLRDLTRLRVLDLSYNRISRIGQGLSNCTLIKELYLAGNKISNVEGLHRLLKLIVLDLSFNKIATTKAIGQLVANYNSLVALNILGNPIQSNVGEDQLRKTVSSLLPKLVYLNKQLIKPQRAREVLKDSVARAAFGGGDSLHHRRKRTSTNKVVGAASPSVHHRGHIAKGRGSKNRSQHQLRKTSAAESPLH

SEQ ID NO: 6180 - protein, 213 aa, Arabidopsis lyrata
MGWYTSFIAALAFLAVGVIFSPETFGSLSNGENSEKLSIFLKLAHLLSFATAWGAALWATFIGGIIMFKNLPRHQFGNLQSKMFPAYFTLVGSCCAISLSAFGYLHPWKSSSTVDKYQLGFLLSAFAFNLTNLFVFTPMTINMMKERHKVERENNIGDEVGWSKNREKAKTIPKLAAMNKKFGMIHGLSSLANIFSFGSLAMHSWYLAGKLNL

SEQ ID NO: 6181 - protein, 213 aa, Unknown
  Sequence found in Organisms: Brassica napus, Brassica rapa
MGWLTRFLTAVAFLAAGVIFSPETFGSLSKGENPAKVLIFVKLAHLLSFATAWGAALWATFIGGIIMFKNLPRHQFGNLQSKMFPAYFTLVGSCCAISLSAFGYLHPWKSSSTVEKYQLGFLVSAFAFNLTNLLVFTPMTIDMMKQRHKVERENNIGDEVGWSKNREKAKTIPKLAAMNKKFGMIHGLSSLANIFSFGSLAMHSWYLAGKLDL

SEQ ID NO: 6182 - protein, 213 aa, Eutrema parvulum
MGWLTRFLAAVAFLAAGVIFSPETFGSLSNGENSAMLLIFLKLAHLLSFATAWGAALWATFIGGIIMFKNLPRHQFGNLQSKMFPAYFTLVGSCCAISLSAFGYLHPWKSSSAVEKYQLGFLLSAFAFNLTNLFIFTPMTIDMMKQRHKVERENNIGDEVGWSKNKEKAKTIPKLAAMNKKFGMIHGLSSLANIFSFGSLAMHSWYLAGKMDL

SEQ ID NO: 6183 - protein, 213 aa, Brassica juncea
MGWLTRFLTAVAFLAAGVIFSPETFGSLSKGENPAKVLILVKLAHLLSFATAWGAALWATFIGGIIMFKNLPRHQFGNLQSKMFPAYFTLVGSCCAISLSAFGYLHPWKSSSAVEKYQLGFLVSAFAFNLTNLFVFTPMTIDMMKQRHKVERENNIGDEVGWSKNREKAKTIPKLAAMNKKFGMIHGLSSLANIFSFGSLAMHSWYLAGKLDL

SEQ ID NO: 6184 - protein, 213 aa, Brassica napus
MGWLTRFLAAVAFLAAGVIFSPETFGSLSKGENPAKVLIFVKLAHLLSFATAWGAALWATFIGGIIMFKNLPRHQFGNLQSKMFPAYFTLVGSCCAISLSAFGYLHPWKSSSIVEKYQLGFLVSAFAFNLTNLLVFTPMTIDMMKQRHKVERENNIGDEVGWSKNREKAKTIPKLAAMNKKFGMIHGLSSLANIFSFGSLAMHSWYLAGKLDL

SEQ ID NO: 6185 - protein, 213 aa, Eutrema halophilum
MGWLTRFLAAVAFLAAGIIFSPETFGSLSKGENSAKLLIFLKLSHLLSFATAWGAALWATFIGGIIMFKNLPRHQFGNLQSKMFPAYFTLVGSCCAISLSAFGYLHPWKSSSAVEKYQLGFLLSAFAFNLTNLLVFTPMTIDMMKQRHKVERENNIGDEVGWSKNREKAKTIPKLAAMNKKFGMIHGLSSLANIFSFGSLAMHSWYLAGKMDL

SEQ ID NO: 6186 - protein, 210 aa, Brassica juncea
MGWLTRFLAAVAFLAAGVIFSPETFGSLSKGENSAKVLILVKLAHLLSFATAWGAALWATFIGGIIMFKNLPRHQFGNLQSKMFPAYFTLVGSCCAISLSAFGYLHPWKSSSTVEKYQLGFLVSAFAFNLTNLLVFTPMTIDMMKQRHKVERENNIGDEVGWSKNREKAKTIPKLAAMNKKFGMIHGLSSLANIFSFGSLAMHSWYLAGK

SEQ ID NO: 6187 - protein, 213 aa, Brassica oleracea
  misc_feature (113)..(114): Xaa can be any naturally occurring amino acid
MGWLTRFLAAVAFLAAGVIFSPETFGSLSKGENPAKVLIFVKLAHLLSFATAWGAALWATFIGGIIMFKNLPRHQFGNLQSKMFPAYFTLVGSCCAISLSAFGYLHPWKSSSXXEKYQLGFLVSAFAFNLTNLLVFTPMTIDMMKQRHKVERENNIGDEVGWSKNREKAKTIPKLAAMNKKFGMIHGLSSLANIFSFGSLAMHSWYLAGKLDL

SEQ ID NO: 6188 - protein, 210 aa, Brassica juncea
MGWLTRFLTAVAFLAAGVIFSPETFGSLSKGENPAKVLIFVKLAHLLSFATAWGAALWATFIGGIIMFKNLPRHQFGNLQSKMFPAYFTLVGSCCAISLSAFGYLHPWKSSSTVEKYQLGFLVSAFAFNLTNLLIFTPMTIDMMKQRHKVERENNIGDEVGWSKNREKAKTIPKLAAMNKKFGMIHGLSSLANIFSFGSLAMHSWYLAGK

SEQ ID NO: 6189 - protein, 213 aa, Raphanus sativus
MGWLTRFLTAVAFLAAGVIFSPETFGSLSKGENSAKVLILVKLAHLLSFATAWGAALWATFIGGIIMFKNLPRHQFGNLQSKMFPAYFTLVGSCCAISLSAFGYLHPWKSSSSVEKYQLGFLVSAFAFNLTNLLVFTPMTIDMMKQRHKVERENNIGDEVGWSKNREKAKTIPQLAAMNKKFGMIHGLSSLANIFSFGSLAMHSWYLAGKMDL

SEQ ID NO: 6190 - protein, 213 aa, Raphanus sativus
MGWLTRFLTAVAFLAAGVIFSPETFGSLSKGENSAKVLILVKLAHLLSFATAWGAALWATFIGGIIMFKNLPRHQFGNLQSKMFPAYFTLVGSCCAISLSAFGYLHPWKSSSAVEKYQLGFLVSAFAFNLTNLLVFTPMTIDMMKQRHKVERENNIGDEVGWSKNREKAKTIPQLAAMNKKFGMIHGLSSLANIFSFGSLAMHSWYLAGKMDL

SEQ ID NO: 6191 - protein, 118 aa, Raphanus sativus
MGWLTRFLTAVAFLAAGVIFSPETFGSLSKGENSAMVLILVKLAHLLSFATAWGAALWATFIGGIIMFKNLRGISSVTFRARCFQLISLLLVLAVLFHSLPLGICIHGSLLLLLRSIS

SEQ ID NO: 6192 - protein, 213 aa, Raphanus sativus
  misc_feature (4)..(4): Xaa can be any naturally occurring amino acid
  misc_feature (113)..(113): Xaa can be any naturally occurring amino acid
  misc_feature (141)..(141): Xaa can be any naturally occurring amino acid
  misc_feature (166)..(166): Xaa can be any naturally occurring amino acid
  misc_feature (192)..(192): Xaa can be any naturally occurring amino acid
MGWXTRFLTAVAFLAAGVIFSPETFGSLSKGENSAMVLILVKLAHLLSFATAWGAALWATFIGGIIMFKNLPRHQFGNLQSKMFPAYFTLVGSCCAISLSAFGYLHPWKSSSXVEKYQLGFLVSAFAFNLTNLLVFTPMTXDMMKQRHKVERENNIGDEVGWSKNXEKAKTIPQLAAMNKKFGMIHGLSSLXNIFSFGSLAMHSWYLAGKMDL

SEQ ID NO: 6193 - protein, 213 aa, Unknown
  Sequence found in Organisms: Citrus clementina, Citrus sinensis
MAWLTRFLAAVAFLAIGVIFSPETFGSKSDGLNSSKLSPFLKLAHLLCFSTAWGAALWVTFIGGIIMFKNLPRHQFGNLQSKMFPAYFSLVGVCCSIAVASFAYLHPWKSSSTAEKYQLGFLLSAFAFNLTNLFVFTPMTIEMMKQRHKVEREENIGDEVGWTKNREVAKSNPKLAAMNKKFGMIHGLSSLANIMSFGSLAMHSWYLAGKINL

SEQ ID NO: 6194 - protein, 215 aa, Cleome spinosa
MAWLTRFLAAVAFLAMGVIFSPETFGSKSDGENPAKVTASALLKLAHLLSFSTAWGAALWATFFGGIIMFKNLPRHQFGNLQSKMFPAYFTLVGTCCAISLAAFGYLHPWKSSSAVEKYQLGFLLSAFAFNLANLFVFTPMTIETMKQRHKVEKENNIGNEIGWSKNQEVAKSNPKLAAMNKKFGMIHGLSSLANIMSFGCLAMHSWYLAGKIHL

SEQ ID NO: 6195 - protein, 213 aa, Cleome spinosa
MAWLTRLLAAVAFLAVGVIFSPEIFGSKSDGENPAKVTALLKLAHLLSFSTAWGAALWVTFIGGIIMFKNLPRHQFGNLQSKMFPAYFTLVGICCAISLAAFGYLHPWKSSSAVEKYQLGFLLSAFAFNLSNLLVFTPMTIEMMKQRHKVEKENSIGTEIGWSKNQEVAKSNPKLAAMNKKFGMIHGLSSLANIMSFGSLAVHSWYLAGKINL

SEQ ID NO: 6196 - protein, 213 aa, Theobroma cacao
MAWITRFLTAVAFLAVGVIFSPETFGSKLDGPNSPKLSTFIKLAHLLSFATAWGAALWVTFIGGIIMFKNLPRHQFGNLQSKMFPAYFSMVGVCCAIAVAAFGYLHPWKSATTAEKYQLGFLVSGFAFNLSNLLVFTPMTIEMMKQRHKVEKEQNIGDEIGWSKNQEAAKSNPKLAAMNKKFGMIHGLSSLANIMSFGSLAMHSWYLAGKLNL

SEQ ID NO: 6197 - protein, 212 aa, Arachis hypogaea
MGWVTRFLTAVVFLAVGVIFSPETFRSNSDSAASRISTYLKLSHLLCFSTAFGAALWVTFIGGIIMFKNLPRHQFGNLQSKMFPAYFSMVGVCCAISVASFGYLHPWKSSSTTEKYQLGFLLSSFAFNLTNLFVFTPMTIEMMKQRHKVERENNIGEEVGWSKNVEVAKKNPKLAAMNKKFGMIHGLSSLANIMSFGSLAMHSWYLAGKLNL

SEQ ID NO: 6198 - protein, 213 aa, Euonymus alatus
MGWLTRFLAAVAFLAVGVLFSPEIFGSKSDGQKSSHLSTYLKLAHLLCFSTAFGAALWVTFIGGIIMFRNLPRHQFGNLQSKMFPAYFSLVGACAAISVASFGYLHPWKSASTVEKYQLGFLLSSFAFNLTNLFVFTPMTIEMMKQRHKVEREQNIGDEVGWSKNREAAKANPKLAAMNKKFGMIHGLSSLANIMSFGSLAMHSWYLAGKMNL

SEQ ID NO: 6199 - protein, 213 aa, Tripterygium wilfordii
MGWLTRFLAAVAFLVVGVIFSPETFGSKSDGQKSSNLSTYLKLAHLLSFSTAFGAALWVTFIGGIIMFRNLPRHQFGNLQSKMFPAYFLLVGACAAISVASFGYLHPWKSASTAEKYQLGFLLSSFAFNLTNLFVFTPMTIEMMKQRHKVEREQNIGDEVGWSKNREAAKVNPKLAAMNKKFGMIHGLSSLANIMSFGSLAMHSWYLAGKMSL

SEQ ID NO: 6200 - protein, 171 aa, Pteridium aquilinum
MAWITRFLTAVAFLAVGVIFSPETFGSKLDGPNSPKLSTFIKLAHLLSFATAWGAALWVTFIGGIIMFKNLPRHQFGNLQSKMFPAYFSMVGVCCAIAVAAFGYLHPWKSATTAEKYQLGFLVSGFAFNLSNLLVFTPMTIEMMKQRHKVEKEQNIGDEIGWSKKSRSCKV

SEQ ID NO: 6201 - protein, 214 aa, Quercus alba
MGWLTRFLGAVAFLAVGVIFSPETFGSKSDGENSTSKLAIYLKLAHLLCYATAFGTALWVTFIGGIIMFKNLPRHQFGNLQSKMFPAYFSMVGICCAVSVGSFAYLHPWKSSSTTEKYQLGFLLSAFAFNLANLLVFTPMTIEMMKQRHKVERESNIGEEVGWSKNVEVAKVNPKLKAMNKKFGMIHGLSSLANIMSFGSLAMHSWYLAGKLNL

SEQ ID NO: 6202 - protein, 213 aa, Unknown
  Sequence found in Organisms: Gossypium hirsutum, Gossypium raimondii
MAWITRFLTAVAFLAVGVIFSPETFGSKSDGTKSPNLSSFIKLAHLLSFSTAWGAALWVTFIGGIIMFKNLPRHQFGNLQSKMFPAYFSMVGVCCAISVAAFGYLHPWKSATMPEKYQLGFLVSAFAFNLSNLFVFTPMTIEMMKQRHKVEREANIGDEIGWSKNQEAAKTNPKLAAMNKKFGMIHGLSSLANIMSFGSLAMHSWFLAGKLNL

SEQ ID NO: 6203 - protein, 213 aa, Tripterygium wilfordii
MGWLTRFLAAVAFLAVGVIFSPETFGSKPDGQKSSHLSTYLKLAHLLSFSTAFGSALWVTFIGGIIMFKNLPRHQFGNLQSKMFPAYFSLVGACAAISVASFGYLHPWESASTVEKYQLGFLLSSFAFSLTNLFVFTPMTIEMMKQRHKVEREQNIGEEVGWSKNREAAKVNPKLATMNKKFGMIHGLSSLANIMSFGSLAMHSWYLAGKMNL

SEQ ID NO: 6204 - protein, 208 aa, Cirsium arvense
MGWMTRFLTAVAFLAIGVIFSPETFGSKSAKITTLVKLAHLLCFSTAWGAALWVTFIGGIIMFKNLPRHQFGNLQSKMFPAYFMMVGICCAVSVGCFGYTHPWKSSSTAEKYQLGFLLSAFAFNLTNLFVFTPMTIEMMKQRHKVERESNIGEEVGWTKNQEVAKVNPKLAAMNKKFGMIHGLSSLANIMSFGSLAMHSWYLAGKIDL

SEQ ID NO: 6205 - protein, 208 aa, Cynara scolymus
MAWMTRFLTAVAFLAIGVIFSPETFGSKSAKITTFVKLAHLLCFSTAWGAALWVTFIGGIIMFKNLPRHQFGNLQSKMFPAYFMMVGICCAVSVGCFGYTHPWKSSSTAEKYQLGFLLSAFAFNLTNLFVFTPMTIEMMKQRHKVERESNIGEEVGWTKNQEVAKVNPKLAAMNKKFGMIHGLSSLANIMSFGSLAMHSWYLAGKIDL

SEQ ID NO: 6206 - protein, 213 aa, Eucalyptus grandis
MGWLTRFLAAVAFLAVGVIFSPETFGSTSDGSKSPTAATLLKLAHLLGFATAWGAALWVTFIGGIIMFKNLPRHQFGNLQSKMFPAYFTMVGVCCAMSVASFGYLHPWKSSSSTEKYQLGFLLSAFAFNLTNLFVFTPMTIEMMKQRHKVEKEENIGNEVGWSKNVEVAKVNPKLAAMNKKFGMIHGLSSLANIMAFGSLAIHSWYLASKINL

SEQ ID NO: 6207 - protein, 213 aa, Vitis vinifera
MGWLTRFLGAVTFLAVGVIFSPETFGSKSDGSHSSKLTAALKLAHLLCFATAWGAALWVTFIGGIIMFKNLPRHTFGNLQSKMFPAYFSMVGVCCAVSTASFGYLHPWKSSSTAEKYQLGFLLSAFAFNLTNLLVFTPMTIEMMKQRHKVEREQNIGEEIGWSKNKEVAKVNPKLAAMNKKFGMIHGLSSLANIMSFGSLAMHSWYLAGKMDL

SEQ ID NO: 6208 - protein, 213 aa, Humulus lupulus
MGWLSRFLTAVTFLAIGVIFSPESFGSKSDGSNSPKIYTYLKLAHLLCFSTAWGAALWVTFIGGIIMFKNLPRHQFGNLQSKMFPAYFSMVGTCCAVSVASFGYLHPWKTSATTEKYQLGFLLSAFAFNLTNLFVFTPMTIEMMKQRHKVEREENIGGEVGWSKNVEVAKVNPKLAAMNKKFGMIHGLSSLANIMSFGSLAMHSWYLAGKINL

SEQ ID NO: 6209 - protein, 212 aa, Platanus occidentalis
GWITRFLAAVAFLSFGVLFSPETFGSKSEGGYPSKLSISLKLAHLLSFSTAWGAALWVTFIGGIIMFKNLPRHQFGNLQSKMFPAYFSMVGLCCAISVASFGYLHPWRSSSSAEMYQLGFLLSAFAFNLTNLFVFTPMTIEMMKQRHKIEREENIGEEVGWTKNREVAKVNPKLAAMNKKFGMIHGLSSLANIMSFGSLAMHSWYLAGKLNL

SEQ ID NO: 6210 - protein, 213 aa, Cannabis sativa
MGWLSRFLTAVTFLAVGVIFSPESFGSKSDSHHSPKIFTYIKLAHLLCFSTAWGAALWVTFIGGIIMFKNLPRHQFGNLQSKMFPAYFSMVGVCCAVSVASFGYLHPWKTSATTEKYQLGFLLSAFAFNLTNLFVFTPMTIEMMKQRHKVEREENIGGEVGWSKNVEVAKVNPKLAAMNKKFGMIHGLSSLANIMSFGSLAMHSWYLAGKLNL

SEQ ID NO: 6211 - protein, 212 aa, Carpinus betulus
GWLTRFLAAVAFLAIGVIFSPETFGSQSDGQNSTKFAIYLKLAHLLCFSTAFGSALWVTFIGGIIMFKNLPRHQFGNLQSKMFPAYFSMVGVCCAISAGSFGYLHPWKSSSTAEKYQLGFLVSSFAFNLANLFVFTPMTIEMMKQRHKVERESNIGDEVGWTKNVEVAKVNPKLAAMNKKFGMIHGLSSLANIMSFGSLAVHSWYLAGKINL

SEQ ID NO: 6212 - protein, 213 aa, Carica papaya
MAWLTRFLAAVAFLAIGVIFSPETFGSTSEGQNSSKLSVYLKLVHLLSFSTAWGAALWVTFIGGIIMFKNLPRHQFGNLQSKMFPAYFSLVGVCCALSVAAFGYSHPWKSSATAEKYQLGFLLSGFAFNLTNLFVFTPMTIEMMKKRHKVEREQNIGDEIGWTKNKEVAKVNPQLAAMNKKFGMIHGLSSLANIMAFGSLAMHSWYLAGKINL

SEQ ID NO: 6213 - protein, 208 aa, Cajanus cajan
MGWITRFITAVAFLAVGVIFSPETLGSKSNTLSTYLKLAHLLSFSTAFGAALWVTFIGGIIMFKNLPRHQFGNLQSKMFPAYFSMVGVCCAVSLASFGYLHPWKTSSTTERYQLGFLLSAFAFNLTNLFVFTPMTIEMMKQRHKVERENNIGEEVGWSKNVQVAKSNPKLAAMNKKFGMIHGLSSLANIMSFGSLAIHSWYLAGKIDL

SEQ ID NO: 6214 - protein, 208 aa, Carthamus tinctorius
MAWMTRFLTAVAFLAIGVIFSPETFGSKSAKITSFVKLAHLLCFSTAWGAALWVTFIGGIIMFKNLPRHQFGNLQSKMFPAYFMMVGICCAVSVGCFGYSHPWKSSSTAEKYQLGFLLSAFVFNLTNLFVFTPMTIEMMKQRHKVERESNIGEEVGWTKNQEVAKVNPKLAAMNKKFGMIHGLSSLANILSFGSLAMHSWYLAGKIDL

SEQ ID NO: 6215 - protein, 664 aa, Brassica napus
MVESEENGVLFPIFILTIIAIPLVPYTFVKLSRAFSKKQRSIHCQCLDCDRSGKYKRSLSHRVATFTSCSNLTVVLLWFVMIFLIYYTKNISRESQLFEPFSILGLEPGASDSQIKKAYRKLSIQYHPDKNPDPEANKYFVESIAKAYQALTDPLSRENFEKYGHPDGRQGYKLGIALPQFILDFNGESGGLLLLFTVGLCILLPLVVASIYLWRSSKYTGNYVKLQTRQAYYELMKPSLTTSKVMDVFIKAAEYTEIPVRKTDDESLKKLFASVKSELSLDPKKMKQDEAKFWKQDPAVIKAELLIHKQLTRESAVLSPALQTDFRRVLEFAPRLLEDLMKMAVIPHNEQGHGWLSPALGVIELSQCIVQAVPLSLRKLSSEGTAPFLQLPHLNESIAQKIALQVGSFKEFQDLSLEERSKLLKEVAGLSETDVADVEKVLEMIPSLKIEVTCKTEGEEGIQEGDVTTVQAWITLKRPNGLVGAVSHSPHFPFHKEENFWVILADSNNVWFFQKVSFMDEAEAISTASIAISETMESLGASAEAKNSAVEEAVEKVKTGSRLVMGRLLAPAEGTYNLTCFCLSDAWIGCDQKTSLKVEVLKRTRDVEGEAAEEGMEEEGEEDELEEEDYESEYSEDEEDKKRGSKKKVNKKESSSEESGSDED

SEQ ID NO: 6216 - protein, 303 aa, Raphanus sativus
MLSLRYSLPYLPQTKESTKLFSRRPSNVVVCAARGPRPRSPRVWKTRKRIGSISKSAKMIACIKELSNVKEEVYGALDSFIAWELEFPLVIVKKALAILEDEREWKKIIQVTKWMLSKGQGRTMGTYFSLLNALAEDNRLDEAEELWNKLFMEHLEGTPRKFFNKMISIYYKRDMHHKLFEVFADMEELGVKPNIAIVDMVGKVFLKLGMNDKYEKLMKKYPPPQWEFRYIKGRRVKVKAKQLNELSEGEGGLSSDEDKIESKTEEANQDGDDFSEEEEEGLGANQRQIGTSREPCLDHLDSF

SEQ ID NO: 6217 - protein, 315 aa, Eutrema halophilum
MLSLRYSLPYLPQTKESTKLFSKRPNNVVVCAARGPRPRHPRVWKTKKRIGSISKAAKMLSCIKELSNVKEEVYGALDSFIAWELEFPLVIVKKALAILEDEREWKKIIQVTKWMLSKGQGRTMGTYFSLLNALAEDNRLDEAEELWNKLFMEHLEGTPRKFFNKMISIYYKRDMHHKLFEVFADMEELGVKPNIAIVSMVGKVFMKLEMKDKYEKLMKKYPPPQWEFRYIKGRRIKVKAKQLSELSEGEGGVSSDEDKTDSEIESKSEMFSDEEANQDAEDLSENEEDENELFSGNQGQIGTSREFSFDHLDST

SEQ ID NO: 6218 - protein, 314 aa, Eutrema parvulum
MLCLRYSLPYLPQTKESTKLFSKRPNNVVVCAARGPRPRYPRVWKTRKRIGSISKAAKMIACIKELSNVKEEVYGALDSFIAWELEFPLVIVKKALAILEDEREWKKIIQVTKWMLSKGQGRTMGTYFSLLNALAEDNRLDEAEELWKKLFMQHLEGTPRKFFNKMISIYYKRDMHHKLFEVFADMEELGVKPNIAIVSMVGKVFMKLGMTDKYEKLTKKYPPPQWEFRYIKGRRVKVKAKQLNELSEGEGGLSSDEDNVDNDIESKSEMLSNKEAYKDVEDVSEEEEEEELLGTNQGQIGTSREPCHDHLDSS

SEQ ID NO: 6219 - protein, 304 aa, Brassica rapa
MLSLRYSLPYLPQTKESTKLFSKRPNNVVVCAARGPRPRSPRVWKTRKRIGSISKAAKMIACIKELSNVKEEVYGALDSFIAWELEFPLVIVKKALAVLEDEREWKKIIQVTKWMLSKGQGRTMGTYFSLLNALAEDNRLDEAEELWNKLFMEHLEGTPRKFFNKMISIYYKRDMHHKLFEVFADMEELGVKPNTAIVNMVGKVFLKLGMDDKYEKLMKKYPPPQWEFRYIKGRRVKVKAKQLNELSEGEGGLSSDEDKIESKSDMLSDEEANQDGEDSSEEEEKLVGMNQRQIETSREPCLDH

SEQ ID NO: 6220 - protein, 273 aa, Arabidopsis lyrata
MLSLRYSLPYLLLQTKESSTKLFSKRPNNVVVCAARGPRPRSPRVWKTRKRIGTISKAAKMIACIKGLSNVKEEVYGALDSFIAWELEFPLVIVKKALVILEDEKEWKKIIQVTKWMLSKGQGRTMGTYFSLLNALAEDNRLDEAEELWNKLFMEHLEGTPRKFFNKMISIYYKRDMHQKLFEVFADMEELGVKPNIAIVSMVGKVFVKLEMKDKYEKLMKKYPPPQWEFRYIKGRRVKVKAKQLNELSEGEGGLSSDEDKIDTEIERTKARW

SEQ ID NO: 6221 - protein, 298 aa, Brassica napus
MLSLRYSLPYLPQTKESTKLFSKRPNNVVVCAARGPRPRSPRVWKTRKRIGSISKAAKMIACIKELSNVKEEVYGALDSFIAWELEFPLVIVKKALAVLEDEREWKKIIQVTKWMLSKGQGRTMGTYFSLLNALAEDNRLDEAEELWNKLFMEHLEGTPRKFFNKMISIYYKRDMHHKLFEVFADMEELGVKPNTAIVNMVGKVFLKLGMEDKYEKLVKKYPPPQWEFRYIKGRRVKVKAKQLNELSEGEGGFSSDEDNNGDEIESKSEMLLSDKEPNKVDEPVKESLQQDTKESFQD

SEQ ID NO: 6222 - protein, 287 aa, Brassica juncea
KLFSKRPNNVVVCAARGPRPRYPRVWKTRKRIGTISKAAKMIACIKELSNVKEEVYGALDSFIAWELEFPLVIVKKALAILEDEREWKKIIQVTKWMLSKGQGRTMGTYFSLLNALAEDNRLDEAEELWNKLFMEHLEGTPRKFFNKMISIYYKRDMHHKLFEVFADMEELGVKPNIAIVHMVGKVFLKLGMNDKYEKLMKKYPPPQWEFRYIKGRRVKVKAKQLNELSEGEGGLSSDEDKTDIEIESKSEMLLDEEANQDGEDFSEEEEELVGMNQRQIEHLETMS

SEQ ID NO: 6223 - protein, 307 aa, Brassica juncea
MAVSCSHSSILLPPSTSSVGFNRFPRLQTLRFKSRNVYQKARISTVSASSSRSLEALIFDCDGVILESENLHRQAYNDAFSHFDVRCPPSSSESLNWSLEFYDKFQNLVGGGKPKMRWYFRENGWPTSTLFDTPPESDDDRAKLIDSLQDWKTERYKEIIKSGSVEARPGVIRLMDEARAAGKKLAVCSAATKSSVILCLENLIQIERFQGLDCFLAGDDVKEKKPDPSIYITAAEKLGVSVNDCLVIEDSVIGLQAATKAGMSCVITYTSSTSDQDFKEAIAVYPDLTNVSLKDLETLLQTIVTAA

SEQ ID NO: 6224 - protein, 311 aa, Raphanus sativus
MAVSCSYSSILFPRSTAGTSSIGFNRFPCLQTLRFKSRNVYPKSRASSVSASSASRSLEALIFDCDGVILESENLHRQAYNDAFSHFDVRCPPSSSESLNWSLEFYDKFQNLVGGGKPKMRWYFRENGWPTSTLFDTPPESDDDRAKLIDTLQDWKTERYKEIIKSGGVEARPGVIRLMDEARAAGKKLSVCSAATKSSVVLCLENLIQIERFQGLDCFLAGDDVKEKKPDPSIYITAAEKLGVSVKDCLVIEDSVIGLQAATKAGMSCVITYTSSTSDQDFKEAIAVYPDLSNVSLKELETLLQTIVTAA

SEQ ID NO: 6225 - protein, 307 aa, Brassica juncea
MAVSCSHSSILLPPSTSSVGFNRFPRLQTLRFKSRNVYQKARISTVSASSSRSLEALIFDCDGVILESENLHRQAYNDAFAHFDVRCPPSSSESLNWSLEFYDKFQNLVGGGKPKMRWYFRENGWPTSTLFDTPPESDDDRAKLIDSLQDWKTERYKEIIKSGSVEARPGVIRLMDEARAAGKKLAVCSAATKSSVILCLENLIQIERFQGLDCFLAGDDVKEKKPDPSIYITAAEKLGVSVNDCLVIEDSVIGLQAATKAGMSCVITYTSSTSDQDFKEAISVYPDLTNVSLKDLETLLQTIVTAA

SEQ ID NO: 6226 - protein, 307 aa, Brassica napus
MAVSCSHSSILLPPTTSSVGFNSFPCLQTLRFKSRDVYQKARISTVSASSSRSLEALIFDCDGVILESENLHRQAYNDAFAHFDVRCPPSSSESLNWSLEFYDKFQNLVGGGKPKMRWYFRENGWPTSTLFDSPPESDDGRAKLIDTLQDWKTERYKEIIKSGSVEARPGVIRLMDEARAAGKKLAVCSAATKSSVILCLENLIQIERFQGLDCFLAGDDVKEKKPDPSIYITAAEKLGVSVNDCLVIEDSVIGLQAATKAGMSCVITYTSSTSDQDFKEAIAVYPDLTNVSLKDLETLLQTIVTAA

SEQ ID NO: 6227 - protein, 209 aa, Brassica oleracea
  misc_feature (205)..(205): Xaa can be any naturally occurring amino acid
MAVSCSHSSILLPPTTSSVGFNRFPCLQTLRFKSRNVYQKARISTVSASSSRSLEALIFDCDGVILESENLHRQAYNDAFAHFDVRCPPSSSESLNWSLEFYDKFQNLVGGGKPKMRWYFRENGWPTSTLFDSPPESDDGRAKLIDTLQDWKTERYKEIIKSGSVEARPGVIRLMDEARAAGKKLAVCSAATKSSVILCLENLIXIERF

SEQ ID NO: 6228 - protein, 307 aa, Brassica rapa
MAVSCSHSSILLPPSTSSVGFNRFPRLQTLRFKSRNVYQKARISTVSASSSRSLEALIFDCDGVILESENLHRQAYNDAFAHFDVRCPPSSSESLNWSLEFYDKFQNLVGGGKPKMRWYFRENGWPTSTLFESPPESDDDRAKLIDSLQDWKTERYKEIIMSGSVEARPGVIRLMDEARAAGKKLAVCSAATKSSVILCLENLIQIERFQGLDCFLAGDDVKEKKPDPSIYITAAEKLGVSVNDCLVIEDSVIGLQAATKAGMSCVITYTSSTSDQDFKEAISVYPDLTNVSLKDLETLLQTIVTAA

SEQ ID NO: 6229 - protein, 424 aa, Triticum aestivum
MAAADEAQGFRPLDEASLVAYIRATPALAASLGGRVDDLAVKEVGDGNLNFVYIVTSDAGSVVVKQALPYIRCVGDSWPMTRERAYFEASALREHGRLCPDHVPEVYHFDRAMSLIGMRYIKPPHIILRKGLIAGVEYPLLAEHMSDYMAKTLFFTSLLYNSTTEHKKQVARYCENVEMCRLTEQVVFSDPYMVSKYNRWNSPFLDKDAEAVREDDGLKLEIAELKSMFIERAQALIHGDLHTGSIMVTPDSTQVIDPEFAFYAPMGYDIGAFLGNLILAYFAQDGHADQTNDRKAYKQWILKTIEESWNLFQQKFLGLWNKHKDGNGEAYLPAIYNNPELLSVVQKKYMTGLLHDSLGFGSAKMIRRIVGIAHVEDFDSIEDASKRASCERRALDCAKAILKGRRQFESIEQVIVHVQSVNHD

SEQ ID NO: 6230 - protein, 424 aa, Secale cereale
MAAADEAQGFRPLDEASLVAYIRATPALAASLGGRVDDLVVKEVGDGNLNFVYIVTSDAGSIVVKQALPYIRCVGDSWPMTRERAYFEASALREHGRLCPDHVPEVYHFDRAMSLIGMRYIKPPHIILRKGLIAGVEYPLLADHMADYMAKTLFFTSLLYNSTTDHKKQVARYCENVEMCRLTEQVVFSDPYMVSKYNRWNSPLLDKDAEAVRQDDGLKLEIAELKSMFIERAQALIHGDLHTGSIMVTPESTQVIDPEFAFYAPMGYDIGAFLGNLILAYFAQDGHADQTNDRKAYKQWILKTIEESWNLFQQKFLGLWNKHKDGNGEAYLPAIYNNPELLSVVQKKYMTGLLHDSLGFGSAKMIRRIVGIAHVEDFDSIEDASKRASCERRALDCAKAILKGRRQFESIEQVIAHVQSVTHD

SEQ ID NO: 6231 - protein, 424 aa, Triticum aestivum
MAAADEAQGFRPLDEASLVAYIRATPALAASLGGRVDDLAVKEVGDGNLNFVYIVSSDAGSVVVKQALPYIRCVGDSWPMTRERAYFEASALREHGRLCPDHVPEVYHFDRAMSLIGMRYIKPPHIILRKGLIAGVEYPLLAEHMSDYMAKTLFFTSLLYNSTTEHKKQVARYCENVEMCRLTEQVVFSDPYMVSKYNRWNSPFLDKDAEAVREDDGLKLEIAELKSMFIERAQALIHGDLHTGSIMVTPDSTQVIDPEFAFYAPMGYDIGAFLGNLILAYFAQDGHADQTNDRKAYKQWILKTIEESWNLFQQKFLGLWNKHKDGNGEAYLPAIYNNPELLSDVQKKYMTGLLHDSLGFGSAKMIRRIVGIAHVEDFDSIEDASKRASCERRALDCAKAILKGRRQFESIEQVIVHVQSVNHD

SEQ ID NO: 6232 - protein, 424 aa, Triticum aestivum
MAAGDEEQGFRPLDEASLVAYIRATPALAASLGGRVDGLAVKEVGDGNLNFVYIVTSDAGSVVVKQALPYIRCVGDSWPMTRERAYFEASALREHGRLCPDHVPEVYHFDRAMSLIGMRYIKPPHIILRKGLIAGVQYPLLADHMADYMAKTLFFTSLLYNSTTEHKKQVARYCENVEMCRLTEQVVFSDPYMVSKYNRWNSPLLDKDAEAVREDDGLKLEIGELKSMFIERAQALIHGDLHTGSIMVTPDSTQVIDPEFAFYAPMGYDIGAFLGNLILAYFAQDGHADEANDRKAYKQWILKTIEESWNLFQQKFLGLWNKHKDGNGEAYLPAIYNNPELLSVVQKKYMTGLLHDSLGFGSAKMIRRIVGIAHVEDFDSIEDASKRASCECRALDCGKAILKGRRQFESIEQVIALVQSVTQD

SEQ ID NO: 6233 - protein, 72 aa, Secale cereale
QGFRPLDEASLVAYIRATPALAASPAAASTTSPSRRSATATSTSSTSSPPTPAPSSSSRRCRTSAAWGTRGR

SEQ ID NO: 6234 - protein, 402 aa, Secale cereale
RATPALAASLGGRVDDLAVKEVGDGNLNFVYIVTSDAGSVVVKQALPYIRCVGDSWPMTKERAYFEASALREHGRLCPDHVPEVYHFDRAMSLIGMRYIKPPHIILRKGLIAGVQYPLLADHMADYMARTLFFTSLLYNSTTDHKKQVARYCENVEMCRLTEQVVFSDPYMVSKYNRWNSPFLDKDAEAVREDVELKLEIAELKSMFIERAQALIHGDLHTGSIMVTTESTQVIDPEFAFYAPMGYDIGAFLGNLILAYFAQDGHADQTNDRKAYKQWILKTIEESWNLFQQKFLGLWNKHKDGNGEAYLPAIYNNLELLSVVQKKYMTGLLHDSLGFGSAKMIRRIVGIAHVEDFDSIEDASKRASCERRALDCAKAILKGRRQFQSIEQVIAHVQSVTHD

SEQ ID NO: 6235 - protein, 407 aa, Secale cereale
MAAADEAQGFRPLDEASLVAYIRATPALAASLGGRVDDLVVKEVGDGNLNFVYIVTSDAGSIVVKQALPYIRCVGDSWPMTRERAYFEASALREHGRLCPDHAPEVYHFDRAMSLIGMRYIKPPHIILRKGLIAGVEYPLLADHMADYMAKTLFFTSLLYNSTTDHKKQVARYCENVEMCRLTEQVVFSDPYMVSKYNRWNSPLLDKDAEAVRQDDGLKLEIAELKSMFIERAQALIHGDLHTGSIMVTPESTQVIDPEFAFYAPMGYDIGAFLGNLILAYFAQDGHADQTNDRKAYKQWILKTIEESWNLFQQKFLALWNKHKDGNGEAYLPAIYNNPELLSVVQKKYMTGLLHDSLGFGSAKMIRRIVGIAHVEDFDSIEDASKRASCERRALDCAKAILKADAN

SEQ ID NO: 6236 - protein, 445 aa, Secale cereale
TVNPGRFPTLSVPIHSAAEPARHGRAGEAQGFRPLDEASLVAYIRATPALAASLGGRVDDLAVKEVGDGNLNFVYIVTSDAGSIVVKQALPYIRCVGDSWPMTRERAYFEASALREHGRLCPDHVPEVYHFDRAMSLIGMRYIKPPHIILRKGLIAGVEYPLLADHMADYMAKTLFFTSLLYNSTTDHKKQVARYCENVEMCRLTEQVVFSDPYMVSNHRWNSPLLDKDAEAVRQDDGLKLEIAELKSMFIERAQALIHGDLHTGSIMVTPESTQVIDPEFAFYAPMGYDIGAFLGNLILAYFAQDGHADQTNDRKAYKQWILKTIEESWNLFQQKFLGLWNKHKDGNGEAYLPAIYNNPELLSVVQKKYMTGLLHDSLGFGSAKMIRRIVGIAHVEDFDSIEDASKRSSCERRALDCGKAILKGRRQFESIEQVIAHVQSVTHD

SEQ ID NO: 6237 - protein, 429 aa, Avena sativa
MATATATAAELEAQGFRPLDEASLVAYIRATPALAASLGGRVDALEVKEVGDGNLNFVYIVLSEGGSVVVKQALPYVRCVGDSWPMTRERAYFEASALQEHGRLCPDHVPEVYHFDRAMSLIGMRYIKPPHIILRKGLIAGVQYPLLAEHMAEYMARTLFFTSLLYNSTTDHKKRVAQYCGNVELCRLTEQVVFSDPYMVSKFNHWTSPFLDKDAEAVREDDGLKLEIAELKSMFIERAQALIHGDLHTGSIMVTTDSTQVIDPEFAFYGPMGYDIGAFLGNLILAYFAQDGHADQANDRKDYKEWILKTIEESWNSFQQKFVGLWNKHKDGNGEAYLPAIYNNPELLSVAQKKYMTSLFHDSLGFGSAKMIRRIVGIAHVEDFDSIEDASKRASCERRALDCAKAILKGRRQFESIEQVIARIRSITH

SEQ ID NO: 6238 - protein, 452 aa, Secale cereale
GRVVCVRKLRPIPDLSQSRLHSAAEPARHGRRRRGAGLRPLDEASLVAYIRATPALAASLGGRVDDLVVKEVGDGNLNFVYIVTSDAGSIVVKQALPYIRCVGDSWPMTRERAYFEASALREHGRLCPDHVPEVYHFDRAMSLIGMRYIKPPHIILRKGLIAGVEYPLLADHMADYMAKTLFFTSLLYNSTTDHKKQVARYCENVEMCRLTEQVVFSDPYMVSKYNRWNSPLLDKDAEAVRQDDGLKLEIAELKSMFIERAQALIHGDLHTGSIMVTPESTQVIDPEFAFYAPMGYDIGAFLGNLILAYFAQDGHADQTNDRKAYKQWILKTIEESWNLFQQKFLGLWNKHKDGNGEAYLPAIYNNPELLSVVQKKYMTGLLHDSLGFGSAKMIRRIVGIAHVEDFDSIEDASKRASCERRALDCAKAILKGRRQFESIEQVIAHVQSVTHD

SEQ ID NO: 6239 - protein, 426 aa, Brachypodium distachyon
MAAAATAEEGGFRPLDEASLVAYIRATPALAASLGGRVDALTVKEVGDGNLNFVYIVLSDAGSVVVKQALPYIRCVGDSWPMTRERAYFEASTLQEHGRLCPDHVPEVYHFDRAMSLIGMRYIKPPHIILRKGLVAGVQYPLLAEHMAEYMARTLFFTSLLYNSTTDHKAKVAQYCGNIEMCRLTEQVVFSDPYMVAKYNRWTSPFLDEDAEAVRGDDELKLEIAELKSIFIERAQALIHGDLHTSSIMLTTDSTQVIDPEFGFYGPMGYDVGAFLGNLILAYFAQDGHADQTNDRKAYKEWILKTIEESWNLFHKKFVGLWNKHKDGNGEAYLPAIYNNPELLSLAQKKYMTDLFHDSLGFGSAKMIRRIVGIAHVEDFESIEDASMRATCERRALDCAKAILKGRRQFEGIEQVIAHVQSITHD

SEQ ID NO: 6240 - protein, 381 aa, Leymus cinereus x Leymus triticoides
  misc_feature (207)..(207): Xaa can be any naturally occurring amino acid
  misc_feature (279)..(279): Xaa can be any naturally occurring amino acid
  misc_feature (286)..(286): Xaa can be any naturally occurring amino acid
VGDGNLNFVYFVTSDAGSVVVKQALPYIRCVGDSWPMTRERAYFEASALREHGRLCPDHVPEVYHFDRAMSLIGMRYIKPPHIILRKGLIAGVEYPLLAEHMADYMAKTLFFTSLLYNSTSEHKKQVARYCENVEMCRLTEQVVFSDPYMVSKYNRWNSPFLDKDAEAVREDDGLKLEIAELKSMFIERAQALIHGDLHTGSIMVTXDSTQVIDPEFAFYAPMGYDIGAFLGNLILAYFAQDGHADQTNDRKAYKQWILKTIEESWNLFQQKFLGLWNXHKDGNGXAYLPAIYNNPELLSVVQKKYMTGLLHDSLGFGSAKMIRRIVGIAHVEDFDSIEDASKRASCERRALDCAKAILKGRRQFESIEQVIAHVQSVTHD

SEQ ID NO: 6241 - protein, 374 aa, Triticum aestivum
FVYIVSSDAGSVVVKQALPYIRCVGDSWPMTRERAYFEASALREHGRLCPDHVPEVYHFDRAMSLIGMRYIKPPHIILRKGLIAGVEYPLLAEHMADYMAKTLFFTSLLYNSTTEHKKQVARYCENVEMCRLTEQVVFSDPYMVSKYNRWNSPLLDKDAEAVREDDGLKLEIAELKSMFIERAQALIHGDLHTGSIMVTPDSTQVIDPEFAFYAPMGYDIGAFLGNLILAYFAQDGHADQANDRKAYKQWILKTIEESWNLFQQKFLGLWNKHKDGNGEAYLPAIYNNPELLSVVQKKYMTGLLHDSLGFGSAKMIRRIVGIAHVEDFDSIEDASKRASCERRALDCGKAILKGRRQFESIEQVIALVQSVTHD

SEQ ID NO: 6242 - protein, 430 aa, Oryza sativa
MAAAAEQQQQQQQQGFRPLDEASLVAYIKATPALAARLGGSLDALTIKEVGDGNLNFVYIVLSDAGSVVIKQALPYIRCVGDSWPMTRERAYFEASALQKHRGLCPDHVPEVYHFDRAMSLIGMRYIEPPHIILRKGLIAGVEYPLLAEHMADYMAKTLFFTSLLYNSTTDHKKGVAQYCDNVEMCRLTEQVVFSDPYMLAKYNRCTSPFLDNDAAAVREDAELKLEIAELKSMFIERAQALLHGDLHTGSIMVTPDSTQVIDPEFAFYGPMGYDIGAFLGNLILAYFSQDGHADQANDRKAYKKWILKTIEDSWNLFHKKFVELWNKHKDGNGEAYLPPIYNSSELLCLAQKKYMTSLFHDSLGFGSAKMIRRIVGIAHVEDFESIEDASKRASCERRALNCAKAILKGRRQFESIGQVIVHVQSFDRD

SEQ ID NO: 6243 - protein, 427 aa, Oryza sativa
MAAAAAEQQQQGFRPLDEASLVAYIKATPALAARLGGRLDALTIKEVGDGNLNFVYIVLSDAGSLVIKQALPYIRLVGDSWPMSRERAYFEASALQKHRALCPDHVPEVYHFDRAMSLIGMRYIEPPHIILRKGLVAGVEYPLLAEHMADYMAKTLFFTSLLYNSTTDHKKGVAQYCDNVEMSRLTEQVVFSDPYRVAKYNRCTSPFLDNDAAAVREDAELKLEIAELKSMFIERAQAFLHGDLHTSSIMVTPDSTQVIDPEFAFYGPMGYDIGAFLGNLILAYFSQDGHADQANDRKAYKKWILKTIEDSWNFFHKKFVELWNKHKDGNGEAYLPPIYNSSELLSLVQKKYMTSLFHDSLGFGSAKMIRRIVGIAHVEDFESIEDASKRASCERRALNCAKAILKGRRQFESIEQVIVHVQSFDRD

SEQ ID NO: 6244 - protein, 422 aa, Panicum virgatum
MAAEAEQGFRPLDEASLVTYIKATPALASRLGGGGSVEIKEVGDGNLNFVYIVKSSSGAIVVKQALPYVRCVGDSWPMTRERAYFEASTLREHGRLCPEHTPEVYHFDRAMSLMGMRYIEPPHIILRKGLIAGVEYPLLADHMSNYMAKTLFFTSLLYNNTTDHKKGVAEYCANVEMCRLTEQVVFSDPYRVSKFNRWTSPYLDKDAEAVREDDELKLEIAELKSMFIERAQALIHGDLHTGSIMVTPNSTQVIDPEFGFYGPMGFDIGAFLGNLILAYYAQNGHADQTNDRKAYKKWILKTIEESWNLFQKKFVELWNKHKEGNGEAYLPDVYNNSNLLSLAQKKYMTNLFHDSLGFGSAKMIRRIVGIAHVEDLESIKDASKRAECERAALNCAKTILKGRRQFETIEQVIEHIQSFDRD

SEQ ID NO: 6245 - protein, 425 aa, Setaria italica
MAAEAEQGFRPLAEASLVAYIKATPALASRLGGGGSLDSVEIKEVGDGNLNFVYIVKSSSGTIVIKQALPYVRCVGDSWPMTRERAYFEASTLREHGRLCPEHTPEVYHFDRAMSLMGMRYIEPPHIILRKGLIAGVEYPLLADHMSNYMAKTLFFTSLLYNNTTDHKKGVAQYCANVEMCRLTEQVVFSDPYRVSKFNRWTSPYLDKDAEAVREDDELKLEVAELKSMFIERAQALIHGDLHTGSIMVTPDSTQVIDPEFGFYGPMGFDIGAFLGNLILAYYAQNGHADQANDRKAYKKWILKTIEESWNLFQNKFVGLWNEHKEGNGEAYLPDIYNNSNLLSLAQKKYMTNLFHDSLGFGSAKMIRRIVGIAHVEDLESIKDASKRAECERAALNCAKTILKGRRQFETIEQVIEHIQSFDRN

SEQ ID NO: 6246 - protein, 422 aa, Panicum virgatum
MAAEAEQGFRPLDEASLVTYIKATPALASRLGGGGSVEIKEVGDGNLNFVYIVKSSSGAIVVKQALPYVRCVGDSWPMTRERAYFEASTLREHGRLSPEHTPEVYHFDRAMSLMGMRYIEPPHIILRKGLIAGVEYPLLADHMSNYMAKTLFFTSLLYNNTTDHKKGVAEYCANVEMCRLTEQVVFSDPYRVSKFNRWTSPYLDKDAEAVREDDELKLEIAELKSMFIERAQALIHGDLHTGSIMVTPNSTQVIDPEFGFYGPMGFDIGAFLGNLILAYYAQNGHADQTNDRKAYKKWILKTIEESWNLFQKKFVELWNKHKEGNGEAYLPDVYNNSNLLSLAQKKYMTNLFHDSLGFGSAKMIRRIVGIAHVEDLESIKDASKRAECERAALNCAKTILKGRRQFETIEQVIEHIQSFDRD

SEQ ID NO: 6247 - protein, 425 aa, Sorghum bicolor
MAAEAEQGFRPLDEASLLAYIKATPALSSRLGGGGSLDSIEIKEVGDGNLNFVYIVQSEAGAMVVKQALPYVRCVGDSWPMTRERAYFEASTLREHGRLCPEHTPEVYHFDRAMSLMGMRYIEPPHIILRKGLIAGVEYPLLADHMSDYMAKTLFFTSLLYNNTTDHKNGVAKYSANVEMCRLTEQVVFSDPYRVSKFNRWTSPYLDKDAEAVRQDDELKLEVAGLKSMFIERAQALIHGDLHTGSIMVTTGSTQVIDPEFGFYGPMGFDIGAFLGNLILAYYAQNGHADQANDRKAYKKWILKTIEESWNLFQKKFVELWNKHKEGNGEAYLPDIYNNSKLVSVAQKKYMTNLFHDSLGFGSAKMIRRIVGIAHVEDLESIKDASKRAECERAALSCAKEILKGRRQFETIEQVIEHIQSFDQD

SEQ ID NO: 6248 - protein, 425 aa, Zea mays
MAAEEEQGFRPLDEASLLAYIKATPALASRLGGGGSLDSIEIKEVGDGNLNFVYIVQSEAGAIVVKQALPYVRCVGDSWPMTRERAYFEASTLREHGRLCPEHTPEVYHFDRTLSLMGMRYIEPPHIILRKGLVAGVEYPLLADHMSDYMAKTLFFTSLLYNNTTDHKNGVAKYSANVEMCRLTEQVVFSDPYRVSKFNRWTSPYLDKDAEAVREDDELKLEVAGLKSMFIERAQALIHGDLHTGSIMVTEGSTQVIDPEFGFYGPMGFDIGAFLGNLILAYYAQNGHADQANDRKAYKKWILKTIEESWNLFQKKFVELWNKHKESNGEAYLPDIYNKPKLLSVVQKKYMTNLFHDSLGFGSAKMIRRIVGIAHVEDLESIKDASKRAECERAALNCAKTILKGRHQFETIEQVVEHIQSFDQD

SEQ ID NO: 6249 - protein, 785 aa, Triticum aestivum
MAKRPRNFRAVRSNSFESYLRRAISEAGLAVPGCCADDVAAALRARHPDLRRKQHAPLVAAVRRALLTVPLAPAPGADASDSDSEMDSRASSPSSRRRRHDAHATASSSTSYSEHDDDARAPSPPPAFDVTKAMLRTRYASLTPRKEPAAVAAAAASQQLEIELNAEKPRRRVTTDGGGGGDPKQEAGAGEGGGGGGAKGPRFSDLGGMESVIDELMMEVVVPLCHPELPLRLGVRPVAGILLHGPPGCGKTTLAHAIANETGVPFYKISAPEVVSGVSGASEENIRVLFKKAYRTAPSIVFIDEIDAIASKRENLQREMERRIVTQLMTCMDEFHQNAGSDGGDLDSQSSEKKPGYVIVIGATNRPDAVDQALRRPGRFDREISLGVPDEIGRKQILKMLTQNLTLEKDQFDLFKIARATPGFVGADLKALVDKAGNLAMKRIIVERKKQSGGGDVNNKQDWWRHPWSEGEMDSLCITMDDFEEAATMVQPSLRREGFSSVPDVTWEDVGGLDSLKKEFDRCIVRCIKHPEVYKDFGVNMQAGFLLFGPPGCGKTLIAKAVAHDAGANFIHIKGPELLNKYVGESESEVRKIFTRARINSPCILFFDEIDALTTKRGKEGGWVVERLLNQLLVELDGADQRHGVYVIGATNRIDVIDEAVLRPGRFGKKHFVPLPGADERVAILKAHTEKKTLSVDVDLNAIARREECNNLTGADLASLVNEAAMAALEERCEFLAKGDSSMSTDLTNKIKLRHFEHALSKVKPSVSEQQRKHFDALSKKYSAN

SEQ ID NO: 6250 - protein, 785 aa, Triticum aestivum
MAKRPRNFRAVRSNSFESYLRRAISEAGLAVPGCCADDVAAALRARHPDLRRKQHAPLVAAVRRALLTVPLAPAPGADGDESDSEMDSRASSPSSRRRRHDAHATASSSTSYSEHDDDARAPSPPPAFDVTKAMLRTRYASLTPRKEPAAVAAAAASQQLEIELNAEKPRRRVTTDGGGGGDPKQEAGAGEGGGGGGAKGPRFSDLGGMESVIDELMMEVVVPLCHPELPLRLGVRPVAGILLHGPPGCGKTTLAHAIANETGVPFYKISAPEVVSGVSGASEENIRVLFKKAYRTAPSIVFIDEIDAIASKRENLQREMERRIVTQLMTCMDEFHQNAGSDGGDLDSQSSEKKPGYVIVIGATNRPDAVDQALRRPGRFDREISLGVPDEIGRKQILKMLTQNLTLEKDQFDLFKIARATPGFVGADLKALVDKAGNLAMKRIIVERKKQSGGGDVNNKQDWWRHPWSEGEMDSLCITMDDFEEAATMVQPSLRREGFSSVPDVTWEDVGGLDSLKKEFDRCIVRCIKHPEVYKDFGVNMQAGFLLFGPPGCGKTLIAKAVAHDAGANFIHIKGPELLNKYVGESESEVRKIFTRARINSPCILFFDEIDALTTKRGKEGGWVVERLLNQLLVELDGADQRHGVYVIGATNRIDVIDEAVLRPGRFGKKHFVPLPGADERVAILKAHTEKKTLSVDVDLNAIARREECNNLTGADLASLVNEAAMAALEERCEFLAKGDSSMSSDLTNKIKLRHFEHALSKVKPSVSEQQRKHFDALSKKYSAN

SEQ ID NO: 6251 - protein, 695 aa, Hordeum vulgare
PSSRRRHRAHATASSSTSYSEHDDDDDDAPSPPPAFDVTKAMLRTRYASLTPRKEPAAAAAAAASQQLEIELNSEKPRRRVTTDGGGGGGGDPKQEAGASEGGGGGGAKGPRFSDLGGMETVIDELMMEVVVPLCHPELPLRLGVRPVAGILLHGPPGCGKTTLAHAIANETGVPFYKISAPEVVSGVSGASEENIRVLFKKAYRTAPSIVFIDEIDAIASKRENLQREMERRIVTQLMTCMDEFHQNVGSDGGDLDSQSSEKKPGYVIVIGATNRPDAVDQALRRPGRFDREISLGVPDEIGRKQILKMLTQNLTLEKDQFDLFKIARATPGFVGADLKALVDKAGNLAMKRIIVERKKQSGGGDVNSKQDWWRHPWSEDEMDSLCITMDDFEEAATMVQPSLRREGFSSVPDVTWEDVGGLDSLKKEFDRCIVRCIKHPEVYKDFGVNMQAGFLLFGPPGCGKTLIAKAVAHDAGANFIHIKGPELLNKYVGESESEVRKIFTRARINSPCILFFDEIDALTTKRGKEGGWVVERLLNQLLVELDGADQRHGVYVIGATNRIDVIDEAVLRPGRFGKKHFVPLPGADERVAILKAHTEKKTLSEDVDLETIARREECNNLTGADLASLVNEAAMAALEERCEFLAKGDSSMSTDLTNKIKLQHFEHALSKVKPSVSEQQRKHFDALSKKYSAN

SEQ ID NO: 6252 - protein, 783 aa, Brachypodium distachyon
MGKRPRNVRAIRSNSFESYLRRLIADGGLAVPGCSADDVAGALRSRNPDLRRKQLGPFVAAVRRALLSSMPAPAEAFSADSDVDSRASSPSSSRRQRRRLSHDASSSTSFSGDDDDGGARPPSPPPAFDVTKSMLRARYASLTPKKDPGTNQQLEIEVNAEKPRRRMTADGGAGGDSKLEAAAVAPATTEGGGRVGKGPMFSDLGGMKTVIDELMMEVVVPLCHPQLPLRLGVRPVAGILLHGPPGCGKTTLAHAIANETGVPFYKISAPEIVSGVSGASEENIRILFQKAYRTAPSIVFIDEIDAIASKRENLQREMERRIVTQLMTCMDEFHQNVGSDGSDLDSQSSEKKPGYVIVIGATNRPDAVDQALRRPGRFDREISLGVPDETARQQILKMLTKNLTLEAEGHFDLFKIARATPGYVGADLKALVDKAGNLAMKRIIIARKKLLGDDENNEQDWWRLPWNESEMENLCIAMDDFENAVTMVQPSLRREGFSSVPDVTWEDVGGLDSLRKEFYRCIVRCIKYPEDYKEYGVNMQAGFLLFGPPGCGKTLIAKAVAHDAGASFIHIKGPELLNKYVGESESEVRKIFTRARTNSPCILFFDEIDALTTKRGKEGGWVVERLLNQLLIELDGADQRHGVYVIGATNRIDVIDEAVLRPGRFGKKHFVPLPGADERVSILKAHAKDKPVSADVDLDTLARRQECNNLSGADLASLVNEAAMAALGEKIEFLENGTASRSLSFTREIELLHFEHALSKVKPSVSEQQRKHFDMLSKKYSAD

SEQ ID NO: 6253 - protein, 803 aa, Secale cereale
DSPEAPPSQTLAAAADGEAAAQLPGGAVQLLRVLPPAGHIRGRARRAGLLRRRRRRRAPGPPPGPAPQAARPSRGCRPPRPPQHPPSPPPRRRGLRLRLRHGLPRLLPLLPPPPPAPRRPRHRLLLHLLLRARRRCPRPLPPPPFDVTKAMLRTRYASLTPRKEPAAAAAAAAASQQLEIELNSEKPRRRVTTDGGGAGDPKQEAGASEGGGGGGVKGPRFSDLGGMESVIDELMMEVVVPLCHPELPLRLGVRPVAGILLHGPPGCGKTTLAHAIANETGVPFYKISAPEVVSGVSGASEENIRVLFKKAYRTAPSIVFIDEIDAIASKRENLQREMERRIVTQLMTCMDEFHQNVGSDGGDLHSQSPEKKPGYVIVIGATNRPDAVDQALRRPGRFDREISLGVPDEIGRKQILKMLTQNLTLEKEQFDLFKIARATPGFVGADLKALVDKAGNLAMKRIIVERKKQSGGADINNKQDWWRHPWSEGEMDSLCITMDDFEEAATMVQPSLRREGFSSVPDVTWEDVGGLDSLKKEFDRCIVRCIKHPEVYKDFGVNMQAGFLLFGPPGCGKTLIAKAVAHDAGANFIHIKGPELLNKYVGESESEVRKIFTRARINSPCILFFDEIDALTTKRGKEGGWVVERLLNQLLVELDGADQRNGVYVIGATNRIDVIDEAVLRPGRFGKKHFVPLPGADERVAILKAHTEKKSLSEDVDLNAIARREECNNLTGADLASLVNEAAMAALEERCEFLAKGDSSMSTDLTNKIKLRHFEHALSKVKPSVSEQQRKHFDALSKKYSAN

SEQ ID NO: 6254 - protein, 245 aa, Oryza sativa
MRPVFVGNLDYDTRHSELDRLFYRYGRIDRIDMKSGFAFVYFEDERDGDEAIRALDGYPFGPGRRRLSVEWSRGDRGSRRDGYSKPPVNTKPTKTLFVINFDPINTRVTDIERHFEPFGKLSNVRIRRNFAFVQFETQEEATKALEATHSTKLLDRVISVEYAFRDDTERGDRYDGARGGYGRRDDSPYRRSVSPVYRSRPSPDYGRQRSPVYGSYDRSPVNDRYRSRSPVRRSRSPLANRRAYD

SEQ ID NO: 6255 - protein, 247 aa, Setaria italica
MRPVFVGNLDYDTRHSELDHLFYRYGRIERIDMKSGFAFVYFEDERDGDDAIRALDGYPFGPGRRRLSVEWSRGDRAARRDGNKPEANTKATKTLFVINFDPITTTVGDIEKHFAPFGNISNVRIRRNFAFVQFETLEEARKALEATHATTLLDRVISVEYAFRDDGERSDRYDSPRRAGGYGRCGDNPYRRSISPVYRSRPSPDYGRPPSPVYGSYGRSRSPVRDRYRRSPGYRSRSPPAKRRAYD

SEQ ID NO: 6256 - protein, 527 aa, Secale cereale
MAADTAAARAILLLLVAVAVAALLRTGEASVHEYSGLSFLNKGNAFILHAGSEGLYAPVSPANATVEEEDDEAAADAFIRFDKITFRRPEEANDSVREISSSKVQIIVFEIEDREMIGGSAYGGQKAICCTSDLAKLGACVEGSVIYRPSQVNPGWPQLFVASFDGSDLIATLPSRTIPVKKTGMYNMYFIHCDPALDGLEIDGKTIWKNPTGYLPGRMAPLKNFFGLMSFAFVILGIYWFYQYMKFWREVLPLQNCITLVITLGMLEMALWYFEYAEFNETGVRAKAITFWAVTFGTIKRTVARLIILIVSMGYGVVRPTLGGLTSKVVMLGGTFFVATEILELVENLGTVNDLSGKARLFLVYPVAILDASFIVWIFISLAKTLSQLQARRLMAKLDIYRKFTIALAITVLVSIGWIGYEIYFKSTDVFNERWQYAWIIPAFWHALSFSLLCVISYLWAPSQSSMRFTNDASEKFDREDSLSLIRPRPIVSNNGWSVASSTDAKVTKNTDSVTSFDEDDEENKRE

SEQ ID NO: 6257 - protein, 532 aa, Oryza sativa
MAAVSAAAARLHHLLSLCVAVAGLLLMLLGGGEASVHEYRGLGFLNKGNAFILHAGSEGLYAPSSPANATTAEDDEDAAAAAVADAFIRFDKITFRRPKDAAKETGSAMVQILVFEIEDREMIGGSAYGGQKAICCTSDLAKLGACTEGSVIYRPSQVNPGWPQLLFSSFDGSDTIATLPSRIIPITKTGMYNMYFIHCDPSLAGLEIEGQTVWKNPTGYLPGRMAPLKNFFGIMSFAFVVLGIYWFYQYMKFWREVLPLQNCITLVITLGMLEMSLWYFEYAEFNETGVRPKGITFWAVTFGTVKRTVARVIILIVSMGYGVVRPSLGGLTSKVVMLGGTFFLATEILELVENLGAVNDLSGKARLFLVYPVAILDAAFVVWIFISLAKTLDKLQARRSMAKLDIYRKFTIALAVTVLVSIGWIGYEIYFKSTDVFNERWQYAWIIPAFWHVLSFSLLCVISYLWAPSQNSMRFTYDASENFDREDSLSLIRPGPIASKNGWSLSSSPDTKATKNVTVTSFDGDDEENKRE

SEQ ID NO: 6258 - protein, 455 aa, Hordeum vulgare
FIFPPLFRFDKITFRRPEEANDSVKETSSSKVQILVFEIEDREMIGGSAYGGQKAICCTSDLAKLGACVEGSVIYRPSQVNPGWPQLFVASFDGSDLIATLPSRTIPVKKTGMYNMYFIHCDPALAGLEIDGKTIWKNPTGYLPGRMAPLKNFFGLMSFAFVILGIYWFYQYMKFWREVLPLQNCITLVITLGMLEMALWYFEYAEFNETGVRAKAITFWAVTFGTIKRTVARLIILIVSMGYGVVRPTLGGLTSKVVMLGGTFFVATEILELVENLGTVNDLSGKARLFLVYPVAILDASFIVWIFISLAKTLSQLQARRLMAKLDIYRKFTIALAITVLVSIGWIGYEIYFKSTDVFNERWQYAWIIPAFWHALSFSLLCVISYLWAPSQSSMRFTNDASEKFDREDSLSLIRPRPIVSKNGWSVTSAPDAKATNNTNTVASFDEDDEENKRE

SEQ ID NO: 6259 - protein, 519 aa, Setaria italica
MAAARFLLAVALALLLRPGEASVHEYRGLGFANKGNAFILHAGSEGLYAASSANATAEDDEDAAAAADAFIRFDKITFRRPEDAIDSVKEATSAKVQVLVFEIEDREMIGGSAYGGQKAICCTSDLAKLGACTEGSVIYRPSQVNPGWPKLFVASFDGSDLIATLPSRTIPITKTGMYNMYFIHCDPSLADLEIEGKTIWKNPTGYLPGRMAPLKNFFGLMSFAFVVLGIYWFYQYMKSWREVLPLQNCITLVITLGMLEMALWYFEYAEFNETGVRPKGITFWAVTFGTVKRTAAEIIVLIVSMGYGVVTPTLGGLTSKVVMLGGTFFLATETLELVENLGAVNDLSGKARLFLVYPVAILDAAFVIWIFISLAKTIGKLQARRLMAKLEIYRKFAIALIVSVLVSVGWIGYEIYFKSTDVFNERWQYAWIIPAFWHVLSFSLLCVICYLWAPSQNSMRFAYDGSEFFDRKDNLSLIRPAPSASKNGWSLSSTPEDKATKNVNSVASFDEDDEENKRE

SEQ ID NO: 6260 - protein, 520 aa, Panicum virgatum
MAVRFLLVVALALLLRPGEASVHEYRGLGFANKGNAFILHAGSEGLYAASPANATATAGDDEDAAAVADAFIRFDKITFRRPEDAVDSVKETSSAKVQVLVFEIEDREMIGGSAYGGQKAICCTSDLAKLGACTEGSVIYRPSQVNPGWPKLFVASFDGSDLIAMLPSRTIPINKTGMYNMYFIHCDPSLAGLEIEGKTIWKNPTGYIPGRMAPLKNFFGLMSFAFVILGIYWFYQYMKSWREVLPLQNCITLVITLGMLEMALWYFEYAEFNETGIRPKGITFWAVTFGTVKRTAAEVIVLIVSMGYGVVTPTLGGLTSKVVMLGGTFFVATETLELVENLGAVNDLSGKARLFLVYPVAILDAAFVVWIFISLAKTIGKLQARRLMAKLEIYRKFAIALIVSVLVSVAWIGYEIYFKSTDVFNERWQYAWIIPAFWHVLSFSLLCVICYLWAPSQNSMRFAYDASEFFDRKDNLSLIRPAPSASKNGWSLSSTPDDKATKNVNTESSFDGDDEENKRE

SEQ ID NO: 6261 - protein, 518 aa, Sorghum bicolor
MAVRLLLAVAVALLLRPGDASVHEYRGLSFANKGNAFILHAGSEGLYAASHANTTAEDDEDAAAVADAFIRFDKITFRRPEDTNNSVKETSSAKVQVLVFEIEDREMIGGSAYGGQKAICCTSDLAKLGACTEGSVIYRPSQVNPGWPKLFVASFDGSDLIATLPSRTIPITKTGMYNMYFIHCDPSLASLEIEGKTIWKNPTGYLPGRMAPLKNFFGLMSFAFVVLGIYWFYQYMKSWREVLPLQNCITLVITLGMFEMALWYFEYAEFNETGVRPKGITFWAVTFGTVKRTAAEVIVLIVSMGYGVVTPTLGGLTSKVVMLGGTFFLATEILELVENLGAVNDLFGKARLFLIYPVAILDAAFVVWIFISLAKTIGKLQARRLMAKLEIYRKFATALIISVLVSIGWIGYEIYSKSTDLFNERWQHAWIIPAFWHILSFLLLCVICYLWAPSQNSMRFSYDASEFFDRKDNLSLIRPAPSASKNGWSVSSTPEPKATKDMNTVADLEGDDEESKRE

SEQ ID NO: 6262 - protein, 518 aa, Saccharum officinarum
MAARLLLAVADALLLCAGDASVHEYRGLGFANKGNAFILHAGSEGLYAASHANTTAEDDEDAAALPDAFIRFDKITFRRSEDTNDSVKGTSSAKVQVLVFEIEDREMIGGSAYGGQKAICCTSDLAKLGACTEGSVIYRPSQVNPGWPKLFVASFDGSDLIATLPSRTIPITKTGMYNMYFIHCDPSLASLEIEGKTIWKNPTGYVPGRMAPLKNFFGLMSFAFVVLGIYWFYQYMKFWREVLPLQNCITLVITLGMFEMALWYFEYAEFNETGVRPKGITFWAVTFGTVKRTAAEVIVLIVSMGYGVITPTLGGLTSKVVMLGGTFFLATEILELVENLGAVNDLSGKARLFLVYPVAILDAAFVIWIFISLAKTIGKLQARRLMAKLDIYRKFATALIVSVLVSVGWIGYEIYSKSTDVFNERWQHAWIIPAFWHVLSFLLLCVICYLWAPSQNSMRFSYDASEFFDRKDNLSLIRPAPSASKNGWSLSSTPVPKATKDVNTVTDFEGDDEENKRE

SEQ ID NO: 6263 - protein, 442 aa, Triticum aestivum
FRRPEEANDSVKETSSSKVQIIVFEIEDREMIGGSAYGGQKAICCTSDLAKLGACVEGSVIYRPSQVNPGWPQLFVASFDGSDLIATLPSRTIPVKKTGMYNMYFIHCDPALAGLEIDGKTIWKNPTGYLPGRMAPLKNFFGLMSFAFVILGIYWFYQYMKFWREVLPLQNCITLVITLGMLEMALWYFEYAEFNETGVRAKAITFWAVTFGTIKRTVARLIILIVSMGYGVVRPTLGGLTSKVVMLGGTFFVATEILELVENLGTVNDLSGKARLFLVYPVAILDASFIVWIFISLAKTLSQLQARRLMAKLDIYRKFTIALAITVLVSIGWIGYEIYFKSTDVFNERWQYAWIIPAFWHALSFSLLCVISYLWAPSQSSMRFTNDASEKFDREDSLSLIRPRPIVSNNGWSVASSTDAKATKNTDSVTSFDEDDEENKRE

SEQ ID NO: 6264 - protein, 518 aa, Zea mays
MAVHLLLAVAVALLLCPGDASVHDYRGLSFANKGNAFILHAGSEGLYAASHANTTAEDDEDTAAVADAFIRFDKVTFRRPEDTNDSVKETSSAKVHILVFEVEDREMIGGSAYGGQKAICCSSDLAKLGACKEGSVIYRPSQVNPGWPKLFVASFEGSDLIATLPSRTIQITKTGMYNMYFIHCDPSLASLEIEGKTIWKNPTGYLPGRMAPLKNFFGLMSFAFVVLGIYWFYQYMKSWKEVLPLQNCITLVITLGMLEMALWYFEYAEFNETGVRPKGITFWAVTFGTVKRTAAEVIVLIVSMGYGVVAPTLGGLTSKVVMLGGTFFLATEILELVENLGAVNDLSGKARLFLVYPVAILDAAFVVWIFISLAKTIGKLQARRLMAKLDIYRKFATALIVSVLVSVGWIGYEIYSKSTDVFNERWQHAWIIPAFWHVLSFLLLCVICYLWAPSQNSMRFSYDASEFFDRKDNLSLIRPATSASKNGWSLSSAPEAKATKDVNTVADFEGDDEENKRE

SEQ ID NO: 6265 - protein, 515 aa, Zea mays
MAGRFLLVVAVALLLRPGDASVHEYRGLSFANKGNAFILHAGSEGLYAASHANTTAEDAAAVAEALIRFDKITFRRSEDTNNSVKETSSAKVQVLIFEIEDREMIGGSAYGGQKAICCTSDLAKLGACTEGSVIYRPSQVNPGWPKLFVASFDGSDLIATLPSRTIPITKTGIYNMYFIHCDPSLASLEIEGKTIWKNPTGYLPGRMAPLKNFFGLMSFAFVVLGIYWFYQYMKSWREVLPLQNCITLVITLGMFEMALWYFEYAEFNETGVRPKGITFWAVTFGTVKRTAAEVIVLIVSMGYGVVTPTLGGLTSKVVMLGGTFFLATEILELVENLGAVNDLSGKARLFLVYPVAILDAAFVIWIFISLAKTIGKLQARRLMAKLDIYRKFATALIISVLVSVGWIGYEIYSKSTDVFNERWQHAWIIPAFWHVLSFLLLCVICYLWAPSQNSMRFSYDASEFFDRKDNISLIRPAPSASKNGWNLSSTPEPKATKDVNTVADFEGDDEENKRE

SEQ ID NO: 6266 - protein, 419 aa, Triticum aestivum
MWRARRWPRPRWFSSDTAAVGADSGNPARRRVAALWGNGDHGRLGLGALESRWSPTACPFFLTRPADPPTSLACGGAHTLFLTEGGRVFATGLNDFGQLGIGSSMPHTLDPVEVSGFHEKVVQISAGNHHSCAVTADGELFVWGKNSSGQLGLGKSAGKVVSTPRKVDYLADVRVKMTALGSEHSIVVTEDGEALSWGAAGAGRLGHGHKSSFLGFAMTSNEYTPRLIKNLDGIKIKRIAAGMLHSACIDEKGTVFMFGQKTEKVLGRSNDAPRPSAVEEIQFSEEVACGGYHTCAVTDRGDLYSWGSNENGCLGLGGTGMVRFPEVVRSSLFKLPVSKVSCGWKHTAVISGEDIYTWGWGGANGTFFEEGHSSGGQLGHGNDVDYCEPMMVELGKNASAVHVSCGFNHTGAILEYAEN

SEQ ID NO: 6267 - protein, 419 aa, Triticum aestivum
MWRARRWPRPRWFSSHTAAVGVDSGNPARRRVAALWGNGDHGRLGLGALESRWSPTACPFFLTRPADPPTSLACGGAHTLFLTEGGRVFATGLNDFGQLGIGSSMPHTLDPVEVSGFHEKVVEISAGNHHSCAVTADGELFVWGKNSSGQLGLGKSAGKVVSTPRKVDYLADVRVKMTALGSEHSIVVTEDGEALSWGAAGAGRLGHGHKSSFLGFAMTSNEYTPRLIKNLDGIKIKRIAAGMLHSACIDEKGTVFMFGQKTEKVLGRSNDAPRPSVVEEIQFSEEVACGGYHTCAVTDRGDLYSWGSNENGCLGLGGTGMVRFPEVVRSSLFKLPVSKVSCGWKHTAVISGEDIYTWGWGGANGTFFEEGHSSGGQLGHGNDVDYCEPMMVELGKNARAVHVSCGFNHTGAILEYAEN

SEQ ID NO: 6268 - protein, 422 aa, Brachypodium distachyon
MWRARRWPWPSPRSRPRWLSTEAVAGSGEPAWRRVAALWGNGDYGRLGLGALESRWNPTACPFFLARAGDPPASLACGGAHTLFLTQSGRVFATGLNDFGQLGIGSSTTHIVDPIEVTGFGEKVVQISAGNHHSCAVTADGELFVWGKNSSGQLGLGKGVGKVVSTPRKVDYLADVRVRMVALGSEHSIAVTEGGEALSWGAAGAGRLGHGHKSSILGFGMVSSEYTPRLIKNLDGVKIKRIAAGMLHSACIDEKGTLFIFGQKTEKVFGRSNDAPRPTVVEEIQFSEEVACGGYHTCALTDGGDLYSWGSNENGCLGLGVTGMVRSPEVLRSTLFKLPVSKVSCGWKHTAVISGEDIYTWGWGGANGTFFEEGQSSGGQLGHGNDVDYFEPMMVELGRNARAVHVSCGFNHTGAIFEYKEN

SEQ ID NO: 6269 - protein, 425 aa, Oryza sativa
MWRARRWPWPWRSQRRAARMLSSGEPAAGRRRVAALWGNGDYGRLGMGALESRWSPTACPFFLTGRPGDDDDDPPASLACGGAHTLFLTESGRVFAAGLNDFGQLGIGSSVTHSLEPIEVSGFDEKVVEVSAGNHHSCAVTADGKLFAWGRNSSGQLGLGKRAGKVVSTPRKVDCLADARVKMVALGSEHSIATTEEGEVLSWGAAGAGRLGHGHKTSILGFSITTSEYTPRLIKNLDGVKIKRIAAGMLHSACIDEKGTLFIFGQKTEKGFGRSGDELRPTVVEEVPFSEEVACGGYHTCVVTDSGDLYSWGSNENGCLGLGGTDMVRSPEVLKSSLFKFPVSKVSCGWKHTAVISGGDIYTWGWGGANGTFFEEGHSSGGQLGHGNDVDYFEPMMVEFGKNARAVHVSCGFNHTGAIFEYSEN

SEQ ID NO: 6270 - protein, 418 aa, Sorghum bicolor
MWRATRRCPPLLRWFSSDAAASKAAPRRQRVAALWGNGDYGRLGLGVLESRWSPTVCPFFLARAADPPASLACGGAHTLFLTQSGRVFATGLNDFGQLGVGSSVTHTLEPVEVSGFHERVVEVSAGNHHSCAVTADGKLFVWGRNSGGQLGLGKGAGKVVSTPTKVDCLTDFRIKMVALGSEHSIAVTEEGEVLSWGAAGSGRLGHGRQSSILGFSLTTSEYTPRLIKNFDGIKIKKIAAGMLHSACIDEKGTLFIFGQKTEKGFGRSNEAFRPNIVEEIPFSEEVACGGYHTCVVTDSGDLYSWGSNENGCLGLGGTDMVCSPEILKSSLFKLPVSKVSCGWKHTAVISGDDIYTWGWGGANGTFFEEGHSSGGQLGHGNDVDYFEPMMVPFGKNARAVHVSCGFNHTGAIYEYSED

SEQ ID NO: 6271 - protein, 416 aa, Setaria italica
MWRATRRWPPLLRCLSSDAASSRAPRQRVAALWGNGDYGRLGLGALESRWSPTACPFFLSRAADPPASLACGGAHTLFLTQSGRVFATGLNDFGQLGIGSSVTHTLEPVEVSGFHERVVEVSAGNHHSCAITADGKLFVWGRNSGGQLGLGKGAGKVVSSPTKVDCLTDFRVKMVALGSEHSIAVTDEGEVLSWGASGSGRLGHGPQSSILGFSLTSSEYTPRLIKNLDGIKIKKIAAGMLHSACIDEKGTLFIFGQKTEKGFGRSNEAFRPVIVEEIPFSEEVACGGYHTCVVADSGDLYSWGSNENGCLGLGGTDMVRSPEILKSSLFKLPVSKVSCGWKHTAVISGDDIYTWGWGGANGTFFEEGHSSGGQLGHGNDVDYFEPMMVPFGKNARAVHVSCGFNHTGAIYEYCED

SEQ ID NO: 6272 - protein, 345 aa, Leymus cinereus x Leymus triticoides
MSDAPGAPASAMGSGRELANPPSDGISNLRFSNHSDHLLVSSWDKTVRLYDAEANVLKGEFAHPGPVLDCCFHDDSSGFSAGADHTVRRLAFTSSKEDVLGRHDAPVRCVEYSYAAGQVITGSWDKTIKCWDPRGVSGPERTLVGTYAQPERVYSMSLVGNRLVVATAGRHVSIYDLRNMSQPEQKRESSLKYQTRCVRCFPNGTGYALSSVEGRVSMEFFDLSESAQSKKYAFKCHRKSESGRDTVYPVNAIAFHPIYGTFATGGHDGFVNVWDGTNKKRLYQYSKYVSSIAALSFSKDGHLLAVASSYGYEEGEKPHEPDLIFIRGVNEVEVKPKPKALAAPQ

SEQ ID NO: 6273 - protein, 345 aa, Secale cereale
MSDAPGAAASAMGSGRELANPPSDGISNLRFSNHSDHLLVSSWDKTVRLYDAEANVLKGEFAHPGPVLDCCFHDDSSGFSAGADHTVRRLSFTSSKEDVLGRHDAPVRCVEYSYAAGQVITGSWDKTIKCWDPRGVSGPERTLVGTYAQPERVYSMSLVGNRLVVATAGRHVSIYDLRNMSQPEQKRESSLKYQTRCVRCFPNGTGYALSSVEGRVSMEFFDLSESAQSKKYAFKCHRKSESGRDTVYPVNAIAFHPIYGTFATGGHDGFVNVWDGTNKKRLYQYSKYASSIAALSFSKDGHLLAVASSYGYEEGEKPHEPDAIFIRGVNEVEVKPKPKALAAPQ

SEQ ID NO: 6274 - protein, 345 aa, Triticum aestivum
MSDAPGAAASAMGSGRELANPPSDGISNLRFSNHSDHLLVSSWDKTVRLYDAEANLLKGEFAHPGPVLDCCFHDDSSGFSAGADHTVRRLSFTSSKEDVLGRHDAPVRCVEYSYAAGQVITGSWDKTIKCWDPRGVSGPERTLVGTYAQPERVYSMSLVGNRLVVATAGRHVSIYDLRNMSQPEQKRESSLKYQTRCVRCFPNGTGYALSSVEGRVSMEFFDLSESAQSKKYAFKCHRKSESGRDTVYPVNAIAFHPIYGTFATGGHDGFVNVWDGTNKKRLYQYSKYASSIAALSFSKDGHLLAVASSYGYEEGEKPHEPDAIFIRGVNEVEVKPKPKALAAPQ

SEQ ID NO: 6275 - protein, 345 aa, Brachypodium distachyon
MSDASAAPAAAMGSGRELANPPADGISNLRFSNHSDHLLVSSWDKTVRLYDADANVLKGEFAHPGPVLDCCFHDDSSGFSAGADHTVRRLVFTSSKEDVLGRHDGPVCCVEYSYAAGQVITGSWDKTIKCWDPRGVSGPERTLVGTYAQPERVYSMSLVGNRLVVATAGRHVNIYDLRNMSQPEQKRDSSLKYQTRCVRCFPNGTGYALSSVEGRVSMEFFDLSESAQSKKYAFKCHRKSESGRDTVYPVNAIAFHPIYGTFATGGCDGYVNVWDGTNKKRLYQYSKYASSIAALSFSKDGHMLAVASSYTYEEGEKSHEPDAIFIRGVNEVEVKPKPKALTAPK

SEQ ID NO: 6276 - protein, 344 aa, Panicum virgatum
MSAAAAAPAAMGSGKELANPPSDGISNLRFSNHSNNLLVSSWDKTVRLYDADANVLKGEFVHPGPVLDCCFHDDSSGFSAGADHTVRRLVFSSSKEDVLGRHDGPVRCVEYSYAAGQVITGSWDKTVKCWDPRGVSGPERTLVGTYTQPERVYSLSLVGNRLVVATAGRHVNIYDLRNMSQPEQKRDSSLKYQTRCVRCFPNGTGYALSSVEGRVSMEFFDLSESAQSKKYAFKCHRKSEAGRDSVYPVNAIAFHPIYGTFATGGCDGFVNVWDGINKKRLYQYSKYASSIAALSFSKDGHLLAVASSYTYEEGEKSHEPDAIFIRTVNEVEVKPKPKALAAPQ

SEQ ID NO: 6277 - protein, 343 aa, Panicum virgatum
MSAAAAPAAMGSGKELANPPSDGISNLLFSNHSNNLLVSSWDKTVRLYDADANVLKGEFVHPGPVLDCCFHDDSSGFSAGADHTVRRLVFSSSKEDVLGRHDGPVRCVEYSYAAGQVITGSWDKTVKCWDPRGVSGPERTLVGTYTQPERVYSLSLVGNRLVVATAGRHVNIYDLRNMSQPEQKRDSSLKYQTRCVRCFPNGTGYALSSVEGRVSMEFFDLSESAQSKKYAFKCHRKSEAGRDSVYPVNAIAFHPIYGTFATGGCDGFVNVWDGINKKRLYQYSKYASSIAALSFSKDGHLLAVASSYTYEEGEKSHEPDAIFIRTVNEVEVKPKPKALAAPQ

SEQ ID NO: 6278 - protein, 343 aa, Zea mays
MSSAAAPAAVGSGKELANPPADGITNLRFSNHSNNLLVSSWDKTVRLYDADANVLKGEFMHPGAVLDCCFHDDSSGFSAGADHTVRRLVFSSSKEDVLGRHDGPVRCVEYSYAAGQVITGSWDKTVKCWDPRGVSGPERTLVGTYAQPERVYSLSLVGNRLVVATAGRHVNIYDLRNMSQPEQKRDSSLKYQTRCVRCFPNGTGYALSSVEGRVSMEFFDLSESAQSKKYAFKCHRKSEAGRDTVYPVNAIAFHPIYGTFATGGCDGFVNVWDGINKKRLYQYSKYASSIAALSFSKDGHLLAVASSYTYEEGEKTHEPDAIFIRTVNEVEVKPKPKALAAPQ

SEQ ID NO: 6279 - protein, 343 aa, Oryza sativa
MSAAAAPAAAVGSGKELANPPTDGISNLRFSNHSDHLLVSSWDKTVRLYDADANVLKGEFVHAGAVLDCCFHDDSSGFSAGADHTVRRLVFGSAKEDLLGRHDAPVRCVEYSYAAGQVITGSWDKTIKCWDPRGVSGPERTLVGTYAQPERVYSLSLVGNRLVVATAGRHVNIYDLRNMSQHEQKRDSSLKYQTRCVRCFPNGTGYALSSVEGRVSMEFFDLSESAQSKKYAFKCHRKSEAGRDTVYPVNAIAFHPIYGTFATGGCDGFVNVWDGINKKRLYQYSKYASSIAALSFSKDGHLLAVASSYTYEEGEKSHEPDAIFIRSVNEVEVKPKPKALAAP

SEQ ID NO: 6280 - protein, 343 aa, Sorghum bicolor
MSSAAAPAAVGSGKELANPPADGISNLRFSNHSNNLLVSSWDKTVRLYDADANVLKGEFVHPGAVLDCCFHDDSSGFSAGADHTVRRLVFSSNKEDVLGRHDGPVRCVEYSYAAGQVITGSWDKTVKCWDPRGVSGPERTLVGTYAQPERVYSLSLVGNRLVVATAGRHVNIYDLRNMSQPEQKRDSSLKYQTRCVRCFPNGTGYALSSVEGRVSMEFFDLSESAQSKKYAFKCHRKSEAGRDTVYPVNAIAFHPIYGTFATGGCDGFVNVWDGINKKRLYQYSKYASSIAALSFSKDGHLLAVASSYTYEEGEKTHEPDAIFIRTVNEVEVKPKPKALAAPQ

SEQ ID NO: 6281 - protein, 343 aa, Cenchrus ciliaris
MSAAAAPAAMGSGKELANPPADGISNLRFSNHTNNLLVSSWDKTVRLYDADANVLKGEFVHPGPVLDCCFHDDSSGFSAGADHTVRRLVFGSAKEDVLGRHDGPVRCVEYAYAAGQVITGSWDKTVKCWDPRGVSGPERTLVGTYTQPERVYSLSLVGNRLVVATAGRHVNIYDLRNMSQPEQKRDSSLKYQTRCVRCFPNGTGYALSSVEGRVSMEFFDLSESAQSKKYAFKCHRKSEAGRDTVYPVNAIAFHPIYGTFATGGCDGFVNVWDGINKKRLYQYSKYASSIAALSFSKDGHLLAVASSYTYEDGEKSHEPDAIFIRTVNEVEVKPKPKALAAPQ

SEQ ID NO: 6282 - protein, 346 aa, Saccharum officinarum
MSSAAAPAAVGSGKELANPPADGISNLRFSNHSNNLLVSSWDKTVRLYDADANVLKGEFVHPGAVLDCCFHDDSSGFSAGADHTVRRLVFSSSKEDVLGRHDGPVRCVEYSYAAGQVITGSWDKTVKCWDPRGVSGPEHTLVGTYAQPERVYSLSLVGNRLVVATAGRHVNIYDLRNMSQPEQKRDSSLKYQTRCVRCYPNGTGYALSSVEGRVSMEFFDLSESAQSKKYAFKCHRKSEAGRDTVYPVNAIAFHPIYGTFATGGCDGFVNVWDGINKKRLYQYSKYASSIAALSFSKDGHLLAVASSYTYEEGEKTHEPDAIFIRTVNEVEVKPKPKALAAPPVVL

SEQ ID NO: 6283 - protein, 344 aa, Pennisetum glaucum
MCAAAAPAAMGSGKELANPPADGISNLRFSNHSNNLLVSSWDKTVRLYDADANLLKGEFVHPGPVLDCCFHDDSSGFSAGADHTVRRLVFGSAKEDVLGRHDGPVRCVEYSYAAGQVITGSWDKTVKCWDPRGVSGPDRTLVGTYTQPERVYSLSLVGNRLVVATAGRHVNIYDLRNMSQPEQKRDSSLKYQTRCVRCFPNGTGYALSSVEGRVSMEFFDLSESAQSKKYAFKCHRKSEAGRDTVYPVNAISFHPIYGTFATGGCDGFVNVWDGTNKKRLYQYSKYASSIAALSFSKDGHLLAVASSYTYEDGEKSHEPDAIFIRTVNEVEVKPKPKALAAPPQ

SEQ ID NO: 6284 - protein, 166 aa, Setaria italica
MSQPEQKRDSSLKYQTRCVRCFPNGTGYALSSVEGRVSMEFFDLSESAQSKKYAFKCHRKSEAGRDTVYPVNAIAFHPIYGTFATGGCDGFVNVWDGINKKRLYQYSKYTSSIAALSFSKDGHLLAVASSYTYEEGEKSHEPDAIFIRTVNEVEVKPKPKVLAAPQ

SEQ ID NO: 6285 - protein, 342 aa, Phalaenopsis aphrodite
MSGAPPSGSGRELANPPSDGISNLRFSNHSDHLLVSSWDKSVRLYDASANVLKGEFMHGGPVLDCCFHDDSSGFSASADCTVRRHVFSSGKEDILGRHDAPVRCVEYSYAAGQVITGSWDKTLKCWDPRGASGPEHTLVGTYPQPERVYSLSLVGHRLVVATAGRHVNVYDLRNMSQPEQRRESSLKYQTRCVRCYPNGTGFALSSVEGRVAMEFFDLSEASQSKKYAFKCHRKSEAGRDTVYPVNAIAFHPIYGTFATGGCDGYVNVWDGNNKKRLYQYSKYPSSIAALSFSKDGRLLAVASSYTFEEGDIPHEEDAIFLRSINEVEVKPKPKAIPAATPL

SEQ ID NO: 6286 - protein, 341 aa, Unknown
  Sequence found in Organisms: Prunus persica, Prunus mume
MTAVPPPAPGRELSSPPSDGISNLRFSNHSDHLLVSSWDKTVRLYDASANVLRGEFKHGGPVLDCCFHDDSSGFSAGADNTVRRLVFSSSKEDILGRHDAPVRCVEYSYAAGQLITGSWDKTLKCWDPRGASGQERTLVGTYPQPERVYSLSLVGNRLVVATAGRHVNVYDLRNMSQPEQRRESSLKYQTRCVRCYPNGTGYALSSVEGRVAMEFFDLSEASQTKKYAFKCHRKSEAGRDIVYPVNAIAFHPIYGTFATGGCDGYVNVWDGNNKKRLYQYSKYPTSIAALSFSRDGRLLAVASSYTFEEGDKPHEPDSIFVRSVNEIEVKPKPKVYPNPPA

SEQ ID NO: 6287 - protein, 340 aa, Aristolochia fimbriata
MTAVHPPAPGRELAKPPSDGISNLRFSNHSDHLLVSSWDKSVRLYDASANVLRGEFLHGGPVLDCCFHDDSSGFSASADHTVRRYVFSSGKEDILGRHDAPVRCVEYSYAAGQVITGSWDKTLKCWDPRGASGQERTLVGTYPQPERVYSLSLVGNRLVVATAGRHVNVYDLRNMSQPEQRRESSLKYQTRCVRCYPNGTGFALSSVEGRVAMEFFDLSEAGQAKKYAFKCHRKSEAGKDTVYPVNAIAFHPIYGTFATGGCDGYVNVWDGNNKKRLYQYSKYPTSIAALSFSRDGRLLAVASSYTFEEGDKPHEPDAIFVRSVNEVEVKPKPKVYPTPS

SEQ ID NO: 6288 - protein, 342 aa, Carica papaya
MTAVAQPPASGRELSNPPSDGISNLRFSNHSDHLLVSSWDKTVRLYDASANVLRGEFMHGGPVLDCCFHDDSSGFSASADNTVRRLVFNIGKEDVLGRHEAPVRCVEYSYAAGQVITGSWDKTLKCWDPRGASGQERTLVGTYPQPERVYSLSLVGNRLVVATAGRHVNIYDLRNMSQPEQRRESSLKYQTRCVRCYPNGTGYALSSVEGRVAMEFFDLSEVSQAKKYAFKCHRKSEAGRDIVYPVNAIAFHPVYGTFATGGCDGFVNVWDGNNKKRLYQYSKYPSSIAALSFSRDGRLLAVGSSYTFEEGDKPHEPDSIFIRSVNEIEVKPKPKVYPNPPV

SEQ ID NO: 6289 - protein, 342 aa, Sesamum indicum
MTAPPPPPSTGRELSSPPTDGISNLRFSNHSDHLLVSSWDKSVRLYDASANALRGEFMHGGPVLDCCFHDDSSGFSACADHTVRRLVFNYNREDVLGRHDAPVRCVEYSYGTGQVITGSWDKTLKCWDPRGASGQERSLVGTYTQPERVYSMSLVGNRLVVATAGRHVNVYDLRNMSQPEQRRESSLKYQTRCVRCYPNGTGYALSSVEGRVAMEFFDLSEAGQSKKYAFKCHRKSEAGRDIVYPVNAIAFHPIYGTFATGGCDGYVNVWDGNNKKRLYQYTKYPTSIAALSFSRDGRLLAVASSYTYEEGDKDHEPDAIFVRSVNEVEVKPKPKALPNPAT

SEQ ID NO: 6290 - protein, 341 aa, Malus domestica
MTAVPPPAPGRELSNPPTDGISNLRFSNHSDHLLVSSWDKTVRLYDASADVLRGEFMHGGPVLDCCFHDDSSGFSAGADNTVRRFVFSSSKEDILGRHDAPVRCIEYSYAAGQLITGSWDKTVKCWDPRGASGQEQTLVGSYPQPERVYSLSLVGNRLVVATAGRHVNVYDLRNMSQPEQRRESSLKYQTRCVRCYPNGTGYALSSVEGRVAMEFFDLSEASQTKKYAFKCHRKSEAGRDIVYPVNAIAFHPIYGTFATGGCDGYVNVWDGNNKKRLYQYSKYPTSIAALSFSRDGRLLAVASSYTYEEGDKPHEPDAIFVRSVNEIEVKPKPKAYPNPPA

SEQ ID NO: 6291 - protein, 342 aa, Manihot esculenta
MTAVVPPPGSGRELSSPPSDGISNLRFSNHSDHLLVSSWDKSVRLYDASANALRGEFMHGGPVLDCCFHDDSSGFSASADNTVRRLVFSYGKEDILGRHDAPVRCIEYSYAAGQVITGSWDKTLKCWDPRGASGQERTLVGTYPQPERVYSLSLVGNRLVVATAGRHVNIYDLRNMSQPEQRRESSLKYQTRCVRCYPNGTGYALSSVEGRVAMEFFDLSEASQAKKYAFKCHRKSEAGRDIVYPVNAIAFHPVYGTFATGGCDGFVNVWDGNNKKRLYQYSKYPSSIAGLSFSRDGRLLAVASSYTFEEGDKPHEPDAIFVRSVNEIEVKPKPKVLPTPPA

SEQ ID NO: 6292 - protein, 342 aa, Unknown
  Sequence found in Organisms: Citrus clementina, Citrus sinensis
MTAVHPPPTSGRELGNPPSDGISNLRFSNHSDHLLVSSWDKSVRLYDASANVLRGEFMHGGPVLDCCFHDDSSGFSASADHTVRRLVFSHGKEDILGKHDAPVRCIEYSYAAGQVITGSWDKSLKCWDPRGASGQERTLVGTYPQPERVYSLSLVGNRLVVATAGRHVNVYDLRNMSQPEQRRESSLKYQTRCVRCYPNGTGYALSSVEGRVAMEFFDLSEASQAKKYAFKCHRKSEAGRDIVYPVNAIAFHPIYGTFATGGCDGFVNVWDGNNKKRLYQYSKYPTSIAALSFSRDGRLLAVASSYTFEEGDKPHEPDAIFVRSVNEIEVKPKPKAYPNPPA

SEQ ID NO: 6293 - protein, 375 aa, Eucalyptus grandis
PPPRFQISLPSPPADLQNPKKSPALPPPPTGRREINSPVPPAPGRELSSPPSDGISNLRFSNHSDHLLVSSWDKTVRLYDASANVLRGEFLHGGAVLDCCFHDDSSGFSASADHAVRRLVFNAGKEDILGKHDAPVRCVEYSYAAGQVITGSWDKTLKCWDPRGASGQDRTLVGTYPQPERVYSLSLVGNRLVVATAGRHVNIYDLRNMSQPEQRRESSLKYQTRCVRCYPNGTGYALSSVEGRVAMEFFDLSEASQAKKYAFKCHRKSEAGRDIVYPVNAIAFHPIYGTFATGGCDGFVNVWDGNNKKRLYQYSKYPTSIAALSFSRDGRLLAVGSSYTFEEGDKPHEPDAIFVRSVNEIEVKPKPKVYPNPPA

SEQ ID NO: 6294 - protein, 343 aa, Elaeis guineensis
MSAAVLPTSSGGRELSNPPSDGISNLRFSNHSDHLLVSSWDKTVRLYDASANILKGEFMHGGPVLDCCFHDDFSGFSASADNTVRRFVFGTGKEDILGRHEAPVRCVEYSYAAGQVITGSWDKTLKCWDPRGASGPDRTLVGTYPQPERVYSLSLVGHRLVVATAGRHVNVYDLRNMSQPEQRRESSLKYQTRCVRCYPNGTGFALSSVEGRVAMEFFDLSEAGQSKKYAFKCHRKSEAGKDTVYPVNAIAFHPIYGTFATGGCDGYVNVWDGNNKKRLYQYSKYPTSIAALSFSRDGRLLAVASSYTFEEGDIAREPDAIFVRNVNEVEVKPKPKALPAPPP

SEQ ID NO: 6295 - protein, 342 aa, Ricinus communis
MTAVAPPLGSGRELSNPPTDGISNLRFSNHSDHLLVSSWDKSVRLYDASANALRGEFLHGGPVLDCCFHDDSSGFSASADNTVRRLVFNYGKEDILGRHDAPVRCIEYSYAAGQVITGSWDKTLKCWDPRGASGQDRTLVGTYPQPERVYSLCLVGNRLVVATAGRHVNIYDLRNMSQPEQRRESSLKYQTRCVRCYPNGTGYALSSVEGRVAMEFFDLSEASQAKKYAFKCHRKSEAGRDIVYPVNAIAFHPVYGTFATGGCDGFVNVWDGNNKKRLYQYSKYPSSIAALSFSRDGRLLAVASSYTFEEGDKPHEPDSIFVRSVNEIEVKPKPKVLPNPPA

SEQ ID NO: 6296 - protein, 341 aa, Raphanus sativus
MSQPPPPSAGRELANPPSDGISNLRFSNTSDHLLVSSWDKSVRLYDVSTNSLKGEFLHGGAVLDCCFHDDSSGFSVGSDNKVRRIVFNVGKEDVLGTHEKPVRCVEYSYAAGQVITGSWDKTVKCWDPRGASGPERTQVGTYVQPERVYSLSLVGNRLVVATAGRHVNIYDLRNMSQPEQRRESSLKYQTRCVRSYPNGTGYALSSVEGRVAMEFFDLSEAAQAKKYAFKCHRKSEAGRDIVYPVNAIAFHPIYGTFATGGCDGFVNIWDGNNKKRLYQYSKYPSSIAALSFSRDGHLLAVASSYTFEEGEKSHEPEAIFVRNVNEIEVKPKPKACPTPAA

SEQ ID NO: 6297 - protein, 341 aa, Amsonia hubrichtii
MTAAPQVSTGRELSSPPTDGISNLRFSNHSDHLLVSSWDKSVRLYDASANDLRGEFMHGGPVLDCCFHDDSSGFSASADNTVRRLVFNYGREDILGRHDAPVRCVEYSYATGQVITGSWDKTLKCWDPRGASGQDRTLVGTYAQPERVYSLSVVGNRLVVATAGRHVNVYDLRNMSQPEQRRESSLKYQTRCVRCYPNGTGYALSSVEGRVAMEFFDLSESGQSKKYAFKCHRKSEAGRDIVYPVNAIAFHPIYGTFATGGCDGFVNVWDGNNKKRLYQYTKYPSSIAALSFSRDGRLLAVASSYTFEEGDKPHEPDAIFVRSVNEVEVKPKPKVLPNPAA

SEQ ID NO: 6298 - protein, 341 aa, Gossypium hirsutum
MTSAQPPAPGRELSNPPTDGISNLRFSNHSDHLLVSSWDKTVRLYDASADSLRGEFMHGGPVLDCCFHDDSSGFSASADNTVRRIVFSHGKEDILGRHDAPVRCIEYSYAAGQVITGSWDKTLKCWDPRGASGQERTLVGTYPQPERVYSLSLVGNRLVVATAGRQVNVYDLRNMSQPEQRRESSLKYQTRCVRCYPNGTGYALSSVEGRVAMEFFDLSEASQAKKYAFKCHRKSEAGRDIVYPVNAIAFHPVYGTFATGGCDGFVNVWDGNNKKRLYQYSKYPTSIAALSFSRDGRLLAVASSYTFEEGEKPHEPDAIFVRSVNEIEVKPKPKVYPNPPA

SEQ ID NO: 6299 - protein, 341 aa, Citrullus lanatus
MTAVPPPAAGRELSNPPSDGISNLRFSNHSDHLLVSSWDKTVRLYDASANVLRGEFVHGGPVLDCCFHDDSSGFSASVDNTVRRLVFNHNKEDILGRHDAPVRCVEYSYAAGQLITGSWDKTLKCWDPRGASGQEHTLVGTYPQPERVYSLSLVGNRLVVATAGRHVNVYDLRNMSQPEQRRESSLKYQTRCVRCYPNGTGYALSSVEGRVAMEFFDPSEASQAKKYAFKCHRKSEAGRDIVYPVNAIAFHPIYGTFATGGCDGYVNVWDGNNKKRLYQYSKYPTSIAALSFSRDGRLLAVASSYTFEEGDKPHEPDAIYVRSVNEIEVKPKPKVYPNPPT

SEQ ID NO: 6300 - protein, 342 aa, Unknown
  Sequence found in Organisms: Pinus pinaster, Pinus taeda
MAATSPVGAGSGRELANPPTDGISNLRFSNHSDHLLVSSWDRKVRLYDASANSLKGQFVHGGPVLDCCFHDDASGFSGSADNTVRRYDFSTRKEDILGRHEAPVRCVEYSYAAGQVITGSWDKTLKCWDPRGASGQEKTLVGTYSQPERVYSMSLVGHRLVVATAGRHINVYDLRNMSQPEQRRESSLKYQTRCVRCYPNGTGFALSSVEGRVAMEFFDLSEAGQAKKYAFKCHRKSEAGRDTVYPVNAIAFHPIYGTFATGGCDGYVNVWDGNNKKRLYQYSKYPTSIAALSFSRDGRLLAVASSYTFEEGEKPHEPDAVFVRSVNEAEVKPKPKVYAAPP

SEQ ID NO: 6301 - protein, 340 aa, Arachis hypogaea
MATAVTPASLGRELSDPPSDGISNLRFSNHSDLLLVSSWDKSVRLYDASANVLKAEFMHGGPVLDCCFHDDSSGFSAAGDNTVRRLLFASNKDDILGKHDAPVRCVEYSYAAGQLITGSWDKTLKCWDPRGASGQERTLVGTYPQPERVYSLSLVGHRLVVATAGRHVNIYDLRNMSQPEQRRESSLKYQTRCVRCYPNGTGYALSSVEGRVAMEFFDLSDASQAKKYAFKCHRKSEAGRDIVYPVNAIAFHPVYGTFATGGCDGYVNVWDGNNKKRLYQYSKYPTSIAALSFSRDGRLLAVASSYTYEEGLKPHDKDAIYIRGVNEIEVKPKPKVLPPA

SEQ ID NO: 6302 - protein, 342 aa, Picea glauca
MAATAPVGAGSGRELANPPTDGISNLRFSNHSDHLLVSSWDRKVRLYDASANTLKGQFVHGGPVLDCCFHDDASGFSGSADHAVRRYDFSTRKEDILGRHEAPVRCVEYSYAAGQVITGSWDKTLKCWDPRGASGHEKTLVGTYSQPERVYSMSLVGHRLVVATAGRNINVYDLRNMSQPEQRRESSLKYQTRCVRCYPNGTGFALSSVEGRVAMEFFDLSEAGQAKKYAFKCHRKSEAGRDTVYPVNAIAFHPIYGTFATGGCDGYVNVWDGNNKKRLYQYSKYPTSIAALSFSRDGRLLAVASSYTFEEGDKPHEPDAIFVRSVNEAEVKPKPKVYAAPP

SEQ ID NO: 6303 - protein, 340 aa, Triphysaria pusilla
MTAAPQPPTGRELTSPPTDGISNLRFSNHSDHLLVSSWDKSVRLYDASANELRGEFMHGGAVLDCCFHDDSSGFSASADHTVRRLVFNYNREDILGKHDAPVRCIEYSYATGQVITGSWDKTIKCWDPRGSSGQDRSLVGTYSQPERVYSMSLVGNRLVIATAGRHVNVYDLRNMSQPEQRRESSLKYQTRCVRSYPNGTGYALSSVEGRVAMEFFDLSEAGQSKKYAFKCHRKSEAGRDIVYPVNAIAFHPIYGTFATGGCDGYVNVWDGNNKKRLYQYAKYPSSIAGLSFSRDGRLLAVASSYTYEEGEKQHEPDAIFVRSVNEVEVKPKPKVLPNPA

SEQ ID NO: 6304 - protein, 342 aa, Aquilegia formosa
MSAIVPPPPAPGKELLNPPRDGISNLRFSNHSDHLLVSSWDKSVRLYDATSNVMMGEFLHGGPVLDCCFHDDSSGFSASADNTVRRYVFSSGKEDILGRHEAPVRCIEYSYAAGQVITGSWDKTVKCWDPRGASGKERTLVGTYPQPERVYSLSLVGNRLVVATAGRHVNVYDLRNMSQPEQRRESSLKYQTRCVCCYPNGTGFALSSVEGRVAMEFFDLSEAGQAKKYAFKCHRKSEAGRDTVYPVNAIAFHPIYGTFATGGCDGFVNVWDGNNKKRLYQYSKYPTSIAALSFSRDGRLMAVASSYTYEEGDKPHESDAIFVRSVNEIEVKPKPKVYANPS

SEQ ID NO: 6305 - protein, 340 aa, Nicotiana benthamiana
MTAVPQSAGRELASPPKDGISNLRFSNHSDHLLVSSWDKTVRLYDASANALRGEFMHGGPVLDCCFHDDSSGFSASADNTVRRLVFNYGREDILGRHDAPVRCIEYSYATGQVITGSWDKTLKCWDPRGASGQERTLVGTYTQPERVYSLSLVGNRLVVATAGRHVNVYDLRNMSQPEQRRESSLKYQTRCVRCYPNGTGYALSSVEGRVAMEFFDLSEAGQSKKYAFKCHRKTEAGRDIVYPVNAIAFHPIYGTFATGGCDGYVNVWDGNNKKRLYQYPKYPSSIAALSFSRDGRLLAVASSYTFEEGEKPHEPDAIIVRSVNEVEVKPKPKVLPNPTT

SEQ ID NO: 6306 - protein, 340 aa, Nicotiana benthamiana
MTAVAQSAGRELASPPKDGISNLRFSNHSDHLLVSSWDKTVRLYDASANALRGEFMHGGPVLDCCFHDDSSGFSASADNTVRRLVFNYGREDILGRHDAPVRCIEYSYATGQVITGSWDKTLKCWDPRGASGQERTLVGTYTQSERVYSLSLVGNRLVVATAGRHVNVYDLRNMSQPEQRRESSLKYQTRCVRCYPNGTGYALSSVEGRVAMEFFDLSEAGQSKKYAFKCHRKTEAGRDIVYPVNAIAFHPIYGTFATGGCDGYVNVWDGNNKKRLYQYPKYPSSIAALSFSRDGRLLAVASSYTFEEGEKPHEPDAIIVRSVNEVEVKPKPKVLPNPTT

SEQ ID NO: 6307 - protein, 340 aa, Papaver somniferum
MTTAIPPMPGRELTNPPKDGVSNLRFSNHSDNLLVSSWDKSVKLYDANANGLKGEFMHGGPVLDCCFHDDSSGFSAGGDNTVRRFVFESGKEDILGKHDAPVRCVEYSYAAGQVITGSWDKMLKCWDPRGASGQERTLVGMYPQPERVYSISLVGNRLVVATAGRHVNVYDLRNMSQPEQRRESSLKYQTRCVRCYPNGTGFALSSVEGRVAMEFFDLSEAGQAKKYAFKCHRKSEAGRDTVYPVNAIAFHPIYGTFATGGCDGFVNVWDGNNKKRLYQYSKYPTSIAALSFSKDGRLLAVASSYTYEEGDQSHEPDAIFVRTVNEVEVKPKPKVYPTPA

SEQ ID NO: 6308 - protein, 185 aa, Lippia dulcis
MTAAPPPSTGRELSSPPTDGVSNLRFSNHSDHLLVSSWDKSVRLYDASANALRGEFMHGGPVLDCCFHDDTSGFSASADCTVRRLVFNYNREDILGRHDAPVRCVEYSYATGQVITGSWDKTLKCWDPRGASGQERTLVGTHTQPERVYSLSLVGNRLVVATAGRHVNVYDLRNMSQPEQRRESS

SEQ ID NO: 6309 - protein, 337 aa, Tabernaemontana elegans
MTATPQASTGRELSSPPTDGISNLRFSNHSDHLLVSSWDKSVRLYDASANDLRGEFMHGGPVLDCCFHDDSSGFSASADNTVRRLVFNHGREDILGRHDAPVRCVEYSYATGQVITGSWDKTLKCWDPRGASGQERTLVGTYTQPERVYSLSVVGNRLVVATAGRHVNVYDLRNMSQPEQRRESSLKYQTRCVRCYPNGTGYALSSVEGRVAMEFFDLSETGQSKKYAFKCHRKSEAGRDIVYPVNAIAFHPIYGTFATGGCDGFVNVWDGNNKKRLYQYAKYPTSIAALSFSRDGRLLAVASSYTFEEGDKSHEPDAIFVRSVNEVEVKPKPKVLP

SEQ ID NO: 6310 - protein, 342 aa, Musa acuminata
MSAATLPATGGRELSDPPSDGISNLRFSNHSDLLLVSSWDRSLRLYDAGADALKGEFAHVGPVLDCCFHDDSSGFSACADHMVRRFVFGSGKEDILGRHDAPVRCVEYSYATGQVITGSWDKTLKCWDPRGASGPDHALVGTYPQPERVYSLSLVGHRLVVATAGRHVNVYDLRNMSQPEQRRESSLKYQTRCVRCYPNGTGFALSSVEGRVAMEFFDLSEAAQAKKYAFKCHRKSEAGRDTVYPVNAIAFHPIYGTFATGGCDGYVNVWDGNNKKRLYQYSKYPTSIAALSFSRDGRQLAVASSYTFEEGDTLHEPDTIFVRNVNEVEVKPKPKALPAPPP

SEQ ID NO: 6311 - protein, 340 aa, Brassica rapa
MSQPPPSAGRELANPPSDGISNLRFSNTSDHLLVSSWDKRVRLYDVSTNSLKGEFLHGGAVLDCCFHDDSSGFSVGSDNKVRRIVFNVGKEDVLGMHEKPVRCVEYSYAAGQVITGSWDKTVKCWDPRGASGPERTQVGTYLQPERVYSLSLVGNRLVVATAGRHVNIYDLRNMSQPEQRRESSLKYQTRCVRSYPNGTGYALSSVEGRVAMEFFDLSEAAQAKKYAFKCHRKSEAGRDIVYPVNAIAFHPIYGTFATGGCDGFVNIWDGNNKKRLYQYSKYPSSIAALSFSRDGQLLAVASSYTFEEGEKSHEPEAIFVRNVNEIEVKPKPKAYPNPAA

SEQ ID NO: 6312 - protein, 341 aa, Unknown
  Sequence found in Organisms: Castanea mollissima, Quercus alba
MTAVPAPTPGRELSNPPSDGISNLRFSNHSDHLLVSSWDKSVRLYDASANALRGEFMHGGPVLDCCFHDDSSGFSAGADNTVRRLVFSYNKEDILGRHDAPVRCIEYSYAAGQLITGSWDKTLKCWDPRGASGQERTLVGTYPQPERVYSLSLVGHRLVVATAGRHVNVYDLRNMSQPEQRRESSLKYQTRCVRCYPNGTGYALSSVEGRVAMEFFDPSESSQAKKYAFKCHRKSEAGRDIVYPVNAIAFHPVYGTFATGGCDGYVNVWDGNNKKRLYQYSKYPTSVAALSFSRDGRLLAVASSYTFEEGDKPHEPDAIYVRSVNEIEVKPKPKVYPNTPA

SEQ ID NO: 6313 - protein, 340 aa, Solanum lycopersicum
MTAVSQSAGRELENPPKDGISNLRFSNHSDHLLVSSWDKTVRLYDASANALRGEFMHGGAVLDCCFHDDSSGFSASADNTVRRLVFNSGREDILGRHDAPVRCIDYSYATGQVITGSWDKTLKCWDPRGASGQEHTLVGTYTQPERVYSLSLVGNRLVVATAGRHVNVYDLRNMNQPEQRRESSLKYQTRCVRCYPNGTGYALSSVEGRVAMEFFDLSESGQSKKYAFKCHRKSEAGRDIVYPVNAIAFHPIYGTFATGGCDGYVNVWDGNNKKRLYQYPKYPSSVAALSFSRDGKLLAVASSYTFEEGEKPHEPDAIFVRSVNEVEVKPKPKVLPNPTS

SEQ ID NO: 6314 - protein, 122 aa, Fagus grandifolia
MTAVPTPTPGRELSNPPSDGISNLRFSNHSDHLLVSSWDKSVRLYDASANALRGEFMHGGPVLDCCFHDDSSGFSAGADHTVRRLVFSSNKEDILGRHDAPVRCIEYSYAAGQLSRVVGTKP

SEQ ID NO: 6315 - protein, 243 aa, Sarracenia psittacina
MAAVPQVAGRELSKPPSDGISNLRFSNHSDHLLVSSWDKSVRLYDASANVLRGEFMHGGPVLDCCFHDDSSGFSACVDSSVRRLVFGLGKEDILGRHDAPVRCIEYSYATGQVITGSWDKTLKCWDPRGASGQERTLVGTYTQPERVYSLSLFGNRLVAATAGRHVNVYDLRNMSQPEQRRESSLKYQTRCVRCYPNGQVMLLVLWKVGLQWNFLIFLSLVNPRNTLSSVIESQKLEGTLFTL

SEQ ID NO: 6316 - protein, 341 aa, Phaseolus coccineus
MASAVPAATGRELSNPPSDGITNLRFSNHSDNLLVSSWDKSVRLYDASANVLRGEFMHAGPVLDCCFHDDSSGFSASADNTVRRLFFSSNKEDILGRHDAPVRCVEYSYAAGQLITGSWDKTLKCWDPRGASGQERTLVGTYPQPERVYSLSLVGHRLVVATAGRHVNIYDLRNMSQPEQKRESSLKYQTRCVRCYPNGTGYALSSVEGRVAMEFFDLSEASQAKKYAFKCHRKSEAGRDIVYPVNAIAFHPIYGTFATGGCDGYVNVWDGNNKKRLYQYSKYPTSVAALSFSRDGRLLAVASSYTFEEGPKSNEPDAIFVRSVNEIEVKPKPKVYPNPPA

SEQ ID NO: 6317 - protein, 341 aa, Lactuca sativa
MAVAPPVTGKELINPPSDGISNLRFSHHSDHLLVSSWDKTVRLYDASENVLRGEFTHGGAVLDCCFHDDNSGFSASADNTVRRLVFNNEREDVLGRHDAPVRCIEYSYATGQVITGSWDKTLKCWDPRGATSAQERALVGTYAQPERVYSLSLVGNRVVVATAGRHVNVYDLRNMSQPEQQRESSLKYQTRCVRCYPNGTGYALSSVEGRVAMEFFDLSPAGQSKKYAFKCHRKSEAGRDIVYPVNAIAFHPVYGTFATGGCDGFVNVWDGNNKKRLYQYSKYPTSIAALSFSRDGRLLAVASSYTFEEGEKPHEPDAIFVRSVNEVEVKPKPKQYPNPAT

SEQ ID NO: 6318 - protein, 341 aa, Vigna unguiculata
MASAVPAATGRELSNPPSDGITNLRFSNHSDHLLVSSWDKSVRLYDASANVLRGEFMHAGPVLDCCFHDDSSGFSAAADNTVRRLVFSSNKEDILGRHDAPVRCVEYSYAAGQLITGSWDKTLKCWDPRGASGQERTLVGTYPQPERVYSLSLVGHRLVVATAGRHVNIYDLRNMSQPEQKRESSLKYQTRCVRCYPNGTGYALSSVEGRVAMEFFDLSEASQAKKYAFKCHRKSEAGRDIVYPVNAIAFHPIYGTFATGGCDGYVNVWDGNNKKRLYQYSKYPTSVAALSFSRDGRLLAVASSYTFEEGPKSNESDAIFVRSVNEIEVKPKPKVYPNPPA

SEQ ID NO: 6319 - protein, 342 aa, Populus trichocarpa
MTAVIPPPFSGRELSNPPTDGISNLRFSNHSDLLLVSSWDKTVRLYDASANALRGEFLHGGAVLDCCFHDDSSGFSASGDNTVRRLVFNHGKEDILGRHDAPVRCIEYSYAAGQVITGSWDKTLKCWDPRGASGQERTLVGTYPQPERVYSLSLVGNRLVVATAGRHVNVYDLRNMSLPEQRRESSLKYQTRCVRCYPNGTGYALSSVEGRVAMEFFDPSEASQAKKYAFKCHRKSEAGRDIVYPVNAIAFHPVYGTFATGGCDGFVNVWDGNNKKRLYQYSKYPSSVAALSFSRDGRLLAVASSYTYEEGDKPHEPDAIFVRSVNEIEVKPKPKAYPNPPA

SEQ ID NO: 6320 - protein, 341 aa, Mimulus guttatus
MSAAPPQPPGRELSNPPTDGISNLRFSNHSDQLLVSSWDKSVRLYDASANALMGEFMHGAAVLDCCFHDDSSGFSACADHTVRRLVFNYNREDILGRHDAPVRCVEYSYATGQVITGSWDKTLKCWDPRGTNGQERCLVGTYTQPERIYSMSLVGNRLVVATAGRHVNVYDLRNMSQPEQRRESSLKYQTRCVRCYPNGTGYALSSVEGRVAMEFFDLSEAGQTKKYAFKCHRKSEAGTDIVHPVNAIAFHPIYGTFATGGCDGYVNMWDGNNKKRLYQYSKYPTSIAALSFSRDGRLLAVASSYTYEEGDKPHEPDAIFVRSVNEVEVKPKPKVLPSPAT

SEQ ID NO: 6321 - protein, 342 aa, Populus trichocarpa
MTAVIPPQFSGRELSNPPTDGISNLRFSNHSDHLLVSSWDKTVRLYDAGTNVLRGEFMHGGAVLDCCFHDDSSGFSASADNTVRRLVFNYEKEDILGRHDAHVRCVEYSYAAGQVITGSWDKTLKCWDPRGASGQERTLIGTYLQPERVYSLSLVGNRLVVATAGRHVNVYDLRNMSQPEQRRESSLKYQTRCVRCYPNGTGYALSSVEGRVAMEFFDSSEASQAKKYAFKCHRKSEAGRDIVYPVNAIAFHPVYGTFATGGCDGFINIWDGNNKKRLYQYSKYPSSIAALSFSRDGSLLAVASSYTYEEGDKPHEPDAIFVRSVNEIEVKPKPKPYPNPPA

SEQ ID NO: 6322 - protein, 340 aa, Unknown
  Sequence found in Organisms: Solanum tuberosum, Solanum phureja
MTAVSQSAGRELENPPKDGISNLRFSNHSDHLLVSSWDKTVRLYDASANALRGEFMHGGAVLDCCFHDDSSGFSASADNTVRRLVFNSGREDILGRHDAPVRCIDYSYATGQVITGSWDKTLKCWDPRGASGQEHTLVGTYTQPERVYSLSLVGNRLVVATAGRHVNVYDLRNMNQPEQRRESSLKYQTRCVRCYPNGTGYALSSVEGRVAMEFFDLSESGQSKKYAFKCHRKSEAGRDIVYPVNAIAFHPIYGTFATGGCDGYVNVWDGNNKKRLYQYPKYPSSVAALSFSRDGKLLAVASSYTFEEGEKPHEPDAIYVRSVNEVEVKPKPKVLPNPTS

SEQ ID NO: 6323 - protein, 341 aa, Fragaria vesca
MTAVPPPSSGQELSNPPTDGVSNLRFSNHSDHLLVSSWDRTVRLYDATANVLRGEFSHGSPVLDCCFHDDSSGFSASADNTVRRFVFNSNKEDIIGKHDAPVRCVEYSYAAGQLITGSWDKTLKCWDPRGANGQERTLIGTYQQPERVYSLSLVGNRLVVATAGRHVNVYDLRNMSQPEQRRESSLKYQTRCVRCYPNGTGYALSSVEGRVAMEFFDLSEASQTKKYAFKCHRKSEAGRDIVYPVNAIAFHPIYGTFATGGCDGYVNVWDGNNKKRLYQYSKYPTSIAALSFSRDGRLLAVASSYTFEEGEKPHEPDAIFVRNVNEIEVKPKPKVYPNPPA

SEQ ID NO: 6324 - protein, 166 aa, Vaccinium corymbosum
MAAVPPVAGRELSNPPSDGITNLRFSNHSDHLLVSSWDKSVRLYDASADVLRGEFTHGGPVLDCCFHDDSSGFSASADNTVRRLVFSLGKEDILGKHDAPVRCIEYSYATGQVITGSWDKTLKCWDPRGASGQERTLVGTYTQPERVYSLSLFCQPFSRSNCRKAC

SEQ ID NO: 6325 - protein, 341 aa, Beta vulgaris
MSAVAPPVVGRELLNPPTDGVTNLRFSNHSDHLLVSSWDKTVRLYDASANVLRGEFKHGGPVLDCCFHDDSSGFSASGDSTVRRLVFNSGKEDILGKHEAHVRCVEYSYTTGQVISGSWDKTLKCWDPRGASGQERTLVGTYAQPERVYSMSLVGHRVVVATAGRHVNVYDLRNMSQPEQRRESSLKYQTRCVRCYPNGTGYALSSVEGRVAMEFFDLSEAGQSKKYAFKCHRKSEAGRDIVYPVNAIAFHPIYGTFATGGCDGIVNVWDGNNKKRLYQYVKYPTSISALSFSKDGRLLAVASSYTYEEGEKPHEPDAIFIRSVNEVEVKPKPKVYANPPA

SEQ ID NO: 6326 - protein, 340 aa, Glycine max
MASAVPATGRELSNPPSDGITNLRFSNHSDHLLVSSWDKSVRLYDASANVLRGEFMHAGPVLDCCFHDDSSGFSVAADNTVRRLVFSSNKEDILGRHDAPVRCVEYSYAAGQLITGSWDKTLKCWDPRGASGQERTLVGTYPQPERVYSLSLVGHRLVVATAGRHVNIYDLRNMSQPEQRRESSLKYQTRCVRCYPNGTGYALSSVEGRVAMEFFDLSEASQAKKYAFKCHRKSEAGRDIVYPVNAIAFHPIYGTFATGGCDGYVNVWDGNNKKRLYQYSKYPTSVAALSFSRDGRLLAVASSYTFEEGPKSQEQDAIFVRSVNEIEVKPKPKVYPNPPA

SEQ ID NO: 6327 - protein, 341 aa, Vigna unguiculata
MASAVAAAAGLELSNPPSDGITNLRFSNHSDNLLVSSWDKSVRLYDASANVLRGEFRHAGPVLDCCFHDDSSGFSVAADNTVRRLFFSSNKEDILGKHDAPVRCVEYSYAAGQLITGSWDKTLKCWDPRGASGQERTLVGTYPQPERVYSLSLVGNRLVVATAGRHVNIYDLRNMSQPEQKRESSLKYQTRCVRCYPNGTGYALSSVEGRVSMEFFDLSEAIQAKKYAFKCHRKSEAGRDIVYPVNAMAYHPIYGTFATGGCDGYVNVWDGNNKKRLYQYMKYPTSIAALSFSRDGRLLAVASSYTFEEGPKSNESDAIFVRSVNEIEVKPKPKVYPNAPA

SEQ ID NO: 6328 - protein, 344 aa, Medicago truncatula
MATTTTTTVVSSGRELTNPPSDGISNIRFSNHSDHLLVSSWDKTVRLYDATADFLRGEFLHGGPVLDCCFHDDSSGFSASADNTVRRLIFATGKEDILGKHDAPVRCVEYSYAAGQLITGSWDKTIKCWDPRGASGQERTLVGTYAQPERVYSLSLVGHRLVVATAGRHVNVYDMRNMSCPEQRRESSLKYQTRCVRCYPNGTGYALSSVEGRVAMEFFDLSEASQAKKYAFKCHRKSEAGRDIVYPVNAMAFHPIYGTFATGGCDGFVNVWDGNNKKRLYQYSKYPSSVAALSFSRDGRLLAVASSYTFEEGPKPHDQDAIYVRSVNEIEVKPKPKALPNPTA

SEQ ID NO: 6329 - protein, 339 aa, Eutrema parvulum
MTLPPSAGRELSNPPSDGISNLRFSNTSDHLLVSSWDKRVRLYDVSTNSLRGEFLHGGAVLDCCFHDDSSGFSVGGDNKVRRIVFNVGKEDILGMHDKPVRCVEYSYAAGQVITGSWDKTVKCWDPRGASGPERTQVGTYLQPERVYSLSLVGNRLVVATAGRHVNIYDLRNMSQPEQRRESSLKYQTRCVRSYPNGTGYALSSVEGRVAMEFFDLSEAAQAKKYAFKCHRKSEAGRDIVYPVNAIAFHPIYGTFATGGCDGFVNIWDGNNKKRLYQYSKYPSSIAALSFSRDGQLLAVASSYTFEEGEKSHEPEAIFIRNVNEIEVKPKPKAHPNPAA

SEQ ID NO: 6330 - protein, 216 aa, Euonymus alatus
MTAAAPPLGAGRELSNPPTDGISNLRFSNHSDHLLVSSWDKSVRLYDASANVLRGEFLHGGPVLDCCFHDDSSGFSASSDNTVRRLVFNHGKEDILGRHNAPVRCVEYSYATGQVITGSWDKTLKCWDPRGASGQERTFVGTYPQPERVYSLSLVGHRLVVATAGRHVNVYDLRNMSQPEQRRESSLKYQTRSVCCYPNGTGYALVLLKVVWQWSI

SEQ ID NO: 6331 - protein, 339 aa, Eutrema halophilum
MSLVPTVGRELSNPPSDGISNLRFSNSSDHLLVSSWDKSVRLYDANADSMRGEFKHGGPVLDCCFHDDSSGFSVCGDNKVRRIDFNAGKEDILGTHDKPVRCVEYSYAAGQVITGSWDKTIKCWDPRAASGPERTQIGTYQQPERVNSISLVGNRLVVATAGRHVNIYDLRNMSQPEQRRESSLKYQTRCVRCYPNGTGYALSSVEGRVSMEFFDLSEAAQAKKYAFKCHRKSEDGRDIVYPVNAIAFHPIYGTFATGGCDGFVNIWDGNNKKRLYQYSKYPTSIAALSFSRDGGLLAVASSYTFEEGDKPHEPDAIFVRNVNEIEVKPKPKAYPNPPV

SEQ ID NO: 6332 - protein, 339 aa, Eutrema parvulum
MSLVPAVGRELSNPPSDGISNLRFSNSSDHLLVSSWDKSVRLYDATADSMRGEFKHGGAVLDCCFHDESSGFSVCSDHKVRRIDFNAGKEDTLGTHDKAVRCVEYSYAAGQVITGSWDKTIKCWDPRAASGPERTEIGTYQQPERVNSLSLVGNRLVVATAGRHVNIYDLRNMSQPEQKRESSLKYQTRCVRCYPNGTGYALSSVEGRVSMEFFDLSEAAQAKKYAFKCHRKSEDGRDIVYPVNAIAFHPIYGTFATGGCDGFVNIWDGNNKKRLYQYSKYPTSIAALSFSRDGGLLAVASSYTFEEGDKPHEPDAIFVRNVNEIEVKPKPKAYPNPQV

SEQ ID NO: 6333 - protein, 342 aa, Gossypium hirsutum
MTSVHPPPVPGRELSNPPTDGISNLRFSNHSDNLLVSSWDKTVRLYDASANVLRGEFMHGGPVLDCCFHDDSSGFSASADNKVRRIMFSHGKEEILGRHDAPVRCIEYSYAAGQVITGSWDKTLKCWDPRGASGQERTLVGTYPQPERVYSLSLVGNRLVVATAGRHVNVYDLRNMSQPEQRRESSLKYQTRCVRCYPNGTGYALSSVEGRVAMEFFDLSEASQAKKYAFKCHRKSEAGRDIVYPVNAIAFHPVYGTFATGGCDGFVNVWDGNNKKRLYQYSKYPTSVAALSFSRDGRLLAVASSYTFEEGDKAHEPDAIFVRSVNEIEVKPKPKVYPNPPA

SEQ ID NO: 6334 - protein, 343 aa, Cycas rumphii
  misc_feature (42)..(42): Xaa can be any naturally occurring amino acid
  misc_feature (137)..(137): Xaa can be any naturally occurring amino acid
MIGAAPAVGAGSGRELSNPPTDGISNLRFSNHSDHLLVSSWXSKVRLYDASANILKGQFSHGGAVLDCCFHDDASGFSGSADCTVRRYDFSTGKEDILGRHEAPIRCVEYSYAAGQVITGSWDKTLKCWDPRGASGXERTLVGTYPQPERVYSMSLVGHRLVVATAGRRVNVYDLRNMSQPEQRRESSLKYQTRCVRCYPNGTGFALSSVEGRVAMEFFDLSEAGQAKKYAFKCHRKSEAGRDTVYPVNAIAFHPIYGTFATGGCDGYINVWDGNNKKRLYQFSKYPTSIAALSFSRDGRLLAVASSYTFEEGDKPHEPDAIFVRSINEAEVKPKPKAYVPAP

SEQ ID NO: 6335 - protein, 337 aa, Cajanus cajan
MASATGRELSNPPSDGISNLRFSNHSDHLLVSSWDKSVRLYDASANVLRGEFMHSGPVLDCCFHDDSSGFSAAADNTVRRLLFSSNKEDILGRHDAAVRCIEYSYAAGQLITGSWDKTLKCWDPRGASAQDRTLVGTYPQPERVYSLSLVGHRLVVATAGRHVNIYDLRNMSQPEQRRESSLKYQTRSVRCYPNGTGYALSSVEGRVAMEFFDLSEASQAKKYAFKCHRKSEAGRDIVYPVNAIAFHPIYGTFATGGCDGYVNVWDGNNKKRLYQYSKYPTSIAALSFSRDGRLLAVASSYTFEEGPKAHEQDAIFARSVNEIEVKPKPKVYANPPA

SEQ ID NO: 6336 - protein, 340 aa, Glycine max
MASAVPATGRELSNPPLDGITNLRFSNHSDHLLVSSWDKSVRLYDASANVLRGEFMHAGPVLDCCFHDDSSGFSVAADNTVRRLVFSSNKEDILGRHDAPVRCVEYSYAAGQLITGSWDKTLKCWDPRGASGQERTLVGTYPQAERVYSLSLVGHRLVVATAGRHVNIYDLRNMSQPEQRRESSLKYQTRCVHCYPNGTGYALSSVEGRVAMEFFDLSEASQAKKYAFKCHRKSEAGRDIVYPVNAIAFHPIYGTFATGGCDGYVNVWDGNNKKRLYQYSKYPTSVAALSFSRDGRLLAVASSYTFEDGPKSQEQDAIFVRSVNEIEVKPKPKVYPNPPV

SEQ ID NO: 6337 - protein, 341 aa, Catharanthus roseus
MTAAPLANPGRELSSPPTDGISNLRFSNHSDHLLVSSWDKSVRLYDASANDLRGEFMHGGAVLDCCFHDDSSGFSASADNTVRRLVFNYGREDILGRHDAPVRCIEYSYATGQVITGSWDKYLKCWDPRGASGQERTLVGSYAQPERVYSLSVVGNRLVVATAGRHVNVYDLRNMSQPEQRRESSLKYQTRCVRCYPNGTGYALSSVEGRVAMEFFDLSEAGQSKKYAFKCHRKSEAGRDIVYPVNAIAFHPIYGTFATGGSDGFVNVWDGNNKKRLYQYTKYPTSVAALSFSRDGRLLAVASSYTFEEGDKAHEPDAIFVRSVNEVEVKPKPKVLPNPTA

SEQ ID NO: 6338 - protein, 342 aa, Linum usitatissimum
MAAAVLPPGSGRELSNPPTEGISNLRFSNLSDHLLVSSWDKSVRLYDASANSLLGEFLHGGAVLDCCFHDESSGFSASADNLVRRLVFNHGKEDILRKHDAPVRCIEYSYAAGQVITGSWDRTVKCWDPRGASGQDHTLVGTYPQPERVYSLSLVGNRVVVATAGRHVNVYDLRNMSQPEQQRESSLKYQTRCVRCYPNGAGYALSSVEGRVAMEFFDLSEAAQAKKYAFKCHRKSEAGRDIVYPVNAIAFHPVYGTFATGGCDGFVNVWDGNNKKRLYQYSKYPSSIAALSFSKDGRLLAVASSYTYEEGEKPHEPDAIFVRSVNEVEVKPKPKVYPNPPA

SEQ ID NO: 6339 - protein, 342 aa, Gossypium raimondii
MTSVHPPPVPGRELSNPPTDGISNLRFSNHSDNLLVSSWDKTVRLYDASASVLRGEFMHGGPVLDCCFHDDSSGFSASADNKVRRIMFSHGKEEILGRHDAPVRCIEYSYAAGQVITGSWDKTLKCWDPRGASGQERTLVGTYPQPERVYSLSLVGNRLVVATAGRHVNVYDLRNMSQPEQRRESSLKYQTRCVRCYPNGTGYALSSVEGRVAMEFFDLSEASQAKKYAFKCHRKSEAGRDIVYPVNAIAFHPVYGTFATGGCDGFVNVWDGNNKKRLYQYSKYPTSVAALSFSRDGRLLAVASSYTFEEGDKAHEPDAIFVRSVNEIEVKPKPKVYPNPPA

SEQ ID NO: 6340 - protein, 339 aa, Ipomoea nil
MTAVTLSAGRELSNPPTDGISNLRFSNHSDHLLVSSWDKTVRLYDASANVLRGEFLHGGAVLDCCFHDDSSGFSASIDNTVRRLVFNYGRDDILGKHDAPVRCVEYSYTGQVITGSWDKTLKCWDPRGASGQEHTLVGTYAQPERVYSLSLVGNRLVVATAGRHVNVYDLRNMSQPEQRRESSLKYQTRCVRCYPNGTGYALSSVEGRVAMEFFDLSDAGQIKKYAFKCHRKSEAGRDIVYPVNAIAFHPIYGTFATGGCDGFVNVWDGNNKKRLYQYSKYPASIAALSFSRDGRLLAIASSYTFEEGHKPHEPDTIFLRSVNEVEVKPKPKLLPNPTM

SEQ ID NO: 6341 - protein, 185 aa, Antirrhinum majus
MTAAPPQSMGIEISNPPTDGISNLRFSNHSDNLLVSSWDKTVRLYDASSNALRGEFLHGGAVLDCCFHDDSSGFSACADNTVRRLVFNYNREDILGRHDAPVRCIEYSYATGQVITGSWDKTLKCWDPRGASGQEHSLVGTYTQPERVYSMSLVGNRLVVSTAGRHVNVYDLRNMSQPEHGENLL

SEQ ID NO: 6342 - protein, 340 aa, Cirsium arvense
MAAVPQVTGTELISPPSDGISNLRFSHHSDHLLVSSWDKRVRLYDASANVLRGEFLHGGAVLDCCFHDDTSGFSASGDNTVRRLVFDHEREDVLGRHDAPVRCIEYSYATGQVITGSWDKTLKCWDPRGASSQERALVGTYTQPERVYSISLVGNRVVVATAGRHVNVYDLRNMSQPEQRRESSLKYQTRCVRCYPNGTGYALSSVEGRVAMEFFELTEAGQSKKYAFKCHRKSEAGRDIVYPVNAIAFHPVYGTFATGGCDGFVNVWDGNNKKRLYQYSKYPTSVAALSFSRDGRLLAVASSYTYEEGEKPHEPDAIFVRNVNEVEVKPKPKAYPNPSS

SEQ ID NO: 6343 - protein, 340 aa, Cirsium arvense
MAAVPQVTGRELSNPPSDGISNLRFSHHSDHLLVSSWDKSVRLYDASENVLRGEFTHGGAVLDCCFHDDNSGFSASADNTVRRLVFNYEREDVLGRHDAPVRCIEYSYATGQVITGSWDKTLKCWDPRGASAQERALVGTYAQPERVYSLSVVGNRLVVATAGRHVNVYDLRNMSQPEQRRESSLKYQTRCVRSYPNGTGYALSSVEGRVAMEFFDLSDAGQSKKYAFKCHRKSEAGRDIVYPVNSIAFHPVYGTFATGGCDGFVNVWDGNNKKRLYQYSKYPTSIAALSFSRDGRLLAVASSYTFEEGDKPHEPDAIFVRSVNEVEVKPKPKVYPNPAT

SEQ ID NO: 6344 - protein, 339 aa, Silene vulgaris
MTAVAPPVTGREISNPPTDGITNLRFSNHSDHLLVSSWDKTVRLYDASANVLRGEFKHGGPVLDCCFHDDSSGFSACGDSTVRRLVFNHGKEDILGKHDAHVRCVEYSYTTGQVITGSWDRTLKCWDPRGASGQERTLVGTYPQPERVYSMSLVGHRLVVATAGRHVNVYDLRNMSQPEQKRESSLKYQTRCVRSYPNGTGYALSSVEGRVAMEFFDMSEAGQVKKYAFKCHRRSEAGRDIVYPVNAIAFHPIYGTFATGGCDGIVNVWDGNNKKRLYQYAKYPTSVAALSFSRDGRLLAIASSYTFEEGEKPHEPDAIFVRSVNEVEVKPKPKVNPPA

SEQ ID NO: 6345 - protein, 337 aa, Vitis vinifera
MTAVNPPVIGRELVNPPADGISNLRFSNHSDNLLVSSWDKSVRLYDASANVLRGEFMHGGPVLDCCFHDDSSGFSASVDNSVRRLVFSHGKEDVLGRHDAPVRCIEYSYATGQVVTGSWDKTLKCWDPRGASGQERTLVGTYAQPERVYSLSLFSNRLVVATAGRHVNIYDLRNMSQPEQRRESSLKYQTRCVRCYPNGTGYALSSVEGRVAMEFFELSEASQAKKYAFKCHRKSEAGRDIVYPVNAIAFHPIYGTFATGGCDGFVNVWDGNNKKRLYQYSKYPSSVAALSFSRDGRLLAVASSYTFEEGDKPHEPDAIFVRSVNEMEVKPKPKVLP

SEQ ID NO: 6346 - protein, 340 aa, Cicer arietinum
MAATTVVAGRELSNPPSDGISNIRFSNHSDHLLVSSWDKSVRLYDASANVLRGEFMHGGPVLDCCFHDDSSGFSAGADNTVRRLLFSTNKEDILGKHDAPVRCIEYSYAAGQLITGSWDKTLKCWDPRGASGQERTLVGTYQQPERVYSLSLVGHRLVVATAGRHVNVYDLRNMSIPEQRRESSLKYQTRCVRCYPNGTGYALSSVEGRVAMEFFDLSEASQAKKYAFKCHRKSEAGRDIVYPVNAMAFHPIYGTFATGGCDGFVNVWDGNNKKRLYQYSKYPTSIAALSFSRDGRLLAVASSYTFEEGPKTNEQDAIYVRSVNEIEVKPKPKAYPNPTA

SEQ ID NO: 6347 - protein, 339 aa, Arabidopsis lyrata
MTTTPSAGRELSNPPSDGISNLRFSNNSDHLLVSSWDKRVRLYDVSTNSLKGEFLHGGAVLDCCFHDDFSGFSVGADYKVRRIVFNVGKEDILGTHDKPVRCVEYSYAAGQVITGSWDKTVKCWDPRGASGPERTQVGTYLQPERVYSMSLVGHRLVVATAGRHVNIYDLRNMSQPEQRRESSLKYQTRCVRCYPNGTGYALSSVEGRVAMEFFDLSEAAQAKKYAFKCHRKSEAGRDIVYPVNSIAFHPIYGTFATGGCDGFVNIWDGNNKKRLYQYSKYPTSISALSFSRDGQLLAVASSYTFEEGEKSQEPEAIFVRSVNEIEVKPKPKVYPNPAA

SEQ ID NO: 6348 - protein, 341 aa, Lotus japonicus
MTTTTPVVAGRELSNPPSDGISNLRFSNHTDLLLVSSWDKTVRLYDASANVLRGEFIHGGPVLDCCFHDDSSGFSVAADNTVRRLVFNTSQEDILGKHDAPVRCVEYSYAAGQLITGSWDKTLKCWDPRGASGQERTLVGTYPQPERVYSLSLVGNRLVVATAGRHVNVYDLRNMSLPEQRRESSLKYQTRCVRCYPNGTGYALSSVEGRVAMEFFDLSEASQAKKYAFKCHRKSEAGRDFVYPVNAMAFHPIYGTFATGGCDGYVNVWDGNNKKRLYQYSKYPTSIAALSFSRDGRLLAVASSYTFEEGPKPHEKDAIYVRSVNEIEVKPKPKVYPNPAA

SEQ ID NO: 6349 - protein, 303 aa, Pseudoroegneria spicata
MERATPVRSPHTSTADLLTWSATGADASAASPAAPSRPSLKPAGGITPAMFGAPVSEHEAEDLSNSERRLMSGSKMKEMTGSGIFAEKSENSDSESSNPANRTSVRMYQQTVTGVSQISFSADGSVSPKKPSSLPEVAKQRELSGTFETDAEAKINKQLSEAKNKELSGSNIFGPPPETPARPLAARNMELQGNVDFALPQRRSVHTSVKVSNPAGGPSNITFSEDPVTKTAKKIHNQKFQELTGNNIFNEDAPPGSADKSLSSAKLKEMSGNDIFSDGKASSRDYLGGVRKPPGGESSIALI

SEQ ID NO: 6350 - protein, 303 aa, Secale cereale
MERATPVRSPHTSTADLLTWSATGADASAASPAAPSRPSLKPAGGITPAMFGAPVSEHDAEDLSNSERRLMSGSKMKEMTGSGIFAEKNENSDSESSNPANRTSVRMYQQTVTGVSQISFSADGSVSPKKPSSIPEVAKQRELSGTFETDAEAKINKQLSEAKNKELSGSNIFGPPPETPARPLAARNMELQGNVDFALPQRRSVHTSVKVSNPAGGPSNITFSEDPVTKTAKKIHNQKFQELTGNNIFNEDAPPGSADKSLSSAKLKEMSGNDIFSDGKASSRDYLGGVRKPPGGESSIALI

SEQ ID NO: 6351 - protein, 303 aa, Triticum aestivum
MERATPVRSPHTSTADLLTWSATGADASAASPAAPSRPSLKPAGGITPAMFGAPVSEHEAEDLSNSERRLMSGSKMKEMTGSGIFAEKNENSDSESSNPANRTSVRMYQQTVTGVSQISFSADGSVSPKKPSSIPEVAKQRELSGTFETDAEAKINKQLSEAKNKELSGSNIFGPPPETPARPLAARNMELQGNVDFALPQRRSVHTSVKVSNPAGGPSNITFSEDPVTKTAKKIHNQKFQELTGNNIFNEDAPPGSADKSLSSAKLKEMSGNDIFSDGKASSRDYLGGVRKPPGGESSIALI

SEQ ID NO: 6352 - protein, 303 aa, Leymus cinereus x Leymus triticoides
MERAVPVRNPHTSTADLLTWSATGADASPASPAAPSRPSLKPAGGITPAMFGAPVSEHEAEDLSNSERRSMSGSKMKEMTGSGIFAEKSENSDSESSNPANRTSVRMYQQTVTGVSQISFSADGSVSPKKPSSLPEVAKQRELSGTFETDAEAKINKQLSEAKNKELSGSNIFGPPPETPARPLAARNMELQGNVDFALPQRRSVHTSVKVSNPAGGPSNITFSEDPVTKTAKKIHNQKFQELTGNNIFNEDAPPGSADKSLSSAKLKEMSGNDIFSDGKASSRDYLGGVRKPPGGESSIALI

SEQ ID NO: 6353 - protein, 303 aa, Brachypodium distachyon
MERAVPVRNPHTSTADLLTWSPTGADAPAASPAASSRPSLKPAGGITPAMFGAPVSEHEAEDLSNSERKLVSGYKMKEMTGSGIFAEKGEYGDSESANPANRTSVRMYQQTVTGISQISFSADGSVSPKKPSSLPEVAKQRELSGTFESDAEAKINRQLSEAKNKELSGSDIFGPPPETPARPLAARNMELQGNLDFALPQPRSVHTSVKVSNPAGGPSNITFSEDPVTKTSKKIHNQKFQELTGNNIFKEDASPGSAEKSLSSAKLKEMSGNDIFSDGKASSRDYLGGVRKPPGGESSIALI

SEQ ID NO: 6354 - protein, 305 aa, Oryza sativa
MERAVPVRKPHTSTADLLTWSATGPDAAAAAASPVASSRPSLKPAGGITPAMFGAPVSEKEAEDLSKSERKFCSGSKLKEMTGSGIFAENSENDDSEASNPANKTSVRMYQQTVTGISQISFSADGSVSPKKPSSLPEVAKQRELSGTLETDAEAKMNKQHSEAKSKELSGSDIFGPPPEIPARPLAARNMELQGNLDFALPQPRSVHTSVKVSNPAGGPSNITFSEEPVVKTSKKIHNQKFQELTGNNIFKEDATPASAEKSLSSAKLKEMSGSDIFADGAAAPRDYLGGVRKPPGGESSIALI

SEQ ID NO: 6355 - protein, 299 aa, Zea mays
MERAVPVRKPHTSTADLLSWSATAPDASASPAASSRPSLKPAAGITPAMFGAPVTEQEAEDLSKSERKFCSGSKLKEMSGSGIFAEKSENGDSEASNPDNKTSLRMYQQTVTGISQISFSADGSVSPKKPSSIPEVAKQRELSGTLEDADAKINKQLSEAKTKELSGSDIFGPPPEIPARPLAARNMELQGNVDFSLPQRSVHTSVKVSNPAGGPSNISFSEEPVVKTAKKIHNQKFQELTGNNIFKEDVPSSAEKSLSSAKLKEMSGSDIFADGTPAPREYLGGIRKPPGGESSIALI

SEQ ID NO: 6356 - protein, 299 aa, Sorghum bicolor
MERAVPVRKPHTNTADLLSWSATGPDASASPAAASRPSLKPAAGITPAMFGAPVTDQEAEDLSKSERKFCSGSKLKEMSGSGIFAEKSEIGDSEASNPANKTSLRMYQQTVTGISQISFSADGSVSPKKPSSIPEVAKQRELSGTLEDADAKINKQLSEAKTKELSGSDIFGPPPEIPARPLAARNMELQGNVDFSLPQRSVHTSVKVSNPAGGPSNISFSEDPVVKTAKKIHNQKFQELTGNNIFKEDVPTSAEKSLSSAKLKEMSGSDIFADGTPAPREYLGGIRKPPGGESSIALI

SEQ ID NO: 6357 - protein, 299 aa, Saccharum officinarum
MERAVPVRKPHTNTADLLSWSATGPDASASPAASSRPSLKPAAGITPAMFGAPVTEQEAEDLSKSERKFCSGSKLKEMSGSGIFTEKSENGDSEASNPANKTSLRMYQQTVTGISQISFSADGSVSPKKPSSIPEVAKQRELSGTLEDADAKINKQLSEAKTKELSGSDIFGPPPEIPARPLAARNMELQGNVDFSLPQRSVHTSVKVSNPAGGPSNISFSEEPVVKTAKKIHNQKFQELTGNNIFKEDVPASAEKSLSSAKLKEMSGSDIFADGTPAPREYLGGIRKPPGGESSIALI

SEQ ID NO: 6358 - protein, 299 aa, Zea mays
MERAVPVRKSHTNTADLLSWSATGPDASASPAASSRPSLKPAAGITPAMFGAPVTEQEAEDLSKSERKFCSGSKLKEMGGSGIFAEKSENGDAEASNPANKTSLRMYQQTVTGISQISFSADGSVSPKKPSSIPEVAKQRELSGTLEDADAKINKQLSEAKTKELSGSDIFGPPPEIPARPLAARNMELQGNVDFSLPQRSVHTSVKVSNPAGGPSNISFSEEPVVKTAKKIHNQKFQELTGNNIFKEDVPASAEKSLSSAKLKEMSGSDIFADGTPAPREYLGGIRKPPGGESSIALI

SEQ ID NO: 6359 - protein, 296 aa, Panicum virgatum
MERAVPVRKPHTSTADLLTWSAAGPDAAAASSRPSLKPAAGITPAMFGAPVSEQEAEDLSKSERKFCSGSKLKEMSGSGIFAEKSENGESEASSHANKTSVRMYQQTVTGISQISFSADGSVSPKKPSSIPEVAKQRELSGTLEDADAKINKQLSEAKTKELSGSDIFGPPPEIPARPLAARNMELQGNVDFSLPQRSVHTSVKVSHPAGGPSNISFSEEPVVKTAKKIHNQKFQELTGNNIFKEEAPASAEKSLSSAKLKEMSGSDIFADGTPAPREYLGGVRKPPGGESSIALI

SEQ ID NO: 6360 - protein, 277 aa, Festuca arundinacea
MERAVPVRNPHTSTADLLTWSPTAAAASAASSRPSLKPAGGITPAMFGAPVSEDDAEDLSSSERRLMSGSKMKEMTGSGIFAEKGENGDSESSNPANRTSVRMYQQTVAGMSQISFSADGSVSPKKPSSLPEVAKQRELSGTFESDAEAKTSKQLSESKNKELSGSNIFGPPPVTPVRPLAARNMELQGNVDFALPQPRSVHTSVKVSHPAGGPSNITFSEDPATKTSKKIHNQKFQELTGNNIFKEDASPGSDKSLSSAKLKEMSGNDIFSDGKAS

SEQ ID NO: 6361 - protein, 301 aa, Setaria italica
MERAVPVRKPHTSTADLLTWSATGPDAPAGASPAASSRPSLKPAAGITPAMFGAPVSEQEAEDLSKSERKFCSGSKLKEMSGSGIFAEKGENGDSEDSKSANKTSLRMYQQTVTGISQISFSADGSLSPKKPSSIPEVAKQRELSGTLEDADSKTNKQLSEAKTKELSGSDIFGPPPEIPARPLAARNMELQGNVDFSLPQRSVHTSVKVSNPAGGPSNISFSEEPVVKTAKKIHNQKFQELTGNNIFKEEAPASAEKSLSSAKLKEMSGSDIFADGTPAPREYLGGVRKPPGGESSIALI

SEQ ID NO: 6362 - protein, 301 aa, Pennisetum glaucum
MERAVPVRKPHTSTADLLTWSATGPDAPAGTSPAASSRPSLKPAAGITPAMFGAPVSEQEAEDLSKSERKFCSGSKLKEMNGSGIFAEKGENGDSEDSKSANKTSLRMYQQTVTGISQISFSADGSISPKKPSSIPEVAKQRELSGTLEDADAKTNKLLSEAKTKELSGSDIFGPPPEIPARPLAARNMELQGNVDFSLPQRSVHTSVKVSNPAGGPSNISFSEEPLVKTAKKIHNQKFQELTGNNIFKEEAPASAEKSLSSAKLKEMSGSDIFADGTPAPREYLGGVRKPPGGESSIALI

SEQ ID NO: 6363 - protein, 296 aa, Panicum virgatum
MERAVPVRKPHTSTADLLTWSAAGPDAAAGASRPSLKPAAGITPAMFGAPVSEQEAEDLSKSERKFCSGSKLKEMSGSGIFAEKSENGESEASSYANKTSVRMYQQTVTGISQISFSADGSVSPKKPSSIPEVAKQRELSGTLEDADAKINKQLSEAKTKELSGSDIFGPPPEIPARPLAARNMELQGNVDFSLPHRSVHTSVKVSHPAGGPSNISFSEEPVVKTAKKIHNQKFQELTGNNIFKEEAPASAEKSLSSAKLKEMSGSDIFADGTPAPREYLGGVRKPPGGESSIALI

SEQ ID NO: 6364 - protein, 191 aa, Triticum aestivum
MQPPSQYHQSSYYAVLGVHPGASAAEIRAAYHRLAMRWHPDKIANGRVDPAIAEEAKGRFQKIHEAYQVLSDQKRRELYDAGMYDPLDDSQQEVEGFHDFLQEMLSLMATVGREEPVYSLGELQSMLDGMMQDFSSPQPPPPSSFFTSTGSSTRFSAPSGGAQQQRRPPSRVRPQGFGSSACFSQTAFSGC

SEQ ID NO: 6365 - protein, 191 aa, Pseudoroegneria spicata
  misc_feature (10)..(12): Xaa can be any naturally occurring amino acid
QPPSQHQSSXXXVLGVHPGASSAEIRAAYHRLAMRWHPDKIASGRVDPAIAEEAKGRFQKIHEAYQVLSDEKRRALYDAGAYDPLDDSQEEVEGFHDFLQEMLSLMATVGREEPVYSLGELQSMLDGMMQDFTSPQPPPPSSFFTSTSSSTRFSAPSGGAQQQQQRRSSSRVRPQGFGSSACFSQTAFSGC

SEQ ID NO: 6366 - protein, 187 aa, Festuca arundinacea
  misc_feature (50)..(50): Xaa can be any naturally occurring amino acid
  misc_feature (91)..(91): Xaa can be any naturally occurring amino acid
MQSQSQYGTSYYAVLGVHPRASAAEIRAAYHRLAMRWHPDKIANGRADPXRAEEAKARFQQIHEAYKVLSDEKRRALYDAGMYDPLDDDQXEVEGFHDFLQEMLSLMATVGREEPVYSLGELQSMLNGMMQDFSSPQPPPPPSSFFTSTAPSTRSSGGQQQRRSSSSVRPQGFSSSACFTRTAFSGC

SEQ ID NO: 6367 - protein, 200 aa, Brachypodium distachyon
MQSAESHYQSYYAVLGVHPGASAAEIRAAYHRLAMRWHPDKIANGRADPALAEEAKGRFQKIHEAYQVLSDEKRRALYDAGVYDPLEDGQEEVEGFHDFLQEMLSLMATVGREEPVYSLGELQSMLDGMMQDFASPQPAAAAAAPPSSSSSSSSSFFTGAGSSRFNAPSSGQKRRRSSSRVRPQGFGSSACFSRTAFSGC

SEQ ID NO: 6368 - protein, 312 aa, Triticum aestivum
MGFLICACLLQLLFLGSSPAAAQSPSPARALDAMLQDYAYRAFVRPHTGIVYNGTVPADLAGVAVSGLRLRSGSLRRKGFSDYFEFSIPPGVIVQPYVERVVLVYHNLGELSEKYYPLPGYTYLSPILGLLVYDAANLSAAGLSELSIVASGSPISVSFSNVRAVPSGSPAPQCVWFDLDGVPQFRGLEANNVCATYRRGHFSIVVNSSEVAPAPGPSGAIAPPIPTNGGRDKGSSDAWKIAVGVVGGVIALGLLALLLVCFVRYKREKKMEVMERNAEVGETLRMAQVGRSQAPVALGTRTKPVIESEYVA

SEQ ID NO: 6369 - protein, 203 aa, Secale cereale
MGFLICACLLQLLFLGSSPAAAQSPSPARPLDAMLQDYAYRAFARPHTGIVYNGTVPADLAGVAVSGLRLRSGSLRRKGFPDYFEFSIPPGVIVQPYVERVVLVYHNLGELSEKYYPLPGYTYLSPILGLLVYDAANLSAVGLSELSIVASGSPISVKFSNVRAVPQAVQRRSVCGLIWTACHSSGAWRQTTCVQRIAEGTSP

SEQ ID NO: 6370 - protein, 340 aa, Triticum aestivum
MVVKSGGGGGGAEEGAAGAAVRRWVEAGGGRLVLDGGLATELEAHGADLNDPLWSAKCILSSPHLIRKVHLDYIEAGANIIITASYQATIQGFESKGFSKEQGENLLTKSVEIACEAREMFLKQHPDQSTPLRPILVAASIGSYGAYLADGSEYSGDYGEAGTLEFLKDFHRRRLQVLAEARPDLIAFETIPNKLEAQAYVELLEECNINIPSWFSFNSKDGVNVVSGDSLIECAKIANECAKVGAVGINCTPPRFIHSLILSIRKVTDKPILIYPNSGERYDAEKKEWVESTGVSDGDFVSYVGEWCKDGAALIGGCCRTTPNTIRAITRSLNQYYPAA

SEQ ID NO: 6371 - protein, 339 aa, Pseudoroegneria spicata
MVVKSRGGGCAEEGAAGAAVRRWVEAGGGRLVLDGGLATELEANGADLNDPLWSAKCILSSPHLIRKVHLDYIEAGANIIITASYQATIQGFESKGFSKEQGENLLTKSVEIAHEAREMFLKQHPDQSTALRPILVAASIGSYGAYLADGSEYSGDYGEAGTLEFLKDFHRRRLQVLAEARPDLIAFETIPNKLEAQAYVELLDECNINIPSWFSFNSKDGVNVVSGDSLIECANIANACAKVGAVGINCTPPRFIHSLILSIRKVTDKPILIYPNSGERYDAEKKEWVESTGVSDGDFVSYVGERCKDGAALIGGCCRTTPNTIRAISRSLNQYYPAP

SEQ ID NO: 6372 - protein, 340 aa, Triticum aestivum
MVVKSGGGGGGAEEGAAGAAVRRWVEAGGGRLVLDGGLATELEAHGADLNDPLWSAKCILSSPHLIRKVHLDYIEAGANIIITASYQATIQGFESKGFSKEQGENLLTKSVEIAHEAREMFLKQHPDQSTPLRPILVAASIGSYGAYLADGSEYSGDYGEAGTLEFLKDFHRRRLQVLAEARPDLIAFETIPNKLEAQAYVELLEECNINIPSWFSFNSKDGVNVVSGDSLIECAKIANECAKVGAVGINCTPPRFIHSLILSIRKVTDKPILIYPNSGERYDAEKKEWVESTGVSDGDFVSYVGEWCKDGAALIGGCCRTTPNTIRAITRSLNQYYPAP

SEQ ID NO: 6373 - protein, 340 aa, Triticum aestivum
MVVKSGGGGGGAEEGAAGAAVRRWVEAGGGRLVLDGGLATELEAHGADLNDPLWSAKCILSSPHLIRKVHLDYIEAGANIIITASYQATIQGFESKGFSKEQGENLLTKSVEIAHEAREMFLKQHPDQSTPLRPILVAASIGSYGAYLADGSEYSGDYGEAGTLEFLKDFHRRRLQVLAEARPDLIAFETIPNKLEAQAYVELLEECNINIPSWFSFNSKDGVNVVSGDSLIECAKIANECAKVGAVGINCTPPRFIHSLILSIRKVTDKPILIYPNSGERYDAERKEWVESTGVSDGDFVSYVSEWCKDGAALIGGCCRTTPNTIRAISRSLNQYYPAP

SEQ ID NO: 6374 - protein, 340 aa, Secale cereale
MVVKSGGGGGGAEEGAAGAAVRRWVEAGGGRLVLDGGLATELEAHGADLNDPLWSAKCILSSPHLIRQVHFDYIEAGANIIITASYQATIQGFESKGFSKEQGENLLTKSVEIAHEAREMFLKQHPDQSTASRPILVAASIGSYGAYLADGSEYSGDYGEAGTLEFLKDFHRRRLQVLAEARPDLIAFETIPNKLEAQAYVELLEECNINIPSWFSFNSKDGVNVVSGDSLIECAKIANACTKVGAVGINCTPPRFIHSLILSIRKVTDKPILIYPNSGERYDAERKEWVESTGVSDGDFISYVGEWCKDGAALIGGCCRTTPNTIRAISRSLNQYYPAP

SEQ ID NO: 6375 - protein, 339 aa, Secale cereale
MVVKSGGGGGAEEGAAGAAVRRWVEAGGGRLVLDGGLATELEAHGADLNDPLWSAKCILSSPHLIRQVHFDYIEAGANIIITASYQATIQGFESKGFSKEQGENLLTKSVEIAHEAREMFLKQHPDQSTTSRPILVAASIGSYGAYLADGSEYSGDYGEAGTLEFLKDFHRRRLQVLAEARPDLIAFETIPNKLEAQAYVELLEECNINIPSWFSFNSKDGVNVVSGDSLIECAKIANACTKVGAVGINCTPPRFIHSLILSIRKVTDKPILIYPNSGERYDAERKEWVESTGVSDGDFISYVGEWCKDGAALIGGCCRTTPNTIRAISRSLNQYYPAP

SEQ ID NO: 6376 - protein, 106 aa, Secale cereale
MVVKSGGGGGGAEEGAAGAAVRRWVEAGGGRLVLDGGLATELEAHGADLNDPLWSAKCILSSPHLIRQVHFDYIEAGANIIITASYQATIQGFESKGFSKNKVKIY

SEQ ID NO: 6377 - protein, 340 aa, Brachypodium distachyon
MVVKSGGGGVGEEGAACAAVRRWLEAGGGRLVLDGGLATELEAHGADLNDPLWSAKCILASPHLIRKVHLDYIEAGANIIITASYQATIQGFESKGFSKQQGEDLLTKSVKVAQEAREMFLKEHPDQSTPMQHPILVAASIGSYGAYLADGSEYSGDYGEAGTLEFLKDFHRRRLQVLAEAGPDLIAFETIPNKLEAQAYVELLDECNISIPSWFSFNSKDGVNVVSGDSLIECATIANACAKVGAVGINCTPPRFIHGLILSIRKVTDKPILIYPNSGERYDAEKKEWVESTGVCDGDFVSYVSEWCKDGAALIGGCCRTTPNTIRAINRSLNQCLPAP

SEQ ID NO: 6378 - protein, 337 aa, Setaria italica
MVGTAGGGAEEAVRRWVEAGGGRLVLDGGLATELEANGADLNDPLWSAKCLLASPHLIRKVHMDYLEAGANIIITASYQATIQGFESKGFSKEQSENLLTKSVEIALEAREMFLKEHLEQSTPTQKPILVAASIGSYGAYLADGSEYSGDYGEAGTVQFLKDFHRRRLQVLAEAAPDLIAFETIPNKLEAQAYVELLEECNIHIPAWFSFNSKDGVHIVSGDSLIECATIADKCAKVGAVGINCTPPRFIHGLILSIRKVTDKPILIYPNSGERYDGEKKEWVECTGVSDGDFVSYVSEWCKDGAALIGGCCRTTPNTIRAIQRTLNQGSNARFTMA

SEQ ID NO: 6379 - protein, 342 aa, Oryza sativa
MVGKSGVAEEGGAAAAAAVRRWVEAGGGRLVMDGGLATELEANGADLNDPLWSAKCLLSSPHLVRKVHLDYLEAGANIIITASYQATIQGFESKGFSKEQSEDLLAKSVEIAREARDMFLKEHSDRPIQHPILVAASIGSYGAYLADGSEYSGDYGEAGTLEFLKDFHKRRLEVLAEAGPDLIAFETIPNKLEAQAYVELLDECNISIPAWFSFNSKDGVHIVSGDSLIECATIANGCSKVGAVGINCTPPRFIHGLILSIRKVTDKPILIYPNSGERYDAEKKEWVESTGVSDGDFVSYVNEWCKDGAVLIGGCCRTTPNTIKAISRSLNQRHSSLHLPVA

SEQ ID NO: 6380 - protein, 338 aa, Zea mays
MVGTAEGGAERAVRRWVDAAGGRLVLDGGLATELEANGADLNDPLWSAKCLLSSPHLIRKVHMDYLEAGANIIITASYQATIQGFESKGFSKEQSENLLTKSVQIALEAREMFLKEHLEKSTPIQHPILVAAALGSYGAYLADGSEYSGDYGEAGTKEFLKDFHRRRLQVLAEAGPDLIAFETIPNKLEAQAYVELLEECNINIPSWLSFNSKDGVHVVSGDSLIECATIADKCAKVGAVGINCTPPRFIHGLILSIRKVTDKPILIYPNSGERYDGEKKEWVESTGVSDGDFVSYVNEWCKDGAALIGGCCRTTPNTIRAIHRTLNQGCHKHQLPVA

SEQ ID NO: 6381 - protein, 339 aa, Zea mays
MVVTAAGSAEEAVRRWVDAAGGRLVLDGGLATELEANGADLNDPLWSAKCLLSSPHLIRKVHMDYLEAGANIIITASYQATIQGFESKGFSKEQSENLLTKSVEIALEAREMFLKEHLEKSTPIQHPVLVAASLGSYGAYLADGSEYSGDYGEAGTKEFLKDFHRRRLQVLAEAGPDLIAFETIPNKLEAEAYVELLEECNINIPAWFSFNSKDGVHIVSGDSLIECTTIADKCAKVGAVGINCTPPRFIHGLILSIRKVTDKPILIYPNSGERYDGEKKEWVESTGVSDGDFVSYVNEWCKDGAVLIGGCCRTTPNTIRAIHRTLNKSPNKQQLPAVE

SEQ ID NO: 6382 - protein, 337 aa, Pennisetum glaucum
MVGTAGGGAEEAMRRWVEAGGGRLVLDGGLATELEANGADLNDPLWSAKCLLASPHLIRKVHMDYLEAGANIIITASYQATIQGFESKGFSKDQSENLLTKSVEIAQEAREMFLKEHLEQSTPTQKPILVAASIGSYGAYLADGSEYSGDYGEAGTVQFLKDFHRRRLQVLAEASPDLIAFETIPNKVEAQAYVELLEECNIHIPAWFSFNSKDGVHVVSGDSLIECATIADKCAKVCAVGINCTPPRFIHGLILSIRKVTDKPILIYPNSGERYDGEKKEWVECTGVSDGDFVSYVSEWCKDGAALIGGCCRTTPNTIRAIHRTLNQCSNTCFNVA

SEQ ID NO: 6383 - protein, 331 aa, Sorghum bicolor
MVGTAAGAAEGAVRRWVDAAGGRLVLDGGLATELEANGADLNDPLWSAKCLLSSPHLIRKVHMDYLEAGANILITASYQATIQGFESKGFSKEQSENLLTKSVEIALEAREMFLKEHLEKSIPIQHPILVAASIGSYGAYLADGSEYSGDYGEAGTKEFLKDFHRRRLQVLAEAGPDLIAFETIPNKLEAQAYVELLEECNINIPAWLSFNSKDGVHIVSGDSVIECTTIADKCAKVGAVGINCTPPRFIHGLILSIRKVTDKPILIYPNSGERYDGEKKEWVESTGVSDGDFVSYVNEWCKDGAALIGGCCRTTPNTIRAIQRTLNQGFN

SEQ ID NO: 6384 - protein, 338 aa, Panicum virgatum
MVGTAGGGAAEAVRRWVEAGGGHLVLDGGLATELEANGADLNDPLWSAKCLLVSPRLIRKVHMDYLEAGANIISTTSYQATIQGFESKGFSKEQSENLLTKSVEIAREAREMFLKEHLNQSIPAQKPILVAASIGSYGAYLADGSEYSGDYGEAGTIGFLKDFHRRRLQVLAEAGPDLIAFETIPNKLEAQAYVELLEECNIHIPAWFSFNSKDGVNIVSGDSLIECATIADKCAKVGAVGINCTPPSFIHGLILSIRKITDKPILIYPNSGERYDGEKKEWVESTGVSDGDFVSYVSEWCKDGAALIGGCCRTTPNTIRAIQRTLNQGSNTLQLPVA

SEQ ID NO: 6385 - protein, 305 aa, Avena sativa
GLATELEAHGADLNDPLWSAKCILSSPHLIRKVHLDYIEAGANIIITASYQATIQGFESKGFSKEQSENLLTKSVEIAHEAREMFLKQHSDQSTPMHRPILVAASIGSYGAYLADGSEYSGDYGEAGTLEFLKDFHRRRLQVLAEARPDLIAFETIPNKLEAQAYVELLEECNISIPSWFSFNSKDGVHVVSGDSLIECATIANSCAKVGAVGINCTPPRFIHSLILTIRKVTDKPILIYPNSGERYDGEKKEWVESTGVSDGDFVSYVSEWCKDGAALIGGCCRTTPNTIRAITRTLNQFCPAP

SEQ ID NO: 6386 - protein, 338 aa, Panicum virgatum
MVGTAGGGAAEAVRRWVEAGGGHLVLDGGLATELEANGADLNDPLWSAKCLLVSPRLIRKVHMDYLEAGANIISTTSYQATIQGFESKGFSKEQSENLLTKSVEIAREAREMFLKEHLNQSIPAQKPILVAASIGSYGAYLADGSEYSGDYGEAGTIGFLKDFHRRRLQVLAEAGPDLIAFETIPNKLEAQAYVELLEECNIHIPAWFSFNSKDGVNIVSGDSLIECATIADKCAKVGAVGINCTPPRFIHGLILSIRKITDKPILIYPNSGETYDGVRKEWVESTGVSDGDFVSYVSEWCKDGATLIGGCCRTTPNTIRAIQRTLNQGSNTLQLPVA

SEQ ID NO: 6387 - protein, 338 aa, Saccharum officinarum
MVGTAAGAAEGAVRRWVDAAGGRLVLDGGLATELEANGADLNDPLWSAKCLLSSSHLIRKVHMDYLEAGANILITASYQATIQGFESKGFSKEQSEKLLTKSVEIALEARDMFLKEHLEKSIPIQHPILVAASIGSYGAYLADGSEYSGDYGEAGTKEFLKDFHRRRLQVLAEAGPDLIAFETIPNKLEAQAYGELLEECYINIPAWLSFNSKDGVHIVSGDSLIECATIADKCAKVGAVGINCTPPRFIHGLILSIRKVTDKPILIYPNSGERYDGEKKEWVESTGVSDGDFVSYVNEWCKDGAALIGGCCRTTPNTIRAIQRTLNQGFNEQHLPVA

SEQ ID NO: 6388 - protein, 210 aa, Secale cereale
MSYVHADVENLMATELRLGLPGVEEADKMPSPPSTPRAGSKRALAGEHREEEPKTAPPAAKAQVVGWPPVRSYRKSCFQQASSKTKAAAPAPVVVKQEEAAVAPAPPAAAAAGGSLYVKVSMDGAPYLRKIDLKMYKGYRELREALEAMFLGFSGDAGSVNPSDFAVTYEDKDGDLMLVGDVPFGMFMSTCKRMRIMKGSEARGLGSSKE

SEQ ID NO: 6389 - protein, 210 aa, Triticum aestivum
MSYVHADVENLKATELRLGLPGVEESDKMPSPPSTPRAGTKRALAGEHREEEPKAAPPAAKAQVVGWPPVRSYRKSCFQQASSKTKEAAPAPVVVKQEEAAVAAAPPAAAAAGGSLYVKVSMDGAPYLRKIDLKMYKGYRELREALEAMFLGFSGDAGSVNPSDFAVTYEDKDGDLMLVGDVPFGMFMSTCKRMRIMKGSEARGLGSSKE

SEQ ID NO: 6390 - protein, 210 aa, Secale cereale
MSYVHADVENLMATELRLGLPGVEEADKMPSPPSTPRAGSKRALAGEHREEEPKTAPPAAKAQVVGWPPVRSYRKSCFQQASSKTKAAAPAPVVVKQEEAAVAPAPPSAAAAGGSLYVKVSMDGAPYLRKIDLKMYKGYRELREALEAMFLGFSGDAGSVNPSDFAVTYEDKDGDLMLVGDVPFGMFMSTCKRMRIMKGSEARGLGSSKE

SEQ ID NO: 6391 - protein, 210 aa, Secale cereale
MSYVHADVENLMATELRLGLPGVEEADKMTSPPSTPRAGSKRALAGEHREEEPKTAPPAAKAQVVGWPPVRSYRKSCFQQASSKSKAAAPVPVVVKQEETAVAPAPPAAAAAGGSLYVKVSMDGAPYLRKIDLKMYNGYRELREALEAMFLGFSGDAGSVNPSDFAVTYEDKDGDLMLVGDVPFGMFMSTCKRMRIMKGSEARGLGSSKE

SEQ ID NO: 6392 - protein, 268 aa, Triticum aestivum
MATISSCSRLCGGGSSTAFHRRRSRPARAAVVTCRRFSAVVRAAAAASATAAAPVSTVPQTKEVKLPTWAEFELGKAPVYWKTTNGLPPAPGEGLKIFYNPGTTKLTPNEQFGIAFNGGFNQPIMCGGEPRQMTLQERGKACPPIYTIRIRVPQHAMTLVFSFTNGNEWDGAYTLKFKVPKPWLDKPLSFFNEGLADELNLEGACDRAIFPDENIVITSCDIGGFYEEGGDRCKLDIVSGCMDPTSHMFDPLATIDDGSCPLDSDTEE

SEQ ID NO: 6393 - protein, 268 aa, Triticum aestivum
MATISSCSRLCGGGSSTAFHRRRSRPARAAVVTCRRFSAVVRAAAAASATAAAPVSVVPQTKEVKLPTWAEFELGKAPVYWKTTNGLPPAPGEGLKIFYNPGTTKLTPNEQFGIAFNGGFNQPIMCGGEPRQMTLQERGKACPPIYTIRIRVPQHAMTLVFSFTNGNEWDGAYTLKFKVPKPWLDKPLSFFNEGLADELNMEGACDRAIFPDENIVITSCDIGGFYEEGGDRCKLDIVSGCMDPTSHMFDPLATIDDGSCPLDSDTEE

SEQ ID NO: 6394 - protein, 265 aa, Secale cereale
MATISSCSRLCGGGSSTAFHRRRSRATVVTCRRFSAVVRAAAAASATAAAPVSAVPQTKEVKLPTWAEFELGKAPVYWKTTNGLPPAPGEGLKIFYNPGTTKMTPNEQFGIAFNGGFNQPIMCGGEPRQMTLQERGKACPPIYTIRIRVPQHAMTLVFSFTNGSEWDGAYTLKFKVPKPWLNKPLSFFNEGLADELNMEGACDRAIFPDENIVISSCDIGGFYEEGGDRCKLDIVSGCMDPTSHMFDPLAIIDDGSCPLDSDSEE

SEQ ID NO: 6395 - protein, 269 aa, Avena sativa
MATLSSCSRLSGGGGATAFHRRRSRPSRATVITCRSFSAVVRAAAAASATATETATASVPQTKECSLPTWAEFELGKAPVYWKTTNGLPPAPGEGLKIFYNPGTTKLTPSDQFGIAFNGGFNQPIMCGGEPRQMTLQERGSACPPIYTIRIRVPQHATTLVFSFTNGSEWDGAYTLKFKVPKPWLNKPLSFFNEGLADELNMEGACDRAIFPDENIVITSCEIGSFYEEGGDRCKLDIVSGCMDPASHMFDPLAVVDDGTCPLDSDSEE

SEQ ID NO: 6396 - protein, 268 aa, Festuca arundinacea
MATLSSCSRLSGGATAFHRRRSRPSRATVITCRSFSAAVRAAAAASATATETATASVPPQTKECSLPTWAEFELGKAPVYWKTTSGLPPAPGEGLKIFYNPGTTELTPNEQFGIAFNGGFNQPIMCGGEPRQMTLQERGSADPPIYTIRIRVPQHATTLVFSFTNGSEWDGDYTLKFKVPKPWLGKPLSFFNEGLADELNMEGACDRAIFPDENVVITSCEMGSYYEEGGDRCKLDIVSGCMDPTSHMFDPLAVVDDGTCPLDSDSEE

SEQ ID NO: 6397 - protein, 267 aa, Brachypodium distachyon
MATLSSCSRLSGGATASHRHRSRPARAAVITCRRFSAAVRAAAAASATAAPPATVSVPQSKECALPTWADFELGKAPVYWKTTNGLPPSPGEGLKIFYNPGPNKLTPNEQFGIAFNGGFNQPIMCGGEPRQMTLQARGKADPPMYTIRIRVPQHATTLVFSFTNGKDWDGDYTLKFRVPKPWLNKPLSFFNDGLADELNMEGACDRAIFPDENIVITSCDIGGFYEEGGDRCKLDIVSGCMDPTSNMFDPLATVDDGSCPLESDSEE

SEQ ID NO: 6398 - protein, 267 aa, Festuca arundinacea
MATLSSCSRLSGGATAFHRRRSRPSRATVITCRSFSAAVRAAAAASATAPETATASVPQTKECSLPTWAEFELGKAPVYWKTTSGLPPAPGEGLKIFYNPGTTELTPNDQFGIAFNGGFNQPIMCGGEPRQMTLQERGSADPPIYTIRIRVPQHATTLVFSFTNGSEWDGDYTLKFKVPKPWLGKPLSFFNEGLADELNMEGACDRAIFPDENIVITSCEMGSYYEEGGDRCKLDIVSGCMDPTSHMFDPLAVVDDGTCPLDSDSEE

SEQ ID NO: 6399 - protein, 264 aa, Secale cereale
TISSCSRLCGGGSSSTAFHRRRSRATVVTCRRFSAVVRAAAAASATAAAPVSAVPQTKEVKLPTWAEFELGKAPVYWKTTNGLPPAPGRGPEDILQPRDDQDDTQRAVRHRLQRGFNQPIMCGGEPRQMTLQERGKACPPIYTIRIRVPQHAMTLVFSFTNGSEWDGAYTLKFKVPKPWLNKPLSFFNEGLADELNMEGACDRAIFPDENIVISSCDIGGFYEEGGDRCKLDIVSGCMDRTSHMFDPLATIDDGSCPLDSDSEE

SEQ ID NO: 6400 - protein, 237 aa, Lolium multiflorum
MATLSSCSRLSGGGATAFHRRRSRPSHATVITCRSFSAAVRAAATASATATETATASVPQTKECSLPTWAEFELGKAPVYWKTTSGLPPAPGEGLKIFYNPGTTELAPNEQFGIAFNGGFNQPIMCGGEPRQMTLQERGSADPPIYTIRIRVPQHATTLVFSFTNGSEWDGEYTLKFKVPKPWLGKPLSFFNEGLADELNMEGACDRAIFPDETSSSQAAKWAATTKKVETGASWTL

SEQ ID NO: 6401 - protein, 165 aa, Unknown
  Sequence found in Organisms: Zea mays, Pennisetum glaucum, Sorghum bicolor, Hordeum vulgare, Brachypodium distachyon, Cynodon dactylon, Pseudoroegneria spicata, Secale cereale, Saccharum officinarum, Triticum aestivum
MSSVFSGDETAPFFGFLGAAAALVFSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSSRAGQSRAD

SEQ ID NO: 6402 - protein, 165 aa, Brachypodium distachyon
MASVFSGDETAPFFGFLGAAAALVFSCMGAAYGTAKSGVGVASMGVMRPELVMKSIVPVVMAGVLGIYGLIIAVIISTGINPKAKPYFLFDGYAHLSSGLACGLAGLAAGMAIGIVGDAGVRANAQQPKLFVGMILILIFAEALALYGLIVGIILSSRAGQSRAD

SEQ ID NO: 6403 - protein, 165 aa, Cynodon dactylon
MSSTFSGDETAPFFGFLGAAAALVFSCMGAAYGTAKSGVGVASMGVMRPELVMKSIVPVVMAGVLGIYGLIIAVIISTGINPKAKPYFLFDGYAHLSSGLACGLAGLAAGMAIGIVGDAGVRANAQQPKLFVGMILILIFAEALALYGLIVGIILSSRAGQSRAD

SEQ ID NO: 6404 - protein, 165 aa, Triticum aestivum
MASTFSGDETAPFFGFLGAAAALVFSCMGAAYGTAKSGVGVASMGVMRPELVMKSIVPVVMAGVLGIYGLIIAVIISTGINPKAKPYFLFDGYAHLSSGLACGLAGLAAGMAIGIVGDAGVRANAQQPKLFVGMILILIFAEALALYGLIVGIILSSRAGQSRAD

SEQ ID NO: 6405 - protein, 165 aa, Setaria italica
MSSGFSGDETAPFFGFLGAAAALVFSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSSRAGQSRAD

SEQ ID NO: 6406 - protein, 165 aa, Eragrostis curvula
MSSVFSGDETAPFFGFLGAAAALVFSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMILILIYAEALALYGLIVGIILSSRAGQSRAD

SEQ ID NO: 6407 - protein, 165 aa, Oryza sativa
MSSVFSGDETAPFFGFLGAASALVFSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSSRAGQSRAD

SEQ ID NO: 6408 - protein, 165 aa, Sorghum bicolor
MSSAFSGDETAPFFGFLGAAAALVFSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSSRAGQSRAD

SEQ ID NO: 6409 - protein, 165 aa, Saccharum officinarum
MSSVFSGDETAPFFGFLGAAAALIFSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSSRAGQSRAD

SEQ ID NO: 6410 - protein, 116 aa, Triticum aestivum
MSSVFSGDETAPFFGFLGAAAALVFSCMGAAYGTAKSGVGVASMGVMRPELVMKSIVPVSWRECSESTASSSPSSSAPGSTQGQALLPLRRLRSPLLRARLWPRGARRRHGHWHCR

SEQ ID NO: 6411 - protein, 165 aa, Unknown
  Sequence found in Organisms: Ocimum basilicum, Orobanche aegyptiaca, Lippia dulcis, Plantago ovata, Salvia sclarea, Sesamum indicum, Utricularia gibba
MSSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLAAGMAIGIVGDAGVRANAQQPKLFVGMILILIFAEALALYGLIVGIILSSRAGQSRAD

SEQ ID NO: 6412 - protein, 165 aa, Unknown
  Sequence found in Organisms: Fagus grandifolia, Carpinus betulus
MSSVFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6413 - protein, 166 aa, Brachypodium distachyon
MAASVFSGDETAPFFGFLGAAAALVFSCMGAAYGTAKSGVGVASMGVMRPELVMKSIVPVVMAGVLGIYGLIIAVIISTGINPKAKPYFLFDGYAHLSSGLACGLAGLAAGMAIGIVGDAGVRANAQQPKLFVGMILILIFAEALALYGLIVGIILSSRAGQSRAD

SEQ ID NO: 6414 - protein, 165 aa, Cenchrus ciliaris
MSAAFSGDETAPFFGFLGAAAALVFSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSSRAGQSRAD

SEQ ID NO: 6415 - protein, 165 aa, Zea mays
MSSAFSGDETAPFFGFLGASAALVFSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSSRAGQSRAD

SEQ ID NO: 6416 - protein, 164 aa, Elaeis guineensis
MSSFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLAAGMAIGIVGDAGVRANAQQPKLFVGMILILIFAEALALYGLIVGIILSSRAGQSRAD

SEQ ID NO: 6417 - protein, 165 aa, Oryza sativa
MSSVFSGDETAPFFGFLGAASALIFSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSSRAGQSRAD

SEQ ID NO: 6418 - protein, 165 aa, Panicum virgatum
MSSAFSGDETAPFFGFLGAAAALIFSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSSRAGQSRAD

SEQ ID NO: 6419 - protein, 165 aa, Unknown
  Sequence found in Organisms: Ambrosia trifida, Aquilegia formosa, Arnica chamissonis, Artemisia annua, Centaurea maculosa, Chelidonium majus, Cichorium intybus, Cirsium arvense, Cucurbita pepo and additional organisms as disclosed in Tables 151 and 152
MSSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6420 - protein, 165 aa, Vaccinium corymbosum
MSSEFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6421 - protein, 165 aa, Vaccinium corymbosum
MSSGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6422 - protein, 165 aa, Olea europaea
MSSIFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6423 - protein, 164 aa, Unknown
  Sequence found in Organisms: Amorphophallus konjac, Cleome gynandra, Cleome spinosa, Curcuma longa, Zingiber officinale, Carpinus betulus, Elaeis guineensis
MSSFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6424 - protein, 165 aa, Unknown
  Sequence found in Organisms: Antirrhinum majus, Utricularia gibba
MSSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLAAGMAIGIVGDAGVRANAQQPKLFVGMILILIFAEALALYGLIVGIILSSRAGQSRAE

SEQ ID NO: 6425 - protein, 165 aa, Unknown
  Sequence found in Organisms: Cucumis sativus, Fraxinus spp, Citrus sinensis
MSSAFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6426 - protein, 165 aa, Unknown
  Sequence found in Organisms: Cucumis sativus, Citrus sinensis , Papaver somniferum
MSSSFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6427 - protein, 165 aa, Eschscholzia californica
MSSVFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLSCGLAGLSAGMAIGIVGDAGVRANAQQPKLFVGMILILIFAEALALYGLIVGIILSSRAGQSRAD

SEQ ID NO: 6428 - protein, 166 aa, Setaria italica
MAVATFSGDETAPFFGFLGAAAALVFSCMGAAYGTAKSGVGVASMGVMRPELVMKSIVPVVMAGVLGIYGLIIAVIISTGINPKAKPYFLFDGYAHLSSGLACGLAGLAAGMAIGIVGDAGVRANAQQPKLFVGMILILIFAEALALYGLIVGIILSSRAGQSRAD

SEQ ID NO: 6429 - protein, 166 aa, Zea mays
MAASTFSGDETAPFFGFLGAAAALVFSCMGAAYGTAKSGVGVASMGVMRPELVMKSIVPVVMAGVLGIYGLIIAVIISTGINPKAKPYFLFDGYAHLSSGLACGLAGLAAGMAIGIVGDAGVRANAQQPKLFVGMILILIFAEALALYGLIVGIILSSRAGQSRAD

SEQ ID NO: 6430 - protein, 165 aa, Unknown
  Sequence found in Organisms: Mimulus guttatus, Orobanche aegyptiaca, Triphysaria pusilla
MSSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLSCGLAGLAAGMAIGIVGDAGVRANAQQPKLFVGMILILIFAEALALYGLIVGIILSSRAGQSRAD

SEQ ID NO: 6431 - protein, 166 aa, Avena sativa
MATSTFSGDETAPFFGFLGAAAALVFSCMGAAYGTAKSGVGVASMGVMRPELVMKSIVPVVMAGVLGIYGLIIAVIISTGINPKAKPYFLFDGYAHLSSGLACGLAGLAAGMAIGIVGDAGVRANAQQPKLFVGMILILIFAEALALYGLIVGIILSSRAGQSRAD

SEQ ID NO: 6432 - protein, 165 aa, Lippia dulcis
MASTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLAAGMAIGIVGDAGVRANAQQPKLFVGMILILIFAEALALYGLIVGIILSSRAGQSRAD

SEQ ID NO: 6433 - protein, 166 aa, Unknown
  Sequence found in Organisms: Oryza sativa, Triticum aestivum
MSSSTFSGDETAPFFGFLGAASALVFSCMGAAYGTAKSGVGVASMGVMRPELVMKSIVPVVMAGVLGIYGLIIAVIISTGINPKAKPYFLFDGYAHLSSGLACGLAGLAAGMAIGIVGDAGVRANAQQPKLFVGMILILIFAEALALYGLIVGIILSSRAGQSRAD

SEQ ID NO: 6434 - protein, 161 aa, Secale cereale
FSGDETAPFFGFLGAAAALVFSCMGAAYGTAKSGVGVASMGVMRPELVMKSIVPVVMAGVLGIYGLIIAVIISTGINPKAKPYFLFDGYAHLSSGLACGLAGLAAGMAIGIVGDAGVRANAQQPKLFVGMILILIFAEALALYGLIVGIILSSRAGQSRAD

SEQ ID NO: 6435 - protein, 165 aa, Panicum virgatum
MPSAFSGDETAPFFGFLGAAAALIFSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSSRAGQSRAD

SEQ ID NO: 6436 - protein, 165 aa, Vinca minor
MSSVFSGDETAPFFGFLGAAAALVFSCMGAAYGTAKSGVGVASMGVMRPELVMKSIVPVVMAGVLGIYGLIIAVIISTGINPKTKAYYLFDGYAHLSSGLACGLAGLSAGMAIGIVGDAGVRANAQQPKLFVGMILILIFAEALALYGLIVGIILSSRAGQSRAD

SEQ ID NO: 6437 - protein, 255 aa, Ambrosia trifida
NGVASSNWSPSSFFTPKSLPFSTQWVHKQAKSKSSRILQSIHVSDGNDLLQDAESAKINRRKGLVTSVGLLAVTLGHNFVDGVAMASNFADMPALKGKDYGKSKMKYPDYAETSSGLQYKDLRSGNGIMPNKGDIVVVDWDGYTIGYYGRIFEARNKTKGGSFEGDDKSFYRFRLGDHEVIPAFEEAVAGMSLGGIRRIIVPPDLGYPENDYNKSGPKPTTFSGQRALDFVLKNQGLIDKTLLFDIELLNIIPNN

SEQ ID NO: 6438 - protein, 165 aa, Unknown
  Sequence found in Organisms: Aquilegia formosa, Epimedium sagittatum, Liriodendron tulipifera, Valeriana officinalis
MSTTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6439 - protein, 164 aa, Unknown
  Sequence found in Organisms: Phaseolus coccineus, Vigna unguiculata
MASFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6440 - protein, 165 aa, Vaccinium corymbosum
MSATFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6441 - protein, 165 aa, Vaccinium corymbosum
MSAAFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6442 - protein, 165 aa, Olea europaea
MSSNFSGEETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6443 - protein, 165 aa, Zostera marina
MSSTFSGDETAPFFGFLGAASALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6444 - protein, 165 aa, Unknown
  Sequence found in Organisms: Amsonia hubrichtii, Catharanthus roseus, Coffea canephora, Tabernaemontana elegans, Vinca minor
MSSTFSGDETAPFFGFLGAAAALVFSCMGAAYGTAKSGVGVASMGVMRPELVMKSIVPVVMAGVLGIYGLIIAVIISTGINPKTKAYYLFDGYAHLSSGLACGLAGLSAGMAIGIVGDAGVRANAQQPKLFVGMILILIFAEALALYGLIVGIILSSRAGQSRAD

SEQ ID NO: 6445 - protein, 165 aa, Amsonia hubrichtii
MSSTFSGDETAPFFGFLGAAAALVFSCMGAAYGTAKSGVGVASMGVMRPELVMKSIVPVVMAGVLGIYGLIIAVIISTGINPKTKSYYLFDGYAHLSSGLACGLAGLSAGMAIGIVGDAGVRANAQQPKLFVGMILILIFAEALALYGLIVGIILSSRAGQSRAD

SEQ ID NO: 6446 - protein, 165 aa, Antirrhinum majus
MSSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLSCGLAGLAAGMAIGIVGDAGVRANAQQPKLFVGMILILIFAEALALYGLIVGIILSSRAGQSRAE

SEQ ID NO: 6447 - protein, 165 aa, Antirrhinum majus
MSSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLAAGMAIGIVGDAGVRANAQQPKLLVGMILILIFAEALALYGLIVGIILSSRAGQSRAE

SEQ ID NO: 6448 - protein, 166 aa, Malus domestica
MSSTTFSGDETAPFFGFLGAAAALVFSCMGAAYGTAKSGVGVASMGVMRPELVMKSIVPVVMAGVLGIYGLIIAVIISTGINPKAKPYYLFDGYAHLSSGLACGLAGLSAGMAIGIVGDAGVRANAQQPKLFVGMILILIFAEALALYGLIVGIILSSRSGQSRAD

SEQ ID NO: 6449 - protein, 165 aa, Aristolochia fimbriata
MSDTFAGDVTAPFFGFLGAAAALVFSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSSRAGQSRAD

SEQ ID NO: 6450 - protein, 167 aa, Unknown
  Sequence found in Organisms: Arnica chamissonis, Cichorium intybus
MSSVSGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6451 - protein, 166 aa, Fagus grandifolia
MSSSVFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6452 - protein, 165 aa, Beta vulgaris
MSTVFNGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6453 - protein, 165 aa, Bupleurum chinense
MSTAFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6454 - protein, 165 aa, Unknown
  Sequence found in Organisms: Gossypium hirsutum, Theobroma cacao, Cannabis sativa, Citrus clementina, Flaveria ramosissima, Gossypium raimondii, Humulus lupulus, Citrus sinensis , Populus trichocarpa, Pteridium aquilinum, Tripterygium wilfordii
MSSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6455 - protein, 165 aa, Unknown
  Sequence found in Organisms: Manihot esculenta, Ricinus communis, Hevea brasiliensis
MSSGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6456 - protein, 165 aa, Unknown
  Sequence found in Organisms: Catharanthus roseus, Tabernaemontana elegans
MSSIFSGDETAPFFGFLGAAAALVFSCMGAAYGTAKSGVGVASMGVMRPELVMKSIVPVVMAGVLGIYGLIIAVIISTGINPKTKAYYLFDGYAHLSSGLACGLAGLSAGMAIGIVGDAGVRANAQQPKLFVGMILILIFAEALALYGLIVGIILSSRAGQSRAD

SEQ ID NO: 6457 - protein, 165 aa, Centaurea maculosa
  misc_feature (62)..(62): Xaa can be any naturally occurring amino acid
MSSTFSGDETAPFFGFLGAAAALVFSCMGAAYGTAKSGVGVASMGVMRPELVMKSIVPVVMXGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6458 - protein, 165 aa, Cichorium intybus
MSSTFSGDETAPFFGFLGAAAAPVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6459 - protein, 165 aa, Citrus clementina
MSSAFIGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6460 - protein, 166 aa, Unknown
  Sequence found in Organisms: Citrus clementina, Citrus sinensis
MSSTLFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6461 - protein, 165 aa, Unknown
  Sequence found in Organisms: Citrus clementina, Taraxacum officinale
MPSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6462 - protein, 165 aa, Cleome spinosa
MASVFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIIGIILSSRAGQSRAD

SEQ ID NO: 6463 - protein, 165 aa, Cleome spinosa
MASGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6464 - protein, 165 aa, Cucumis sativus
MSSAFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6465 - protein, 165 aa, Unknown
  Sequence found in Organisms: Cucurbita pepo, Euonymus alatus, Linum usitatissimum, Camellia sinensis, Tripterygium wilfordii, Citrullus lanatus
MASTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6466 - protein, 165 aa, Euonymus alatus
MASDFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6467 - protein, 165 aa, Flaveria ramosissima
MSSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDVGVRANAQQPKLFVGMILILIFAEALALYGLIVGIILSSRAGQSRAD

SEQ ID NO: 6468 - protein, 165 aa, Linum usitatissimum
MVSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6469 - protein, 164 aa, Unknown
  Sequence found in Organisms: Pennisetum glaucum, Setaria italica
MVAFSGDETAPFFGFLGAAAALVFSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSSRAGQSRAD

SEQ ID NO: 6470 - protein, 165 aa, Fraxinus spp
MSSVFNGDETAPFFGFLGAASALVFSCMGAAYGTAKSGVGVASMGVMRPELVMKSIVPVVMAGVLGIYGLIIAVIISTGINPKAKGYYLFDGYAHLSSGLACGLAGLSAGMAIGIVGDAGVRANAQQPKLFVGMILILIFAEALALYGLIVGIILSSRAGQSRAD

SEQ ID NO: 6471 - protein, 165 aa, Gerbera hybrid cultivar
MSSTFSGDETAPFFGFLGAAAALVFSCMGAAYGTAKSGVGVASMGVMRPELVMKSIVPVVMAGVLGIYGLIIAVIISTGINPKAKSHYLFDGYAHLSSGLACGLAGLSAGMAIGIVGDAGVRANAQQPKLFVGMILILIFAEALALYGLIVGIILSSRAGQSRAD

SEQ ID NO: 6472 - protein, 165 aa, Guizotia abyssinica
MSSTFSGDETAPFFGFLGAAAALVFSCMGAAYGTAKSGVGVASVGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6473 - protein, 165 aa, Jatropha curcas
MSSVFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDSGVRANAQQPKLFVGMILILIFAEALALYGLIVGIILSSRAGQSRAE

SEQ ID NO: 6474 - protein, 165 aa, Lactuca sativa
MSSTFAGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6475 - protein, 165 aa, Unknown
  Sequence found in Organisms: Pinus pinaster, Pinus taeda
MVDVFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLSGLAAGMAIGIVGDAGVRANAQQPKLFVGMILILIFAEALALYGLIVGIILSSRAGQSRAD

SEQ ID NO: 6476 - protein, 165 aa, Momordica charantia
MVSSFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6477 - protein, 164 aa, Nuphar advena
MSSFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLSCGLAGLSAGMAIGIVGDAGVRANAQQPKLFVGMILILIFAEALALYGLIVGIILSSRAGQSRAD

SEQ ID NO: 6478 - protein, 164 aa, Elaeis guineensis
MSGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6479 - protein, 164 aa, Elaeis guineensis
MSSFSGDQTAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6480 - protein, 165 aa, Carica papaya
MASSFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6481 - protein, 164 aa, Unknown
  Sequence found in Organisms: Primula obconica, Eutrema halophilum, Eutrema parvulum
MSSFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6482 - protein, 167 aa, Oryza sativa
MAGASTFSGDETAPFFGFLGAAAALVFSCMGAAYGTAKSGVGVASMGVMRPELVMKSIVPVVMAGVLGIYGLIIAVIISTGINPKAKPYFLFDGYAHLSSGLACGLAGLAAGMAIGIVGDAGVRANAQQPKLFVGMILILIFAEALALYGLIVGIILSSRAGQSRAD

SEQ ID NO: 6483 - protein, 166 aa, Rosa hybrid cultivar
MSSTTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6484 - protein, 165 aa, Sarracenia psittacina
MSSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAA

SEQ ID NO: 6485 - protein, 165 aa, Sarracenia psittacina
MSSTFSGDETAPFFGFLGAAAALVFSCMGAAYGTAKSGVGVASMGVMRPELVMKSIVPVVMAGVLGIYGLIIAVIISTGINPKAESYYLFDGYAHLSSGLACGLAGLSAGMAIGIVGDAGVRANAQQPKLFVGMILILIFAEALALYGLIVGIILSSRAGQSRAD

SEQ ID NO: 6486 - protein, 165 aa, Euphorbia esula
  misc_feature (106)..(106): Xaa can be any naturally occurring amino acid
MSSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAXLSAGMAIGIVGDAGVRANAQQPKLFVGMILILIFAEALALYGLIVGIILSSRAGQSRAD

SEQ ID NO: 6487 - protein, 166 aa, Saccharum officinarum
MATSTFSGDETAPFFGFLGAAAALVFSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSSRAGQSRAD

SEQ ID NO: 6488 - protein, 165 aa, Helianthus annuus
MSSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIAGIILSSRAGQSRAD

SEQ ID NO: 6489 - protein, 164 aa, Panicum virgatum
MSAFSGDETAPFFGFLGAAAALIFSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSSRAGQSRAD

SEQ ID NO: 6490 - protein, 165 aa, Tamarix hispida
  misc_feature (142)..(142): Xaa can be any naturally occurring amino acid
MSTVFNGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLAAGMAIGIVGDAGVRANAQQPKLFVGMILILIFAXALALYGLIVGIILSSRAGQSRAD

SEQ ID NO: 6491 - protein, 165 aa, Vinca minor
MSSSFSGDETAPFFGFLGAAAALVFSCMGAAYGTAKSGVGVASMGVMRPELVMKSIVPVVMAGVLGIYGLIIAVIISTGINPKTKAYYLFDGYAHLSSGLACGLAGLSAGMAIGIVGDAGVRANAQQPKLFVGMILILIFAEALALYGLIVGIILSSRAGQSRAD

SEQ ID NO: 6492 - protein, 91 aa, Vaccinium corymbosum
MSSSGFSGDETAPFFGFLGAAAALVFSCMGAAYGTAKSGVGVASMGVMRPELVMKSIVPVVMAGVLGIYGLIIAVIISTGINPKAKSYYLF

SEQ ID NO: 6493 - protein, 195 aa, Amorphophallus konjac
MSSFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILILLKHLPFTVLLLASSSHLAPVSLEQTKRGMVAVGISAKFPVVPYIYDVKPPRLLLSS

SEQ ID NO: 6494 - protein, 74 aa, Flaveria ramosissima
PSLLHDSISVEIGSISENQNPQNPFHFSSDQIKTLNQSINLSIMSSTFSGDETAPFFGFLGAAAALVFSCMGAA

SEQ ID NO: 6495 - protein, 122 aa, Sarracenia psittacina
MGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6496 - protein, 133 aa, Thalictrum flavum
MSSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLLWA

SEQ ID NO: 6497 - protein, 323 aa, Zostera marina
MHAKTDSEGTSLAPSSPTRSPRRTVYYVQSPSRDSHDGEKTTNNSFHSTPIISPMGSPPHSGNHSSRESSSSRFSESLKHLHGGSRKILPNDPHEKKIKKKKKGFEVIDEEGLLDDEDERDTLPRKCYYLAFVLGFFVLFSFFSLVLWGAGNSQKPRITMKTIKFNNFVIQAGTDTTGVPTDMATLNSTVRFTFRNTASFFGVHVTSTPLSLTYSDQLTLAAGRMNYFYQRRKSQRSITVVVEGNKIPLYGGGSSLSSSSSSDKTIEREELVPLMLRFKVRSRAYVLGKLVKHKFYINVLCNVKLNPNELNTPMRLKNSCTFN

SEQ ID NO: 6498 - protein, 236 aa, Panicum virgatum
MSSAFSGDETAPFFGFLGAAAALIFSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMISFSFLQSASSLRSHCGHHSLIPCRPIPCGLGACCYHSIITAVFIICSFERNLNSRFLSSLFMLPCINETVVAEGRWHFQSCSIWWCQEVIFWVKAGWMLLG

SEQ ID NO: 6499 - protein, 165 aa, Unknown
  Sequence found in Organisms: Brassica napus, Brassica juncea, Brassica oleracea, Brassica rapa, Manihot esculenta, Cleome gynandra, Carica papaya, Raphanus sativus, Eutrema halophilum, Eutrema parvulum
MASGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6500 - protein, 164 aa, Unknown
  Sequence found in Organisms: Amorphophallus konjac, Musa acuminata, Chelidonium majus, Eucalyptus grandis, Actinidia deliciosa, Platanus occidentalis
MSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6501 - protein, 164 aa, Musa acuminata
MSTFTGDETAPFFGFLGAAAALVFSCMGAAYGTAKSGVGVASMGVMRPELVMKSIVPVVMAGVLGIYGLIIAVIISTGINPKAKPYYLFDGYAHLSSGLACGLAGLSAGMAIGIVGDAGVRANAQQPKLFVGMILILIFAEALALYGLIVGIILSSRAGQSRAD

SEQ ID NO: 6502 - protein, 164 aa, Unknown
  Sequence found in Organisms: Glycine max, Phaseolus coccineus, Vigna unguiculata, Glycyrrhiza uralensis, Allium cepa, Phalaenopsis aphrodite, Cajanus cajan
MAGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6503 - protein, 165 aa, Unknown
  Sequence found in Organisms: Ipomoea nil, Nicotiana benthamiana, Nicotiana tabacum
MSSTFSGDETAPFFGFLGAAAALVFSCMGAAYGTAKSGVGVASMGVMRPELVMKSIVPVVMAGVLGIYGLIIAVIISTGINPKTKSYYLFDGYAHLSSGLACGLAGLSAGMAIGIVGDAGVRANAQQPKLFVGMILILIFAEALALYGLIVGIILSSRAGQSRAE

SEQ ID NO: 6504 - protein, 165 aa, Unknown
  Sequence found in Organisms: Fraxinus spp, Olea europaea
MSSIFNGDETAPFFGFLGAASALVFSCMGAAYGTAKSGVGVASMGVMRPELVMKSIVPVVMAGVLGIYGLIIAVIISTGINPKAKGYYLFDGYAHLSSGLACGLAGLSAGMAIGIVGDAGVRANAQQPKLFVGMILILIFAEALALYGLIVGIILSSRAGQSRAD

SEQ ID NO: 6505 - protein, 164 aa, Allium cepa
MVGFSGDETAPFFGFLGAAAALVFSCMGAAYGTAKSGVGVASMGVMRPELVMKSIVPVVMAGVLGIYGLIIAVIISTGINPKAKPYYLFDGYAHLSSGLACGLAGLSAGMAIGIVGDAGVRANAQQPKLFVGMILILIFAEALALYGLIVGIILSSRAGQSRAD

SEQ ID NO: 6506 - protein, 165 aa, Zostera marina
MSTTFSGDETAPFFGFLGAASALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6507 - protein, 165 aa, Unknown
  Sequence found in Organisms: Abies balsamea, Pseudotsuga menziesii
MVEAFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLSGLAAGMAIGIVGDAGVRANAQQPKLFVGMILILIFAEALALYGLIVGIILSSRAGQSRAD

SEQ ID NO: 6508 - protein, 164 aa, Amborella trichopoda
MVSFSGDETAPFFGFLGAAAALVFSCMGAAYGTAKSGVGVASMGVMRPELVMKSIVPVVMAGVLGIYGLIIAVIISTGINPKAKPYYLFDGYAHLSSGLACGLAGLSAGMAIGVVGDAGVRANAQQPKLFVGMILILIFAEALALYGLIVGIILSSRAGQSRAE

SEQ ID NO: 6509 - protein, 165 aa, Amsonia hubrichtii
MSTTFSGDETAPFFGFLGAAAALVFSCMGAAYGTAKSGVGVASMGVMRPELVMKSIVPVVMAGVLGIYGLIIAVIISTGINPKTKAYYLFDGYAHLSSGLACGLAGLSAGMAIGIVGDAGVRANAQQPKLFVGMILILIFAEALALYGLIVGIILSSRAGQSRAD

SEQ ID NO: 6510 - protein, 165 aa, Arabidopsis lyrata
MASSFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6511 - protein, 165 aa, Unknown
  Sequence found in Organisms: Arabidopsis thaliana, Gossypium hirsutum, Manihot esculenta, Gossypium raimondii, Populus trichocarpa, Tripterygium wilfordii
MASTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6512 - protein, 164 aa, Persea americana
MANFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLSCGLAGLAAGMAIGIVGDAGVRANAQQPKLFVGMILILIFAEALALYGLIVGIILSSRAGQSRAD

SEQ ID NO: 6513 - protein, 164 aa, Brassica napus
MSTFSGDETAPFFGFLGAAAALVFSCMGAAYGTAKSGVGVASMGVMRPELVMKSIVPVVMAGVLGIYGLIIAVIISTGINPKAKSYFLFDGYAHLSSGLACGLAGLSAGMAIGIVGDAGVRANAQQPKLFVGMILILIFAEALALYGLIVGIILSSRAGQSRAE

SEQ ID NO: 6514 - protein, 165 aa, Manihot esculenta
MTSGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6515 - protein, 165 aa, Manihot esculenta
MPSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6516 - protein, 166 aa, Castanea mollissima
SSSSVFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLSCGLAGLSAGMAIGIVGDAGVRANAQQPKLFVGMILILIFAEALALYGLIVGIILSSRAGQSRAD

SEQ ID NO: 6517 - protein, 165 aa, Cichorium intybus
MCSTFSGDETAPFFGFLGAAAALIFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6518 - protein, 166 aa, Cirsium arvense
MSSSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6519 - protein, 164 aa, Cleome spinosa
MSAFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6520 - protein, 165 aa, Gossypium hirsutum
MSTTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6521 - protein, 165 aa, Cycas rumphii
MAEVFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRSD

SEQ ID NO: 6522 - protein, 165 aa, Eschscholzia californica
MSTSFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLSCGLAGLSAGMAIGIVGDAGVRANAQQPKLFVGMILILIFAEALALYGLIVGIILSSRAGQSRAD

SEQ ID NO: 6523 - protein, 165 aa, Eschscholzia californica
MSTQFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLSCGLAGLSAGMAIGIVGDAGVRANAQQPKLFVGMILILIFAEALALYGLIVGIILSSRAGQSRAD

SEQ ID NO: 6524 - protein, 165 aa, Euphorbia peplus
MSTGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6525 - protein, 167 aa, Flaveria ramosissima
MSSASGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6526 - protein, 164 aa, Gerbera hybrid cultivar
ASTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6527 - protein, 166 aa, Mesembryanthemum crystallinum
MSSAVFNGDETAPFFGFLGAASALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6528 - protein, 165 aa, Mesembryanthemum crystallinum
MSTVFNGDETAPFFGFLGAASALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6529 - protein, 165 aa, Ipomoea batatas
MSSAFSGDETAPFFGFLGAAAALVFSCMGAAYGTAKSGVGVASMGVMRPELVMKSIVPVVMAGVLGIYGLIIAVIISTGINPKTKSYYLFDGYAHLSSGLACGLAGLSAGMAIGIVGDAGVRANAQQPKLFVGMILILIFAEALALYGLIVGIILSSRAGQSRAE

SEQ ID NO: 6530 - protein, 165 aa, Ipomoea batatas
MSSSFSGDETAPFFGFLGAAAALVFSCMGAAYGTAKSGVGVASMGVMRPELVMKSIVPVVMAGVLGIYGLIIAVIISTGINPKTKSYYLFDGYAHLSSGLACGLAGLSAGMAIGIVGDAGVRANAQQPKLFVGMILILIFAEALALYGLIVGIILSSRAGQSRAE

SEQ ID NO: 6531 - protein, 165 aa, Actinidia deliciosa
  misc_feature (112)..(112): Xaa can be any naturally occurring amino acid
  misc_feature (163)..(163): Xaa can be any naturally occurring amino acid
MSSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMXIGIVGDAGVRANAQQPKLFVGMILILIFAEALALYGLIVGIILSSRAGQSXAD

SEQ ID NO: 6532 - protein, 165 aa, Tropaeolum majus
MVSGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6533 - protein, 165 aa, Tropaeolum majus
MVSNFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6534 - protein, 164 aa, Elaeis guineensis
MSDFSGDQTAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6535 - protein, 165 aa, Olea europaea
MSSNFSGEETAPFFGFLGAAAALVFSCMGAACGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6536 - protein, 165 aa, Carica papaya
MSTPFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6537 - protein, 165 aa, Populus trichocarpa
MSSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLSCGLAGLSAGMAIGIVGDAGVRANAQQPKLFVGMILILIFAEALALYGLIVGIILSSRAGQSRAE

SEQ ID NO: 6538 - protein, 165 aa, Populus trichocarpa
MVSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6539 - protein, 164 aa, Primula obconica
MSSFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLSCGLAGLSAGMAIGIVGDAGVRANAQQPKLFVGMILILIFAEALALYGLIVGIILSSRAGQSRAE

SEQ ID NO: 6540 - protein, 166 aa, Rosa hybrid cultivar
MASSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6541 - protein, 162 aa, Salvia sclarea
MSSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLAAGMAIGIVGDAGVRANAQQPKLFVGMILILIFAEALALYGLIVGIILSSRAGQS

SEQ ID NO: 6542 - protein, 164 aa, Glycine max
MPGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6543 - protein, 166 aa, Fragaria vesca
MASSSFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6544 - protein, 166 aa, Panicum virgatum
MAGSTFSGDETAPFFGFLGAAAALIFSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSSRAGQSRAD

SEQ ID NO: 6545 - protein, 165 aa, Taxus baccata
MADVFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLSGLSAGMAIGIVGDAGVRANAQQPKLFVGMILILIFAEALALYGLIVGIILSSRAGQSRAD

SEQ ID NO: 6546 - protein, 165 aa, Tripterygium wilfordii
MSSTFSGDESAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6547 - protein, 165 aa, Vinca minor
MPSTFSGDETAPFFGFLGAAAALVFSCMGAAYGTAKSGVGVASMGVMRPELVMKSIVPVVMAGVLGIYGLIIAVIISTGINPKTKAYYLFDGYAHLSSGLACGLAGLSAGMAIGIVGDAGVRANAQQPKLFVGMILILIFAEALALYGLIVGIILSSRAGQSRAD

SEQ ID NO: 6548 - protein, 164 aa, Juglans hindsii x Juglans regia
MSNFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6549 - protein, 80 aa, Fraxinus spp
MSSIFNGDETAPFFRLPRRRFCPRLLLYGCGVWNGEEWCRCRFDGSDEAGAGDEVDRAGGYGWSVGYLRVDYCCDYQHWD

SEQ ID NO: 6550 - protein, 68 aa, Lippia dulcis
YSFIHQSEDHLRSDLCTNPNRSIMSSTFSGDETAPFFGFLGAAAALVFSCMGAAYGTAKSGVGVRRWG

SEQ ID NO: 6551 - protein, 199 aa, Pteridium aquilinum
FLLHLSLPLLTEEIHRSKFPKSLQFVGGIFLANENVVHVSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6552 - protein, 141 aa, Salvia sclarea
MSSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLAAGMAIGIVGDAGVRANAQQPMLFCWNDPHSHFH

SEQ ID NO: 6553 - protein, 164 aa, Unknown
  Sequence found in Organisms: Arabidopsis thaliana, Brassica napus, Arabidopsis lyrata, Brassica juncea, Brassica oleracea, Brassica rapa, Musa acuminata, Vitis vinifera and additional organisms as disclosed in Tables 151 and 152
MSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6554 - protein, 163 aa, Brassica juncea
SGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6555 - protein, 164 aa, Unknown
  Sequence found in Organisms: Glycine max, Phaseolus coccineus, Vigna unguiculata, Cajanus cajan
MAAFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6556 - protein, 166 aa, Unknown
  Sequence found in Organisms: Taraxacum officinale, Lactuca sativa, Tragopogon dubius
MGSDSFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6557 - protein, 164 aa, Unknown
  Sequence found in Organisms: Allium cepa, Phalaenopsis aphrodite
MVGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6558 - protein, 165 aa, Capsicum annuum
MASAFSGDETAPFFGFLGAAAALVFSCMGAAYGTAKSGVGVASMGVMRPELVMKSIVPVVMAGVLGIYGLIIAVIISTGINPKTKSYYLFDGYAHLSSGLACGLAGLSAGMAIGIVGDAGVRANAQQPKLFVGMILILIFAEALALYGLIVGIILSSRAGQSRAE

SEQ ID NO: 6559 - protein, 166 aa, Unknown
  Sequence found in Organisms: Malus domestica, Prunus persica, Prunus mume
MSSSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRSGQSRAD

SEQ ID NO: 6560 - protein, 166 aa, Unknown
  Sequence found in Organisms: Malus domestica, Prunus persica, Prunus mume
MASSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRSGQSRAD

SEQ ID NO: 6561 - protein, 164 aa, Zostera marina
MSTFSGDETAPFFGFLGAASALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6562 - protein, 164 aa, Unknown
  Sequence found in Organisms: Acacia harpophylla, Cicer arietinum, Glycyrrhiza uralensis, Lotus japonicus, Tropaeolum majus, Arachis hypogaea
MAGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6563 - protein, 166 aa, Unknown
  Sequence found in Organisms: Ambrosia trifida, Arnica chamissonis, Flaveria ramosissima, Guizotia abyssinica, Helianthus annuus
MADSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6564 - protein, 167 aa, Ambrosia trifida
MSSSSGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6565 - protein, 166 aa, Arabidopsis thaliana
MASSGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6566 - protein, 161 aa, Unknown
  Sequence found in Organisms: Arnica chamissonis, Cirsium arvense
FSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6567 - protein, 164 aa, Persea americana
MTDFSGDVTAPFFGFLGAAAALVFSCMGAAYGTAKSGVGVASMGVMRPELVMKSIVPVVMAGVLGIYGLIIAVIISTGINPKAKSYYLFDGYAHLSSGLSCGLAGLAAGMAIGIVGDAGVRANAQQPKLFVGMILILIFAEALALYGLIVGIILSSRAGQSRAD

SEQ ID NO: 6568 - protein, 164 aa, Persea americana
MVAFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLSCGLAGLAAGMAIGIVGDAGVRANAQQPKLFVGMILILIFAEALALYGLIVGIILSSRAGQSRAD

SEQ ID NO: 6569 - protein, 165 aa, Brassica rapa
MASGFSGDETAPFFGFLGAAAAPVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6570 - protein, 164 aa, Catharanthus roseus
MSAFSGDETAPFFGFLGAAAALVFSCMGAAYGTAKSGVGVASMGVMRPELVMKSIVPVVMAGVLGIYGLIIAVIISTGINPKTKAYYLFDGYAHLSSGLACGLAGLSAGMAIGIVGDAGVRANAQQPKLFVGMILILIFAEALALYGLIVGIILSSRAGQSRAD

SEQ ID NO: 6571 - protein, 166 aa, Unknown
  Sequence found in Organisms: Centaurea maculosa, Cirsium arvense, Cynara scolymus
MADSGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6572 - protein, 165 aa, Cephalotaxus harringtonia
MADSFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLSGLSAGMAIGIVGDAGVRANAQQPKLFVGMILILIFAEALALYGLIVGIILSSRAGQSRAD

SEQ ID NO: 6573 - protein, 166 aa, Cichorium intybus
MASDSFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6574 - protein, 164 aa, Vigna unguiculata
MVDFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6575 - protein, 164 aa, Unknown
  Sequence found in Organisms: Glycine max, Cyamopsis tetragonoloba, Cajanus cajan
MAPFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6576 - protein, 165 aa, Unknown
  Sequence found in Organisms: Solanum lycopersicum, Solanum melongena, Nicotiana benthamiana, Solanum tuberosum, Solanum phureja, Nicotiana tabacum
MASTFSGDETAPFFGFLGAAAALVFSCMGAAYGTAKSGVGVASMGVMRPELVMKSIVPVVMAGVLGIYGLIIAVIISTGINPKTKSYYLFDGYAHLSSGLACGLAGLSAGMAIGIVGDAGVRANAQQPKLFVGMILILIFAEALALYGLIVGIILSSRAGQSRAE

SEQ ID NO: 6577 - protein, 167 aa, Euphorbia peplus
MSSASVFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6578 - protein, 166 aa, Euphorbia peplus
MSSGGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLSCGLAGLSAGMAIGIVGDAGVRANAQQPKLFVGMILILIFAEALALYGLIVGIILSSRAGQSRAE

SEQ ID NO: 6579 - protein, 165 aa, Unknown
  Sequence found in Organisms: Euphorbia peplus, Euphorbia esula
MSTGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLSCGLAGLSAGMAIGIVGDAGVRANAQQPKLFVGMILILIFAEALALYGLIVGIILSSRAGQSRAE

SEQ ID NO: 6580 - protein, 166 aa, Unknown
  Sequence found in Organisms: Guizotia abyssinica, Parthenium argentatum
MAGSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6581 - protein, 165 aa, Hevea brasiliensis
MATAFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRVD

SEQ ID NO: 6582 - protein, 165 aa, Ipomoea batatas
MSTTFSGDETAPFFGFLGAAAALVFSCMGAAYGTAKSGVGVASMGVMRPELVMKSIVPVVMAGVLGIYGLIIAVIISTGINPKTKSYYLFDGYAHLSSGLACGLAGLSAGMAIGIVGDAGVRANAQQPKLFVGMILILIFAEALALYGLIVGIILSSRAGQSRAE

SEQ ID NO: 6583 - protein, 165 aa, Ipomoea nil
MSSTFSDDETAPFFGFLGAAAALVFSCMGAAYGTAKSGVGVASMGVMRPELVMKSIVPVVMAGVLGIYGLIIAVIISTGINPKTKSYYLFDGYAHLSSGLACGLAGLSAGMAIGIVGDAGVRANAQQPKLFVGMILILIFAEALALYGLIVGIILSSRAGQSRAE

SEQ ID NO: 6584 - protein, 165 aa, Jatropha curcas
MATGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6585 - protein, 165 aa, Tropaeolum majus
MVAGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6586 - protein, 167 aa, Quercus alba
MSSSSVFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLSCGLAGLSAGMAIGIVGDAGVRANAQQPKLFVGMILILIFAEALALYGLIVGIILSSRAGQSRAD

SEQ ID NO: 6587 - protein, 164 aa, Elaeis guineensis
MTDFSGDEVAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6588 - protein, 165 aa, Petunia hybrida
MSSSFAGDETAPFFGFLGAAAALVFSCMGAAYGTAKSGVGVASMGVMRPELVMKSIVPVVMAGVLGIYGLIIAVIISTGINPKTKSYYLFDGYAHLSSGLACGLAGLSAGMAIGIVGDAGVRANAQQPKLFVGMILILIFAEALALYGLIVGIILSSRAGQSRAE

SEQ ID NO: 6589 - protein, 164 aa, Phalaenopsis aphrodite
MAGFAGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6590 - protein, 164 aa, Rhizophora mangle
SSVFSGDETAPFFGFLGAASALVFSCMGAAYGTAKSGVGVASMGVMRPELVMKLIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAG

SEQ ID NO: 6591 - protein, 165 aa, Silene vulgaris
MSSVFNGDETAPFFGFLGAAAALIFSCMGAAYGTAKSGVGVASMGVMRPELVMKSIVPVVMAGVLGIYGLIIAVIISTGINPKAKSYYLFDGYAHLSSGIACGLSGLAAGMAIGVVGDAGVRANAQQPKLFVGMILILIFAEALALYGLIVGIILSSRAGQSRAD

SEQ ID NO: 6592 - protein, 164 aa, Glycine max
MAGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLSCGLAGLSAGMAIGIVGDAGVRANAQQPKLFVGMILILIFAEALALYGLIVGIILSSRAGQSRAD

SEQ ID NO: 6593 - protein, 165 aa, Picea glauca
MVEAFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLSGLAAGMAIGIVGDAGVRANAQQPKLFVGMILILIFAEALALYGLIVGIILSSRAGQSRSD

SEQ ID NO: 6594 - protein, 166 aa, Fragaria vesca
MASTTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6595 - protein, 165 aa, Camellia sinensis
MSSTFSGDETAPFFGFLGAAAALVFSCMDAAYGTAKSGVGVASMGVMRPELVMKSIVPVVMAGVLGIYGLNIAVIISTGINPKAKSYYLFDGYAHLSSGLACGLAGLSAGMAIGIVGDAGVRANAQQPKLFVGMILILIFAEAPALYGLIVGIILSSRAGQSRAD

SEQ ID NO: 6596 - protein, 162 aa, Thalictrum flavum
TFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6597 - protein, 165 aa, Nicotiana tabacum
  misc_feature (158)..(158): Xaa can be any naturally occurring amino acid
MSSTFSGDETAPFFGFLGAAAALVFSCMGAAYGTAKSGVGVASMGVMRPELVMKSIVPVVMAGVLGIYGLIIAVIISTGINPKTKSYYLFDGYAHLSSGLACGLAGLSAGMAIGIVGDAGVRANAQQPKLFVGMILILIFAEALALYGLIVGIILSSXAGQSRAE

SEQ ID NO: 6598 - protein, 165 aa, Nicotiana tabacum
MPSTFSGDETAPFFGFLGAAAALVFSCMGAAYGTAKSGVGVASMGVMRPELVMKSIVPVVMAGVLGIYGLIIAVIISTGINPKTKSYYLFDGYAHLSSGLACGLAGLSAGMAIGIVGDAGVRANAQQPKLFVGMILILIFAEALALYGLIVGIILSSRAGQSRAE

SEQ ID NO: 6599 - protein, 167 aa, Ambrosia trifida
NRSCLQRSPAMKQRRFRTPWSRCRSSLLLYGGGVWDGKEWCRSGVNGSDEAGVGDEVNCASCYGWSVGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6600 - protein, 133 aa, Gossypium raimondii
MSTTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVELMHSSQNFLLE

SEQ ID NO: 6601 - protein, 116 aa, Allium cepa
MVGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIWDCW

SEQ ID NO: 6602 - protein, 116 aa, Platanus occidentalis
MSTFSGDETAPFFGFLGAAAALVFSCMGAAYGTAKSGVGVASMGVMRPELVMKSIVPVVMAGVLGIYGLIIAVIISTGINPKAKSYYLFVWLCAPFFWSCLWSGWSLCWNGHWDCW

SEQ ID NO: 6603 - protein, 164 aa, Brassica juncea
MSTFSGDETAPFFGFLGAAAALVFSCMGAAYGTAKSGVGVVSMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6604 - protein, 164 aa, Brassica juncea
MSTFSGDETAPSFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6605 - protein, 163 aa, Vaccinium corymbosum
MSSAGFSGDETAPFFGFLGAAAALVFSCMGAAYGTAKSGVGVASMGVMRPELVMKSIVPVVMAGVLGIYGLIIAVIISTGINPKAKSYYGYAHLSSGLACGLAGLSAGMAIGIVGDAGVRANAQQPKLFVGMILILIFAEALALYGLIVGIILSSRAGQSRAD

SEQ ID NO: 6606 - protein, 167 aa, Unknown
  Sequence found in Organisms: Arnica chamissonis, Lactuca sativa
MSSGSAFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6607 - protein, 164 aa, Unknown
  Sequence found in Organisms: Solanum melongena, Ipomoea nil, Capsicum annuum, Petunia hybrida
MSTFSGDETAPFFGFLGAAAALVFSCMGAAYGTAKSGVGVASMGVMRPELVMKSIVPVVMAGVLGIYGLIIAVIISTGINPKTKSYYLFDGYAHLSSGLACGLAGLSAGMAIGIVGDAGVRANAQQPKLFVGMILILIFAEALALYGLIVGIILSSRAGQSRAE

SEQ ID NO: 6608 - protein, 166 aa, Capsicum annuum
MGSSRFSGDETAPFFGFLGAAAALVFSCMGAAYGTAKSGVGVASMGVMRPELVMKSIVPVVMAGVLGIYGLIIAVIISTGINPKTKSYYLFDGYAHLSSGLACGLAGLSAGMAIGIVGDAGVRANAQQPKLFVGMILILIFAEALALYGLIVGIILSSRAGQSRAE

SEQ ID NO: 6609 - protein, 164 aa, Unknown
  Sequence found in Organisms: Acacia harpophylla, Cicer arietinum, Trifolium pratense, Glycyrrhiza uralensis, Lotus japonicus, Medicago truncatula, Arachis hypogaea, Trigonella foenum-graecum
MAPFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6610 - protein, 164 aa, Amborella trichopoda
MVAFSGDETAPFFGFLGAAAALVFSCMGAAYGTAKSGVGVASMGVMRPELVMKSIVPVVMAGVLGIYGLIIAVIISTGINPKAKPYYLFDGYAHLSSGLACGLAGLSAGMAIGVVGDAGVRANAQQPKLFVGMILILIFAEALALYGLIVGIILSSRAGQSRAE

SEQ ID NO: 6611 - protein, 166 aa, Malus domestica
MAPSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRSGQSRAD

SEQ ID NO: 6612 - protein, 165 aa, Aristolochia fimbriata
MSTPFAGDVVGPFFGFLGAAAALVFSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSSRAGQSRAE

SEQ ID NO: 6613 - protein, 167 aa, Arnica chamissonis
MSSASAFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6614 - protein, 164 aa, Brassica rapa
MSTFSGDETAPFFGFLGAAAALVFSCMGAAYGTAKSGVGVASMGVMRPELVMKSIVPVVMAGVLGIYGLIIAVIIRTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6615 - protein, 165 aa, Brassica rapa
MASGFSGDETAPFFGFLGAAAALVFSCMGAAYGTAKSGVGVASMGVMRPELVMKSIVPVVMAGVLGIYGLIIAVIISTGVNPKAKSYYLFDGYAHLSSGLAWGLAGLSAGMAIGIVGDAGVRANAQQPKLFVGMILILIFAEALALYGLIVGIILSSRAGQSRAE

SEQ ID NO: 6616 - protein, 164 aa, Brassica napus
MSTFSGDEAAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6617 - protein, 164 aa, Brassica napus
MSTFSGDETAPFFGFLGAAAALVFSCMGAAYGTAKSGVGVDSMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6618 - protein, 165 aa, Ricinus communis
MAPAFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGVVGDAGVRANAQQPKLFVGMILILIFAEALALYGLIVGIILSSRAGQSRAE

SEQ ID NO: 6619 - protein, 166 aa, Cedrus atlantica
MVAVTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLSGLAAGMAIGIVGDAGVRANAQQPKLFVGMILILIFAEALALYGLIVGIILSSRAGQSRAD

SEQ ID NO: 6620 - protein, 167 aa, Centaurea maculosa
MGSGSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6621 - protein, 165 aa, Cephalotaxus harringtonia
MAEAFSGDETAPFFGFLGAAAALVFSCMGAAYGTAKSGVGVASMGVMRPELVMKSIVPVVMAGVLGIYGLIIAVIISTGINPKAKSYYLFDGYAHFSSGLACGLSGLSAGMAIGIVGDAGVRANAQQPKLFVGMILILIFAEALALYGLIVGIILSSRAGQSRAD

SEQ ID NO: 6622 - protein, 167 aa, Unknown
  Sequence found in Organisms: Cirsium arvense, Cynara scolymus, Senecio madagascariensis
MSSGSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6623 - protein, 166 aa, Cirsium arvense
MADSGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSNAD

SEQ ID NO: 6624 - protein, 165 aa, Cryptomeria japonica
MGDLFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLSGLSAGMAIGIVGDAGVRANAQQPKLFVGMILILIFAEALALYGLIVGIILSSRAGQSRAE

SEQ ID NO: 6625 - protein, 165 aa, Cryptomeria japonica
MAVGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLSGLSAGMAIGIVGDAGVRANAQQPKLFVGMILILIFAEALALYGLIVGIILSSRAGQSRAE

SEQ ID NO: 6626 - protein, 160 aa, Curcuma longa
MSSFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQ

SEQ ID NO: 6627 - protein, 167 aa, Taraxacum officinale
MSTGSGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6628 - protein, 166 aa, Distylium racemosum
MAVDGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLSGLSAGMAIGIVGDAGVRANAQQPKLFVGMILILIFAEALALYGLIVGIILSSRAGQSRAD

SEQ ID NO: 6629 - protein, 164 aa, Unknown
  Sequence found in Organisms: Solanum lycopersicum, Solanum melongena, Solanum tuberosum, Solanum phureja
MSNFAGDETAPFFGFLGAAAALVFSCMGAAYGTAKSGVGVASMGVMRPELVMKSIVPVVMAGVLGIYGLIIAVIISTGINPKTKSYYLFDGYAHLSSGLACGLAGLSAGMAIGIVGDAGVRANAQQPKLFVGMILILIFAEALALYGLIVGIILSSRAGQSRAE

SEQ ID NO: 6630 - protein, 166 aa, Euphorbia peplus
MSSSGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLSCGLAGLSAGMAIGIVGDAGVRANAQQPKLFVGMILILIFAEALALYGLIVGIILSSRAGQSRAE

SEQ ID NO: 6631 - protein, 167 aa, Gerbera hybrid cultivar
MPSGSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6632 - protein, 167 aa, Gerbera hybrid cultivar
MASGSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6633 - protein, 164 aa, Vitis vinifera
MTTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6634 - protein, 167 aa, Marchantia polymorpha
MSTDVGFSGDETAPFFGFIGAAAALVFSCMGAAYGTAKSGVGVASMGVMRPELVMKSIVPVVMAGVLGIYGLIIAVIISTGINPKAKPYYLFDGYAHLSSGLACGLAGLSAGMAIGIVGDAGVRANAQQPKLFVGMILILIFAEALALYGLIVGIILSSRAGQSRGE

SEQ ID NO: 6635 - protein, 165 aa, Pinus pinaster
MADPFSGDELAPFFGFLGAAAALVFSCMGAAYGTAKSGVGVASMGVMRPELVMKSIVPVVMAGVLGIYGLIIAVIISTGINPKAKSYYLFDGYAHLSSGLACGLSGLSAGMAIGIVGDAGVRANAQQPKLFVGMILILIFAEALALYGLIVGIILSSRAGQSRAD

SEQ ID NO: 6636 - protein, 164 aa, Tropaeolum majus
MAAFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6637 - protein, 165 aa, Nicotiana benthamiana
MASTFSGDETAPFFGFLGAAAALVFSCMGAAYGTAKSGVGVASMGVMRPELVMKSIVPVVMAGVLGIYGLIIAVIISTGINPKTKSYYLFDGYAHLSSGIACGLAGLSAGMAIGIVGDAGVRANAQQPKLFVGMILILIFAEALALYGLIVGIILSSRAGQSRAE

SEQ ID NO: 6638 - protein, 167 aa, Quercus alba
MSSSSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLSCGLAGLSAGMAIGIVGDAGVRANAQQPKLFVGMILILIFAEALALYGLIVGIILSSRAGQSRAD

SEQ ID NO: 6639 - protein, 167 aa, Unknown
  Sequence found in Organisms: Parthenium argentatum, Helianthus annuus, Tragopogon dubius
MSSGSGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6640 - protein, 163 aa, Petunia hybrida
STFSGDETAPFFGFLGAAAALVFSCMGAAYGTAKSGVGVASMGVMRPELVMKSIVPVVMAGVLGIYGLIIAVIISTGINPKTKSYYLFDGYAHLSSGLACGLAGLSAGMAIGIVGDAGVRANAQQPKLFVGMILILIFAEALALYGLIVGIILSSRAGQSRAE

SEQ ID NO: 6641 - protein, 164 aa, Primula obconica
MTAFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6642 - protein, 166 aa, Carthamus tinctorius
MADSGFSGDETAPFFGFLGAAAALVFSCMGAAYGTAKSGVGVASMGVIRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6643 - protein, 165 aa, Sciadopitys verticillata
MKETFSGDEVAPFFGFLGAAAALVFSCMGAAYGTAKSGVGVASMGVMRPELVMKSIVPVVMAGVLGIYGLIIAVIISTGINPKAKSYYLFDGYAHLSSGLACGLSGLSAGMAIGIVGDAGVRANAQQPKLFVGMILILIFAEALALYGLIVGIILSSRAGQSRAD

SEQ ID NO: 6644 - protein, 165 aa, Sciadopitys verticillata
MTEGFSGDEVAPFFGFLGAAAALVFSCMGAAYGTAKSGVGVASMGVMRPELVMKSIVPVVMAGVLGIYGLIIAVIISTGINPKAKSYYLFDGYAHLSSGLACGLSGLSAGMAIGIVGDAGVRANAQQPKLFVGMILILIFAEALALYGLIVGIILSSRAGQSRAD

SEQ ID NO: 6645 - protein, 165 aa, Sequoia sempervirens
MAVDFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLSGLSAGMAIGIVGDAGVRANAQQPKLFVGMILILIFAEALALYGLIVGIILSSRAGQSRAE

SEQ ID NO: 6646 - protein, 165 aa, Sequoia sempervirens
MAGGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLSGLSAGMAIGIVGDAGVRANAQQPKLFVGMILILIFAEALALYGLIVGIILSSRAGQSRAE

SEQ ID NO: 6647 - protein, 165 aa, Silene vulgaris
MSTVFNGDETAPFFGFLGAAAALIFSCMGAAYGTAKSGVGVASMGVMRPELVMKSIVPVVMAGVLGIYGLIIAVIISTGINPKAKSYYLFDGYAHLSSGIACGLSGLAAGMAIGVVGDAGVRANAQQPKLFVGMILILIFAEALALYGLIVGIILSSRAGQSRAD

SEQ ID NO: 6648 - protein, 166 aa, Helianthus annuus
MADSTFSGDETAPFFGFLGAAFALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6649 - protein, 165 aa, Nicotiana tabacum
MASTFSGDETAPFFGFLGAAAALVFSCMGAAYGTAKSGLGVASMGVMRPELVMKSIVPVVMAGVLGIYGLIIAVIISTGINPKTKSYYLFDGYAHLSSGLACGLAGLSAGMAIGIVGDAGVRANAQQPKLFVGMILILIFAEALALYGLIVGIILSSRAGQSRAE

SEQ ID NO: 6650 - protein, 164 aa, Trigonella foenum-graecum
MAGFSGDETAPFFGFLGAAAALIFSCMGAAYGTAKSGVGVASMGVMRPELVMKSIVPVVMAGVLGIYGLIIAVIISTGINPKAKPYYLFDGYAHLSSGLACGLAGLSAGMAIGVVGDAGVRANAQQPKLFVGMILILIFAEALALYGLIVGIILSSRAGQSRAE

SEQ ID NO: 6651 - protein, 161 aa, Vinca minor
FSGDETAPFFGFLGAAAALVFSCMGAAYGTAKSGVGVASMGVMRPELVMKSIVPVVMAGVLGIYGLIIAVIISTGINPKTKAYYLFDGYAHLSSGLACGLAGLSAGMAIGIVGDAGVRANAQQPKLFVGMILILIFAEALALYGLIVGIILSSRAGQSRAD

SEQ ID NO: 6652 - protein, 127 aa, Zostera marina
MKQLPSSASSEPHRLSFSHAVGQHMERRKVGLEWHRVGVMRPELVMKSIVPVVMAGVLGIYGLIIAVIISTGINPKAKSYYLFDGYAHLSSRSSLVALPVFLPEWPSESSEMRESGLMHSSQNSLLV

SEQ ID NO: 6653 - protein, 76 aa, Cirsium arvense
FSGDETAPFFGFLGAAAALVFSCSGGGVWDGEERCWSGVDGSDEAGVGDEVDCAGGYGWSVRYLRIDYCGYYQYRY

SEQ ID NO: 6654 - protein, 69 aa, Gossypium raimondii
MSSTFSGDETAPFFGFLGAAAALVFSCMGAAYGTAKSGVGVASMGVMRPELVMKSIVPVVTAGVWVFMA

SEQ ID NO: 6655 - protein, 116 aa, Tropaeolum majus
MASAFSGDETAPFFGFLGAAAALVFSCMGAAYGTAKSGVGVASMGVMRPELVMKSIVPVVMAGVLGIYGLIIAVISVLVLTLGEIVLPLRWIRSLVIRSGLRARWSIGGYGNWHCW

SEQ ID NO: 6656 - protein, 132 aa, Phalaenopsis aphrodite
MAGFSGDETAPFFGFLGAAAALVFSCMGAAYGTAKSGVGVASMGVMRPELVMKSIVPVVMAGVLGIYGLIIAVIISTGITPRRSLTTSLMAMRICHLVWHAASLVFLPVWLSGSWVMPGLEPMHSSRSCSWG

SEQ ID NO: 6657 - protein, 130 aa, Lippia dulcis
TFSGDETAPFFGFLGAAAALVFSCMGAAYGTAKSGVGVASMGVMRPELVMKSIVPVVMAGVLGIYGLIIAVIISTGINPKAKSYYLSMAMHISLRAWPVALLGLLLEWLLGLWVMLVLGRMRNSLSFLSV

SEQ ID NO: 6658 - protein, 92 aa, Primula obconica
VLLLDEYIILVIYISLSLIGSVCNTNSKSNSKSNSNTNSSEREKMSSFSGDETAPFFGFLGAAAALVFSCMGAAYGTDKKWRRGGVNGCDEA

SEQ ID NO: 6659 - protein, 71 aa, Thalictrum flavum
SGDETAPFFGFLGAAAALVFSCMGAAYGTAKSGVGVASMGVMRPELVMKSIVPVVMAGVFGYLWIDYCCYY

SEQ ID NO: 6660 - protein, 167 aa, Unknown
  Sequence found in Organisms: Castanea mollissima, Quercus alba
MSSGSSFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLSCGLAGLSAGMAIGIVGDAGVRANAQQPKLFVGMILILIFAEALALYGLIVGIILSSRAGQSRAD

SEQ ID NO: 6661 - protein, 168 aa, Cirsium arvense
MASGGSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6662 - protein, 167 aa, Euphorbia peplus
MSSSSGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLSCGLAGLSAGMAIGIVGDAGVRANAQQPKLFVGMILILIFAEALALYGLIVGIILSSRAGQSRAE

SEQ ID NO: 6663 - protein, 167 aa, Gerbera hybrid cultivar
MSSGSTFSGDETAPFFGFLGAAAALVFSCMGAAYGTAKSGVGVASMGVMRPELVMKSIVPLVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6664 - protein, 167 aa, Guizotia abyssinica
MSSGSGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSHAGQSRAD

SEQ ID NO: 6665 - protein, 166 aa, Eragrostis curvula
  misc_feature (3)..(5): Xaa can be any naturally occurring amino acid
  misc_feature (44)..(44): Xaa can be any naturally occurring amino acid
  misc_feature (66)..(66): Xaa can be any naturally occurring amino acid
  misc_feature (91)..(91): Xaa can be any naturally occurring amino acid
MAXXXFSGDETAPFFGFLGAAAALVFSCMGAAYGTAKSGVGVAXMGVMRPELVMKSIVPVVMAGVXGIYGLIIAVIISTGINPKAKPYYLXDGYAHLSSGLACGLAGLAAGMAIGIVGDAGVRANAQQPKLFVGMILILIFAEALALYGLIVGIILSSRAGQSRAD

SEQ ID NO: 6666 - protein, 167 aa, Marchantia polymorpha
MSTDVGFSGDETAPFFGFIGASAALVFSCMGAAYGTAKSGVGVASMGVMRPELVMKSIVPVVMAGVLGIYGLIIAVIISTGINPKAKPYYLFDGYAHLSSGLACGLAGLSAGMAIGIVGDAGVRANAQQPKLFVGMILILIFAEALALYGLIVGIILSSRAGQSRGE

SEQ ID NO: 6667 - protein, 168 aa, Quercus alba
MSSSSSEFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLSCGLAGLSAGMAIGIVGDAGVRANAQQPKLFVGMILILIFAEALALYGLIVGIILSSRAGQSRAD

SEQ ID NO: 6668 - protein, 166 aa, Silene vulgaris
MSSSVFNGDETAPFFGFLGAAAALIFSCMGAAYGTAKSGVGVASMGVMRPELVMKSIVPVVMAGVLGIYGLIIAVIISTGINPKAKSYYLFDGYAHLSSGIACGLSGLAAGMAIGVVGDAGVRANAQQPKLFVGMILILIFAEALALYGLIVGIILSSRAGQSRAD

SEQ ID NO: 6669 - protein, 121 aa, Musa acuminata
MSTFSGDETAPFFGFLGAAAALVFSGMGAAYGTAKSGVGVASMGVMRPELVMKSIVPVVMAGVLGIYGLIIAVIISTGINPKAKSYYLFDGYAHLSSGLACGLAGLSAGMAIGIVGDAGVR

SEQ ID NO: 6670 - protein, 131 aa, Arabidopsis lyrata
MASGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLSLLVWLLESSVMLVLERMRNNRSCLWE

SEQ ID NO: 6671 - protein, 67 aa, Fraxinus spp
MSSIFNGDETAPFFGFLSAASALVLSCMGAAYGTAKSGVGVASMGVMRPELVMKSIVPVVMAGVLGI

SEQ ID NO: 6672 - protein, 159 aa, Antirrhinum majus
MSSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLAAGMAIGIVGDAGVRANAQQPKLFVGMILILIFAEALALYGLIVGIILSSRA

SEQ ID NO: 6673 - protein, 159 aa, Cirsium arvense
GDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6674 - protein, 165 aa, Euonymus alatus
MSSNFSGDETAPFFGFIGAAAALVFSCMGAAYGTAKSGVGVASMGVMRPELVMKSIVPVVMAGVLGIYGLIIAVIITTGINPTANSYYLFDGYAHLSSGLACGLAGLSAGMAIGIVGDAGVRANAQQPKLFVGMILILIFAEALALYGLIVGIILSSRAGQSRAE

SEQ ID NO: 6675 - protein, 164 aa, Fagopyrum esculentum
MATFNGDETAPFFGFLGAAAALVFSCMGAAYGTAKSGVGVASMGVMRPELVMKSIVPVVMAGVLGIYGLIIAVIISTGINPKAKGYYLFDGYAHLSSGLACGLAGLSAGMAIGIVGDAGVRANAQQPKLFVGMILILIFAEALALYGLIVGIILSSRAGQSRAE

SEQ ID NO: 6676 - protein, 163 aa, Fagopyrum esculentum
MTFNGDETAPFFGFLGAAAALVFSCMGAAYGTAKSGVGVASMGVMRPELVMKSIVPVVMAGVLGIYGLIIAVIISTGINPKAKGYYLFDGYAHLSSGLACGLAGLSAGMAIGIVGDAGVRANAQQPKLFVGMILILIFAEALALYGLIVGIILSSRAGQSRAE

SEQ ID NO: 6677 - protein, 164 aa, Fagopyrum esculentum
MAHFNGDETAPFFGFLGAAAALVFSCMGAAYGTAKSGVGVASMGVMRPELVMKSIVPVVMAGVLGIYGLIIAVIISTGINPKAKGYYLFDGYAHLSSGLACGLAGLSAGMAIGIVGDAGVRANAQQPKLFVGMILILIFAEALALYGLIVGIILSSRAGQSRAE

SEQ ID NO: 6678 - protein, 164 aa, Fagopyrum esculentum
MTTFNGDETAPFFGFLGAAAALVFSCMGAAYGTAKSGVGVASMGVMRPELVMKSIVPVVMAGVLGIYGLIIAVIISTGINPKAKGYYLFDGYAHLSSGLACGLAGLSAGMAIGIVGDAGVRANAQQPKLFVGMILILIFAEALALYGLIVGIILSSRAGQSRAE

SEQ ID NO: 6679 - protein, 164 aa, Medicago truncatula
MAGFSGDETAPFFGFLGAAAALIFSCMGAAYGTAKSGVGVASMGVMRPELVMKSIVPVVMAGVLGIYGLIIAVIISTGINPKAKSYYLFDGYAHLSSGLACGLAGLSAGMAIGVVGDAGVRANAQQPKLFVGMILILIFAEALALYGLIVGIILSSRAGQSRAE

SEQ ID NO: 6680 - protein, 164 aa, Unknown
  Sequence found in Organisms: Nicotiana benthamiana, Nicotiana tabacum
MSTFAGDETAPFFGFLGAAAALVFSCMGAAYGTAKSGVGVASMGVMRPELVMKSIVPVVMAGVLGIYGLIIAVIISTGINPKTKSYYLFDGYAHLSSGLACGLAGLSAGMAIGIVGDAGVRANAQQPKLFVGMILILIFAEALALYGLIVGIILSSRAGQSRAE

SEQ ID NO: 6681 - protein, 165 aa, Pinus taeda
MADPFSGDELAPLFGFLGAAAALVFSCMGAAYGTAKSGVGVASMGVMRPELVMKSIVPVVMAGVLGIYGLIIAVIISTGINPKAKSYYLFDGYAHLSSGLACGLSGLSAGMAIGIVGDAGVRANAQQPKLFVGMILILIFAEALALYGLIVGIILSSRAGQSRAD

SEQ ID NO: 6682 - protein, 165 aa, Podocarpus macrophillus
MGVDFSGDEIAPFFGFLGAAAALVFSCMGAAYGTAKSGVGVASMGVMRPELVMKSIVPVVMAGVLGIYGLIIAVIISTGINPKTKSYYLFDGYAHLSSGLACGLSGLSAGMAIGIVGDAGVRANAQQPKLFVGMILILIFAEALALYGLIVGIILSSRAGQSRAD

SEQ ID NO: 6683 - protein, 156 aa, Secale cereale
TAPFFGFLGAAAALVFSCMGAAYGTAKSGVGVASMGVMRPELVMKSIVPVVMAGVLGIYGLIIAVIISTGINPKAKPYFLFDGYAHLSSGLACGLAGLAAGMAIGIVGDAGVRANAQQPKLFVGMILILIFAEALALYGLIVGIILSSRAGQSRAD

SEQ ID NO: 6684 - protein, 165 aa, Silene vulgaris
MSTLFNGDEIAPFFGFLGAAAALVFSCMGAAYGTAKSGVGVASMGVMRPELVVKSIVPVVMAGVLGIYGLIIAVIISTGINPKAKSYYLFDGYAHLSSGLACGLSGLAAGMAIGVVGDAGVRANAQQPKLFVGMILILIFAEALALYGLIVGIILSSRAGQSRAD

SEQ ID NO: 6685 - protein, 164 aa, Nicotiana tabacum
MSTFSGDETAPFFGFLGAAAALVFSCMGAAYGTAKSGVGVASMGVMRPELVMKSIVPVVMAGVLGIYGLIIAVIICTGINPKTKSYYLFDGYAHLSSGLACGLAGLSAGMAIGIVGDAGVRANAQQPKLFVGMILILIFAEALALYGLIVGIILSSRAGQSRAE

SEQ ID NO: 6686 - protein, 160 aa, Vinca minor
SGDETAPFFGFLGAAAALVFSCMGAAYGTAKSGVGVASMGVMRPELVMKSIVPVVMAGVLGIYGLIIAVIISTGINPKTKAYYLFDGYAHLSSGLACGLAGLSAGMAIGIVGDAGVRANAQQPKLFVGMILILIFAEALALYGLIVGIILSSRAGQSRAD

SEQ ID NO: 6687 - protein, 165 aa, Zamia vazquezii
  misc_feature (14)..(15): Xaa can be any naturally occurring amino acid
MAEAFSGDETAPFXXFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6688 - protein, 170 aa, Vaccinium corymbosum
THESTISSEFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6689 - protein, 167 aa, Antirrhinum majus
  misc_feature (44)..(44): Xaa can be any naturally occurring amino acid
RRDVFTFSGDETAPFFGFLGAAAALVFSCMGAAYGTAKSGVGVXSMGVMRPELVMKSIVPVVMAGVLGIYGLIIAVIISTGINPKAKSYYLFDGYAHLSSGLACGLAGLAAGMAIGIVGDAGVRANAQQPKLFVGMILILIFAEALALYGLIVGIILSSRAGQSRAE

SEQ ID NO: 6690 - protein, 168 aa, Castanea mollissima
MSSSASGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLSCGLAGLSAGMAIGIVGDAGVRANAQQPKLFVGMILILIFAEALALYGLIVGIILSSRAGQSRAD

SEQ ID NO: 6691 - protein, 123 aa, Malus domestica
MAPSTFSGDETAPFFGFLGAAAALVFSGMGAAYGTAKSGVGVASMGVMRPELVMKSIVPVVMAGVLGIYGLIIAVIISTGINPKAKSYYLFDGYAHLSSGLACGLAGLSAGMAIGIVGDAGVR

SEQ ID NO: 6692 - protein, 79 aa, Phaseolus coccineus
MVDFSGDETAPFFGFLGAAAALVFSCMGAAYGTAKSGVGVASMGVMRPELVMKSIVPVVMAGVLGIYGLIIAVAITAGH

SEQ ID NO: 6693 - protein, 132 aa, Fagopyrum esculentum
MPTFNGDETAPFFGFLGAAAALVFSCMGAAYGTAKSGVGVASMGVMRPELVMKSIVPVVMAGVLGIYGLIIAVIISTGINPKAKGYYLFDGYAHLSSGLACGLAGLSAGMAIGIVGDAGVRANAQQPKLLLE

SEQ ID NO: 6694 - protein, 75 aa, Trigonella foenum-graecum
MDSSLASSSLLELASPEQNRVQGSETWVVASWCYSVVSSPIACTVKHFSRSYFESIDEFLEVVYAVCMIEKIGVS

SEQ ID NO: 6695 - protein, 164 aa, Nicotiana benthamiana
MSTFAGDETAPFFGFLGAAAALVFSCMGAAYGTAKSGVGVASMGVMRPELVMKSIVPVVMAGVLGIYGLIIAVIISTGINPKTKSYYLFDGYAHLSSGLACGLAGLSDGMAIGIVGDAGVRANAQQPKLFVGMILILIFAEALALYGLIVGIILSSRAGQSRAE

SEQ ID NO: 6696 - protein, 164 aa, Acacia harpophylla
MAGFSGDETAPFFGFLGAAAALVFSCMGTAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILTLILAEALALYGLIVGIILSSRAGQSRAE

SEQ ID NO: 6697 - protein, 158 aa, Bruguiera gymnorhiza
MSSVFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSR

SEQ ID NO: 6698 - protein, 165 aa, Cedrus atlantica
MADSFSGDDMAPFFGFMGAAAALVFSCMGAAYGTAKSGVGVASMGVMRPELVMKSIVPVVMAGVLGIYGLIIAVIISTGINPKAKSYYLFDGYAHLSSGLACGLSGLSAGMAIGIVGDAGVRANAQQPKLFVGMILILIFAEALALYGLIVGIILSSRAGQSRAD

SEQ ID NO: 6699 - protein, 163 aa, Selaginella moellendorffii
MDAFSGDETAPFFGFIGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRG

SEQ ID NO: 6700 - protein, 164 aa, Juglans hindsii x Juglans regia
MTTFSGGETAPFFGFLGAAAALVFSCMGAAYGAAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIIFSSRAGQSRAD

SEQ ID NO: 6701 - protein, 164 aa, Triticum aestivum
MSSVFSGDETAPFFGFLGAAAALVFSCMGAAYGTAKSGVGVASMGVMRPELVMKSIVPVVMAGVLGIYGLIIAVIISTGINPKAKPYYLFDGYAHLSSGLACVLLGLLQAWHWIVGDAGVRANAQQPKLFVGMILILIFAEALALYGLIVGIILSSRAGQSRAD

SEQ ID NO: 6702 - protein, 166 aa, Ipomoea batatas
MAYTTFSGDETAPFFGFLGAAAALVFSCMGAAYGTAKSGVGVASMGVMRPELVMKSIVPVVMAGVLGIYGLIIAVIISTGINPKTKSYYLFDGYAHLSSGLACGLAGLSAGMAIGIVGDASVRANAQQPKLFVRMILILIFAEALALYGLIVGIILSSRAGQSRAE

SEQ ID NO: 6703 - protein, 154 aa, Festuca arundinacea
PFFGFLGAAAALVFSCMGAAYGTAKSGVGVASMGVMRPELVMKSIVPVVMAGVLGIYGLIIAVIISTGINPKAKPYFLFDGYAHLSSGLACGLAGLAAGMAIGIVGDAGVRANAQQPKLFVGMILILIFAEALALYGLIVGIILSSRAGQSRAD

SEQ ID NO: 6704 - protein, 165 aa, Picea glauca
MADAFSGDEMAPFFGFMGAAAALVFSCMGAAYGTAKSGVGVASMGVMKPELVMKSIVPVVMAGVLGIYGLIIAVIISTGINPKAKSYYLFDGYAHLSSGLACGLSGLSAGMAIGVVGDAGVRANAQQPKLFVGMILILIFAEALALYGLIVGIILSSRAGQSRAD

SEQ ID NO: 6705 - protein, 143 aa, Phalaenopsis aphrodite
MAGFSGDETAPFFGFLGAAAALVFSCMGAAYGTAKSGVGVASMGVMRPELVMKSIVPVVMAGVLGIYGLIIAVIISTGINPRRSLTTSLMAMRICHLVWHAASLVFLPVWLSGSWVMPGLDNLQSQCTAAEAVRGDDTDTDIC

SEQ ID NO: 6706 - protein, 166 aa, Abies balsamea
MAADTFSGDEMAPFFGFMGAAAALVFSCMGAAYGTAKSGVGVASMGVMRPELVMKSIVPVVMAGVLGIYGLIIAVIISTGINPKAKSYYLFDGYAHLSSGLACGLSGLSAGMAIGIVGDAGVRANAQQPKLFVGMILILIFAEALALYGLIVGIILASRAGQSRAD

SEQ ID NO: 6707 - protein, 167 aa, Ceratodon purpureus
MSTSAVFNGDEIAPFFGFIGAAAALVFSCMGAAYGTAKSGVGVASMGVMRPELVMKSIVPVVMAGVLGIYGLIIAVIISTGINPKSKPYYVFDGYAHLSSGLSCGLAGLSAGMAIGIVGDAGVRANAQQPKLFVGMILILIFAEALALYGLIVGIILSSRAGQSRAD

SEQ ID NO: 6708 - protein, 167 aa, Physcomitrella patens
MSTSAVFNGDEVAPFFGFIGAAAALVFSCMGAAYGTAKSGVGVASMGVMRPELVMKSIVPVVMAGVLGIYGLIIAVIISTGINPKSKPYYVFDGYAHLSSGLSCGLAGLSAGMAIGIVGDAGVRANAQQPKLFVGMILILIFAEALALYGLIVGIILSSRAGQSRAD

SEQ ID NO: 6709 - protein, 165 aa, Pteridium aquilinum
MSTTEFNGDTTAPFFGFLGAAAALVFSCMGAAYGTAKSGVGVASMGVMRPELVMKSIVPVVMAGVLGIYGLIIAVIISTGINPKSTAYYLFDGYAHLSSGLACGLAGLSAGMAIGIVGDAGVRANAQQPKLFVGMILILIFAEALALYGLIVGIILSSRAGQSRE

SEQ ID NO: 6710 - protein, 166 aa, Selaginella moellendorffii
MASTDAFSGDETAPFFGFIGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRG

SEQ ID NO: 6711 - protein, 72 aa, Secale cereale
RPLLRLSRRRRGARLLMHGAAYGTAKSGVGVASMGVMRPELVMKSIVPVVMAGVLGIYGLIIAVIISTGINP

SEQ ID NO: 6712 - protein, 161 aa, Ocimum basilicum
SVAMRQLPFFGFFGAAAALVFSCMGAAYGTAKSGVGVASMGVMRPELVMKSIVPVVMAGVLGIYGLIIAVIISTGINPKAKSYYLFDGYAHLSSGLACGLAGLAAGMAIGIVGDAGVRANAQQPKLFVGMILILIFAEALALYGLIVGIILSSRAGQSRAD

SEQ ID NO: 6713 - protein, 157 aa, Hevea brasiliensis
MSSGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSS

SEQ ID NO: 6714 - protein, 162 aa, Juglans hindsii x Juglans regia
MSHGDETAPFFGFLGAAAALVFSCMGAAYGTAKSGVGVASMGVMRPELVMKSIVPVVMAGVLGIYGLIIAVIISTGINPKAKPYYLFDGYAHFSSGLSCGLAGLSAGMAIGVVGDAGVRANAQQPKLFVGMILILIFAEALALYGLIVGIILSSRAGQSRAE

SEQ ID NO: 6715 - protein, 167 aa, Ceratodon purpureus
MSTAAVFNGDEVAPFFGFIGAAAALVFSCMGAAYGTAKSGVGVASMGVMRPELVMKSIVPVVMAGVLGIYGLIIAVIISTGINPKSKPYYVFDGYAHLSSGLSCGLAGLSAGMAIGIVGDAGVRANAQQPKLFVGMILILIFAEALALYGLIVGIILSSRAGQSRAD

SEQ ID NO: 6716 - protein, 167 aa, Ceratodon purpureus
MSTAAVFNGDEIAPFFGFIGAAAALVFSCMGAAYGTAKSGVGVASMGVMRPELVMKSIVPVVMAGVLGIYGLIIAVIISTGINPKSKPYYVFDGYAHLSSGLSCGLAGLSAGMAIGIVGDAGVRANAQQPKLFVGMILILIFAEALALYGLIVGIILSSRAGQSRAD

SEQ ID NO: 6717 - protein, 164 aa, Adiantum capillus-veneris
MSTTEFNGDTTAPFFGFLGAAAALVFSCMGAAYGTAKSGVGVASMGVMRPELVMKSIVPVVMAGVLGIYGLIIAVIISTGINPTSTAYYLFDGYAHLSSGLACGLAGLSAGMAIGIVGDAGVRANAQQPKLFVGMILILIFAEALALYGLIVGIILSSRAGQSR

SEQ ID NO: 6718 - protein, 157 aa, Nicotiana benthamiana
  misc_feature (66)..(66): Xaa can be any naturally occurring amino acid
  misc_feature (108)..(108): Xaa can be any naturally occurring amino acid
MKRRPSSVSSEQLQLSFSPVCSAYGTANSGVGVASMGVMRPELVMKSIVPVVMAGVLGIYGLIIAXIISTGINPKTKSYYLFDGYAHLSSGLACGLAGLSAGMAIGIXGDAGVRANAQQPKLFVGMILILIFAEALALYGLIVGIILSSRAGQFRAE

SEQ ID NO: 6719 - protein, 157 aa, Brassica juncea
MSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSR

SEQ ID NO: 6720 - protein, 157 aa, Brassica juncea
ETAPFFGFLGAAAALVFSCMGAAYGTAKSGVGVASMGVMRPELVMRSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6721 - protein, 166 aa, Zostera marina
MSTTTFAGDETAPFFGFIGAASALIFSCMGAAYGTAKSGVGVASMGVMRPELVMKSIVPVVMAGVLGIYGLIIAVIISTGISPKTKSYYLFDGYAHLSSGLACGLAGLSAGMAIGIVGDAGVRANAQQPKLFVGMILILIFAEALALYGLIVGIILSSRAGQSREV

SEQ ID NO: 6722 - protein, 167 aa, Physcomitrella patens
MSTAAVFNGDEVAPFFGFIGAAAALVFSCMGAAYGTAKSGVGVASMGVMRPELVMKSIVPVVMAGVLGIYGLIIAVIISTGINPKSKAYYVFDGYAHLSSGLSCGLAGLSAGMAIGIVGDAGVRANAQQPKLFVGMILILIFAEALALYGLIVGIILSSRAGQSRAD

SEQ ID NO: 6723 - protein, 167 aa, Physcomitrella patens
MSTAAAFNGDEVAPFFGFIGAAAALVFSCMGAAYGTAKSGVGVASMGVMRPELVMKSIVPVVMAGVLGIYGLIIAVIISTGINPKSKPYYVFDGYAHLSSGLSCGLAGLSAGMAIGIVGDAGVRANAQQPKLFVGMILILIFAEALALYGLIVGIILSSRAGQSRAD

SEQ ID NO: 6724 - protein, 165 aa, Pteridium aquilinum
MTTTEFNGDTTAPFFGFLGAAAALVFSCMGAAYGTAKSGVGVASMGVMRPELVMKSIVPVVMAGVLGIYGLIIAVIISTGINPKSTAYYLFDGYAHLSSGLACGLAGLSAGMAIGIVGDAGVRANAQQPKLFVGMILILIFAEALALYGLIVGIILSSRAGQSRE

SEQ ID NO: 6725 - protein, 158 aa, Flaveria ramosissima
MKPLPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6726 - protein, 155 aa, Papaver somniferum
MSSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIIL

SEQ ID NO: 6727 - protein, 427 aa, Zostera marina
KIYKPVVDTDLGPNSNEIYITAKVKAPRIAGFILKICVWFLELKIIGDILVYIQIKNNLIHKFVSFAKIKEPPLFAPNHAWEDPKDQHIISVNPDLSAVERIREATKCLLDPSIEKKYLNCSYIFHRWTIMDFSRAYNSGETSPLMVAKKFVSSLQDSSKPHLQMSFFIEYNIEDILEQARESTHRYQNGRPISVLDGVLIAVKDEIDCLPYSTTGGTKWLQRFRTCKKDAACIKNLRLCGAILVGKTNMHELGIGTSGINPHYGVTRNPYDPEKIAGGSSSGSAAVVSAGLCPVALGVDGGGSVRIPASLCGVVGLKPTNGRFSHDGIIPLNWTVGNVGVLAGTVEDAFIVYAALSDHLLSSCSTKVQAILNLPLLKSTNLVSDIKLAKYDKWFNHCADDIQICCDKALSILCKKHGWKKFQGNRL

SEQ ID NO: 6728 - protein, 157 aa, Epimedium sagittatum
MATSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILS

SEQ ID NO: 6729 - protein, 75 aa, Zostera marina
MSTTFSGDETAPFFGFLGAASALRFLMQWGSIWNGRKWVGVASMGVMRPELVMKSIVPVVMAGVLGIYGVSLHYY

SEQ ID NO: 6730 - protein, 150 aa, Utricularia gibba
FLGAAAALVFSCMGAAYGTAKSGVGVASMGVMRPELVMKSIVPVVMAGVLGIYGLIIAVIISTGINPKAKSYYLFDGYAHLSSGLACGLAGLAAGMAIGIVGDAGVRANAQQPKLFVGMILILIFAEALALYGLIVGIILSSRAGQSRAD

SEQ ID NO: 6731 - protein, 165 aa, Adiantum capillus-veneris
MTTTDFNGDTTAPLFGFLGAAAALVFSCMGAAYGTAKSDVDVTSMGVMRPELVMKSIVPVVMAGVLGIYGLIIAVIISTGINPTSTAYYLFDGYAHLSSGLACGLAGLSAGMAIGIVGDAGVRANAQQPKLFVGMILILIFAEALALYGLIVGIILSSRAGQSRE

SEQ ID NO: 6732 - protein, 167 aa, Carthamus tinctorius
  misc_feature (13)..(15): Xaa can be any naturally occurring amino acid
  misc_feature (18)..(18): Xaa can be any naturally occurring amino acid
  misc_feature (23)..(23): Xaa can be any naturally occurring amino acid
  misc_feature (37)..(37): Xaa can be any naturally occurring amino acid
  misc_feature (47)..(47): Xaa can be any naturally occurring amino acid
  misc_feature (50)..(50): Xaa can be any naturally occurring amino acid
  misc_feature (124)..(124): Xaa can be any naturally occurring amino acid
  misc_feature (150)..(150): Xaa can be any naturally occurring amino acid
MSSGSTFSGDETXXXFGXLGAAXALVFSCMGAAYGTXKSGVGVASMXVMXPELVMKSIVPVVMAGVLGIYGLIIAVIISTGINPKAKSYYLFDGYAHLSSGLACGLAGLSAGMAIGIVGDAGVXANAQQPKLFVGMILILIFAEALALYXLIVGIILSSRAGQSRAD

SEQ ID NO: 6733 - protein, 121 aa, Pteridium aquilinum
MGVMKPELVMKSIVPVVMAGVLGIYGLIIAVIISTGINPESTAYYLFDGYAHLASGLSCGLAGLAAGLAIGIVGDAGVRANAQQPKLFVGMILILIFAEALALYGLIVGIILSSRAGQSRE

SEQ ID NO: 6734 - protein, 170 aa, Camellia sinensis
MSSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLLVGMILILIFAEALALYGLIVASYVFSSWSIQSRLRRWFS

SEQ ID NO: 6735 - protein, 149 aa, Amaranthus tuberculatus
LGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6736 - protein, 150 aa, Brassica juncea
FLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6737 - protein, 163 aa, Mesostigma viride
MTGQYGDETAPFFGFLGAASALVFSCMGAAYGTAKSGVGIASMGVMRPELVMKSIIPVVMAGVLGIYGLIIAVIITTGIAPGKTPYYLFDGYAHLSSGLACGLAGLSAGMAIGIVGDAGVRANAQQPKLFVGMILILIFAEALALYGLIVGIILSSRAGTSHG

SEQ ID NO: 6738 - protein, 146 aa, Secale cereale
AAALVFSCMGAAYGTAKSGVGVASMGVMRPELVMKSIVPVVMAGVLGIYGLIIAVIISTGINPKAKPYFLFDGYAHLSSGLACGLAGLAAGMAIGIVGDAGVRANAQQPKLFVGMILILIFAEALALYGLIVGIILSSRAGQSRAD

SEQ ID NO: 6739 - protein, 179 aa, Zinnia violacea
MSSTFSGDETAPFFGFLGAAAALVFSCMGAVYGTAKSGVGVASMGVMRPELVMKSIVPVVMAGVLGIYGLIIAVIISTGINPKAKSYYLFDGYAHLSSGLACGLAGLSAGMAIGMVGDAGVRANAQQPKLFVGMILILIYAEALALYGLIVGIILSSRAGQSRADYNQWMIYACIYSYY

SEQ ID NO: 6740 - protein, 153 aa, Cirsium arvense
MADSGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVG

SEQ ID NO: 6741 - protein, 149 aa, Brassica juncea
LGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6742 - protein, 149 aa, Cicer arietinum
PRRRGCPSFLMYGSGIWNCEERCWCCIDGCDETGVSYEIDRTVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6743 - protein, 154 aa, Cirsium arvense
MSSGSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVG

SEQ ID NO: 6744 - protein, 148 aa, Eschscholzia californica
GAAAALVFSCMGAAYGTAKSGVGVASMGVMRPELVMKSIVPVVMAGVLGIYGLIIAVIISTGINPKAKSYYLFDGYAHLSSGLSCGLAGLSAGMAIGIVGDAGVRANAQQPKLFVGMILILIFAEALALYGLIVGIILSSRAGQSRAD

SEQ ID NO: 6745 - protein, 166 aa, Setaria italica
MSSVMFNGDEVAPFFGFIGAASALVFSCMGAAYGTAKSGVGVAHMGVMRPELVTKSIVPVVMAGVLGIYGLIVAVIISSGINPVAKPYYLFDGFAHLAAGLSCGVSGLAAGMAIGIVGDAGVRANAQQPKLFVGMILMLIFAEALALYGLIIGIILCTRAGQSRAD

SEQ ID NO: 6746 - protein, 65 aa, Guizotia abyssinica
MSSASGFSGDETAPFFGFLGAAAALVFSCMGAAYGTAKSGVGVASMGGCAWYLWFDYCCHHQYRD

SEQ ID NO: 6747 - protein, 147 aa, Cycas rumphii
MADVFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALY

SEQ ID NO: 6748 - protein, 176 aa, Chlamydomonas reinhardtii
MDHYRSLLQETAASNQDTAPFFGFIGAAAALVFSCMGAAYGTAKSGVGIASMGVMRPELVMKSIVPVVMAGVLGIYGLIIAVIISTGVNPATYKLYDGFAHLASGLACGLAGLAAGMAIGIVGDAGVRANAQQPKLFVGMILILIFAEALALYGLIVGIILSSKAGASAAAPPAAL

SEQ ID NO: 6749 - protein, 165 aa, Oryza sativa
MSSTFNGDEFAPFLGFIGAALALVFSCMGAAYGTARSGVGVAHMGVMRPELVMKSIVPVVMAGVLGIYGLIIAVIITTGINPTAMPYYHFDGSVHLAAGLATGLCALAAGLAIGVVGDAGVRANAQQPKLFVGMILILIFAEALGLYGLIVGIILSSRAGQSRAH

SEQ ID NO: 6750 - protein, 182 aa, Taxus baccata
MAEAFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLSGLSAGMAIGIVGDAGVRANAQQPKLFVGMILILIFAEALALYGLIVGIILSSRAGRVTSRLEKLVAGLMFTHFICQF

SEQ ID NO: 6751 - protein, 166 aa, Panicum virgatum
SLSLSLSLSLSLSLSLSLSLSLSLCLAGMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSSRAGQSRAD

SEQ ID NO: 6752 - protein, 141 aa, Leymus cinereus x Leymus triticoides
FSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSSRAGQSRAD

SEQ ID NO: 6753 - protein, 150 aa, Ocimum basilicum
PWAPVLPSFFSCMGAAYGTAKSGVGVASMGVMRPELVMKSIVPVVMAGVLGIYGLIIAVIISTGINPKAKSYYLFDGYAHLSSGLACGLAGLAAGMAIGIVGDAGVRANAQQPKLFVGMILILIFAEALALYGLIVGIILSSRAGQSRAD

SEQ ID NO: 6754 - protein, 164 aa, Allium cepa
MVGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMESGLLVMLVLEPTHNSQSSLVGMILILIFAEALALYGLIVGIILSSRAGQSRAD

SEQ ID NO: 6755 - protein, 165 aa, Panicum virgatum
MSSTFNGDELAPFLGFIGAASALVFSCMGAAYGTAKSGVGVAHMGVMRPELVTKSIVPVVMAGVLGIYGLIVAVMVTSAINPLAKPYYLFDGYVHLASGLSCGISCLASGMAIGIVGDAGVRANAQQPKLFVGMILILIFAEALGLYGLIVGILLSSRAGQSRAN

SEQ ID NO: 6756 - protein, 190 aa, Castanea mollissima
INFPNFPKSKTNPTKKERKEKKKNKSSAVFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLSCGLAGLSAGMAIGIVGDAGVRANAQQPKLFVGMILILIFAEALALYGLIVGIILSSRAGQSRAD

SEQ ID NO: 6757 - protein, 141 aa, Papaver somniferum
FSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6758 - protein, 141 aa, Brassica juncea
FSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6759 - protein, 139 aa, Musa acuminata
CMGAAYGTAKSGVGVASMGVMRPELVMKSIVPVVMAGVLGIYGLIIAVIISTGINPKAKPYYLFDGYAHLSSGLACGLAGLSAGMAIGIVGDAGVRANAQQPKLFVGMILILIFAEALALYGLIVGIILSSRAGQSRAD

SEQ ID NO: 6760 - protein, 140 aa, Curcuma longa
SCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6761 - protein, 160 aa, Camellia sinensis
MSSTFAGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGPHCWHHPFLLVL

SEQ ID NO: 6762 - protein, 171 aa, Pteridium aquilinum
RERRRGHVDHRIQWRHHGSLLRLLGAAAALVFSCMGAAYGTAKSGVGVASMGVMRPELVMKSIVPVVMAGVLGIYGLIIAVIISTGINPKSTAYYLFDGYAHLSSGLACGLAGLSAGMAIGIVGDAGVRANAQQPKLFVGMILILIFAEALALYGLIVGIILSSRAGQSRE

SEQ ID NO: 6763 - protein, 155 aa, Secale cereale
LIGGRSDRGVRGACDAGMGAAYGTAKSGVGVASMGVMRPELVMKSIVPVVMAGVLGIYGLIIAVIISTGINPKAKPYFLFDGYAHLSSGLACGLAGLAAGMAIGIVGDAGVRANAQQPKLFVGMILILIFAEALALYGLIVGIILSSRAGQSRAD

SEQ ID NO: 6764 - protein, 138 aa, Unknown
  Sequence found in Organisms: Artemisia annua, Euonymus alatus, Carpinus betulus, Sarracenia psittacina, Camellia sinensis, Thalictrum flavum
MGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 6765 - protein, 138 aa, Fagopyrum esculentum
MGAAYGTAKSGVGVASMGVMRPELVMKSIVPVVMAGVLGIYGLIIAVIISTGINPKAKGYYLFDGYAHLSSGLACGLAGLSAGMAIGIVGDAGVRANAQQPKLFVGMILILIFAEALALYGLIVGIILSSRAGQSRAD

SEQ ID NO: 6766 - protein, 148 aa, Utricularia gibba
MSSTFSGDETAPFFGFLGAATALVFSCMGAAYGTAKSGVGVASMGVMRPELVMKSIVPVVMAGVLGIYGLIIAVIISTGINPKAKSYYLFDGYAHLSSGLACGLAGLAAGMAIGIVGDAGVRANAQQPKLFVGMILILFLLKPLHCTV

SEQ ID NO: 6767 - protein, 174 aa, Volvox carteri
MADHYRALLQSSSGSDASATAPFFGFIGAAAALVFSCMGAAYGTAKSGVGIASMGVMRPELVMKSIVPVVMAGVLGIYGLIIAVIISTGVNPVKYQLFDGFAHLASGLACGLAGLAAGMAIGIVGDAGVRANAQQPKLFVGMILILIFAEALALYGLIVGIILSSKAGAAATAE

SEQ ID NO: 6768 - protein, 138 aa, Bruguiera gymnorhiza
  misc_feature (115)..(115): Xaa can be any naturally occurring amino acid
MGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAXALALYGLIVGIILSSRAGQSRAD

SEQ ID NO: 6769 - protein, 138 aa, Cannabis sativa
MGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6770 - protein, 139 aa, Cannabis sativa
GMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6771 - protein, 88 aa, Theobroma cacao
MRPELVMKAIVPVVMAGVLGIYGLIIAVIIGTGINPKANSYYLSDGYAHLSSGIAGIPIGIVGDAGVRTNAQQPQLGFCWDDPHSHLC

SEQ ID NO: 6772 - protein, 130 aa, Brassica napus
MSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRFVCSSFATV

SEQ ID NO: 6773 - protein, 122 aa, Hordeum vulgare
MSSVFSGDETAPFFGFLGAAAALVFSCMGAAYGTAKSGVGVASMGVMRPELVMKSIVPVVMAGVLGIYGLIIAVIISTGINPKAKPYFLFDGYAHLSSGLACGLAGLAAGMAIGIVGDAGVR

SEQ ID NO: 6774 - protein, 159 aa, Ostreococcus lucimarinus
MSTSDEVAPFFGFMGATSALVFSCMGAAYGTAKSGVGIASMGVMRPELVMKSIVPVVMAGVLGIYGLIIAVVISTNIDASSYTLFQGYAHLGSGLACGLSGLSAGMCIGIVGDAGVRANAQQPKLFVGVILILIFAEALALYGMIVGIILSSAASAATS

SEQ ID NO: 6775 - protein, 190 aa, Secale cereale
LPPPSPLHSSPPSNLRRRSPPPPAGSHVFRLQRRRDAPLRLLGAAAALVFSCMGAAYGTAKSGVGVASMGVMRPELVMKSIVPVVMAGVLGIYGLIIAVIISTGINPKAKPYFLFDGYAHLSSGLACGLAGLAAGMAIGIVGDAGVRANAQQPKLFVGMILILIFAEALALYGLIVGIILSSRAGQSRAD

SEQ ID NO: 6776 - protein, 115 aa, Eucalyptus grandis
MGAAYGTAKSGVGVASMGVMRPELVMKSIVPVVMAGVLGIYGLIIAVIISTGINPKAKSYYLFDGYAHLSSGLACGLAGLSAGMAIGIVGDAGVRYATRAAAKAFCRDDPYPHFR

SEQ ID NO: 6777 - protein, 136 aa, Unknown
  Sequence found in Organisms: Brassica juncea, Pisum sativum
AAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAE

SEQ ID NO: 6778 - protein, 332 aa, Pseudoroegneria spicata
MEAPAARGGARMWLRLVVSVVVVMAMAAATARAQLQVGYYDTLCPAAEIIVQQEVSKGVSGSPGTAAGLLRLHFHDCFVRGCDGSVLLDSTPGNQAEKDAPPNSSLRGFEVIDAAKTRLEQACYGVVSCADVLAFAARDALALVGGNTYQVPAGRKDGNVSVAGETNGNLPPPTANVNQLNQIFGSKGLSQAQMVALSGAHTVGMAQCSSFSSRLYSYGTSGGKDPSMDPSYLATLSTQCPQSGASQPVAMDPVTPNTFDTNYYANVAANRGLLTSDQALLADNSTAAQVLGYTTSPGTFQTDFANAMVAMGAIGVLTGNSGTIRTNCRVVG

SEQ ID NO: 6779 - protein, 331 aa, Triticum aestivum
MEAPAARGGARMRLRLVSLVVVVAMAAATARAQLQVGYYDTLCPAAEIIVQQEVSKGVSGSPGTAAGLLRLHFHDCFVRGCDGSVLLDSTPGNQAEKDAPPNSSLRGFEVIDAAKTRLEQACYGVVSCADVLAFAARDALALVGGNSYQVPAGRRDGNVSVAGETNGNLPPPTANVNQLNQIFGSKGLTQAQMVALSGAHTVGMAQCSSFSSRLYSYGTSGGKDPSMDPSYLATLSTQCPQSGASQPVAMDPVTPNTFDTNYYANVAANRGLLASDQALLADNSTAAQVLGYTSSPGTFQTDFASAMVAMGAIGVLTGNQGTIRTNCRVVG

SEQ ID NO: 6780 - protein, 331 aa, Triticum aestivum
MEAPAARGGARMRLRLVSLVVVVAMAAATARAQLQVGYYDTLCPAAEIIVQQEVSKGVSGSPGTAAGLLRLHFHDCFVRGCDGSVLLDSTPGNQAEKDAPPNSSLRGFEVIDAAKTRLEQACYGVVSCADVLAFAARDALALVGGSSYQVPAGRRDGNVSVAGETNGNLPPPTANVNQLNQIFGSKGLSQAQMVALSGAHTVGMAQCSSFSSRLYSYGTNGGKDPSMDPAYLATLSTQCPQSGASQPVAMDPVTPNTFDTNYYANVAANRGLLASDQALLADNSTAAQVLGYTASPGTFQTDFASAMVAMGAIGVLTGNQGTIRTNCRVVG

SEQ ID NO: 6781 - protein, 329 aa, Secale cereale
MEAPAARGGARMRLRLRLVCLVVVMATARAQLQVGYYDTLCPAAEIIVQQEVSKGVSGSPGTAAGLLRLHFHDCFVRGCDGSVLLDSTAGNQAEKDAAPNSSLRGFEVIDAAKTRLEQACYGVVSCADVLAFAARDALALVGGSSYQVPAGRRDGNVSVAGETNGNLPPPTANVNQLNQIFGSKGLSQAQMVALSGAHTVGMAQCSSFSSRLYSYGTNGGKDPSMDPTYLATLSTQCPQSGASQPVAMDPVTPNTFDTNYYANVAANRGLLASDQALLADNSTAAQVLAYTASPGTFQTDFASAMVAMGAIGVLTGNQGTVRTNCRVVG

SEQ ID NO: 6782 - protein, 324 aa, Leymus cinereus x Leymus triticoides
MRLRLLSVVVAVMVMAMAAGTARAQLQIGYYDTLCPAAEIIVQEEVSKGVSGSPGTAAGLLRLHFHDCFVRGCDGSVLLDSTPGNQAEKDAPPNSSLRGFEVIDAAKTRLEQACYGVVSCADVLAFAARDALALVGGNSYQVPAGRRDGNVSVAGETNGNLPPPTANVNQLNQIFGSKGLSQAQMVALSGAHTVGMAQCSSFSNRLYSYGTSGGKDPSMDPSYLATLSTQCPQSGGAGQLVAMDPVTPNTFDTNYYANVAANRGLLTSDQALLADNSTAAQVVGYTNSPGTFQTDFANAMVAMGAIGVLTGSSGTIRTNCRVVG

SEQ ID NO: 6783 - protein, 182 aa, Triticum aestivum
MASSKTLLLVLCAAAAAAMLSPASAADDLTKFKVYFHDVLAGKSPTAIRIAQAASTNSSSTFFGAVVAIDDPLTTTPAVTGSAKSKDEVGRAQGSYTFADQATFGLLMNMNFVFTAGDYKGSSLTIYGRNEVLSAVREMSIIGGTGKFRMARGYVQASTVDSGAKSGETVVEYTVYVKAAAA

SEQ ID NO: 6784 - protein, 183 aa, Secale cereale
MAGSKVLLLLLFAAAAAAAMLSPASAADNLTKFKVYFHDVLAGKSPTAIRIAQAASTNSSSTFFGAVVAIDDPLTTSPAVTGSAKSKDEVGRAQGSYTFADQATFGLLMNMNFVFTAGDYKGSSLTIYGRNEVLSTVREMSIIGGTGKFRMARGYVEASTVDSGAKSGETVVEYTIHVMAAAA

SEQ ID NO: 6785 - protein, 186 aa, Pseudoroegneria spicata
MAGSKAVLLLLLCAAAAAVLLTPASAADDGLTKFKLYWHDVLAGTSPTAIRIAQAASTNSSSTFFGAVVAIDDPLTTGPAVTGSAKSKDEIGRAQGTYTFADQATFGLLMNMNFVFTAGDYKGSGLTIYGRNEVLSAVREMSIVGGTGKFRMARGYVEARTMDSGAKSGETVVEYTVYVKAAAAAA

SEQ ID NO: 6786 - protein, 181 aa, Hordeum vulgare
MAGSKAVLLLLLCAAALLTPASAADDGLTKFKLYWHDVLAGTSPTAIRIAQAASTNSSSTFFGAVVAIDDPLTTGPAVTGSAKSKDEIGRAQGTYTFADQATFGLLMNMNFVFTAGDYKGSGLTIYGRNEVLSAVREMSIVGGTGKFRMARGYVEARTMDSGAKSGETVVEYTVYVKAAAA

SEQ ID NO: 6787 - protein, 181 aa, Triticum aestivum
MAGGKAALLLLLCAAVLLAPASAADDGLTKFKLYWHDVLAGTSPTAIRIAQAASTNSSSTFFGAVVAIDDPLTTGPAVTGSAKSKDEIGRAQGTYTFADQATFGLLMNMNFVFTAGDYKGSGLTIYGRNEVLSAVREMSIIGGTGKFRMARGYVEARTMDSGAKSGETVVEYTVYVKAAAA

SEQ ID NO: 6788 - protein, 182 aa, Triticum aestivum
MAGGKAALLLLLCAAVLLTPASAADDGLTKFKLYWHDVLAGTSPTAIRIAQAASSNSSSTFFGAVVAIDDPLTTGPAVTGSAKSKDEIGRAQGTYTFADQATFGLLMNMNFVFTAGDYKGSGLTIYGRNEVLSAVREMSIIGGTGKFRMARGYVEARTMDSGAKSGETVVEYTVYVKAAAAA

SEQ ID NO: 6789 - protein, 183 aa, Triticum aestivum
MAGGKAALLLLLCAAGLLTPASAADDGLTKFKLYWHDVLAGTSPTAIRIAQAASSNSSSTFFGAVVAIDDPLTTGPAVTGSAKSKDEIGRAQGTYTFADQATFGLLMNMNFVFTAGDYKGSGLTIYGRNEVLSAVREMSIIGGTGKFRMARGYVEARTMDSGAKSGETVVEYTVYVKAAAAAA

SEQ ID NO: 6790 - protein, 75 aa, Triticum aestivum
MNMNFVFTAGDYKGSSLTIYGRNEVLSAVREMSIIGGTGKFRMARGYVQASTVDSGAKSGETVVEYTIYVKAAAA

SEQ ID NO: 6791 - protein, 183 aa, Avena sativa
MAGPKAALLLLLCAIAAALLLTPATAADDGLTKFKVYWHDVFGGKSPTAIRIAQAASTNSSSTFFGAVVAIDDPLTTTSAVAGSARSKDEVGRAQGTYTFADQRTIGCLMNMNFVFTAGDYKGSGLTIYGRNEVLTAVREMSIVGGTGKFRMARGYVEARTISNDNGETVVEYTVFVKPAAAA

SEQ ID NO: 6792 - protein, 546 aa, Triticum aestivum
MALTLLRGIRTQTLFGANAGLFCTTRRHPLAHFTTRVESVQTSEPKSVRKSIQQATKEAAEHKTQGFEAVIGIETHVQLSTITKAFCSCPYDYGSQPNSTVCPTCMGHPGTLPVLNAKVVECAVKLGLALNCEISMTSKFDRKQYFYPDLPKGYQISQFDIPIAEKGYLDLDIPMEFGGGHRRFGVTRVHMEEDAGKLLHSESGSFSQVDLNRAGVPLLEIVSEPDMRTGIEAAEYGAEIQRVVRYLGVGNGNMQEGSLRCDVNVSVRPIGQSEFGTKVEIKNMNSFSEISRAIDYEISRQILLHKESQADKIVQETRLWDESSQKTFTMRKKEGLADYRYFPEPDLPEVVLTSDYIDEIRNSMPELPEAKRRRYENMGLSMQDVIFLANDDIVAHFFDSTLERGADAKLAANWIMGDITAYLKNEKLSIDEIKLTPLELSELIAFIKNGTISGKIGKEILVELITKGGTVKSVIEEKDLVQIADPAAIEAMVDKVLAENPKQLEQYRAGKTKLQGFFAGQVMKASKGKASPVLLNKILGEKLKGN

SEQ ID NO: 6793 - protein, 546 aa, Secale cereale
MALTLLRGIRTQTLSGANAGLFCTTRRPPLAHFTARVESVQTSEPKSVRKSIQQATKEAAEHKTHGFEAVIGIETHVQLSTITKAFCSCPYDYGSQPNSTVCPTCMGHPGTLPVLNAKVVECAVKLGLALNCEISMASKFDRKQYFYPDLPKGYQISQFDIPIAEKGYLDLDIPMEFGGGHRRFGVTRVHMEEDAGKLLHSESGSFSQVDLNRAGVPLLEIVSEPDMRTGIEAAEYGAEIQRVVRYLGVGNGNMQEGSLRCDVNVSVRPIGQSEFGTKVEIKNMNSFSEISRAIDYEISRQILLHKESQADKIVQETRLWDESSQKTFTMRKKEGLADYRYFPEPDLPEVVLTSEYIDEIRNSLPELPEAKRRRYENMGLSMQDVIFLANDDIVAHFFDSTLERGADAKLAANWIMGDITAYLKNEKLSIDEIKLTPLELSELIAFIKNGTISGKIGKEILVELITKGGTVKSVIEEKDLVQIADPAAIEAMVDKVLAENPKQLEQYRAGKTKLQGFFAGQVMKASKGKASPVLLNKILGEKLKGN

SEQ ID NO: 6794 - protein, 546 aa, Triticum aestivum
MALTLLRGIRTQTLSGANAGLFCTTRRPPLAHFTARVESVQTSEPKSVHKSIQQATKEAVEQKTHGFEAVIGIETHVQLSTITKAFCSCPYDYGSQPNSTVCPTCMGHPGTLPVLNAKVVECAVKLGLALNCEISMTSKFDRKQYFYPDLPKGYQISQFDIPIAEKGYLDLDIPMEFGGGHRRFGVTRVHMEEDAGKLLHSESGSFSQVDLNRAGVPLLEIVSEPDMRTGIEAAEYGAEIQRVVRYLGVGNGNMQEGSLRCDVNVSVRPIGQSEFGTKVEIKNMNSFSEISRAIDYEISRQILLHKESQADKIVQETRLWDESSQKTFTMRKKEGLADYRYFPEPDLPEVVLTSEYVDEIRNSMPELPEAKRRRYENMGLSMQDVIFLANDDIVAHFFDSTLERGADAKLAANWIMGDITAYLKNEKLSIDEIKLTPLELSELIAFIKNGTISGKIGKEILVELITKGGTVKSVIEEKDLVQIADPAAIEAMVDKVLAENPKQLEQYRAGKTKLQGFFAGQVMKASKGKASPVLLNKILGEKLKGN

SEQ ID NO: 6795 - protein, 546 aa, Triticum aestivum
MALTLLRGIRTQTLSGANAGLFCTTRRPPLAHLTARVESVQTSEPKSVRKSIQQATKEAVEQKTHGFEAVIGIETHVQLSTITKAFCSCPYDYGSQPNSTVCPTCMGHPGTLPVLNAKVVECAVKLGLALNCEISMTSKFDRKQYFYPDLPKGYQISQFDIPIAEKGYLDLDIPMEFGGGHRRFGVTRVHMEEDAGKLLHSESGSFSQVDLNRAGVPLLEIVSEPDMRTGIEAAEYGAEIQRAVRYLGVGNGNMQEGSLRCDVNVSVRPIGQSEFSTKVEIKNMNSFSEISRAIDYEIARQILLHKESQADKIVQETRLWDESSQKTFTMRKKEGLADYRYFPEPDLPEVVLTSDYIDEIRNSMPELPEAKRRRYENMGLSMQDVIFLANDDIVAHFFDSTLEHGADAKLAANWIMGDITAYLKNEKLSIDEIKLTPLELSELIAFIKNGTISGKIGKEILVELITKGGTVKSVIEEKDLVQIADPAAIEAMVDKVLAENPKQLEQYRAGKTKLQGFFAGQVMKASKGKASPVLLNKILGEKLKGN

SEQ ID NO: 6796 - protein, 546 aa, Triticum aestivum
MALTLLRGIRTQTLSGANAGLFCTTRRPPLAHFTARVESVQTSEPKSVHKSIQQATKEAAEQKIQGFESVIGIETHVQLSTITKAFCSCPNNYGSQPNSTVCPTCMGHPGTLPVLNAKVVECAVKMSLALNCKISMTSKFDRKQYFYPDLPKGYQISQFDIPIAEKGYLDVDIPIEFGGGHRRFGVTRVHMEEDAGKLLHSESGSYSQVDLNRAGVPLLEIVSEPDMRTGIEAAEYGAEIQRVVRYLGVGNGNMQEGSLRCDVNVSVRPIGQSEFGTKVEIKNMNSFSEISRAIDYEIARQILLHKESQADKIVQETRLWDESSQKTFTMRKKEGLADYRYFPEPDLPEVVLTSDYIDEIRNSMPELPEAKRRRYENMGLSMQDVIFLANDDIVAHFFDSTLERGADAKLAANWIMGDITAYLKNEKLSIDEIKLTPLELSELIAFIKNGTISGKIGKEILVELITKGGTVKSVIEEKDLVQIADPAAIEAMVDKVLAENPKQLEQYRAGKTKLQGYFAGQVMKASKGKASPVLLNKILGEKLKGN

SEQ ID NO: 6797 - protein, 338 aa, Triticum aestivum
MALTLLRGIRTQTLSGANAGLFCTTRRPPLAHLTARVESVQTSEPKSVHKSIQQATKEAAEQKIQGFESVIGIETHVQLSTITKAFCSCPNNYGSQPNSTVCPTCMGHPGTLPVLNAKVVECAVKLGLALNCEISMTSKFDRKQYFYPDLPKGYQISQFDIPIAEKGYLDLDIPMEFGGGHRRFGVTRVHMEEDAGKLLHSESGSFSQVDLNRAGVPLLEIVSEPDMRTGIEAAEYGAEIQRVVRYLGVGNGNMQEGSLRCDVNVSVRPIGQSEFGTKVEIKNMNSFSEISRAIDYEISRQILLHKESQADQIVQETRLWDESSQKLLQCEKGGTCRL

SEQ ID NO: 6798 - protein, 547 aa, Brachypodium distachyon
MALTLLRGIRTPTLFRTNVGLFCTARHPPLAHFTTRAGGMQTTEPKAAPKSIQQATKEAAEHKTRGFEAVIGIETHVQLSTITKAFCSCPYNYGSQPNSTVCPTCMGHPGTLPVLNAKVVDCAVKLGLALNCEISMTSKFDRKQYFYPDLPKGYQISQFDIPIAEKGYLDLDLPVEFGGGHRRFGITRVHMEEDAGKLLHSESGSYSQVDLNRAGVPLLEIVSEPDMRTGIEAAEYGAEIQRLVRYLGVGNGNMQEGSLRCDVNVSVRPIGQPEFGTKVEVKNMNSFSEISRAIDYEISRQILLHKESQADQIVQETRLWDESSQKTFTMRKKEGLADYRYFPEPDLPEVVLTSEYIDEIRNSMPELPEAKRRRYENMGLSMQDVIFLANDDNVAHFFDATLERGADAKLAANWIMGDITAYLKNEKLSIDEIKLTPLELSELIASIKNGTINGKIGKEILVELIAKGGTVKSVIEEKDLVQIADPAAIEAIVDQVLADNPKQLEQYRAGKTKLQGFFAGQVMKASKGKASPVLLNKILAEKLKGNQ

SEQ ID NO: 6799 - protein, 547 aa, Triticum aestivum
MALTLLRGIRTPTLLRANFSLLCTTQRHPLAHFTTRAESVQTTEPKAVPKSIQQATKEAVEQKTHGFEAVIGIETHVQLSTITKAFCSCPYDYGSQPNSTVCPTCMGHPGTLPVLNAKVVECAVKLGLALNCEISMTSKFDRKQYFYPDLPKGYQISQFDIPIAEKGYLDLDIPMEFGGGHRRFGVTRVHMEEDAGKLLHSESGSFSQVDLNRAGVPLLEIVSEPDMRTGIEAAEYGAEIQRLVRYLGVGNGNMDEGSLRCDVNVSVRPIGQSEFGTKVEIKNMNSFSAISRAIDYEISRQILLHKGSQADQIVQETRLWDESSQKTFTMRKKEGLADYRYFPEPDLPEVVLTGEYIDEIRNLMPELPEAKRRRYENIGLSMQDVIFLANDDKVAHFFDSTLEHGADAKLAANWIMGDITAYLKDEKLSIDESKLTPLELSEMIAYIKNGTISGKIAKEIVVDLIAKGGTVKSVIEEKDLVQIADPAAIEAMVDQVLTANPKQLEQYRAGKTKLQGYSAGQVMKASKGKASPVLLNKILGEKLKGSC

SEQ ID NO: 6800 - protein, 547 aa, Triticum aestivum
MALTLLRGIRTPTLLRANFSLFCTTQRHPLAHFTTRVESVQTTEPKAVPKSIQQATKEAAEQKIQGFESVIGIETHVQLSTITKAFCSCPNNYGSQPNSTVCPTCMGHPGTLPLLNAKVVECAVKMGLALNCKISMTSKFDRKQYFYPDLPKGYQISQFDIPIAEKGYLDVDIPVEFGGGHRRFGVTRVHMEEDAGKLLHSESGSYSQVDLNRAGVPLLEIVSEPDMRTGIEAAEYGAEMQRLVRYLGVGNGNMDEGSLRCDVNVSVRPIGQSEFGTKVEIKNMNSFSAISRAIDYEISRQILLHKGSQADQIVQETRLWDESSQKTFTMRKKEGLADYRYFPEPDLPEVVLTSEYIDEIRNLMPELPEAKRRRYENMGLSMQDVIFLANDDKVAHFFDSTLEHGADAKLAANWIMGDITAYLKDEKLSIDESKLTPLELSEMIAYIKNGTISGKIAKEIVVDLIAKGGTVKSVIEEKDLVQIADPAAIEAMVDQVLADNPKQLEQYRAGKTKLQGYFAGQVMKASKGKASPVLLNKILGEKLKGSC

SEQ ID NO: 6801 - protein, 547 aa, Triticum aestivum
MALTLLRGIRTPTLLRANFSLFCTTQRHPLAHFTTRVESVQTTEPKAVPKSIQQATKEAAEQKIQGFESVIGIETHVQLSTITKAFCSCTNNYGSQPNSTVCPTCMGHPGTLPVLNAKVVECAVKMSLALNCKISMTSKFDRKQYFYPDLPKGYQISQFDIPIAEKGYLDVDIPLEFGGGHRRFGVTRVHMEEDAGKLLHSESGSYSQVDLNRAGVPLLEIVSEPDMRTGIEAAEYGAEIQRLVRYLGVGNGNMDEGSLRCDVNISVRPIGQSEFGTKVEIKNMNSFSAISRAIDYEISRQILLHKGSQADQIVQETRLWDESSQKTFTMRKKEGLADYRYFPEPDLPEVVLTSEYIDEIRNLMPELPEAKRRRYENMGLSMQDVIFLANDDKVAHFFDSTLEHGADAKLAANWIMGDITAYLKDEKLSIDESKLTPLELSEMIAYIKNGTISGKIAKEIVVDLIAKGGTVKSVIEEKDLVQIADPAAIEAMVDQVLADNPKQLEQYRAGKTKLQGYFAGQVMKASKGKASPVLLNKILGEKLKGSC

SEQ ID NO: 6802 - protein, 547 aa, Secale cereale
MALTLLRGIRTPTLLRANFSLFCTTQRHPLAHFTTRAESVQTTEPKAVPKSIQQATKEAAEQKIQGFESVIGIETHVQLSTITKAFCSCPNNYGSQPNSTVCPTCMGHPGTLPVLNAKVVECAVKMSLALNCKISMTSKFDRKQYFYPDLPKGYQISQFDIPIAEKGYLDVDIPVEFGGGHRRFGVTRVHMEEDAGKLLHSESGSYSQVDLNRAGVPLLEIVSEPDMRSGIEAAEYGAEIQRLVRYLGVGNGNMDEGSLRCDVNVSVRPIGQLEFGTKVEIKNMNSFSAVSRAIDYEISRQILLHKESQADQIVQETRLWDESSQKTFTMRKKEGLADYRYFPEPDLPEVVLTDEYIDEIRNSMPELPEAKRRRYENMGLSMQDVIFLANDDKVAHFFDSTLEHGADAKLAANWIMGDITAYLKDEKLSIDESKLTPLELSEMIAYIKNGTISGKIAKEIVVDLIAKGGTVKSVIEEKDLVQIADPAAIEAMVDQVLADNPKQLEQYRAGKTKLQGYFAGQVMKASKGKASPVLLNKILGEKLKGSC

SEQ ID NO: 6803 - protein, 547 aa, Triticum aestivum
MALTLLRGIRTPTLLRANFSLFCTTQRHPLAHFTTRAESVQTTEPKAVPKSIQQATKEAAEQKIQGFESVIGIETHVQLSTITKAFCSCPNNYGSQPNSTVCPTCMGHPGTLPVLNAKVVECAVKMSLALNCKISMTSKFDRKQYFYPDLPKGYQISQFDIPIAEKGYLDVDIPVEFGGGHRRFGVTRVHMEEDAGKLLHSESGSYSQVDLNRAGVPLLEIVSEPDMRSGIEAAEYGAEIQRLVRYLGVGNGNMDEGSLRCDVNVSVRPIGQSEFGTKVEIKNMNSFSAISRAIDYEISRQILLYKESQADQIVQETRLWDESSQKTFTMRKKEGLADYRYFPEPDLPEVVLTGEYIDEIRNLMPELPEAKRRRYENIGLSMQDVIFLANDDKVAHFFDSTLEHGADAKLAANWIMGDITAYLKDEKLSIDESKLTPLELSEMIAYIKNGTISGKIAKEIVVDLIAKGGTVKSVIEEKDLVQIADPAAIEAMVDQVLTDNPKQLEQYRAGKTKLQGYFAGQVMKASKGKASPVLLNKILGEKLKGSC

SEQ ID NO: 6804 - protein, 518 aa, Triticum aestivum
MALTLLRGIRTPTLLRANFSLFCTTQRHPLAHFTTRAESVQTTEPKAVPKSIQQATKEAAEQKIQGFESVIGIETHVQLSTITKAFCSCPNNYGSQPNSTVCPTCMGHPGTLPVLNAKVVECAVKIGLALNCKISMTSKFDRKQYFYPDLPKGYQISQFDIPIAEKGYLDLDIPMEFGGGHRRFGVTRVHMEEDAGKLLHSESGSFSQVDLNRAGVPLLEIVSEPDMRTGIEAAEYGAEIQRVVRYLGVGNGNMQEGSLRCDVNVSVRPIGQSEFGTKVEIKNMNSFSEISRAIDYEISRQILLHKESQADKIVQETRLWDESSQKTFTMRKKEGLADYRYFPEPDLPEVVLTSDYIDEIRNSMPELPEAKRRRYENMGLSMQDVIFLANDDIVAHFFDSTLEHGADAKLAANWIMGDITAYLKNEKLSIDEIKLTPLELSELIAFIKNGTISGKIGKEILVELITKGGTVKSVIEEKDLVQIADPAAIEAMVDKVLAENPKQLEQYRAGKTKLQGYF

SEQ ID NO: 6805 - protein, 547 aa, Triticum aestivum
MALTLLRGIRTPTLLRANFSLLCTTQRHPLAHFTTRAESVQTTQPKAVPKSIQQATKEAAEQKIQGFESVIGIETHVQLSTITKAFCSCPNNYGSQPNSTVCPTCMGHPGTLPVLNAKVVECAVKMSLALNCKISMTSKFDRKQYFYPDLPKGYQISQFDIPIAEKGYLDVDIPVEFGGGHRRFGVTRVHMEEDAGKLLHSESGSYSQVDLNRAGVPLLEIVSEPDMRSGIEAAEYGAEIQRLVRYLGVGNGNMDEGSLRCDVNVSVRPIGQSEFGTKVEIKNMNSFSAISRAIDYEISRQILLYKESQADQIVQETRLWDESSQKTFTMRKKEGLADYRYFPEPDLPEVVLTGEYIDEIRNLMPELPEAKRRRYENIGLSMQDVIFLANDDKVAHFFDSTLEHGTDAKLAANWIMGDITAYLKDEKLSIDESKLTPLELSEMIAYIKNGTISGKIAKEIVVDLIAKGGTVKSVIEEKDLVQIADPAAIEAMVDQVLTDNPKQLEQYRAGKTKLQGYFAGQVMKASKGKASPVLLNKILGEKLKGSC

SEQ ID NO: 6806 - protein, 544 aa, Oryza sativa
MALTLLRGMRTPVVARRNAGLFFTTLQSPLLSRFTMRAESARAAAPKSIQLATKEAAEQKAQGFEAVIGIETHVQLSTVTKAFCSCPYSYGSQPNSTVCPTCMGHPGTLPVLNAKVVECAVRLGLALNCEIAMTSKFDRKQYFYPDLPKGYQISQFDIPIAKEGYLDLDLPVEFGGGHRRFGVTRVHMEEDAGKLLHSESGSYSQVDLNRAGVPLLEIVSEPDMRTGIEAAEYGAELQRLVRYLGVSNGNMQEGSLRCDVNVSVRPIGQSNFGTKVEIKNMNSFSAISRAIDYEISRQILLHKEGQADQIVQETRLWDESSQKTFTMRKKEGLADYRYFPEPDLPEVVLTSEYIDEIQNSMPELPEAKRRRFENMGLSMQDVLFLANDDNVARFFDSTLEHGADAKLAANWIMGDIAAYLKNEKLSIDEIKLTPLELSELIASIRNGTISGKIGKEILIELIAKGGTVKSVIEEKDLVQIADPAAIEAMVDQVLADNPKQLEQYRSGKTKLQGFFAGQVMKASKGKANPVLLNKILGEKLKANS

SEQ ID NO: 6807 - protein, 546 aa, Panicum virgatum
MALTLLRGMRTPISFRSNTGLFFTVLRPRLARFTTRAESAQATEAKAAAKSIQLATKEAAEQKTQGFEAIIGIETHVQLSTVTKAFCSCPYNYGSQPNTTICPTCMGHPGTLPVLNEKVVECAVKLGLALNCEISMTSKFDRKQYFYPDLPKGYQISQFDIPIAKKGYVDLDLPVEFGGGHRKFGITRVHMEEDAGKLLHSESGSYSQVDLNRAGVPLLEIVSEPDMRTGIEAAEYGAELQRIVRYLGVSNGNMQEGSLRCDVNVSVRPVGQSEFGTKVEIKNMNSFSEINRAIDYEISRQILLHKEGQADQIVQETRLWDESSQKTFTMRKKEGLADYRYFPEPDLPEVVLTTDYIDEISKSLPELPEAKRRRYENMGLSMQDVLFLANDDNVAHFFDSTLEHGADAKLACNWIMGDIAAYLKNEKLSIDETKLTPLELSELIASIKNGTISGKIGKEILVELISKGGTVKGVIEEKDLVQIADPAEIEAMVDKVIAENPKQLEQYRAGKTKLQGFFAGQVMKASKGKANPVLLNKILGEKLNAN

SEQ ID NO: 6808 - protein, 545 aa, Panicum virgatum
  misc_feature (39)..(39): Xaa can be any naturally occurring amino acid
  misc_feature (47)..(47): Xaa can be any naturally occurring amino acid
  misc_feature (68)..(68): Xaa can be any naturally occurring amino acid
  misc_feature (544)..(544): Xaa can be any naturally occurring amino acid
MALTLLRGMRTPISFRSNTGLFFTVRPRLARFTTRAESXQATEAKAXAKSIQLATKEAAEQKTQGFEXIIGIETHVQLSTVTKAFCSCPYNYGSQPNTTICPTCMGHPGTLPVLNEKVVECAVKLGLALNCEISMTSKFDRKQYFYPDLPKGYQISQFDIPIAKKGYVDLDLPVEFGGGHRKFGITRVHMEEDAGKLLHSESGSYSQVDLNRAGVPLLEIVSEPDMRTGIEAAEYGAELQRIVRYLGVSNGNMQEGSLRCDVNVSVRPVGQSEFGTKVEIKNMNSFSEINRAIDYEISRQILLHKEGQADQIVQETRLWDESSQKTFTMRKKEGLADYRYFPEPDLPEVILSTDYIDEISKSLPELPEAKRRRYENMGLSMQDVLFLANDDNVAHFFDSTLEHGADAKLACNWIMGDIAAYLKNEKLSIDETKLTPLELSELIASIKNGTISGKIGKEILVELISKGGTVKGVIEEKDLVQIADPAAIEAMVDKVIADNPKQLEQYRAGKTKLQGFFAGQVMKASKGKANPVLLNKILGEKLNXN

SEQ ID NO: 6809 - protein, 546 aa, Setaria italica
MALTLLRGMRTPISFRSNSGLLFTVLRPRLSRFTTRAESAQATEPKAAPKSIQLATKEAAEQKTQGFEAVIGIETHVQLSTVTKAFCSCPYNYGSQPNSTICPTCMGHPGALPVLNEKVVECAVKLGLALNCEISMISKFDRKQYFYPDLPKGYQISQFDIPIAKKGYVNLDLPVEFGGGHRKFGITRVHMEEDAGKLLHSESRSYSQVDLNRAGVPLLEIVSEPDMRTGIEAAEYGAELQRIVRYLGVSNGNMQEGSLRCDVNVSVRPVGQSEFGTKVEIKNMNSFSEINRAIDYEISRQIMLHKEGQADQIVQETRLWDESSQKTFTMRKKEGLADYRYFPEPDLPEVVLSTDYIDEISKSMPELPEAKRRRYENMGLSMQDVLFLANDDNVAHFFDSTLEHGADAKLACNWIMGDIAAYLKNEKLSINETKLTPLELSELIESIKNGTISGKIGKEILVELIAKGGTVKGVIEEKDLVQIADPAAIEAMVDKVIADNPKQLEQYRAGKTKLQGFFAGQVMKASKGKANPVLLNKILGEKLNAN

SEQ ID NO: 6810 - protein, 546 aa, Zea mays
MAVTLLRGMRTPIPFRSNSGFFSTVLRPRLSRFTTRAESAQATEPKAAPRSIQLATKEAAEQKTQGFEAIIGIETHVQLSTVTKAFCSCPYSYGSQPNSTICPTCMGHPGTLPVLNEKVVECAVKLGLALNCEISMTSKFDRKQYFYPDLPKGYQISQFDIPIAKKGCVDLDLPVEFGGGHRKFGVTRVHMEEDAGKLLHSESSSYSQVDLNRAGVPLLEIVSEPDMRTGIEAAEYGAELQRIVRYLGVSNGNMQEGSLRCDVNVSVRPVGQSEFGTKVEIKNMNSFSAINRAIDYEISRQILLHKEGQADQIVQETRLWDESSQKTFTMRKKEGLADYRYFPEPDLPEVVITSDYINEISKSMPELPEAKRRRYENMGLSMQDVLFLANDDNIGHFFDSTLEHGADAKLAANWIMGDIAAYLKDEKVSIDEIKLTPLELSELIASIKNGTISGKIGKEILAELIAKGGTVKAVIEEKDLVQIADPAAIEAMVDKVIADNPKQLEQYRAGKTKLQGFFAGQVMKASKGKANPVLLNKILGEKLNAK

SEQ ID NO: 6811 - protein, 548 aa, Sorghum bicolor
MALTLLRGMRTPVSSGSNPGLFFAVLRPRLSRFTARAESAQATEPKAAPPPRSIQLATKEAAEQKTQGFEAVIGIETHVQLSTVTKAFCSCPYSYGAQPNSTVCPTCMGHPGTLPVLNEKVVECAVKLGLALNCEISMTSKFDRKQYFYPDLPKGYQISQFDIPIAKKGHVDLDLPVEFGGGHRKFGITRVHMEEDAGKLLHSESSSYSQVDLNRAGVPLLEIVSEPDMRTGIEAAEYGAELQRIVRYLGVSNGNMQEGSLRCDVNVSIRPVGQSEFGTKVEIKNMNSFSAINRAIDYEISRQILLHKEGQADQIVQETRLWDESSQKTFTMRKKEGLADYRYFPEPDLPEVVLTSDYINEISKSMPELPEAKRRRYENMGLSMQDVLFLANDDNIGHFYDSTLEHGADAKLAANWIMGDIAAYLKDEKVSIDEIKLTPLELSELIASIKNGTISGKIGKEILAELIAKGGTVKGVIEEKDLVQIADPAAIEAMVDKVIADNPKQLEQYRAGKTKLQGFFAGQVMKASKGKANPVLLNKILGEKLNAN

SEQ ID NO: 6812 - protein, 349 aa, Triticum aestivum
MGSLPVLSPAECAPPPTEGTRATVAASDLAALFDAQRRHLDHFFDRLDMPQAAAFAQALLDAPGAVFFTGVGKSGIVARKLAQTLASLGFARAGFLSPVDALHGDIGSVFPGDVLVLLSKSGASDELLALAPCARAKGAKLISLTSAASGADCPLAAACDLNVHLPLQGEVCPFGLAPVTSTAIQMVFGDTVVAAIMEARRLTRDQYASNHPAGKIGKTLIFKVKDVMKKQNELPLCKEGDMIMDQLTELTSKGCGCLLVVDDEYHLIGTFTDGDLRRTLKASGPAIFSLTVGEMCNRNPRTITADAMAVEAMEKMESPPSPVQFLPVVDDKNVVSGIITLHGLVSAGL

SEQ ID NO: 6813 - protein, 352 aa, Secale cereale
MGSLPVLSPPECAPPRPASPEGTRATVAASDLAALFDAQRRHLDHFFDRLDMPQAAAFAQALLDAPGAVFFTGVGKSGIVARKLAQTLASLGFARAGFLSPVDALHGDIGSVFPGDVLVLLSKSGASDELLALAPCARAKGAQLISLTSAASGADCPLAAACDLNVHLPLQGEVCPFGLAPVTSTAIQMVFGDTVVAAIMEARRLTRDQYASNHPAGKIGKTLIFKVKDVMKKQNELPLCKEGDMIMDQLTELTSKGCGCLLVVDDEYHLIGTFTDGDLRRTLKANGPAIFSLTVGEMCNRNPRTITADATAVEAMEKMESAPSPVQFLPVVDDKNVVSGIITLHGLVSAGL

SEQ ID NO: 6814 - protein, 347 aa, Brachypodium distachyon
MGSLPVLSSPECAPPQGPRAKVAASDLAPLFDAQRRHLGHFFENLDMSQAAAFAQALLDAPGAVFFTGVGKSGIVARKLAQTLASLGFGRAGFLAPVDALHGDIGSVFPGDVLVLLSKSGASDELLALAPCARAKGAHLISLTSAASGADCPLAAACDLNVHLPLQGEVCPFGLAPVTSTAIQMVFGDTVVAAIMEARRLTRDQYASNHPAGKIGKTLIFKVKDVMKKQNELPLCKESDMIMDQLTELTSKGCGCLLVVDDEYHLIGTFTDGDLRRTLKASGPAIFNLTVGEMCNRNPRTITADAMAVEAMEKMESPPSPVQFLPVVDEKNIVSGIITLHGLVSAGL

SEQ ID NO: 6815 - protein, 345 aa, Panicum virgatum
MGSLPVNASPECAPQGRATVSASDLAPLFSAQRRHLDHFFDRLDMSQAAAFAQALLDAPGAVFFTGVGKSGIVARKIAQTLASLGFARAGFLAPVDALHGDIGALFPGDVLVLLSKSGASDELLALAPCARAKGAYLISLTSAASGADCPLAAACDLNVHLPLQGEVCPFGLAPVTSTAIQMVFGDTVVAAIMEARRLSRDQYACNHPAGKIGKTLIFKVKDVMKKQNELPLCKEGDMIMDQLTELTSKGCGCLLVVDEEHHLIGTFTDGDLRRTLKASGPAIFNLTVGEMCNRNPRTITADAMAVEAMEKMESRPSPVQFLPVVDDNNVVCGIITLHGLVSAGL

SEQ ID NO: 6816 - protein, 345 aa, Panicum virgatum
MGSLPVNASPECAAQRRATVSASDLAPLFSAQRRHLDHFFDRLDMSQAAAFAQALLDAPGAVFFTGVGKSGIVARKIAQTLASLGFARAGFLAPVDALHGDIGALFPGDVLVLLSKSGASDELLALAPCARAKGAYLISLTSAASGADCPLAAACDLNVHLPLQGEVCPFGLAPVTSTAIQMVFGDTVVAAIMEARRLSRDQYASNHPAGKIGKTLILKVKDVMKKQNELPLCKEGDMIMDQLTELTSKGCGCLLVVDEDHHLIGTFTDGDLRRTLKASGPAIFNLTVGEMCNRNPRTITADAMAVEAMEKMESPPSPVQFLPVVDDNNVVCGIITLHGLVSAGL

SEQ ID NO: 6817 - protein, 345 aa, Setaria italica
MGSLPVLASPECAPRGRATVSASDLAPLFSAQRRHLDHFFDRLDMSQAAAFAQALLDAPGAVFFTGVGKSGIVARKIAQTLASLGFARAGFLAPVDALHGDIGALFPGDVLVLLSKSGASDELLALAPCARAKGSYLISLTSAASGGDCPLAAACDLNVHLPLQGEICPFGLAPVTSTAIQMVFGDTVVAAIMEARRLSRDQYASNHPAGKIGKTLIFKVKDVMKKQNELPLCKEGDMIMDQLTELTSKGCGCLLVVDEEHHLIGTFTDGDLRRTLKASGPDIFNLTVGEMCNRNPRTITAEAMAVEAMEKMESPPSPVQFLPVVDDNNVVCGIITLHGLVSAGL

SEQ ID NO: 6818 - protein, 344 aa, Oryza sativa
MGSLPVSSPECAPGRRVTVAASDLAPLFGAQRRHLDHFFDRLDLSQAAAFAQALVDAPGAVFFTGVGKSGIVARKLAQTLASLGFTRAGFLSPVDALHGDIGSVFPGDLLVLLSKSGASDELLALAPCARAKGAHLISLTSAASGADCPLAAVCDLNVHLPLQAEVCPFGLAPVTSTAIQMVFGDTVVAAIMEARRLSRDQYASNHPAGKIGKSLIFKVKDVMKKQNELPLCKEGDMIMDQLTELTSKGCGCLLVVDDEYHLIGTFTDGDLRRTLKASGQAIFNLTVGEMCNRHPRTITADAMAVQAMEKMESPPSPVQFLPVVDSNNVVCGIITLHGLVSAGL

SEQ ID NO: 6819 - protein, 345 aa, Zea mays
MGSLPVPASTECTPQGRATVSASDLAPLFSAQRRHLDHFFDRLDMSQAAAFAQVLLDAPGAVFFTGVGKSGIVARKTAQTLASLGFARAGFLAPVDALHGDIGALFPGDVLVLLSKSGASDELLALVPCARAKGGYLVSVTSAASGADCPLAAACDLNVHLPLQGEVCPFGLAPVTSTAIQMVFGDTVIAAIMEARRLSRDQYASNHPAGKIGKTLIFKVKDVMKKQNELPLCKEGDMIMDQLTELTSKGCGCLLVVDEEHHLIGTFTDGDLRRTLKASGPAIFSLTVGEMCNRNPRTITADAMAVEAMEKMESPPSPVQFLPVVNDNNVVCGIITLHGLVSAGL

SEQ ID NO: 6820 - protein, 347 aa, Zea mays
MGSLPAPASAEFAPRPRGRATVVASDLAPLFSAQRRHLDHFFDRLDMAQAAAFAQALLDAPGAVFFTGVGKSGIVARKTAQTLASLGLARAGFLAPVDALHGDIGALFPGDVLVILSKSGASDELLALAPCARAKGAYLVSLTSAASGDDCPLAAACDLNVHLPLQGEVCPFGLAPVTSTAIQMVFGDTVIAAIMEARRLSRDQYASNHPAGKIGKTLIFKVKDVMKKQNELPLCKEGDMIMDQLTELTSKGCGCLLVVDEEHHLIGTFTDGDLRRTLKASGPAIFSLTVGEMCNRNPRTITAEAMAVEAMEKMEAPPSPVQFLPVVNENNVVCGIITLHGLVSAGL

SEQ ID NO: 6821 - protein, 341 aa, Saccharum officinarum
MGSLPVPASAECAPQGRATVSASDLAPLFSAQRRHLDHFFDRLDMSQAAAFAQALLDAPGAVFFTGVGKSGIVARKIAQTLASLGFARAGFLAPVDALHGDIGALFPGDVLVILSKSGASDELLALAPCARAKGAYLISLTSAASGADCPLAAACDLNVHLPLQGEVCPFGLAPVTFTAIQMVFGDTVIAAIMEARRLSRDQYASNHSAGKIGKTLIFKVKDVMKKQNELSLCKEGDMIMEQLTELNSKGWGCLLVVDEEHHLIGTFTDGDLRRTLKASGPAIFNLTGGKMCNRNPRTITGEAMAVEAMEKMESPPSPGQVLPVVNEKNIVWGINTLDGLG

SEQ ID NO: 6822 - protein, 70 aa, Secale cereale
MAGGGIFSRALSYVVNEFLVEGLANNRAFQRFAVRTNRTLEDLSTKAKQAREEISEQFKDARGPDDRFKQ

SEQ ID NO: 6823 - protein, 70 aa, Secale cereale
MAGGGIFSRALSYVVNEFLVEGLANNRAFQRFAVRTNRTLEDLSTKAKQAREEISEQFKDVRGPDDRFKQ

SEQ ID NO: 6824 - protein, 70 aa, Triticum aestivum
MAGGGIFSRALSYVVNEFLVEGLANNRAFQRFAVRTNRTLEDLSSKAKQAREEISEQFKDARGPNDRFKQ

SEQ ID NO: 6825 - protein, 70 aa, Triticum aestivum
MAGGGIFSRALSYVVNEFLVEGLANNRAFQRFAVRTNRTLEELSSKAKQAREEISEQFKDARGPNDRFKQ

SEQ ID NO: 6826 - protein, 61 aa, Pseudoroegneria spicata
ALSYVVNEFLVEGLANNRAFQRFAVRTNRTLENLSSKAKQAREEISEQFKDARGPDDRFKQ

SEQ ID NO: 6827 - protein, 70 aa, Saccharum officinarum
MAGGNLFGRALSYVVNEFLVEGLANNRAFQRFAVKTNRTLENLSSKAKEVREELSEQLKEARGEKDHFKQ

SEQ ID NO: 6828 - protein, 70 aa, Pennisetum glaucum
MAGGNLFGRALSYVVNEFLVEGLANNRAFQRFAVKTNRTLENLSSKAKEVREELSEQLKEARGRDDHFRR

SEQ ID NO: 6829 - protein, 70 aa, Sorghum bicolor
MAGGNLFGRALSYVVNEFLVEGLANNRAFQRFAVKTNRTLENLSSKAKEVREELSEQLKEARGEKDHFKH

SEQ ID NO: 6830 - protein, 274 aa, Secale cereale
RPLLILRRSPEPSLPSTRRSRRLMPPLTAAARATSSGGDAFSELASAADFAAIASPEGRISVIGFGSLLSERSARSTFPELEGFRVAALRGFRRVFAHSAPIFFERGIAIEATKEFSSLSVEYCEGEMIIVTVFEIKEEEVPAFIERELEFRFLAVVPEGLDGAPFPHPAVVCARYSDEEYFQVRCKGSKEIYNQHYGRYNIDKIWRDDILPCRLYLRHCVLAAKNLGEPAYSNFVDHTYLGDRRTTIREYLATTGAGIMEEEPPETLRSRYGG

SEQ ID NO: 6831 - protein, 94 aa, Secale cereale
MGSLGPAVSVSMAKASGGTAAVGGQQQQQQPERGTFSCGFRMPLHYPRYRKADYEAMPEWRVDCLLREYGLPVAGDVEDKRRFAMGAFLWPSQY

SEQ ID NO: 6832 - protein, 93 aa, Triticum aestivum
MGSLGPAVSVSMAKANGGTAAVGGQKQQQPERGTFSCGFRMPLHYPRYRKADYEAMPEWRVDCLLREYGLPVAGDVEDKRRFAMGAFLWPGQY

SEQ ID NO: 6833 - protein, 92 aa, Triticum aestivum
MGSLGPAVNVSMAKASGGTAAVGGQQQQQERGTFSCGFRMPLHYPRYRKADYEAMPEWRVDCLLREYGLPVAGDVEDKRRFAMGAFLWPSQY

SEQ ID NO: 6834 - protein, 92 aa, Secale cereale
MGSLGPAVSVSMAKASGGTASVGGQQQQPERSTFSCGFRMPLHYPRYRKADYEAMPEWRVDCLLREYGLPVAGDVEDKRRFAMGAFLWPSQY

SEQ ID NO: 6835 - protein, 94 aa, Secale cereale
MGSLGPAVSVSMAKANGGTAAVGGQKQQQKPERGRFSCGFQMPLHYPRYRKADYEAMPEWRVDCLLREYGLPVTGDVEEKRRFAMGAFLWPGQY

SEQ ID NO: 6836 - protein, 94 aa, Triticum aestivum
MGSLGPAVSVSMAKANGGTAAVGGQKQQRKPERGTFSCGFQMPLHYPRYRKADYEAMPEWRVDCLLREYGLPVTGDVEEKRRFAMGAFLWPGQY

SEQ ID NO: 6837 - protein, 94 aa, Festuca arundinacea
MGSLGPAVSVSMAKANGGAAAVGGQEQQQKMERGMFGCSFRMPLHYPRYKKADYEAMPEWRVDCLLREYGLPVAGDVDDKRRFAMGAFLWPGQY

SEQ ID NO: 6838 - protein, 91 aa, Triticum aestivum
MGSLGPAVSVSMAKANGGKVAVGGQKQQQSGTFSCGFQMPLHYPRYRKADYEAMPEWRVDCLLREYGLPVTGDIEEKRRFAMGALLWPGQY

SEQ ID NO: 6839 - protein, 97 aa, Avena sativa
MGSLGPAVSVGATKANGGTAAIGGAQQLQQQQQAERGMFSCGFRMPLHYPRYKKADYEAMPEWRVDCLLREYGLPVAGDVDHKRRFAMGAFLWPGQY

SEQ ID NO: 6840 - protein, 94 aa, Secale cereale
MGSLGPAVSVSMAKANGGTAAVGGQKQQQKPERGTFSCGFQMPLHYPRYRKADYEAMPEWRVDCLLREYGLPVTGDFEEKRRFAMGRLPLARQY

SEQ ID NO: 6841 - protein, 96 aa, Avena sativa
MGSLGPAVSVAKANGGGAAAVGGVQQLQQQQQAERGMFSCGFRMPLHYPRYKKADYEAMPEWRVDCLLREYGLPVAGDVDHKRRFAMGAFLWPGQY

SEQ ID NO: 6842 - protein, 88 aa, Hordeum vulgare
MGSLGPAVSVRMAKANGGQKQQQKQERGTFSCGFQMPLHYPRYRKADYEAMPEWRVDCLLREYGLPVAGDIEEKRRFAMGAFLWPGQY

SEQ ID NO: 6843 - protein, 93 aa, Avena sativa
MGSLGPAVSMSMAKAKVNGGTAAVAGQQQAERGMSSCSFQMPLHYPRYKKADYEAMPEWRLDGLLREYGLPLAGDFDHKRRFAMGAFLWPGQY

SEQ ID NO: 6844 - protein, 583 aa, Triticum aestivum
MQHRSPAAATASGAASTAAAMEPGVGGVEPAVTLDQVPRWSDPDQRLYTPSSSSATAEAADGGSEPAASTFLSFSDPLTGDDGGAAGGGCASASRLPVDHEINSRIYLWRGHPWNMEVDAVVNSTNESLDEAHSSPGLHAAAGSGLAEECATLGGCRTGMAKMTNAYDLPARKVIHTVGPKYAVKYHTAAENALSHCYRSCLELLIENGLESIAMGCIYTEAKNYPRETAAHVAIRTVRRFLEKQKGKIAGLIFCITSSSDTEIYKRLLPLYFPRDKQEEETAVSKLPADVGDENGETVIDERKIRIRPLPAGAADRTVATAPLDLPLESGLASRSTFKLDSYLDPSFMSLIKDPDLRRKEQWEKSSQAQKGFNYARLLGYGDIGFPPLSAAEEYSLHSRYLAKANSLNLSEIAEMKIIYRGGVDSEGRPVMVVVGAHFLLRCLDLERFVLHVVKEFEPLIQKPYTIVYLHSAASLQPQPDLGFMKRIQQILGRKHQRNLHGIYILHPTLGLRTAILGMQLLIDGEVWKKVVYVDRLVQLFRYVPREQLTIPDFVFQHDLEVNGGRGMIVDPRTKHIYQRPSG

SEQ ID NO: 6845 - protein, 563 aa, Secale cereale
TAPGVSCVEPAVTLDQVPRWSDPDQRLYTPSSSPAAAEAADGGSEPAASSFLSFSDPLTGDDGGAAGGGCAGASRFPVDHEINSRIYLWRGHPWNMEVDAVVNSTNESLDEAHSSPGLHAAAGSGLAEECATLGGCRTGMAKMTNAYDLPARKVIHTVGPKYAVKYHTAAENALSHCYRSCLELLIENGLESIAMGCIYTEAKNYPREPAAHVAIRTVRRFLEKQKGKIAGVIFCITSSSDTEIYKRLLPLYFPRDKQEEETAVSKLPADVGDENGETVIDERKIRIRPLPAGAADRTVATAPLDLPLESGLASRSTFKLDSYLDPSFMSLIKDPDLRRKEQWEKSSQAQKGFNYARLLGYGDIGFPPLSAAEEYSLHSRYLAKANSLNLSEIAEMKIIYRGGVDSEGRPVMVVVGAHFLLRCLDLERFVLHVVKEFEPLIQKPYTIVYLHSAASLQPQPDLGFMKRVQQILGRKHQRNLHGIYILHPTLGLRTAILGMQLLIDGEVWKKVVYVDRLVQLFRYVPREQLTIPDFVFQHDLEVNGGRGMIVDPRTKHIYQRPSG

SEQ ID NO: 6846 - protein, 583 aa, Brachypodium distachyon
MQHRSPAAAMDSGTGPASTMAPGLGGVEPAVTLDQVPRWSDPDQRLYTPSSSSAAAEAADGGSEPAPSAFLSFSDPLTGDDGGAAGGGHAAASRFPVDHEINSRIYLWRGHPWNLEVDAVVNSTNESLDEAHSSPGLHAAAGSGLAEECTTLGGCRTGMAKMTNAYDLPARKVIHTVGPKYAVKYHTAAENALSHCYRSCLELLIENGLESIAMGCIYTEAKNYPREPAAHVAIRTVRRFLEKQKSKIAGVVFCTTSSSDTEIYKRLLPLYFPRDKQEEEIAISKLPADVGDENGETVIDERKIRIMPLPAGVTDRIVATAPLALPLDSAMASKRGSFKLDSYLDPSFMSLIKDPDLRRKEQWEKSSQAQKGFNYARLLGYGDLGFPSLSAAEEYSLHSRYLAKANSLNLSEIAEMKIIYRGGVDSEGRPVMVVVGAHFLLRCLDLERFVLHVVKEFEPLIQKPYTIVYLHSAASLQPQPDLGFMKRIQQILGRKHQRNLHGIYILHPTLGLRTAILAMQLLVDGEVWKKVVYVDRLVQLFRYVPREQLTVPDFVFQHDLEVNGGRGLIVDPRTKHIYQRPSG

SEQ ID NO: 6847 - protein, 594 aa, Oryza sativa
MQHRSPAAATASSGPVAAAASAAMAVPGVGGIEPAVTLDQVPRWSDPDQRLYAPSSSSAAAAGGVEAGEGGGSEPAASAFLSFSDPLTGDDGGGVTGGGRGGASRFPVDHEINSRIYLWRGHPWNLEVDAVVNSTNESLDESHSSPGLHAAAGSGLAEECSTLGGCRTGMAKMTNAYDLPARKVIHTVGPKYAVKYHTAAENALSHCYRSCLELLIENGLESIAMGCIYTEAKNYPREPAAHVAIRTVRRFLEKQKSKIAGVVFCTVSSSDTEIYKRLLPLYFPRDRQEEEIAVSKLPADVGDENGETVIDERKIRIRPLPAGATDRAATTAPIDLPFDSGLASKRSSFKLDSYLDPSFMSLIKDPDLRRKEQWEKSAQAQKGFNYAKLLGYGDLACPSLSAAEEYSLHSRYLAKANSLNLSEIAEMKIIYRGGVDSEGRPVMVVVGAHFLLRCLDLERFVLHVVKEFEPLIQKPYSIVYFHSAASLQPQPDLGFMKRLQQILGRKHQRNLHAIYVLHPTLGLRTAILAMQMFVDGEVWKKVVYVDRLVHLFRYVPREQLTIPDFVFQHDLEVNGGRGLIVDPRTKHIYQRPSG

SEQ ID NO: 6848 - protein, 577 aa, Setaria italica
MLPRSPPSAAAGAMVPGVGGVEPAVTLDRVPRWSDPDQRIFPSASDETSSAEGGGSEPPVASGFLSFSDPLTGDGAGGGGRGGASRFPVDQEINSRIYLWRGHPWNLEVDAVVNSTNESLDEAHSSPGLHAAAGSGLAEECATLGGCRTGMAKMTNAYDLPARKVIHTVGPKYAVKYHTAAENALSHCYRSCLELLIENGLESIAMGCIYTEAKNYPREPAAHVAIRTVRRFLEKQKGNIAGVVFCTTSSSDTEIYKRLLPLYFPRDKQEEEIAVSKLPADVGDENGETVIDERKIRIRPLPAGVVDRTVTAAPIDLPLSDSGSALKRASFKLDSYLDPSFMSIIKDPDLRRREQWEKSAQAQKGFNYARLLGYGDLGCPSLSAAEEYSLHSRYLAKANSLNLSEIAEMKIIYRGGVDIEGRPVMVVVGAHFLLRCLDLERFVLHVVKEFEPLIQKPYTIVYLHSAASLQPQPDLGFMKRLQQILGRKHQRNLHAIYVLHPTLGLRTAVLAMQMFVDGEVWKKVVYVDRLVQLFRYVPREQLTIPDFVFQHDLEVNGGKGLIVDPRTKHIYQRASSS

SEQ ID NO: 6849 - protein, 584 aa, Sorghum bicolor
MQPRSPAVAEAAGAGATMVPGVGGVEPAVTLDQVPRWSDPDQRIFLASASDEASAEGAGSEATSASGFISFSDPLTVDDDDGAGAGGRAGAASRFPVDQEINSRIYLWRGQPWNLEVDAVVNSTNESLDEAHSSPGLHAAAGSGLAEECATLGGCRTGMAKMTNGYDLPARKVIHTVGPKYAVKYHTAAENALSHCYRSCLELLIENGLESIAMGCIYTEAKNYPREPASHVAIRTVRRFLEKQKGKIAGVVFCTTSSSDTEIYKRLLPLYFPRDKQEEEIAILKLPADVGDENGETVIDERKIRIRPLPAGVVDRTVSATLVDLPLSDSGSALKRGSFKLDSYLDPSFMSIIKDPDLRRKEQWEKSAQAQKGFNYARLLGYGDLGCPSLSSAEEYSLHSRYLAKANSLNLSEIAEMKIIYRGGVDIEGRPVMVVVGAHFLLRCLDLERFVLHVVKEFEPLIQKPYTIVYFHSAASLQPQPDLGFMKRLQQILGRKHQRNLHAIYVLHPTLGLRTAVLAMQMFVDGEVWKKVVYVDRLVQLFRYVPREQLTIPDFVFQHDLEVNGGRGLIVDPRTKHIYQRTSS

SEQ ID NO: 6850 - protein, 583 aa, Zea mays
MQPRSPPPSEAPAPSDAIMMPGVGGVEPAVTLGQVPRWSDPDQRIFLASTSEEASAEDDGSGTTSASGFISFSDPLTVDDGAVGGGHAGGASRFPVDQEINSRIYLWRGQPWNLEVDAVVNSTNESLDEAHSSPGLHAAAGSGLAEECATLGGCRTGMAKMTNAYDLPARKVIHTVGPKYAVKYHTAAENALSHCYRSCLELLIENGLESIAMGCIYTEAKNYPREPAAHVAIRTVRRFLEKQKDKIAGVVFCTTSSSDTEIYKRLLPLYFPRDKQEEYIAIVKLPADVGDENGETAIDERKIRIRPLPAGVLDRTVSANLVDLPLSNSGSALKRGSFKLDSYLDPSFMSIIKDPDLRRKEQWEKSAQAQKGFNYARLFGYGDLGCPSLSAAEEYSLHSRYLTKANSLNLSEIAEMKIIYRGGVDIEGRPVMVVVGAHFLLRCLDLERFVLHVVKEFEPLIQKPYTIVYFHSAASLQPQPDLGFMKRLQQILGRKHQRNLHAIYVLHPTLGLRTAVLAMQMFVDGEVWKKVVYVDRLVQLFRYVPREQLTIPDFVFQHDLEVNGGRGLIVDPRTKHIYQRTSS

SEQ ID NO: 6851 - protein, 582 aa, Setaria italica
MQHRSPSAASASASPTASSAAASPMAPGVGGVEPAVTLDQVPRWSDPDQRISPLSPTSAGSETPPSSFLSFSDPLTGDDAAAGPGGRGASRFPVDHEINSKIYLWRGHPWNLEVDAVVNSTNENLDEAHSSPGLHAAAGPGLAEECATLGGCRTGMAKMTNAYDLPARKVIHTVGPKYAVKYHTAAENALSHCYRSCLELLIENGLDSIATGCIYTEAKNYPREPAAHVAIRTVRRFLEKQKDKIRAIVFCTTSSSDTEIYKRLLPLYFPRDKHEEEIAALKLPADVGDENGETVIDERKIRIKPLPAGAANSKTPIPTLADIPLPDSGLTRRRNSFKLDSYLDPAFMSIIKDPDLRRKEQWEKSAQANKGINFANLLGFGDLGSPPLSAAEEYSLHSRYLAKANSMNLSDIAEMKIIYRGGVDSEGRPVMVVVGAHFLLRCLDLERFVLYVVKEFEPLIQKPYSIVYLHSAASLQPQPDLGFMKRLQQILGRKHQRNLHAIYVLHPTLGLRTAILAMQLFVDGEVWKKTVYIDRLVQLFRYVPREQLTIPDFVFQHDLEVNGGKGIIVDPRTKHVYQRPSG

SEQ ID NO: 6852 - protein, 579 aa, Zea mays
MQHRSPEAASASASPTAAAVEAMAPGVGGVEPAVTLDQVPRWSDPDQRISLLSPTAAGSETPASSFLSFSDPLTGDDAAAGAGGRGASRFPVDYEINSKIYLWRGHPWNLEVDAVVNSTNENLDEAHSSPGLHAAAGSGLAEECATLGGCRTGMAKMTNAYDLPARKVIHTVGPKYAVKYHTAAENALSHCYRSCLELLIENGLESIATGCIYTEAKNYPREPAAHVAIRTVRRFLEKQKDKITAIVFCTISSSDTEIYKRLLPLYFPRDKQEEEIAALKLPADVGDENGETVIDERKIRIKPLPAGEANSKTPIPTLADIPLPDSSLTRRRNSFKLDSYLDPAFMSIIKDPDLRRKEQWEKSQANKGLNLANMLGFGDLGSPPLSAAEEYSLHSRYLAKANSMNLSDVAEMKIIYRGGVDSEGRPVMVIVGAHFLLRCLDLERFVLYVVKEFESLIQKPYTIVYFHSVASLQPQPDLGFMKRLQQILGRKHKKNLHTIYILHPTLGLRTAVMAMQLFVDGEVWKKVVYVDRLVQLFRYVPREQLTIPDFVFQHDLEVNGGKGIIVDPRTKHIYQRPSG

SEQ ID NO: 6853 - protein, 580 aa, Sorghum bicolor
MQHRSPEAASASASPTAAAAAAMAPGVGGVEPAVTLDQVPRWSDPDQRISPLSPTAAGSETPPSSFLSFSDPLTGDDAAAGAGGRGASRFPVDHEINSKIYLWRGHPWSLEVDAVVNSTNENLDEAHSSPGLHAAAGTGLAEECATLGGCRTGMAKMTNAYDLPARKVIHTVGPKYAVKYHTAAENALSHCYRSCLELLIENGLESIATGCIYTEAKNYPREPAAHVAIRTVRRFLEKQKDKITAIVFCTISSSDTEIYKRLLPLYFPRDKQEEEIAALKLPADVGDENGETVIDERKIRIKPLPAGAENSKTPIPTLADIPLPDSRLTRRRNSFKLDSYLDPAFMSIIKDPDLRRKEQWEKSAQANKGLNLANMLGFGDLGSPPLSAAEEYSLHSRYLAKANSMNLSDVAEMKIIYRGGVDSEGHPVMVVVGAHFLLRCLDLERFVLYVIKEFEPLIQKPYSIVYFHSAASLQPQPDLGFMKRLQQILGRKHQKNLHTIYILHPTLGLRTAVMAMQLFVDGEVWKKVVYVDRLVQLFRYVPREQLTIPDFVFQHDLEVNGGKGIIVDPRTKHVYQRPSG

SEQ ID NO: 6854 - protein, 395 aa, Oryza sativa
MQQRSPTAASASASASSVAAAAGVGGVEPAVTLDQVPRWSDADQRLSPSSSPTAAGSDETPASSFLSFADPLIGDGAAAGAGGRGASRFPVDHEINSKICLWRGHPWNLEVDAVVNSTNENLDEAHSSPGLHAAAGPGLAEECTTLGGCRTGMAKMTNAYDLPARKVIHTVGPKYAVKYHTAAENALSHCYRSCLELLIENGLESIAMGCIYTEAKNYPREPAAHVAIRTVRRFLEKQKGKITAVVFCTTTSSDTEIYKRLLPLYFPRDKKEEEIASLKLPADVGDENGETIIDERKIRIKPLPAGSAINKSAAPAPVDIPLSDSGLTRSRNSFKLDSYLDPAFMSLIKDPDLRRKEQLEKSVQANKGFNWAKLVGFGDLGGPPLSAAEDYSLHS

SEQ ID NO: 6855 - protein, 578 aa, Brachypodium distachyon
MQNRSPAAASASASPTAAAAVMVPSVGGVEPAVTLDQVPRWSDPDQRLYSSSPTAAGSETAASPFLSFADPLTGDDAASGAGGRGAARFPVDHEVNSKLYLWRGHPWNLEVDAVVNSTNESLDEAHSSPGLHASAGPGLAEECATLGGCRTGMAKMTNAYDLPARKVIHTVGPKYAVKYHTAAESALSHCYRSCLELLVENGLESIAMGCIYTEAKNYPREPAAHVAIRTVRRFLEKQKDKISALVFCTTSSSDTEIYKRLLPLYFPRDKQEEVIASVKLPADVGDENGEPIIDERKIRIKTLPAEATNSKYAVSPPADIPLAGSGLTRRRNSKLDSYLDPAFMSIIKDPDLRRKEQWEKSAQASKGFNCAKLLGFGDLAGPPLSAAEEYSLHSRYLAKANSLNLSEIAEMKIIYRGGVDSEGRPIMVVVGAHFLLRCLDLERFVLYVVKEFEPLIQKPYSIVYFHSAASLQVQPDLGFMKRLQQMLGRKHQRNLHAIYVLHPTLGLRTAILALQLFVDGDVWKKVVYVDRLMQLFRYVPREQLTIPDFVFQHDLEVNGGRGIIVDPRTKHVYQRPSG

SEQ ID NO: 6856 - protein, 491 aa, Triticum aestivum
ASRLPVDHEINSRIYLWRGHPWNMEVDAVVNSTNESLDEAHSSPGLHAAAGSGLAEECATLGGCRTGMAKMTNAYDLPARKVIHTVGPKYAVKYHTAAENALSHCYRSCLELLIENGLESIAMGCIYTEAKNYPREPAAHVAIRTVRRFLEKQKGKIAGVIFCITSSSDTEIYKRLLPLYFPRDKQEEETAVSKLPADVGDENGETVIDERKIRIRPLPAGAADRTVATAPLDLPLESGLASRSTFKLDSYLDPSFMSLIKDPDLRRKEQWEKSSQAQKGFNYARLLGYGDIGFPPLSAAEEYSLHSRYLAKANSLNLSEIAEMKIIYRGGVDSEGRPVMVVVGAHFLLRCLDLERFVLHVVKEFEPLIQKPYTIVYLHSAASLQPQPDLGFMKRIQQILGRKHQRNLHGIYILHPTLGLRTAILGMQLLIDGEVWKKVVYVDRLVQLFRYVPREQLTIPDFVFQHDLEVNGGRGMIVDPRTKHIYQRPSG

SEQ ID NO: 6857 - protein, 555 aa, Secale cereale
MAPGVGGVEPAVALDQVPRWSDPDQRLHSPSSPTAAGSEAPASSFLSFADPLDAAAGAGGHGACRFPVDPEVNSRIYLWRGHPWNLEVDAVVNSTNESLDEAHSSPGLHAAAGPELAEECATLGGCRTGMAKMTNAYDLPARKVIHTVGPKYAVKYHTAAESALSHCYRSCLELLVENGLESIAMGCIYTEAKNYPREPAAHVAIRTVRRFLEKQKDKITAVVFCTTSSTDTEIYKRLLPLYFPRDKQEEEIASLKLPADVGDENGEPIIDERKIRIKTLPAEAANSKYAVPVPADIPLSGSGLTRRRNSKLDSYLDPSFMSIIKDPDLRRKEQWEKSAQARKGFNFAKLLGFGDLGGPALTAAEEYSLHQRYLAKANSLNLSEIAEMKIIYRGGVDSEGRPIMVVVGAHFLLRCLDLERFILYVVKEFEPLIQKPYSIVYFHSAASLQVQPDLGFMKRLQQMLGRKHQRNLQAIYVLHPTLGLRTAILALQLLVDGDVWKKVVYVDRLMQLFRYVPREQLTIPDFVFQHDLEVNGGKGIIVDPRTKHVYQRPSG

SEQ ID NO: 6858 - protein, 556 aa, Triticum aestivum
GGHGARRGRGRAGRGARPGPALERPRPALPLALLPHRGRIRGPRLLLPLLRRPARRGRGGGHGACRFPVDPEVNSRIYLWRGHPWNLEVDAVVNSTNESLDEAHSSPGLHAAAGPELAEECATLGGCRTGMAKMTNAYDLPARKVIHTVGPKYAVKYHTAAESALSHCYRSCLELLVENGLESIAMGCIYTEAKNYPREPAAHVAIRTVRRFLEKQKDKITAVVFCTISSTDTEIYKRLLPLYFPRDKQEEEMASLKLPADVGDENGEPIIDERKIRIKTLPAEAANSKYAVPVPADIPLSGSGLTRRRNSKLDSYLDPSFMSIIKDPDLRRKEQWEKSAQAKKGFNFAKLLGFGDLGGPALSAAEEYSLHQRYLAKANSLNLSEIAEMKIIYRGGVDSEGRPIMVVVGAHFLLRCLDLERFILYVVKEFEPLIQKPYSIVYFHSAASLQVQPDLGFMKRLQQMLGRKHQRNLQAIYVLHPTLGLRTAILALQLLVDGDVWKKVVYVDRLMQLFRYVPREQLTIPDFVFQHDLEVNGGKGIIVDPRTKHVYQRPSG

SEQ ID NO: 6859 - protein, 362 aa, Triticum aestivum
MKHCFSLAAALAVVTLAALLSSDAVVACIDVGFYDRTSPSAETLVQQTVAAAFGNDSGVPPAIIRLHFHDCFVKGCDGSVLIDSTPGNKAEKDSAPNFPSLRFFDVVDRAKAALEAQCPGVVSCADVLAFAARDSVVLSGGLGYQVPAGRRDGRVSTETDALNNLPGPTSTASDLVAGFAAKNLTVEDIVVLSGAHNIGVSHCSSFTERIYNFPNTTDGIDPKLSKAYAFLLKGICPPNSNQTFPTTTTLMDLITPARFDNKYYVGLTNNLGLFQSDAALLTNATMKSLVDSFVRSEAAFRTRFARSMLKMGQIEVLSGAQGEIRRNCRVINPTNVTSAGAVHHHLLPRSSASSGSNQVAAS

SEQ ID NO: 6860 - protein, 363 aa, Secale cereale
SCLSSPSSVGRWLVVTLAALLSSDAVVACIDVGFYDRTCPSAETLVQQTVAAAFGNDSGVAPAIIRLHFHDCFVKGCDGSVLIDSTPGNKAEKDSAPNFPSLRFFDVVDRAKAAVEARCPGVVSCADVLAFAARDSVVLSGGLGYQVPAGRRDGRVSTEANALNNLPGPTSTASDLVAGFAAKNLTVEDIVVLSGAHTIGVSHCSSFTERIYNFPNTTDGIDPKLSKAYAFLLKGICPPNSNQTFPTTTTLMDLVTPARFDNKYYVGLTNNLGLFQSDAALLTNATMKSLVDSFVRSEAAFRTRFARSMLKMGQIEVLSGAQGEIRRNCRVINPTNATSTGAVHHHLLPRSSGSSGSNQVAAS

SEQ ID NO: 6861 - protein, 568 aa, Hordeum vulgare
MACSCAHGVEFDANVIRNSALEDGLAGWAAVGACTELSVRHEESARVPTETINDVEDGYRPSGRYILAAGRGGEEDGLCQAIPAGALKPRVTYRVAGWIGLGDGAAGEHAVRVNIRLDGGEGGECAMVVEGGAVCAEAGRWTEIKGVFRLKAIPPSGAAVHVQGAPPGVDVKVMDLQVFATDRKARFKKLRKKTDKVRRRDVVLKFAGAGASSAVSGASIRVMQMDTSFAFGACINPAVIQEPAFVDYFTKHFDWAVFENELKWYHTEAVQGQLNYADPDALLDFCDRHGKPVRGHCIFWAVDRMVQKWVKDLPNDQLAAAVQGRLTSLLTRYAGRFPHYDVNNEMLHGTFFQDRLGDDINAFMFKETARIDPGAALFVNDYNVEGGSDPSATPDKYIAQVNALMEKGAPVGGIGLQGHVTNPAGEIICDALDKLATTDLPVWLTELDVCESDVCLRAEDLEVVLREAYAHPAVEGVVLWGFMQGHMWRQDACLVNADGTINDAGQRFINLRQEWTSHARGKIDSDGNFKFRGYHGSYVVQLATATGKMHKAFSVDKGDTPLVLDMDV

SEQ ID NO: 6862 - protein, 380 aa, Brassica rapa
METQGKVITCRAAVAWGAGEALVMEDVKVDPPQRLEVRLRILFTSICHTDLSAWKGENEAQQAYPRILGHEAAGIVESVGEGVEDMKAGDHVLPIFTGECGDCRVCKRDGANLCERFRVDPMKKVMVGDGKTRFFTSKDNKPIYHFLNTSTFSEYTVIDSACVVKVDPRFPLEKMSLLSCGVSTGVGAAWNVADIQPGSTVAIFGLGAVGLAVAEGARAKGASKIIGIDVNPDKFSLGREVGISEFINPKESDKTVHERVMEITEGGVEYSFECAGRIEALREAFLSTNSGVGVTVLLGVHASPQLLPIHPMELFQGRSITASVFGGFKPKTQLPLLFTQCLQGQLNLDLFISHQLPFSDINEAMQLLHQGKALRCLLRL

SEQ ID NO: 6863 - protein, 380 aa, Brassica juncea
METQGKVITCRAAVAWGAGEALVMEDVKVDPPQRLEVRLRILFTSICHTDLSAWKGENEAQQAYPRILGHEAAGIVESVGEGVEDMKAGDHVLPIFTGECGDCRVCKREGANLCEKFRVDPMKKVMVGDGKTRFFTSKDNKPIYHFLNTSTFSEYTVIDSACVVKVDPRFPLEKMSLLSCGVSTGVGAAWNVADIQPGSTVAIFGLGAVGLAVAEGARAKGASKIIGIDVNPDKFPLGREVGINEFINPKESDKTVHERVMEITEGGVEYSFECAGRIEALREAFLSTNSGVGVTVMLGVHASPQLLPIHPMELFQGRSITASVFGGFKPKTQMPLLFTQCLQGQLNLDLFISHQLPFKDINKAMQLLHQGKALRCLLRL

SEQ ID NO: 6864 - protein, 380 aa, Raphanus sativus
  misc_feature (377)..(377): Xaa can be any naturally occurring amino acid
METQGKVITCRAAVAWGAGEALVMEDVKVDPPQRLEVRLRILFTSICHTDLSAWKGENEAQQAYPRILGHEAAGIVESVGEGVEDMKAGDHVLPIFTGECGDCRVCKRDGANLCERFRVDPMKKVMVGDGKTRFFTSKDNKPIYHFLNTSTFSEYTVIDSACVVKVDPRFPLEKMSLLSCGVSTGVGAAWNVANIQPGSTVAIFGLGAVGLAVAEGAKARGASKIIGIDINPDKFPLGREVGISEFINPKECDKTVHERVMEITEGGVEYSFECAGRIEALREAFLSTHSGVGKTVLLGVHASPQLLPIHPMELFQGRSITASVFGGFKPKTQLPLLFNQCLQGQLNLDLFISHQLPFNDINKAMQLLHQGKALRCXIRL

SEQ ID NO: 6865 - protein, 381 aa, Eutrema parvulum
METQGKVITCRAAVAWGAGEALQMEDVKVVPPQRLEVRLRILFTSICHTDLSAWKGENEAQQAYPRILGHEAAGIVESVGEGVEEMKAGDHVLPIFTGECGECRVCKRDGANLCERFRVDPMKKVMVSDGKTRFFTSKDNKPIYHFLNTSTFSEYTVVDSACVVKVDPLFPLEKMSLLSCGVSTGVGAAWNVANIQPGSTVAVFGLGAVGLAVAEGARARGASKIIGIDVNPDKFPLGREVGISEFINPKESDKAVHERMMEITEGGGVEYSFECAGNIGALREAFLSTNSGVGVTVLLGVHASPQLLPIHPMELFQGRSITASVFGGFKPKTQLPLFITQCLQGLLNLELFISHQLPFHDINKAMQLLHQGKALRCLLRL

SEQ ID NO: 6866 - protein, 380 aa, Arabidopsis lyrata
METQGKVITCRAAVAWGAGEPLVMEDVKVDPPQRLEVRLRILFTSICHTDLSAWKGENESQRAYPRILGHEAAGIVESVGEGVEEMKAGDHVLPIFTGECGDCRVCKQDEANLCERFRVDPMKKVMVTDGKTRFFTSKDNKPIYHFLNTSTFSEYTVIDSACVLKVNPLFPLEKISLLSCGVSTGVGAAWNVADIQPGSTVAIFGLGAVGLAVAEGARVRGASKIIGIDVNPDKFPLGREAGISEFINPKESDKAVHERVREITEGGVECSFECAGSIEALREAFLSTNSGVGVTVLLGVHASPQLLPIHPMELFQGRSITASVFGGFKPKTQLPFLITQCLQGLLNLDLFISHQLPFHDINKAMQLLHQGKAIRCLLRL

SEQ ID NO: 6867 - protein, 380 aa, Arabidopsis thaliana
METQGKVITCKAAVAWGAGEPLVMEDVKVDPPQRLEVRIRILFTSICHTDLSAWKGENEAQRAYPRILGHEAAGIVESVGEGVEEMMAGDHVLPIFTGECGDCRVCKRDGANLCERFRVDPMKKVMVTDGKTRFFTSKDNKPIYHFLNTSTFSEYTVIDSACVLKVDPLFPLEKISLLSCGVSTGVGAAWNVADIQPASTVAIFGLGAVGLAVAEGARARGASKIIGIDINPDKFQLGREAGISEFINPKESDKAVHERVMEITEGGVEYSFECAGSIEALREAFLSTNSGVGVTVMLGVHASPQLLPIHPMELFQGRSITASVFGGFKPKTQLPFFITQCLQGLLNLDLFISHQLPFHDINEAMQLLHQGKALRCLLHL

SEQ ID NO: 6868 - protein, 381 aa, Eutrema halophilum
MEKQGKFITCRAAVAWRAGEDLVMEDVKVDPPQRLEVRLRILFTSICHTDLSAWKGENMAQQAYPRILGHEAAGIVESVGEGVENIQAGDHVLPIFTGECGECRVCKRDGANLCERFRVDPMKKVMVSDGKTRFFTSKDNKPIFHFLNTSTFSEYTVIDSACVVKVDPLFPLEKMSLLSCGVSTGVGAAWNVADIQPGSTVAVFGLGAVGLAVAEGARARGASKIIGIDVNPDKFPLGREAGISEFINPKESDKAVHERVMEITEGSGVEYSFECAGSIEALRESFLSTNSGVGVTVLLGVHASPQLLPIHPMELFQGRSITASVFGGFKPKTQLPLFITQCLQGLVNLDLFISHHLPFHDINKAMQLLHQGKALRCLLRL

SEQ ID NO: 6869 - protein, 417 aa, Gossypium raimondii
MSFSEFRPLDENSLIEYIKATPSLSSKIGHNYDGLKIKEVGDGNLNFVYIIVAPSGSFVIKQALPYIRCIGESWPMTKERAYFEVLALKQHGALCPEHVPEVYHFDRTMSLIGMRYLEPPHIILRKGLIAGIEYPLLAEHMSEYMAKTLFCTSLLYRSTTEHKRAVAEFCGNVELCRLTEQVVFSDPYKVSEYNRWTSPYLDRDAETVREDNLLKIEVAELKSKFCERAQALIHGDLHTGSVMVTPDSTQVIDPEFAFYGPMGFDIGAFIGNLILAFFAQDGHAGQGNDRKSYKEWILKTIEDTWNLFHQKFTALWDEHKNGSGEAYLPAIYNNPELQKLIQEKYMKELFHDTLGFGAAKMIRRIVGVAHVEDFESIKEANIRADCERRALELGKTLLKRRREFVSISEVISAMKHV

SEQ ID NO: 6870 - protein, 419 aa, Gossypium hirsutum
MAFSEFRPLDEKSLIEYIKATPSLSSKIVDNYDGLKIKEVGDGNLNFVYIIVAPSGSFVIKQALPYIRCIGESWPMTKERAYFEVLALKQHGALCPEHVPEVYHFDRTMSLIGMRYLEPPHIILRKGLIAGIEYPLLAEHMSEYMAKTLFCTSLLYRSTTEHKRAVAEFCGNVELCRLTEQVVFSDPYKVSEYNRWTSPYLDRDAETVREDNLLKIEVAELKSKFCERAQALIHGDLHTGSVMVTPDSTQVIDPEFAFYGPMGFDIGAFIGNLILAFFAQDGHAGQGNDRKSYKEWILKTIEDTWNLFHQKFTALWDEHKNGSGEAYLPAIYNNPELQKLIQEKYMKELFHDTLGFGAAKMIRRIVGVAHVEDFESIKEANIRADFEQRALELGKTLLKRRREFVSISEVISAMKHVQS

SEQ ID NO: 6871 - protein, 419 aa, Gossypium raimondii
MAFSEFRPLDENSLIEYIKATPSLSSKIVDNYDGLKIKEVGDGNLNFVYIIVAPSGSFVIKQALPYVRLIGESWPMTKERAYFEALALKQHGALCPEHVPEVYHFDRTMSLIGMRYLEPPHIILRNGLIAGIEYPLLAEHMSEYMAKTLFCTSLLYRSTTEHKRAVAEFCGNVELCRLTEQVVFSDPYKVSEYNRWTSPYLDRDAETVREDNLLKIEVAELKSKFCERAQALIHGDLHTSSVMVTPDSTQVIDPEFAFYGPMGFDIGAFIGNLILAFFAQDGHAGQGNDRKSYKEWILKTIEDTWNLFHQKFTALWDEHKNGSGEAYLPAIYNNPELQKLIQEKYMKELFHDTLGFGAAKMIRRIVGVAHVEDFESIKEANIRADCEQRALELGKTLLKRRREFVSISEVISAMKHVQS

SEQ ID NO: 6872 - protein, 419 aa, Theobroma cacao
MAFSEFRPLNEKSLVEYIKATPSLSSKIGDKYDDLKIKEVGDGNLNFVYIIVGASGSFVIKQALPYIRCIGESWPMTKERAYFEAIALKEHGGLCPQHVPEVYHFDRTMSLIGMRYIEPPHIILRKGLIAGIEYPLLAEHMSEYMAKTLFCTSLIYRSTTEHKRAVAEFCGNVELCRLTEQVVFSDPYKVSEYNRWTSPYLDHDALAVREDDILKLEVAELKSKFCERAQALIHGDLHTGSIMVTRDSTQVIDPEFAFYGPMGFDIGAFIGNLILAFFAQDGHADQVNDRKIYKEWILKTIEDTWNLFHQKFTALWDQHKDGSGEAYLPAIYNNPELQKLIQEKYMKELFHDTLGFGAAKMIRRIVGVAHVEDFESIREASIRADCERQALELAKTLLKKRQEFLSIGEVISAITHAQL

SEQ ID NO: 6873 - protein, 436 aa, Theobroma cacao
MAFPEFRPLDEKSLVEYIKVTPFLSSKIGDKYDDIKIKEVGDGNLNFVYIVVGASGSFVIKQALPYVRSLTESWPMTKERAYFEAVALKEHGGLCPRHVPEVYHFDRTMSLIGMRYLEPPHIILRKGLIAGIEYPFLAEHVSVYMAKTLFCTSLLYRSTTEHKRADNVVIPNVMALERNASVLAEFCGNVELCRLTEQVVFSDPYKVSEYNRWTSPYLDHDAEAVRDDVILKLEVAELKSKFCERAQALIHGDLHTGSVMVTRDSTQVIDPEFAFYGPMGYDIGAFIGNLILAFFAQDGHADQGNDRKIYKEWILKTIEDTWNLFHQKFTALWDQHKDGPGEAYLPAIYNNPELQKLIQEKYMKELFHDTLGFGAAKMIRRIVGVAHVEDFESIKEASIRADCERRALELAKTLLKRRREFLSISEVISAIRHVQS

SEQ ID NO: 6874 - protein, 360 aa, Fagus grandifolia
MAFSEFRPLDEKSLIEYIKAVPALNSKLGNNLDDLKVQEVGDGNLNFVYLVVAPGGSFVIKQALPYIRCIGESWPMTKERAYFEAVALKEQGRLSPEHVPEVYHFDRTMSLIGMRYLEPPHIILRKGFIAGIEYPLLAEHMSEFMAKTLYFTSLLYRSTTEHKRDVAEFCGNVELCRLTEQVVFSDPYKVSQYNRWTSPHLDRDAEAVREDNVLKLEVAELKSKFCERAQALIHGDLHTGSVMVTRESTQVIDPEFAFYGPMGFDIGAFVGNLILAFFAQDGHADQVNDRKTYKEWILRTIEETWNLFHKKFIALWDEHKDGSGEAYLPAIYNNPELQQLVQKNLWKIYSMTPLDLVLPK

SEQ ID NO: 6875 - protein, 419 aa, Citrus clementina
MAFTEFRPLDDKSLLEYIKATPSLSSKIGNKFDDLTIKEVGDGNLNFVYIVVGTSGSFVIKQALPYVRCIGESWPMTKERAYFEALALKEHGKLCPDHVPEVYHFDRTMSLIGMRYLEPPHIILRKGLIAGIKYPLLAEHMSEFMAKTLFYTSLLYRTTTEHKRNVAEFCGNVELCRLTEQVVFSDPYKVSKFNHWTSPYLDRDAEAVREDNTLKLEVAGLKSMFCERAQALIHGDLHTGSVMVTPNSTQVIDPEFAFYGPMGFDIGAFVGNLILAFFAQDGHAAEGNDRKEYKEWILRTIEETWTLFHQKFTALWHQHKDGSGEAYLPEIYNKPELQQLVQEKFMKDLFHDTLGFGAAKMIRRIVGVAHVEDFESIKDDSKRATCERQALELAKLLLKERRNFQAITEVVSAIRKLHA

SEQ ID NO: 6876 - protein, 419 aa, Quercus alba
MAFTEFRPLDEKSLIEYIKTVPALHSKLGNNLDDIKVKEVGDGNLNFVFIIVGPDGSFVIKQALPYIRCIGESWPMTKERAYFEAVALREEARLSPEHVPEVYHFDRTMSLIGMRYLEPPHIILRKGLIAGIEYPLLAEHISEFMARTLYFTSLLHRSTTEHKRAVAEFCGNVELCRLTEQVVFSDPYKVSEYNRWTSPFLDLEAEAIRKDNILKLEVAELKSKFCERAQALIHGDLHTGSVMVTRESTQVIDPEFAFYGPMGFDIGAFLGNLILAFFAQDGHADQANDRKTYKEWILRTIEETWNLFRKKFIALWDEHKDGSGEAYLPAIYNNPELQQLVQEKFMDDLFHDTLGFGAAKMIRRIVGVAHVEDFESITDASRRADCELRALEVAKLLLKERRKFHAITEVISAMQKFQS

SEQ ID NO: 6877 - protein, 416 aa, Manihot esculenta
MAFSEFRPLDEKSLIEYIKATPVLSNKVGRNYDDLKIKEVGDGNLNFVYIVVGSAGSFVIKQALPYIRCIGESWPMTKERAYFEALALKVHGQLCPEHVPEVYHFDRTMSLIGMRYLEPPHIILRKGLIAGIKYPYLAEHMSTYMSKTLFYTSLLYRTTTEHKRDVAEFCGNVELCRLTEQVIFSDPYKVSQYNHWTSPYLDRDAEAVREDNVLKLEIAELKSKFCERAQALIHGDLHTGSVMVTSDSTQVIDPEFAFYGPMGFDVGAFIGNLFLAYFAQDGHADSFDDRRSYKEWILRMTEGTWNLFHKKFTAFWDKHKDGPGEAYLPAIYNNPELQQIVQEKFMKDLFHDTLGFGAAKMIRRIVGVAHVEDFESIKDDSKRAECERKALDFAKLLLKERRRFQSINEVVSAIPA

SEQ ID NO: 6878 - protein, 417 aa, Castanea mollissima
MAFTEFRPLDEKSLIEYIKTVPALHSRLGNNLDDIKIKEVGDGNLNFVYIIVGPDGSFVIKQALPYIRCIGESWPMTKERAYFEAVALREQARLSPEHVPEVYHFDRTMSLIGMRYLEPPHIILRKGLIAGIEYPLLAEHISEFMARTLYFTSLLHRSTTEHKRAVAEFCGNVELCRLTEQVVFSDPYKVSEYNRWTSPFLDLEAEAVRKDNILKLEVAELKSKFCERAQALIHGDLHTGSVMVTRESTQVIDPEFAFYGPMGFDVGAFLGNLILAFFAQDGHADQAYDRKTYKAWILRTIEETWNLFRKKFIALWDEHKDGSGEAYLPAIYNNPELQLLVQEKFMDDLFHDTLGFGAAKMIRRIVGVAHVEDFESITDASRRADCELRALEVAKLLLKERRKFHAITEVISAIQKF

SEQ ID NO: 6879 - protein, 200 aa, Fagus grandifolia
MAFSEFRPLDEKSLIEYIKAVPALYSKLGNNLDDLKVQEVGDGNLNFVYIVVAPGGSFVIKQALPYIRCIGESWPMTKERAYFEAVALKEQGRLSPEHVPEVYHFDRTMSLIGMRYLEPPHIILRKGFIAGIEYPLLAEHMSEFMAKTLYFTSLLYRSTTEHKRDVAEFCGNVELCSHTAQVVFSDPYRFPSITVDFSSS

SEQ ID NO: 6880 - protein, 417 aa, Cajanus cajan
MTFSEFRPLDEKSLIEYIKSVPSLSSKLADNFDHLSIKEVGDGNLNFVFIVSNSAGSFVIKQALPYVRCIGESWPMTKERAYFESLALKEEGRLSPEHVPEVYHFDRTMSLIGMRYLEPPHIILRKGLIAGIEYPLLADHMADFMAKTLFFTSLLFRSTTDHKRDVAEYCGNVELCRLTEQVVFSDPYKVSQYNRWTSPFLDSDAEAVREDNLLKLEVAELKSKFCERAQALIHGDLHTGSVMVTRESTQVIDPEFAFYGPMGFDIGAFLGNLILAFFAQDGHADQANDRKAYKEWILKTIEDSWNLFHQKFTSLWDEHRNGVGEAYLPAIYNNPEVQLLVQKKYMTDLFHDSLGFGAAKMIRRIVGVAHVEDFESITDAGKRATCERRALDLAKMLLKERRKFEGIAEIISAIRQF

SEQ ID NO: 6881 - protein, 417 aa, Glycine max
MSFSEFRPLDDTSLIEYIKSVPALSSKLADNLDDLSVKEVGDGNLNFVFIVSNPAGSFVIKQALPYVRCIGESWPMTKERAYFESLALKEEGRLIPEHVPEVYHFDRTMSLIGMRYLEPPHIILRKGLIAGIEYPFLAEHMADFMAKTLFFTSLLFRSTADHKRDVAEFCGNVELCRLTEQVVFSDPYKVSQYNRCTSPYLDRDAEAVREDNLLKLEVAELKSKFIERAQALIHGDLHTGSVMVTRESTQVIDPEFAFYGPMGFDIGAFLGNLILAFFAQDGHADQANDRKSYKEWILKTIEDSWNLFYKKFTSLWDEHKDGAGEAYLPAIYNNPEVQLLVQKKYMTDLFHDSLGFGAAKMIRRIVGVAHVEDFESIADAAKRASCERRALDLAKMLLKERRKFEGIAEIISAIRQY

SEQ ID NO: 6882 - protein, 416 aa, Manihot esculenta
MAFSEFRPLDEQSLIEYIKATPVLSAKIGKNYDDLKIKEVGDGNLNFVYIVVGSAGSFVMKQALPYVRSIGESWPMTKERSYFEALALKEHGQLCPEHVPEVYHFDRTMSLIGMRYLEPPHIILRKGLVAGIEYPYLAEHMSDYMSRTLFYTSLLYRTTTQHKHDVAEFCGNVGLCRLTEQVIFSDPYKVSQYNHWTSPYLDDDAEAVREDNILKLEIAELKSKFCERAQALIHGDLHTSSVMVTPYSTQVIDPEFAFYGPMGFDLGAFIGNLILAYFAQDGHADPANDRKSYKEWILRTIEDSWNLFNKKFTALWNEHKDGPGEAYLPAIYNNPELQQLVQQKFMKDLFHDTLGFGAAKIIRRIFGVAHVEDFESIKEASKRAECERQALKFAKLLLKERRGFQSINDVVSAIRA

SEQ ID NO: 6883 - protein, 416 aa, Quercus alba
MAFTEFRPLDEKSLIEYIKTVPSLYSKLGSDLKVKEVGDGNLNFVYIVVSHAGSFVIKQALPYMRCIGESWPMTKERAYFEAVALRELGRLNPEHVPEVYHFDQTMSLIGMRYLEPPHIIVRKGLIAGIEYPLLAEHMSEFMARTLYFTSLLYRSTTEHKRAVAEFCGNVELCRLTEQVVFSDPYKVSQYNHWTSPYLDRDAEALREDNVLKLEVAELKSKFCERAQALLHGDLHTSSIMVTQESTQVLDPEFAFYGPMGFDIGAFLGNLILAFFAQNGHADQVNDRKTYKEWILRTIEDTWNLFHKKFIALWDEHKGGSGEAYLPAIYNNPELQQLVQKKFMEDLFHDTLGFSAAKMIRRIVGVAHVEDFESITDASRRADCERRALEVAKLLLKERRKFHAITEVISTIQKLQS

SEQ ID NO: 6884 - protein, 418 aa, Populus trichocarpa
MAFTEFRPLDEKYLVEYIKATPALSDKIGNNFDDLKIKEVGDGNLNFVYIVVSPAGSFVIKQAIPYIRCIGESWPMTKERAYFEALTLREHGRLSPENVPEVYHFDRIMSVIGMRYLEPPHIILRKGLVAGIEYPLLAEHISDYMAKTLYHTSLLYHTTTEHKHNVAEFCGNVELCRLTEQVVFSDPYKVSEYNRWTSPYLDRDAEAVREDNILKLEVAELKSKFCERAQALVHGDLHTGSIMVTHESTQVIDPEFAFYGPMGFDIGAFIGNLILAFYAQDGHADQGNDRKTYKEWILRTIKETWSLFYKKFTALWDEHKDGSGEAYLPGIYNNPELHQLVQRKFMQDLFHDTLGFGAAKMIRRIVGVAHVEDFESIPDASKRAQCERLALDLAKMLLKERRKFQSIDEVVSAIQQLQ

SEQ ID NO: 6885 - protein, 419 aa, Mimulus guttatus
MSSDGFRPLDEKSLVEYLKATPSLSVKLGDQFDKLEIKEVGDGNLNFVYIVIGQSGSFVIKQALPYIRCIGESWPMTKERAYFEASTLEEHGRLCPDHVPEVYHFDRKMCLIGMRYIKPPHIILRKGLISGIEYPLLAEHMSEYMARTLFFTSLLYLTTTEHKSAVAKFCGNVELCRLTEQVVFSDPYKVSEYNHWTSPYLDADAEAVREDNLLKLEIAELKSKFCERAQALIHGDLHTGSVMVTTESTQVIDPEFSFYGPMGFDIGAFIGNLILAYFSQDGHAEKDADRKLYKEWILKTISDTWNLFYEKFTALWDQHKDGPGEAYLAAIYNNSELQLLVKQKYMDDLFHDTLGFGAAKMIRRIVGVAHVEDFESIKEADKRAECERKALNLAKTLLKDRKTFHNISEVISAIKHLDK

SEQ ID NO: 6886 - protein, 418 aa, Populus trichocarpa
MVFTEFRPLDEKYLVEYIKATPALSDKIGNNFDDLKIKEVGDGNLNFVYIVVSPAGSFVIKQAIPYIRCIGESWPMTKERAYFEALTLREHGRWSPENVPEVYHFDRIMSVIGMRYLEPPHIILRKGLVAGIEYPLLAEHISDYMAKTLYHTSLLFHTTTEHKHNVAEFCGNVELCRLTEQVVFSDPYKVSEYNRWTSPYLDRDAEAVREDNILKLEVAELKSKFCERAQALVHGDLHTGSVMVTHESTQVIDPEFAFYGPMGFDIGAFIGNLILAFFAQDGHADQGNDRKTYKEWILRTIKETWSLFYKKFTALWDEHKDGSGEAYLPGIYNNPELHQLVQRKFMQDLFHDTLGFGAAKMIRRIVGVAHVEDFESIPDASKRAQCERPALDLAKMLIKERRKFQSIDEVVSAIQQLQ

SEQ ID NO: 6887 - protein, 417 aa, Glycine max
MSLSEFRPLDDKFLIEYIKSVPALSSKLADNFDDLSVKEVGDGNLNFVFIVSNPAGSFVIKQALPYVRCIGESWPMTKERAYFESLALKEEGRLSPEHVPEVYHFDRTMSLIGMRYLEPPHIILRKGLIAGIEYPLLAQHMADFMAKTLFFTSLLFRSTSDHKRDVAEFCGNVELCRLTEQVVFSDPYKVSQYNRWTSPYLDRDAEAVREDNPLKLEVAELKSKFIERAQALIHGDLHTGSVMVTRESTQVIDPEFAFYGPMGFDIGAFLGNLILAFFAQDGHADQANDRKAYKEWILKTIEDSWNLFYQKFTSLWDEHKNGAGEAYLPTIYNNPEVQLLVQKKYMTDLFHDSLGFGAAKIIRRIVGVAHVEDFESITDAAKRASCERRALDLAKMLLKERRKFEGIAEIISAIRQY

SEQ ID NO: 6888 - protein, 418 aa, Citrullus lanatus
MAFSEFRPLNESSLIEYIKTVPSLSDKLGNKFDDIKIKEVGDGNLNFVYIVVASSGSFVIKQALPYVRCIGESWPMTKERAYFEAVTLRKHGHLCPNHVPDVYHFDRTMSLIGMRYLEPPHIILRKGLIAGIEYPLLADHVSEYMAKTLFGTSILYNSTTVHKVSVAEFCGNVELCRLTEQVVFSDPYKVSEYNRWTSPYLDRDAEAVREDNDLKVEIAELKAKFIERTQALIHGDLHTGSIMVTQESTQVIDPEFAFYGPMGFDIGAFLGNLILAFFSQDGHAVEGNDRKTYKEWILRTIEETWNLFRKKFVGLWELHKDGPGEAYLPAIYNNPELQQLVQNKYLTDLFHDSLGFGAAKMIRRIVGVAHVEDFESINDPSKRAGCERRALELAKLLLKKRRSFNSISQVISAIRELQ

SEQ ID NO: 6889 - protein, 75 aa, Arachis hypogaea
MAFSEFRPLDDNSLIEYIKSVPALSSKIGNDFDTLSVKEVGDGNLNFVFIVLNSTGSFVIKQALPYIRCIGDHGR

SEQ ID NO: 6890 - protein, 419 aa, Vitis vinifera
MASSGFRPLDDKSLIEYIKATPALSSKLANQLDGLQIKEVGDGNLNFVYIVISSSGSFVIKQALPYIRCIGESWPMTKERAYFEATALREQRRWCSDHVPEVYHFDREMALIGMRYLEPPHIILRKGLIAGIEYPLLAEHMSEFMARTLFFTSLLYHDTTEHKRAVAEFCGNVELCRLTEQVVFSDPYKVSQYNRWTSPYLDRDAEAVREDNILKLEVAELKSMFCERSQALVHGDLHTGSVMVTPDSTQVIDPEFGFYGPMGFDIGAFLGNLILAYFAQDGHADQVNDRKTYKEWILKAIEQTWNLFHKKFTALWDEHRNGSGEAYLPEIYNNSELQLLTQKKYMQGLLHDTLGFGAAKMIRRIVGVAHVEDFESIVDASKRANCERQALVFAKMLLKERRKFQAITEVVLAVQQEQS

SEQ ID NO: 6891 - protein, 418 aa, Medicago truncatula
MSNFSEFKPLNEKTLIEYIKSIPALSSKLANNFSDLSVKEVGDGNLNFVFIVSNTNGSFVIKQALPYVRCIGESWPMTKERAYFESLALKEEGKLSPDHVPEVYHFDRTMSLIGMRYLEPPHIILRKGLIAGVEYPLLADHMSDFMANTLFFTSLLYRSTTEHKRDVAEFCGNVELCRLTEQVVFSDPYKVSEYNRWTSPNLDRDAEAVREDNLLKLEVAELKSKFCERAQALIHGDLHTGSVMVTRESTQVIDPEFAFYGPMGFDIGAFLGNLILAFFSQDGHADQANDRKAYKEWILKTIADTWNLFHHKFTALWDEHKNGAGEAYLPGIYNNPDVQLLVQKKYMTDLFHDSLGFGAAKMIRRIVGVAHVEDLESIADTGKRATCERRALDLAKMLFKERRKFESISEIVSAIQQF

SEQ ID NO: 6892 - protein, 418 aa, Populus trichocarpa
MAFTEFRPLAEKSLIEYIKATSVLSDKIGNNFGDLKIKEVGDGNLNFVYIVASPSGSFVIKQALPYIRCIGESWPMTKERAYFEALALREHGRLCPENVPEVYHFDRTMSVIAMRYLEPPHIILRKGLIAGIEYPLLAEHMSDYIAKTLYYTSLLYRTTTEHKRDVAEFCGNVELSRLTEQVVFSDPYKISQYNRWTSPYLDRDAEAVREDNILKLEVAELKSMFCERAQALVHGDLHTGSVMVTHDSTQVIDPEFAFYGPMGFDIGAFIGNLILAFYAQDGHADQMNDRKRYKEWILRTIRETWSLFYKKFTALWDEHKDGSGEAYLPEIYNNPELRLLVQRKFMQDLLHDTLGFGAAKMIRRIVGVAHVEDFESITDASKRAKCEQQALDLAKMVLKERKKFQSIDEVVLAIQQVQ

SEQ ID NO: 6893 - protein, 417 aa, Prunus persica
MAFSEFRPLDEKVLIEYIKATPSLSSKLNNKFDNLTIKEVGDGNLNFVFIVVGSTGSFVIKQALPYIRCIGESWPMTKERAYFEALALREHGGLSPDHVPEVYHFDRTMSLIGMRYLEPPHIILRKGLIAGIEYPLLADHMSDYIARTLFFTSLLYRNTTDHKRAVAEFCGNVELCRLTEQVVFSDPYKISQYNHWTSPYLDSDAEAIREDNALKLEVAELKSLFCERAQALIHGDLHTGSVMVTHDSTQVIDPEFAYYGPMGFDIGAFLGNLILAFFAQDGHADEQNDRKAYKDWILRTIENTWNLFDRKFVALWDTNNDSGDAYLPAIYNNPGLLQLVQKKYIKDLLHDSLGFGAAKMIRRIVGVAHVEDFESIADASKRAGCERRALEVAKLLLKERRKFQGIAEVISAIQQVQ

SEQ ID NO: 6894 - protein, 418 aa, Trigonella foenum-graecum
MSNFSEFKPLNEKTLIEYIKSIPALSSKLANNFSDLSVKEVGDGNLNFVFIVSNTNGSFVIKQALPYVRCIGESWPMTKERAYFESLALKEEGKLSPEHVPEVYHFDRTMSLIGMRYLEPPHIILRKGLIAGVEYPLLADHMSGFMANTLFFTSLLFRSTTEHKRDVAEFCGNVELCRLTEQVVFSDPYKVSEYNRWTSPHLDSDAEAVREDNLLKLEIAELKSKFCERAQALIHGDLHTGSVMVTRESTQVIDPEFAFYGPMGFDIGAFLGNLILAFFSQDGHADQANDRKEYKEWILKTIADTWNLFHHKFTALWDEHKNGAGEAYLPGIYNNPDVQLLVQKKYMTDLFHDSLGFGAAKMIRRIVGVAHVEDLESIADAGKRATCERRALDLAKMLLKERRKFESISEIVSAIQQF

SEQ ID NO: 6895 - protein, 424 aa, Ricinus communis
MAFSEFRPLDEKSLIEYIRGTPVLANKIGDKFDDLKIKEVGDGNLNFVYIVVSSDGSFVIKQALPYIRCIGESWPMTKERAYFEARTLKEHGRLCPEHVPDVYHFDHTMCLIGMRYLEPPHIILRKGLIGGHEYPHLAEHMSDYMAKTLFYTSLLYLTTTEHKRAVAEFCGNVELCRLTEQVVFSDPYKVSQYNHWTSPYLDHDAEAVREDNILKLEIAELKSKFCERGQALIHGDLHTGSVMVTPSSTQVIDPEFSFYGPMGFDIGAFIGNLILAYFAQAGHADSANDRKSYKEWILKIIENTWNLFDKKFIALWDEHKDGPGEAYLPEIYNKPEVRQLVQRKFMRDLFHDTLGFGAAKMIRRIVGVAHVEDFESIKDASKRAECERKALDFAKMLLKNRRDFDSIDGVVSAMQPLDSCQTFG

SEQ ID NO: 6896 - protein, 419 aa, Chelidonium majus
MATEGFRALDEKSLIEYIKATPSLCSKLGNQLDGIQIKEVGDGNLNFVYIVTGTAGSFVIKQALPYIRCIGESWPMTKERAYFEATTLKEHGRWCPDRVPEVYHFDRVMSLIGMRYLEPPHIILRKGLIAGVEYPLLAEHMSEYMSKTLFCTSLLYHSTTVHRQAVAEFCGNLELCRLTEQVVFSDPYKESEYNRWNSPYLDRDAEAVREDNLLKLEVAELKSMFCERAQALIHGDLHTGSVMVTLDSTQVIDPEFAVYGPMGYDIGAFIGNLILAFFSQDGHADPANDRREYKQWILRTIEDTWNLFEKKFTALWDENKNGSGEAYLSAIYNNPELFLLAQRKYMKDLFHDSLGFGSAKMIRRIVGVAHVEDFESIDDASKRAYCERRALDFAKMLLKERRKFQTINEVVSAIQALPS

SEQ ID NO: 6897 - protein, 417 aa, Prunus mume
MAFSEFRPLDEKVLIEYIKATPSLSSQLNNNFDNLTIKEVGDGNLNFVFIVVGSTGSFVIKQALPYIRCIGESWPMTKERAYFEALALREHGGLSPDHVPEVYHFDRTMSLIGMRYLEPPHIILRKGLIAGIEYPLLADHMSDYIARTLFFTSLLYRNTTDHKRAVAEFCGNVELCRLTEQVVFSDPYKISQYNHWTSPYLDSDAEAIREDNALKLEVAELKSLFCERAQALIHGDLHTGSVMVTHDSTQVIDPEFAFYGPMGFDIGAFLGNLILAFFAQDGHADEQNDRKAYKDWILRTIENTWNLFDRKFVALWDTNKDSGDAYLPAIYNNPGLLQLVQKKFIKDLLHDSLGFGAAKMIRRIVGVAHVEDFESIADASKRAGCERRALEIAKLLLKERRKFQGIAEVILAIQQVQ

SEQ ID NO: 6898 - protein, 418 aa, Populus trichocarpa
MAFTEFRPLAEKSLIEYIKATSVLSDKIGNNFGDLKIKEVGDGNLNFVYIVASPSGSFVIKQALPYIRCIGESWPMTKERAYFEALALREHGRLCPENVPEVYHFDRTMSVIAMRYLESPHIILRKGLIAGIEYPLLAEHMSDYIAKTLYYTSLLYRTTTEHKRDVAEFCGNVELSRLTEQVVFSDPYKISQYNRWTSPYLDRDAEAVREDNILKLEVAELKSMFCERAQALVHGDLHTGSVMVTHDSTQVIDPEFAFYGPMGFDIGAFIGNLILAFYAQDGHADQMNDRKRYKEWILRTIRETWSLFYKKFTALWDEHKDGSGEAYLPEIYNNPELRLLVQRKFMQDLLHDTLGFGAAKMIRRIVGVAHVEDFESITDASKRAKCEQQALDLAKMVLKERKKFQSIDEVVLAIQQVQ

SEQ ID NO: 6899 - protein, 418 aa, Eucalyptus grandis
MAFAEFRPLDEKSLLEYIQHTPALASKLGNKFDDLKIREVGDGNLNFVYIVVGSAGSFVIKQAIPYVRCIGESWPMTKERAYFEAVALKEQGHWCPDHVPEVYHFDRTMSLIGMRYLEPPHIILRKGLIAGIEYPLLAEHMSEYMARTLFSTSLLYHSTTEHKRAVAEFCGNVEMCRLTEQVVFSDPYKVSQYNHWTSPYLDADAEAVREDNDLKLAIAELKSMFCERAQALVHGDLHTGSVMVTQDSTQVIDPEFAFYGPMGFDVGAFLGNLFLSFFSQDGHANQGNDRKGYKEWILQTTEETWNLFQQKFVSLWDEHKNGSGEAYLPAIYNNDVLLKLVQRKFMKDLFHDSLGFGAAKMIRRIVGVAHVEDLESITDASKRADCERRALNFARMLLKERRKFEEISEVVSLVRKSN

SEQ ID NO: 6900 - protein, 420 aa, Solanum phureja
MASDGFRPLDEKSLVEYIKSTPSLVSILGKQFDKLEIKEVGDGNLNFVYIVVAPSGSIVIKQALPYIRCIGESWPMAKERAYFEATALKEHARLSPEHVPEVYHFDRTMCLIGMRYLEPPHIILRKGLIAGVEYPLLAQHISDYMAKTLFFTSLLYLTTTDHKRAVAEFCGNVELCRLTEQVVFSDPYKVSEYNRCTSPYLDADAEAVRNDNGLKIEVAELKSKFCERAQALIHGDLHTGSLMVTHDSTQVIDPEFSFYGPMGFDIGAFIGNLILAYFSQDGHADQANDRKSYKLWILKTITETWNLFHQKFLALWDEHKDGPGEAYLPEIYNNTELRQLVKQKYMKELFEDTLGFGAAKMIRRIVGVAHVEDFESIKDVAKRADCERQALSCAKKLLKERRNIKSIEEVVSTIEQVQLQ

SEQ ID NO: 6901 - protein, 420 aa, Solanum lycopersicum
MASDGFRPLDEKSLVEYIKSTPSLLSILGKQFDNLEIKEVGDGNLNFVYIVVAPSGSIVIKQALPYIRCIGESWPMAKERAYFEATALKEHGRLSPEHVPEVYHFDRTMCLIGMRYLEPPHIILRKGLVAGVEYPLLAQHISDYMAKTLFFTSLLYLNTTDHKRAVAEFCGNVELCRLTEQVVFSDPYKVSEYNRCTSPYLDADAEAVRNDNGLKIEVAELKSKFCERAQALIHGDLHTGSLMVTQDSTQVIDPEFSFYGPMGFDIGAYIGNLILAYFSQDGHADQANDRKSYKVWILKTITETWNLFHQKFLALWDEHKDGPGEAYLPEIYNNTELRQLVKQKYMKELFEDTLGFGAAKMIRRIVGVAHVEDFESIKDVAKRADCERQALSCAKKLLKERRTIKSIEEVISTIEQVQLQ

SEQ ID NO: 6902 - protein, 420 aa, Nicotiana benthamiana
MPSDGFRPLDEKSLVEYIRATPALVSILGKEFDKLEIKEVGDGNLNFVYIVVAPSGSVVIKQALPYIRCIGESWPMTKERAYFESTALKEHGRLCPEHVPEVYHFDRTMCVIGMRYLEPPHIILRKGLIAGVEYPLLAENISDYMAKTLFFTSLLYLTTTDHKRAVAEFCGNVELCRLTEQVVFSDPYKASQYNRCTSPYLDADAEAVRKDNGLKIEVAELKSKFCERAQALIHGDLHTGSLMVTQDSTQVIDPEFAFYGPMGFDIGAFIGNLILAYFSQDGHADQANDRKSYKVWILKTITETWNLFHKKFLALWDEHKDGPGEAYLPEIYNNTELRELVQQKYMKELFEDTLGFGGAKMIRRIVGVAHVEDFESIKDAAKRADCERRALNCAKKLLKERRNVKSIEEVVSTIEKVHLQ

SEQ ID NO: 6903 - protein, 417 aa, Aristolochia fimbriata
MDLTQFRPLDDKLLVEYIKATPALSSLLGNQFDDLTIKEVGDGNLNYVYIVLGAAGSFVVKQALPYIRCIGESWPMTKERAYFEARTLKEHGGLCPEHVPEVYHFDVNMSLIAMRYLKPPHIILRKGLIAGIEYPLLAEHISEYMAKTLFKTSLLYHSTTEHRKAVAEFCGNVELCRLTEQVVFSDPYKISEYNRWTSPYLDQEAEAVREDNLLKLEVAELKSMFCERAQALIHGDLHTGSVMVTNDSTQVIDPEFAFYGPMGFDIGAFIGNLILAFFAQDGHADQENDRQLYKQWILKTIEDTWNLFQNKFIKLWNESKNGEAYLEEIYNKPELRNLVQEKYMTDLLHDTLGFGAAKMIRRIVGVAHVEDFESIQDNAKRAECERRALGLAKELLKKRREFKSISQVVAAIKEVAH

SEQ ID NO: 6904 - protein, 417 aa, Cicer arietinum
MSFSEFKPLNENTLIEYIQSVPSLSSILGNNFSDLSVKEVGDGNLNFVFIVSNSTGSFVLKQALPYVRCIGESWPMTKERAYFESLALKEEGRLSPDHVPEVYHFDRTMSLIGMRYLEPPHIILRKGFIAGIEYPLLAQHMSDFITNTLFFTSLLFRSTTEHKRDVAEFCGNVELCRLTEQVVFSDPYKVSEYNRWNSPYLDRDAEAVREDNLLKLEVAELKSKFCERAQALIHGDLHTGSVMVTRESTQVIDPEFAFYGPMGFDIGAFLGNLILAFFSQDGHADQANDRKGYKEWILKTIEDTWNLFHHKFTALWEKHRNGAGEAYLPGVYNNPEVHLLVQKKYMTDLFHDSLGFGAAKMIRRIVGVAHVEDFESIADAGKRATCERRALDLAKMLLKERRKFEGISEIVSAIKQF

SEQ ID NO: 6905 - protein, 420 aa, Nicotiana benthamiana
MASDGFRPLDEKSLVEYIKATPALFSILGKEFDKLEIKEVGDGNLNFVYIVVAPSGSFIIKQALPYIRCIGESWPMTKERAYFEATVLKEHGRLCPEHVPEVYYFDRTMCVIGMRYLEPPHIILRKGLIAGVEYPLLAENISDYMAKTLFFTSLLYLTTMDHKRAVAEFCGNVELCRLTEQVVFSDPYKVSQYNRCTSPYLDADAEAVRNDNSLKIEVAELKSKFCERAQALIHGDLHTGSLMVTQDSTQVIDPEFAFYGPMGFDIGAFIGNLILAYFSQDGHADQANDRKSYKVWILKTITETWNLFHKKFLALWDEHKDSPGEAYLPEIYNNTELRQLVKQKYMKELFEDTLGFGAAKMIRRIVGVAHVEDFESIKDAAKRADCERLALNCAKKLLKERRNFKSIDEVVSTIEQVHLQ

SEQ ID NO: 6906 - protein, 420 aa, Nicotiana benthamiana
  misc_feature (288)..(288): Xaa can be any naturally occurring amino acid
MPSDGFRPLDEKSLVEYIRATPALVSILGKEFDKLEIKEVGDGNLNFVYIVVAPSGSVVIKQALPYIRCIGESWPMTKERAYFESTALKEHGRLCPEHVPEVYHFDRTMCVIGMRYLEPPHIILRKGLIAGVEYPLLAENISDYMAKTLFFTSLLYLTTTDHKRAVAEFCGNVELCRLTEQVVFSDPYKASQYNRCTSPYLDADAEAVRKDNGLKIEVAELKSKFCERAQALIHGDLHTGSLMVTQDSTQVIDPEFAFYGPMGFDIGAFIGNLILAYFSQDGHADQAXDRKSYKVWILKTITETWNLFHKKFLALWDEHKDGPGEAYLPEIYNNTELRELVQQKYMKELFEDTLGFGGAKMIRRIVGVAHVEDFESIKDAAKRADCERRALNCAKKLLKERRNVKSIEEVVSTIEKVHLQ

SEQ ID NO: 6907 - protein, 417 aa, Phaseolus coccineus
MAFSEFRPLNEKSLIEYIKSVPALSSKLANNFDDLSVKEVGDGNLNFVYIVSNSAGSFVIKQALPYVRCIGESWPITAERAYFESLTLKEEGRLCPEHVPEVYHFDRTMSLIAMRYLEPPHIILRKGLIAGTEYPLLAEHMADFMAKTLFFTSLLFRSTTDHKRDVAEFCGNVELCRLTEQVVFSDPYKISEYNRWTAPYLDRDAEAVREDNLLKLEVAELKSVFIERAQALLHGDLHTGSVMVTSESTQVIDPEFSFYGPMGFDVGAFLGNLILAFFAQDGHADPTNDRKAYKEWILKTIEDTWNLFQHKFTSLWDEHRNGAGEAYLPAIYNNPEVQLLVQKKYMTNLFHDSLGFGAAKMIRRIVGVAHVEDFESIADAAKRATCERRALDLAKMLLKERRKFEGIAEIISAIRQY

SEQ ID NO: 6908 - protein, 419 aa, Sesamum indicum
MSSDGFRPLDEKLLVEYLKGTPSLAAKLGSQFDKLEIKEVGDGNLNFVYIVIGSSGAVVIKQALPYIRCIGESWPMTKERAYFEATTLQDHGRLCPAHVPEVYHFDREMCLIGMRYIEPPHIILRKGLIAGIEYPLLAEHISEYLARTLFYTSLLYLTTTNHKSAVAKYCGNVELCRLTEQVVFSDPYKVSEYNRWTTPYLDADAEAVREDSILKVEVAQLKSKFCERAQALIHGDLHTGSVMVTTDSTQVIDPEFAFYGPMGFDIGAFIGNLILAYFAQDGHAEKGTDRKLYKEWILKTISDTWNLFYRKFTALWDKNKDGPGEAYLPAIYNNPELQLLVQQKYMEDLFHDSLGFGAAKMIRRIVGVAHVEDFESIKEASKRADCERKALNFAKTLLKERKKFHNISEVVAAIEHLDK

SEQ ID NO: 6909 - protein, 418 aa, Cannabis sativa
MAFSEFRPLDEKTLVDYVKAVPALSSKLGGNLDDLTIKEVGDGNLNFVYIVIGSSGSLVIKQALPYIRCIGESWPMTKERAYFEAVTLKEHGRWCPNNVPEVFHFDRTMSLIAMRYLEPPHIILRKGLIAGVEYPLLAEHISDYMANTLFYTSLIYRSTTEHKKAVAEFCGNVELCRLTEQVVFSDPYKVSEYNHWTSPYLDEDAEAVRNDDGLKVEIAELKSKFCERSQALIHGDLHTGSVMVTHDSTQVIDPEFAFYGPMGFDIGAFLGNLILAYFAQDGHAVGENDRKNYKEWILKTIEDTWNLFRKKFTALWDKHKDGSGEAYLPAIYNNPELQLLVQKKYFEDLLHDTVGFGSAKMIRRIVGVAHVEDLESIADPSKRATCEKRALYLAKMLLKERRKFHDISEIVSAVRNVQ

SEQ ID NO: 6910 - protein, 418 aa, Cucumis melo
MDFSQFRPLDETSLIEYIKTVPSLSDKLGNKFDGIEIKEVGDGNLNFVYIVVGSSGSFVIKQAIPYVRCIGESWPMTKERAYFEAVALRKHGHLCPNHVPDVYHFDRTMSLIGMRYLEPPHIILRKGLIAGIEYPLLADHMSEYMAKTLFGTSILYNSTTVHKESVAEFCGNVELCRLTEQVVFSDPYKVSEHNRWTSPYLDRDAEAIREDNELKVEIAELKAKFIERTQALVHGDLHTGSIMVTQESTQVIDPEFAFYGPMGFDIGAFLGNLILAFFSQDGHAVEGNDRKAYKEWILRMIEETWNLFRKKLVALWELHKDGPGEAYLPAIYNNPELQQLVQNKYLTELFHDSLGFGAAKMIRRIVGVAHVADFETIKDPSKRAECERQALELAKLVLKKRRNFNSISQVISAIREIQ

SEQ ID NO: 6911 - protein, 419 aa, Beta vulgaris
MSTFDEFRPLDEKSLVEYIKATPSLSSLLGVSDNLQIKEVGDGNLNFVYIIVSPYTSVVIKQALPYIRCIGESWPMTKERAYFEATTLKKHGSLCPAHVPEVYHFDRMMSLIGMRYLEPPHIILRKGLIAGAEYPLLAEHMAEYMSRTLFYTSLLYTTTTEHKRAVAEFCGNVELCRLTEQVVFSDPYRVSEYNRWTSPHLDHDAEAVREDNVLKLEVAQLKSMFCERAQALIHGDLHTGSVMVTQDSTQVIDPEFAFYGPMGFDIGAFLGNLILAFFAQDGHANQENDRKTYKKWILKIFGETWNLFHKKFITLWNENKGGPGEAYLPHIYNNPDVWQLIQTNYMRDLFHDSLGFGSAKMIRRIVGVAHVEDFESITDAAKRADCERKALNFAKMLMKERRKFVSIEDVVSAIEQVDL

SEQ ID NO: 6912 - protein, 420 aa, Nicotiana tabacum
  misc_feature (147)..(147): Xaa can be any naturally occurring amino acid
MTSDGFRPLDEKSLVEYIRATPALVSILGTEFDKLEIKEVGDGNLNFVYIVVAPSGSFVIKQALPYIRCIGESWPMTKERAYFEATALKEHGRLCPEHVPEVYYFDRTMCVIGMRYLEPPHIILRKGLIAGVEYPLLAENISDYMAXTLFFTSLLYLTTTDHKHAVAEFCGNVELCRLTEQVVFSDPYKVSQYNRCTSPYLDADAEAVRNDNGLKIEVAELKSKFCERAQALVHGDLHTGSLMVTHNSTQVIDPEFAFYGPMGFDIGAFIGNLILAYFSQDGHADQANDRKSYKVWILKTITETWNLFHKKFLALWDEHKDGPGEAYLPEIYNNTELRQLVKQKYMKELFEDTLGFGAAKMIRRIVGVAHVEDFESIKDAAKRADCERLALNCAKKLLKDRRNFKSIDEVVSIIEQVHLQ

SEQ ID NO: 6913 - protein, 517 aa, Panicum virgatum
MAWARLAARCRLRPGAASAVGRGPHAPPPPQPQAGHAAPAAPPLWRDLRVPQLHSAAAASSAPHARLLGDRWQRLGAARRWLASEASAAPAPAGEAAELVEVPLAQTGEGIAECELLRWFVTEGDQVDEFQPLCEVQSDKATIEITSRFKGKVHQIHFGPGDIVKVGETLLKMIVGDSQIVSPDSIFPSADKSLGVESAVPSSEGNVPSGTLSTPAVRHLAKQYGININEIVGTGKDGRVLKEDVLNYAVNKGLCEEQSSSLEENIGQVELLEERKSLSDMPLYEDKKILLRGYQRAMVKSMSLAAKVPHFHYLEEINCDSLVQLKTRFQNENKDNTIKHTFLPFLIKSLSMALSKYPMLNSSFIEETNEVVLKGSHNIGIAMATSHGLVVPNIKKVQSLSILEITKELVRLHEMASHNRLSTADIEGGTITLSNIGAIGGKFGSPLLNLPEVAIIALGRIQKLPRFDDDENVYPSSIINVTVGADHRVVDGAMVARFCNEWKGLVEKPELLLLHMR

SEQ ID NO: 6914 - protein, 523 aa, Sorghum bicolor
MAWARLASRSRLRPAASASASAAVGRPPNASPSVPPPTPPTVPAATSAPPLRHLLLLPRHRFAAAASSASTARLLGARWPQGHGRRCFASEASAAQAPPGEASELVEVPLAQTGEGIAECELLRWFVAEGDQVDEFQPLCEVQSDKATIEITSRFKGKVHQINFGPGDIVKVGETLLKMIVGDSQIVSPDNIVPSADKSNGVESAVSLSEGNVPSGTLSTPAVRHLAKQYGININEIVGTGKDGRVLKEDVLNYAVSKGVCKEQSSALEGNIDQVELLEEGKSLLDEHVYEDKKILLRGYQRSMVKSMSLAAKVPHFHYLEEINCDSLVQLKTTFQNENKDHTIKHTFLPFLIKSLSMALSKYPILNSSFIEETSEVVFKGSHNIGVAMATAHGLVVPNIKKVQSLSILEITKELARLHEMASHNRLSAADIEGGTITLSNIGAIGGKFGSPLLNLPEVAIIALGRIQKLPRFDDDENVYPSSTINVTIGADHRVVDGATVARFCNEWKSLVEKPELLLLHMR

SEQ ID NO: 6915 - protein, 345 aa, Pennisetum glaucum
MIVGDSQIVSPDNIFPSADKSLEEEPAVPSSEGNIPSGTLSTPSVRHLAKQYGLKINEIVGTGKDGRVLKEDVLNYAVSKGLYREQSSSLEENIGLNDLVEEGKSLPDVPFYEDKKILLRGYQRAMVKSMSLAAKVPHFHYLEEINCDSLVQLKKAFQNENKDNTIKHTFLPFLIKSLSMALSKYPMLNSSFIEETNEVILKGSHNIGIAMATAHGLVVPNIKKVQSLSILEITKELARLQEIASHNRLSAADIEGGTITLSNIGAIGGKFGSPLLNLPEVAIIALGRIQKLPRFDDDENVYPSSIINVTVGADHRVVDGATVARFCNEWKGLVEKPELLLLHMR

SEQ ID NO: 6916 - protein, 213 aa, Panicum virgatum
MARWRPAELLLVVLAAVLAAARRADALSVTVTDTECIHEFVPYEGDTVSGNFVVVDHDIFWSSDHPGIDLTVTSPGGNTVHTLKGKSGDKFEFKAPRGGMYKFCFHNPYGAPETVSFYIHVGHIPNEHNLAKDEHLDPINVKIAELKEALESVTAEQKYLKAREARHRHTNESTRKRVMFYTMAEYLAFMAASALQVVYIRRLFSKNVAYNRV

SEQ ID NO: 6917 - protein, 213 aa, Panicum virgatum
MARWRPAALLVVALAAVLAAARRADALSVTVTDTECIHEFVPYEGDTVSGNFVVVDHDIFWSSDHPGIDLTVTSPGGNTVHTLKGKSGDKFEFKAPRGGMYKFCFHNPYGAPETVSFYIHVGHIPNEHNLAKDEHLDPINVKIAELKEALESVTAEQKYLKAREARHRHTNESTRNRVMFYTMAEYLAFMAASALQVVYIRRLFSKNVAYNRV

SEQ ID NO: 6918 - protein, 214 aa, Cenchrus ciliaris
MARRRPGALLLVLALAAVLTAARRADALSVTVTDTECIHEFVPYEGDTVSGNFVVVDHDIFWSSDHPGIDLTVTSPGGNTVHTLKGKSGDKFEFKAPRGGMYKFCFHNPYGAPETVSFYIHVGHIPNEHNLAKDEHLDPINVKIAELKEALESVTAEQKYLKAREARHRHTNESTRKRVMFYTIAEYLAFMAASALQVVYIRRLFSKNVAYNRV

SEQ ID NO: 6919 - protein, 214 aa, Pennisetum glaucum
MARRRPGALLLVLALAAVLSAARRADALSVTVTDTECIHEFVPYEGDTVSGNFVVVDHDIFWSSDHPGIDLTVTSPGGNTVHTLKGKSGDKFEFKAPRGGMYKFCFHNPYGAPETVSFYIHVGHIPNEHNLAKDEHLDPINVKIAELKEALESVTAEQKYLKAREARHRHTNESTRKRVMFYTIAEYLAFMAASALQVIYIRRLFSKNVAYNRV

SEQ ID NO: 6920 - protein, 213 aa, Zea mays
MARWRPAALLVVALAAVLSAAWRADALSVTVTDTECIHEFVPYEGDTVSGNFVVVDHDIFWSSDHPGIDLTVTSPGGNTVYTLKGKSGEKFEFKAPRGGMYKFCFHNPYGAPETVSFYIHVGHIPNEHNLAKDEHLDPINVKIAELKEALESVTAEQKYLKAREARHRHTNESTRKRVMFYTMAEYLAFMAASALQVLYIRRLFSKNVGYNRV

SEQ ID NO: 6921 - protein, 213 aa, Sorghum bicolor
MARWRPAVLLVVALAAVLSAAWRADALSVTVTDTECIHEFVPYEGDTVSGNFVVVDHDIFWSSDHPGIDLTVTSPGGNTVHTLKGKSGDKFEFKAPRGGMYKFCFHNPYGAPETVSFYIHVGHIPNEHNLAKDEHLDPINVKIAELKEALESVTAEQKYLKAREARHRHTNESTRKRVMFYTMAEYIAFMAASALQVLYIRRLFSKNVGYNRV

SEQ ID NO: 6922 - protein, 213 aa, Saccharum officinarum
MARWRPAALLVVALAAVLSAAWRADALSVTVTDTECIHEFVPYEGDTVSGNFVVVDHDIFWSSDHPGIDLTVTSPGGNTVHTLKGKSGDKFEFKAPRGGMYKFCFHNPYGAPETVSFYIHVGHIPNEHNLAKDEHLDPINVKIAELKEALESVTAEQKYLKAREARHRHTNESTRKRVMFYTMAEYIAFMAASALQVLYIRRLFSKNVGYNRV

SEQ ID NO: 6923 - protein, 213 aa, Zea mays
MARWRPAALLVVALTAVLSAARRADALSVTVTDTECIHEFVPYEGDTVSGNFVVVDHDIFWSSDHPGIDLTVTSPGGNTVHTLKGKSGDKFEFKAPKGGMYKFCFHNPYGAPETVSFYIHVGHIPNEHNLAKDEHLDPINVKIAELKEVLESVTAEQKYLKAREARHRHTNESTRKRVMFYTMAEYIAFVAASTLQVLYIRRMFSKNVGYNRV

SEQ ID NO: 6924 - protein, 213 aa, Avena sativa
MARWRPAMLLVAALALAAAAGWRAEALSVTVTDTECIHEFVPYEGDAVTGNFVVVDHDIFWSSDHPGIDLTVTSPGGNTVHSIKGKSGDKFEFKAPRGGMYKFCFHNPYGAPETVSFYIHVGHIPNEHNLAKDEHLDPINVKIAELKEALESVTAEQKYLKAREARHRHTNESTRRRVMFYTMAEYLAFMAASALQVVYIRRLFSKNVAYNRV

SEQ ID NO: 6925 - protein, 213 aa, Brachypodium distachyon
MATWRPAMLLVAVVALAAAAGWRADALSVTVTDTECIHEFVPYEGDSVTGNFVVVDHDIFWSSDHPGIDLTVTSPGGNTVYSLKGKSGDKFDFKAPRGGMYKFCFHNPYGAPETVSFYIHVGHIPNEHDLAKDEHLDPINVKIAELKEALESVTSEQKYLKAREARHRHTNESTRRRVMFYTMAEYLAFMAASALQVVYIRRLFSKNVAYNRV

SEQ ID NO: 6926 - protein, 213 aa, Secale cereale
MARWRPAMLLVAALALAAAAGWRAEALSVTVTDTECIHEFVPYEGDSVSGNFVVVDHDIFWSSDHPGIDLTVTSPGGNTVYTIKGKSGDKFEFKAPRGGMYKFCFHNPYGAPETVSFYIHVGHIPNEHNLAKDEHLDPINVKIAELKEALESVTAEQKYLKARDARHRHTNESTRRRVMFYTMAEYAAFMAASALQVVYIRRLFSKNVGYNRV

SEQ ID NO: 6927 - protein, 213 aa, Hordeum vulgare
MARWRPAMLLVAALALAAAAGWRAEALSVTVTDTECIHEFVPYEGDSVTGNFVVVDHDIFWSSDHPGIDLTVTSPGGNTVYTMKGKSGDKFEFKAPRGGMYKFCFHNPYGAPETVSFYIHVGHIPNEHNLAKDEHLDPINVKIAELKEALESVTAEQKYLKARDARHRHTNESTRRRVMFYTMAEYAAFMAASALQVVYIRRLFSKNVGYNRV

SEQ ID NO: 6928 - protein, 210 aa, Oryza sativa
MAVGWRPAMLVVVVAVAAWRGEALSVTVTDTECIHEFVPYEGDTVSGNFVVVDHDIFWSSDHPGIDLTVTSPGGNTVYTLKGKSGDKFEFKAPRGGMYKFCFHNPYGAPETVSFYIHVGHIPNEHNLAKDEHLDPINVKIAELKEALESVTAEQKYLKAREARHRHTNESTRRRVMFYTIAEYLAFMGASALQVVYIRRLFSKNVAYNRV

SEQ ID NO: 6929 - protein, 213 aa, Triticum aestivum
MARWRPAMLLVAALALAAAAGWRAEALSVTVTDTECIHEFVPYEGDSVSGNFVVVDHDIFWSSDHPGIDLTVTSPGGNTVYTMKGKSGDKFDFKAPRGGMYKFCFHNPYGAPETVSFYIHVGHIPNEHNLAKDEHLDPINVKIAELKEALESVTAEQKYLKARDARHRHTNESTRRRVMFYTMAEYAAFMAASALQVVYIRRLFSKNVGYNRV

SEQ ID NO: 6930 - protein, 213 aa, Triticum aestivum
MARWRPAMLLIAALALAAAAGWRAEALSVTVTDTECIHEFVPYEGDSVSGNFVVVDHDIFWSSDHPGIDLTVTSPGGNTVYTMKGKSGDKFDFKAPRGGMYKFCFHNPYGAPETVSFYIHVGHIPNEHNLAKDEHLDPINVKIAELKEALESVTAEQKYLKARDARHRHTNESTRRRVMFYTMAEYAAFMAASALQVIYIRRLFSKNVGYNRV

SEQ ID NO: 6931 - protein, 213 aa, Leymus cinereus x Leymus triticoides
MATWRPAMLLVAALALAAATGWRAEALSVTVTDTECIHEFVPYEGDSVTGNFVVVDHDIFWSSDHPGIDLTVTSPGGNTVYTMKGKSGDKFEFKAPRGGMYKFCFHNPYGAPETVSFYIHVGHIPNEHNLAKDEHLDPINVKIGELKEALESVTAEQKYLKARDARHRHTNESTRRRVMFYTMAEYAAFMAASALQVVYIRRLFSKNVGYNRV

SEQ ID NO: 6932 - protein, 193 aa, Pseudoroegneria spicata
GWRAEALSVTVTDTECIHEFVPYEGDSVSGNFVVVDHDIFWSSDHPGIDLTVTSPGGNTVYTMKGKSGDKFEFKAPRGGMYKFCFHNPYGAPETVSFYIHVGHIPNEHNLAKDEHLDPINVKIAELKEALESVTAEQKYLKARDARHRHTNESTRRRVMFYTMAEYAAFMAASALQVVYIRRLFSKNVGYNRV

SEQ ID NO: 6933 - protein, 192 aa, Lolium multiflorum
WRAEALSVTVTDTDCIHEFVPYEGDSVTGNFVVVDHDIFWSSDHPGIDLTVTSPGGNTVHSMKGKSGDKFEFKAPRGGMYKFCFHNPYGAPETVSFYIHVGHIPNEHNLAKDEHLDPINVKIAELKEALESVTAEQKYLKAREARHRHTNESTRRRVMFYTIAEYLAFMAASALQVVYIRRLFSKNVGYNRV

SEQ ID NO: 6934 - protein, 341 aa, Panicum virgatum
MAKGSAAMAAAAAAVLALAALLCAPAAAELARLEHPAKNDGSLSLLVVGDWGRKGTYNQSRVAEQMGKVGEQLGIDFVVSTGDNFYENGLTGTDDQAFEQSFTDIYTAKSLQKPWYLVLGNHDYRGDVLAQLSPVLRKIDSRFICMRSFIVNAEIVDFFFVDTTPFQLKYWTHPKDDHYDWRGVAPREKYLANLLKDLDEAMRKSTATWKIAVGHHTMRSVSDHGDTKELLQLLLPVLQANGIDFYINGHDHCLEHISSKNSPIQYFTSGGGSKAWRGVFQPNEDNVEFFYDGQGFMSLQLDHNQAEFTFYDVNGNVLYQYTQSSLRKTSHLQPSGYATEE

SEQ ID NO: 6935 - protein, 346 aa, Pennisetum glaucum
MAKGSAAMAATSAAAVLALAALLLCSSPTAAELPRLEHHPAKNGGSLSLLVVGDWGRKGAYNQSRVAEQMGKVGEELDIDFVVSTGDNFYENGLTGTDDQAFEQSFTDIYTAKSLQKPWYLVLGNHDYRGDVLAQLSPVLQKIDSRFICMRSFIVNAETVDFFFVDTTPFQLKYWTHPKDSHYDWREVAPRAKYLANLLQDLDEAMKKSTATWKIAVGHHTMRSVSDHGDTKELLQLLLPVLQANDVDFYINGHDHCLEHISSRDSPIQYFTSGGGSKAWRGVFQPNEDNLEFFYDGQGFMSLVLDHNQAEFTFYDVDGNVLYQYTRSSLMKTSHQQPSGGYATEE

SEQ ID NO: 6936 - protein, 339 aa, Cenchrus ciliaris
  misc_feature (254)..(254): Xaa can be any naturally occurring amino acid
  misc_feature (271)..(271): Xaa can be any naturally occurring amino acid
  misc_feature (297)..(297): Xaa can be any naturally occurring amino acid
  misc_feature (306)..(306): Xaa can be any naturally occurring amino acid
  misc_feature (312)..(312): Xaa can be any naturally occurring amino acid
  misc_feature (326)..(326): Xaa can be any naturally occurring amino acid
MAATSSSAAAVLALAALLLCSPAAAELPRLEHHPAKNGGSLSLLVVGDWGRKGTYNQSRVAEQMGKVGEQLDIDFVVSTGDNFYENGLKGTDDEAFEQSFTDIYTAKSLQKPWYLVLGNHDYRGDVLAQLSPVLQKIDSRFICMRSFIVNAEIVDFFFVDTTPFQLKYWTHPKDNHYDWREVAPRAKYLANLLQDLDEAMKKSTATWKIAVGHHTMRSVSDHGDTKELLQMLLPVLQANDVDFYINGHDHCLEXISSRDSPIQYFTSGGGXKAWRGVFQPNEDKLEFFYDGQGFMSXELDQNQADXTFYDVXGNVLYQYTRSSLMXTSHLQPSGYATEE

SEQ ID NO: 6937 - protein, 343 aa, Saccharum officinarum
MAQRKAAMVAAAFFVLLAVAPLLCAPAAAELVRLEHPAKNDGSLSLLVVGDWGRKGTYNQSRVAQQMGKVGEQLNIDFVISTGDNFYENGLTGTDDQAFEQSFTDIYTAKSLQKPWYLVLGNHDYRGDALAQLSPVLQKIDSRFICMKSFIVNAEIVDFFFVDTTPFQLKYWTHPKDDHYDWRGVAPREKYINNLLKDLDEAMKKSTAAWKIAVGHHTMRSVSDHGDTKELLQLLLPVLQANGVDFYINGHDHCLEHISSRDSPIQYFTSGGGSKAWRGVQNTNEDDLKFFYDGQGFMSLQLDHSEAYFNFYDVDGKELYHYSRPSLRKTAGHLQASGYVNEE

SEQ ID NO: 6938 - protein, 343 aa, Sorghum bicolor
MAQRKVAMAAAAFFALLAVASLLCAPAAAGLVRMEHPAKNDGSLSLLVVGDWGRKGTYNQSRVAYQMGKVGEQLNIDFVISTGDNFYENGLTGTDDQGFEQSFTDIYTAKSLQKPWYLVLGNHDYRGDALAQLSPVLRKIDSRFICMKSFIVNAEIVDFFFVDTTPFQLKYWTHPKDDHYDWRGVAPREKYINILLKDLDEAMKKSTAAWKIAVGHHTMRSVSDHGDTKELLQLLLPVLQANGVDFYINGHDHCLEHISSRDSPIQYFTSGGGSKAWRGVQNTNEDDLKFFYDGQGFMSLQLDHSEAHFTFYDVDGEALYHYTRPSLRKTAGHLQASGYVNEE

SEQ ID NO: 6939 - protein, 349 aa, Zea mays
MAQGSRSAAVPAAASFFALLAVAAPLLLCCAPAAAELARLEHPPKDGGSLSLLVVGDWGRKGTFNQSRVAHQMGRVGEQLSIDFVISTGDNFYENGLTGTDDEAFEQSFTDIYTAKSLQKPWYLVLGNHDYRGDALAQLSPVLRKIDSRFICIKSFVVNAEIVEFFFVDTTPFQLKYWTHPKDDHYDWRGVAPRENYINNLLKDLDGAMKTSTAAWKVAVGHHTMRSVSDHGDTKELLQLLLPVLQANGVDFYINGHDHCLEHISSRDSPIQYFTSGGGSKAWRGVQNPTEDDLKFFYDGQGFMSLQLDRSQAKFTFYDVDGKALYSYTRSSLMETGHHLQASGYVNEE

SEQ ID NO: 6940 - protein, 335 aa, Setaria italica
MAKGGAAMALALLAAAAALLCAVAALPRLEHPAKTDGSLSLLVVGDWGRKGMYNQSRVAEQMGRVGEELDIDFVVSTGDNFYETGLTGVDDHAFEQSFTDIYTAKSLQKPWYLVLGNHDYKGNALAQFSPVLRKIDSRFICMRSFIVNAEIADFFFIDTTPFQLKYWTHPKGNHYDWRGVAPREKYITNLLKDLDEAMKKSTAKWKIAVGHHTMRSVSHHGDTKELLQLLLPILKINGVDFYINGHDHCLEHISSRDSPIQYFTSGGGSRAWRGFFQPNEDSLKFFYDGQGFMSLQLHQDQADFIFYDVDGNILYRYSQWSLRKAYLPASYFAEE

SEQ ID NO: 6941 - protein, 338 aa, Leymus cinereus x Leymus triticoides
  misc_feature (57)..(57): Xaa can be any naturally occurring amino acid
  misc_feature (61)..(61): Xaa can be any naturally occurring amino acid
MARRSGASMAVVLAVLAVAALRCAPAAAELPLVEHPAKNDGSLSLLVIGDWGRKGTXNQSXVAEQMGKVGEKLDIDFVVSTGDNFYENGLTGVHDQQFEQSFTNIYTAQSLQKPWYLVLGNHDYRGDALAQLDPVMRKIDERFVCMRSFVVNAEIVEFFFIDTTPFQLKYWTHPKDSHYDWRGVAPRENYIANLLKDLDEAMKKSTAKWKIAVGHHTMRSVSDHGDTKELLQLLLPVLKVNGIDFYINGHDHCLEHISSRDSPIQYFTSGGGSKAWRGVYQPNDDKLQFFYDGQGFMSLQLNQDQADFVFYDVSGKVLYEWTSRKTNHFQPSIYVTAE

SEQ ID NO: 6942 - protein, 334 aa, Brachypodium distachyon
MARSRAPMAAFLALLAVAAGVAAAELTRVEHPAKNDGSLSLLVVGDWGRKGNYNQSRVAEQMGKIGEKLDIDFVVSTGDNFYENGLTGVHDQQFEESFTNIYTAKSLQKPWYLVLGNHDYRGDALAQLSPVLQKLDERFFCMRSFIVNAEIVDIFFIDTTPFQLKYWTHPKDSHYDWREVAPRETYIADLLKDMDKEMKKSTAKWKIAIGHHTMRSVSDHGDTKELLQLLLPVLKVNGIDFYINGHDHCLEHISSKDSPIQYFTSGGGSKAWRGVYQPNDDNLQFFYDGQGFMSLQLNQDQADFIFYDVSGNILYQWSSSKISHLQPSIYVTEK

SEQ ID NO: 6943 - protein, 839 aa, Panicum virgatum
MAEPPQQPSSGPTTPPQEDNQSAKTNSKKSRGTKKSKRASASSLGSSTMAEDPFFVLAGGKEGGFLELEEIDEADFGIVGADVGHVGADEGKAGGDRGKKKKKKKKKRKRGDDDEKRNSDDDEGLNGDGNSVVENVQEGEKEKEKKKTKTKTKRKRNRKKRKVKDSEKSAESDEEVADDNAEGMQDENENMEQDKDDQLILGEDDVFAWHELRLHPLLVKAMCRLGFKEPTPIQKSCFPAAAHQGKDVIGAAETGSGKTLAFGLPILQRLLEEREKAARLHQDDEKMEESSGGSPLRALILTPTRELAKQVCDHLKDAAKFLGIHAVPIVGGLSMEKQERLLKKKPEIVVGTPGRLWELMSMNNQHLVELHSLSFFVLDEADRMIERGHFHELQSIIEMLPLTTGSDEHAARTMPNCETVPILQIKKRQTFVFSATLALSSNFRKKLKRGLSISKASTDDVSSIEALSKQAGMKPNAEIVDLTKASILPEKLEESFIECSEEDKDAYLYYILSVHGQGRTIIFCTSIAALRHISSILRILGINVLTNHAQMQQRARMKAVDRFRGSENSILVATDGFARGMDFDDVRTVIHYQLPHSTDVYIHRSGRTARRSLAGCSIALISSADKSKFYSLCKSLSKENLQQFPVDHAYMPEVMNRLSLARQIDKIARKSSQENANKSWLQRNAESMGLLLETSDSEEERVKGHMQRKATSAHLQKLQQELSDLLKRPLQPKTFSRCYLAGAGISPLLQKQLEELTKRNVSNKSSKSENKGPRLVVIGQDRVEPLQALQNSGQEVCVNLDKQKEKQRLAQNWKRKKHEEKKRTREQKRKEKRKAKGTE

SEQ ID NO: 6944 - protein, 784 aa, Panicum virgatum
MAENPFFVLAGGKEGGFLELEEIDEADFGIVGGDVEDARADEGNAGKDLGKKMMKKKKRKRGDDDEKRNSDDDKGLNGDGNSVVENEQEGEKEKKKTKRKRNRKKRKVKDSEKSGESDEEVTDDNAEDMQDENENMEHDKDDELVFGEDGVFAWRELRLHPLLVKAMRRLGFKEPTPIQKSCFPAAAHQGKDVIGAAETGSGKTLAFGLPILQRLLEEREKAARLHHDDEKMEESSGGIPLRALILTPTRELAKQVCDHLKDAAKFLGIHVVPIVGGLSMEKQERLLKKKPEIVVGTPGRLWELMSMNNQHLVELHSLSFFVLDEADRMIERGHFHELQSIIEMLPLTNGSDEQAARTMPNCETVPILQIKKRQTFVFSATLALSSNFRKKLKRGLSTSKASTDDVSSIEALSKQAGMKPNAEIVDLTKASILPEKLEESFIECSEEDKDAYLYYILSVHGQGRTIIFCTSIAALRHISSILRILGINVLTNHAQMQQRARMKAVDRFRGSENSILVATDGFARGMDFDDVRTVIHYQLPHSTDVYIHRSGRTARKSLAGCSIALISPTDKSKFYSLCKSLSKENLQQFPVDHAYMPEVMNRLSLARQIDKIARKSSQENANKSWLQRNAESMGLLLETSDSEEERVKSHKQRKATSAHLQKLQQELSDLLKRPLQPKTFSRRYLAGAGISPLLQKQLEELAKRNVSNKSSKSENKGSCLVVIGQDRIEPLQALQNSGQEVCVNLDKQKEKRKLAQNWKRKKHEEKKCTREQKRKEKRKAKGME

SEQ ID NO: 6945 - protein, 842 aa, Zea mays
MAEPEPLPQVSSEPTTPPQEGSGRTKTKNKKNRSKKQPKRAGADTDGLSSGASTMVEDPFFVLAGGKEGGFLDLEEIDEADFGIFGGVLDDVGQSVEEAGKDHGKKKKKTKKRKRGGDGEGFSGDAALVVENDQVDVEKVEKKVEDGEKGDKKGKRKMNMKKRKVKDNEMNRESDEDVASDKAEDMQDDTENMEQNEDDELILGEDDVSAWRELRLHPLLLKAMRRLGFKEPTPIQKSCFPAAAHRGKDVIGAAETGSGKTLAFGLPVLQRLLEEREKATRLQQEDEKMEERSCGSPLRALILTPTRELAKQVCDHLKDVAKFLGIHVVPIVGGLSMEKQERLLKKKPEIVVGTPGRLWEHMSMNNQHLVELHSLSFFILDEADRMIERGHFRELQSIIEMLPLTNGSDEQAARTMPNCETVPILQIKKRQTFVFSATLALSSNFRKKLKRGLSTSKASTPDDVSSIEALSKQAGMKSNAEIVDLTKASILPEKLEESFIECSEEDKDAYLYYILSVHGQGRTIIFCTSIAALRHISSILRILGINVLTNHAQMQQRARMKAVDRFRESENSILVATDGFARGMDFDDVRTVIHYQLPHSTDVYIHRSGRTARKSLAGCSIALISPTDKSRFYSLCKSLSKENLQQFPVDHAYMSGVMNRLSLARQIDKIARKTSQENANKSWLQRNAESMGLILDASDSEEDHVQGHKKRKATSAHLQKLQQELSDLLQCPLQPKTFSRRYLAGAGVSPLLQKQLEELAKRNASNNSSKSKNKGSGFVVIGQDRVEPLQALQNSGQEVCVNIDKEREKRRVSENWRRKKHEEKKRTREQKRKDKRKAKEMA

SEQ ID NO: 6946 - protein, 831 aa, Brachypodium distachyon
MDEAPEQPSSDPPTPPQELNQRSKKNKKGRTKKPKRAAAAATSSSGPTMVEDPFFVLAGGKEGGFLELEEIDGADFGIFGGTVEDVEASDRKVGSDQKKKKKKKKRKRGHGAERLDGDDDGDCASGELVFESKEEGNKGEKKGKSKKRNRKKRKVKDTEQDSESKEDVDNVEDMQDGIENMKQDNDDELKLGEDEFYAWLELRLHPLLVKAMHRLGFKEPTPIQKACFPAGAHQGKDVIGAAETGSGKTLAFGLPILQRLLEEREKATRLNVEDKKAMEESSTGGPLRALILTPTRELAKQVCDHLKEASKFLGIHVVPIVGGLSMEKQERLLKKKPEIVVGTPGRLWELMSTGNQHLVELHSLSFFVLDEADRMIERGHFKELHSIIEMLPLSNSSDEQAVRATPSCETVLNLQIKKRQTFVFSATLALSANFRSKLKRGLSTSKASMADNLSSIEALSKQAGMKPNAEIVDLTNASILPEKLEESFIECSDDDKDANLYYILSVHGQGRTIIFCTSIAALRHISSLLRILGINVLTNHAQMQQRARMKAVDRFRESENSILVATDGFARGMDFDNVRTVIHYQLPHSSDVYIHRSGRTARKSLAGCSIALISPADKAKFYSLCKSFSKENLQQFPVDHAYMPAVMNRLSLARQIDKISRKNSQENANKSWLQRNAESMGLILEGSDSEEERVQGHKQRKAISAQLQKLQQDLNELLQRPLQPKTFSRRYLAGAGVSPLLQKQLEELSKRDVNGNSSKNENKGSQFVIIGQDRMEPLQALQNSGQEICVNMDKQREKRRLAENWKRKKHEEKKSTREQKRKDRRKAKERD

SEQ ID NO: 6947 - protein, 832 aa, Oryza sativa
MAAAPPPPPPPQLQSSDPSTPPQETSQVRKGKKSRGAKKPRRAAAAAAASTSSAGTMVEDPFLVLAGGKEGGFLELEEIDEADFGIFGGAVEDLGEIDRKAGKDQKKKKRKKRKRGDDDYALPGDGDLVVECEEEGEKGEKRVKKKRRSRKKRKVKEMEEKMESKEDVSDDNVEDMQDGNDMEQDNNDGLILGEDEVYAWRELRLHPLLITAVRRLGFKEPTPIQKACFPAAAHQGKDVIGAAETGSGKTLAFGLPILQRLLEEQEKAMRLSREDESTQDENSRESPLRALILTPTRELAKQVCDHLKEAAKFLRIQVVPIVGGLSMEKQERLLKRKPEIVVGTPGRLWELMSTGNQHLIKLHSLSFFVLDEADRMIERGHFHELQSIIEMLPVTNGSDEQTVGTTPSCETVPILQIKKRQTFVFSATLALSANFRKKLKRGLVTAKASASTDLSSIEALSKQARMKPNAEIVDLTKASILPEKLEESFIECSDDDKDAYLYYILSVHGQGRTIIFCTSIAALRHLSSILRVLGINVLTNHAQMQQRARMKAVDRFRESENSILVATDGFARGMDFDDVRTVIHYQLPHSTDVYIHRSGRTARKSMAGCSIALISPADKAKFYSLCKSLSKENLQQFPVDHAYMPAVMNRLTLARQIDKITRKNSQENANKSWLQRNAESMGLLLETSDSEEERVQGHKQRKATSANLQKLQQDLSELLQRPLQPKTFSRRYLAGAGVSPLLQKQLEELSKRNVKGSASVNANKGSRFVVIGQDQIEPLQALQNSGQEVCVSIDKQREKRRLAENWRRKKQKEKKSTREQKRKEKRIAKERD

SEQ ID NO: 6948 - protein, 618 aa, Panicum virgatum
MEDIEDVLGPAGLSGGGASPGLRHPVAAVAVKPKRRSSRVAQTPTQPEPRIPGTQTIYVKTFGCSHNQSDSEYMSGQLSAFGYAITEEPEGADLWLINTCTVKNPSQSAMTTLISKCKNANKPLVVAGCVPQGSQGLKELEGISIIGVQQIDRVVEVVEETLKGHEVRLLSRKTLPSLDLPKVRKNKFIEILPINVGCLGACTYCKTKHARGHLGSYTIDSLVDRVKTVVSEGVREIWLSSEDTGAYGRDIGTNLPNLLNAIVAELPVDRSTMLRIGMTNPPFILEHLKEIAAVLRHPSVYSFLHVPVQSGSDAVLTAMNREYTVGEFRKVVDTLCELVPGMQIATDIICGFPGETDEDFAETVNLVKEYQFPQVHISQFYPRPGTPAARMKKVPSNDVKKRSRELTSVFESFSPYQGMEGKVERIWITEIATDGVHLVGHTKGYIQVLVIATDSMLGTSASVKITSVGRWSVFGEVIDGSVVVGEAPKQTSSEPQKQHIQNQVEEAGCCATDSCGACACSDVAQHCRPERCEDIPDAPQTSGGVNHQEAVQQSTLVRRNVEGSTKASKSNAARSVGKEQQVNVVTRRGVNVDTILWCGLAVSFAATVALLVLLTGKI

SEQ ID NO: 6949 - protein, 618 aa, Panicum virgatum
MEDIEDVLGPAGLSGGGASPGLRHPWAAVAVKPKRRSSRVAQTPTQPEPRIPGTQTIYVKTFGCSHNQSDSEYMSGQLSAFGYAITEEPEGADLWLINTCTVKNPSQSAMTTLISKCKNANKPLVVAGCVPQGSQGLKELEGISIIGVQQIDRVVEVVEETLKGHEVRLLSRKTLPSLDLPKVRKNKFIEILPINVGCLGACTYCKTKHARGHLGSYTIDSLVDRVKTVVSEGVREIWLSSEDTGAYGRDIGTNLPNLLNAIVAELPVDRSTMLRIGMTNPPFILEHLKEIAAVLRHPSVYSFLHVPVQSGSDAVLTAMNREYTNSEFRKVVDTLCELVPGMQIATDIICGFPGETDKDFAETVNLVKEYQFPQVHISQFYPRPGTPAARMKKVPSNDVKKRSRELTSVFESFSPYQGMEGKVERIWITEIATDGVHLVGHTKGYIQVLVIATDSMLGTSASVKITSVGRWSVFGEVIDGSVVVGEAPKQTSSEPQKQHIQNQVEEAGCCATDSCGACACSDVAQHCRPERCEDIPDAPQTSGGVNHQEAVQQSTLVRRNVEGSTKASKSNAARSVGKEQQVNVVTRRGVNVDTILWCGLAVSFAATVALLVLLTGKI

SEQ ID NO: 6950 - protein, 623 aa, Sorghum bicolor
MEDIEDVLGPADLSGGGAPPGLRLPLAAVAVKPKRRSSRVAQAPPQPEARIPGTQTIYVKTFGCSHNQSDSEYMSGQLSAFGYAITEEPEGADLWLINTCTVKNPSQSAMTTLISKCKNANKPLVVAGCVPQGSQGLKELEGISIIGVQQIDRVVEVVEETLKGHEVRLLSRKTLPSLDLPKVRKNKFIEILPINVGCLGACTYCKTKHARGHLGSYTIDSLVDRVKTVVSEGVREIWLSSEDTGAYGRDISTNLPNLLNAIVAELPVDQSTMLRIGMTNPPFILEHLKEIAAVLCHPCVYSFLHVPVQSGSDAVLTAMNREYTVAEFRKVVDTLYELVPGMQIATDIICGFPGETDEDFSETVNLVKEYQFPQVHISQFYPRPGTPAARMKKVPSNEVKKRSRELTSVFELFSPYQGMEGKVERIWITEIATDGVHLVGHTKGYIQVLVIAPDSLLGTSANVKITSVGRWSVFGEVIEGSVVVGEAPKQTSAKLQKEHIQNQVEEAGCCATDSCGTCACSNEAQQCSPERCEDTSHAPETCGDVTRQEALQPTLVRRSVEGTTKGSKSSAAHSLGKEQQVKVVTRRGVNIDTILWCGLAVSFAVTIALLVILTSKISSTSSP

SEQ ID NO: 6951 - protein, 626 aa, Zea mays
MEDIEDVLGAAGLSGGGAPPGLRLPLAAVAVKPKRRSSRVAQAPPQPEAGIPGTQTIYVKTFGCSHNQSDSEYMSGQLSAFGYAITEDPEGADLWLINTCTVKNPSQSAMTTLISKCKNANKPLVVAGCVPQGSQGLKELEGISIIGVQQIDRVVEVVEETLKGHEVRLLSRKTLPSLDLPKVRKNKFIEILPINVGCLGACTYCKTKHARGHLGSYTIDSLVDRVKTVVSEGVREIWLSSEDTGAYGRDIGTNLPNLLNAIVAELPVDQSTMLRIGMTNPPFILEHLKEIAAVLCHPCVYSFLHVPVQSGSDSVLKAMNREYTVGEFRKVVDTLCELVPGMQIATDIICGFPGETDEDFSETVNLVKEYQFPQVHISQFYPRPGTPAARMKKVPSNEVKKRSRELTSVFESFSPYQGMEGKVEKIWITEIASDGVHLVGHTKGYIQVLVTAPDSMLGTSADAKITSVGRWSVFGVVVEGSVAVIEAPIQTSAELQEEHVQNQVEEAGCCATDSCGACACSNEAQPCGPDRCGDALRAPQTCGGDVVTTRQEALQPTLVRRSVDGTTKGSDSTAAHSAGKEQRVEVVTRRGVDIDTVLWCGLAASFAVTVALLALLTSKILSTTSH

SEQ ID NO: 6952 - protein, 603 aa, Saccharum officinarum
LRLPLAAVAVKPKRRSSRVAQAPPQPEARIPGTQTIYVKTFGCSHNQSDSEYMSGQLSAFGYAITEEPEGADLWLINTCTVKNPSQSAMTTLISKCKNANKPLVVAGCVPQGSQGLKELEGISIIGVQQIDRVVEVVEETLKGHEVRLLSRKTLPSLDLPKVRKNKLIEILTINVGCLGACTYCKTKHARGHLGSYTIDSLVDRVKTVVSEGVREIWLSSEDTGAYGRDISTNLANLLNAIVAELPVDQSTMLRIGMTNPPFILEHLKEIAAVLRHPCVYSFLHIPVQSGSDAVLTAMNREYTVGEFRKVVDTLCELVPGMQIATDIICGFPGETDQDFSETVNLVKEYQFPQVHISQFYPRPGTPAARMKKVPSNEVKKRSRELTSVFESFSPYQGMEGKVERIWITEIATDGVHLVGHTKGYIQVLVIAPDSLLGTSANVKITSVGRWSVFGDVIEGSVAVGEAPKQTSAKLQKEHGQNQVEEAGCCATDSCGTCACSNEAQQCGPERCEDASHAPETCGDVTRQGALQPTTLVRRSAEGTTKGSDSSAAHLLGKEQQVKVVTRRGVNIDTILWCGLAVSLAVTIALLVILTSKISSTSSQ

SEQ ID NO: 6953 - protein, 624 aa, Oryza sativa
MEDIEDVLGPAGIAGGGAAPGLRLPLAAVAVKPKRPRSSRVAQTRPQPEARIPGTQTIYVKTFGCSHNQSDSEYMSGQLSAFGYAITEEPEGADLWLINTCTVKNPSQSAMTTLISKCKSANKPLVVAGCVPQGSRDLKELEGISVIGVQQIDRVVEVVEETLKGHEVRLLSRKTLPSLDLPKVRKNKFIEILPINVGCLGACTYCKTKHARGHLGSYTIESLVDRVKIVVSEGVREIWLSSEDTGAYGRDIGTNLPNLLNGIAAELPADRSTMLRIGMTNPPFILEHLKEIASVLCHPCVYSFLHVPVQSGSDAVLTAMNREYTVSEFRRVVDTLCELVPGMQIATDIICGFPGETDEDFSQTVNLVKQYLFPQVHISQFYPRPGTPAARMKKVPSVEVKKRSRELTSVFESFSPYQGMEGKVERIWITEIATDGVHLVGHTKGYIQVLVIAPDSMLGTSADVKITSVGRWSVFGEVIEGSVVAKETQKHNHSELQEEYRPSQVEEATCCGTDSCGACTCSDAAQQCNPGPERSENSTPQSCGDATHQEAVQSKLVRRNVEGAVKSSESDTAKQVGEIQRLNVAARRFPDVDTILWGGLAVSFATTVTLIALLAYKISSTPSY

SEQ ID NO: 6954 - protein, 625 aa, Secale cereale
MEDIEDVLGPAGFSGGGAPPGLRLPLSTVAVKPKRRSSRLVQTQPQPDAWIPGTQTIYVKTFGCSHNQSDSEYMSGQLSAFGYAITEEPEGADLWLINTCTVKNPSQSAMSTLISKCKTANKPLVVAGCVPQGSRDLKELEGISIIGVQQIDRVVEVVEETLKGHEVRLLSRKTLPSLDLPKVRKNKFIEILPINVGCLGACTYCKTKHARGHLGSYSIDSLVDRVKIVVSEGVREIWLSSEDTGAYGRDIGTNLPNLLNAIVAELPADRSTMLRIGMTNPPFILEHLNEIASVLRHPCVYTFLHVPVQSGSDAVLKAMNREYTVSEFRMVVDTLCELVPGMQIATDIICGFPGETDEDFVETVNLIKEYQLPQVHISQFYPRPGTPAARMKKVPSIEVKKRSRELTSVFEAFSPYEGLKGKVERIWITEIATDGVHLVGHTKGYIQVLVIAPDSMLGTSADAKITSVGRWSVFGEVIEGSVAVKEAAPQQNSAKGQVENRPNRVEEAACSTNTCDSCACSGAESVAQQCTPQRCEGPSDAPTNCGDATRPETPQSMLVRRNVEGAGKTSESDAEKSRREDQQVHVVTRSALNVDRILWGGLAVSFATTVAILVLLTYKLFYTSS

SEQ ID NO: 6955 - protein, 627 aa, Hordeum vulgare
MEDIEDVLGPAGFSGGGAPPGLRLPLSTVAVKPKRRPSRLVQTQPQPDARIPGTQTIYVKTFGCSHNQSDSEYMSGQLSAFGYAITEEPEGADLWLINTCTVKNPSQSAMSTLISKCKTANKPLVVAGCVPQGSRDLKELEGISIIGVQQIDRVVEVVEETLKGHEVRLLSRKTLPSLDLPKVRKNRFIEILPINVGCLGACTYCKTKHARGHLGSYSIDSLVDRVKIVVSEGVREIWLSSEDTGAYGRDIGTNLPNLLNAIVAELPADRSTMLRIGMTNPPFILEHLNEIASILRHPCVYTFLHVPVQSGSDAVLQAMNREYTVSEFRMVVDTLCELVPGMQIATDIICGFPGETDEDFVETVNLIKEYQLPQVHISQFYPRPGTPAARMKKVPSIEVKKRSRELTSVFEAFSPYEGLKGKVERIWITEIATDGVHLVGHTKGYIQVLVIAPDSMLGTSADAKITSVGRWSVFGEVIEGTIAVKEAALQQNSAEVQVENRPNRVEEAVCSTNTCDSDSCACSGVESVAQQCTPQRCEGPSDAPANYGDATRQETPQSTLVRRNVDGAGKTSESDAEKSRGDDHQVNVVTRRALNIDRILWGGLAVSFATTVAILVMLTYKIFYTSS

SEQ ID NO: 6956 - protein, 625 aa, Triticum aestivum
MEDIEDVLGPAGFSGGGAPPGLRLPLSTVAVKPKRRSSKLVQTQPQPDARIPGTQTIYVKTFGCSHNQSDSEYMSGQLSAFGYAITEEPEGADLWLINTCTVKNPSQSAMSTLISKCKTANKPLVVAGCVPQGSRDLKELEGISIIGVQQIDRVVEVVEETLKGHEVRLLSRKTLPSLDLPKVRKNKFIEILPINVGCLGACTYCKTKHARGHLGSYSIDSLVDRVKIVVSEGVREIWLSSEDTGAYGRDIGTNLPNLLNAIVAELPADRSTMLRIGMTNPPFILEHLNEIASVLRHPCVYTFLHVPVQSGSDAVLKAMNREYTVSEFRMVVDTLCELVPGMQIATDIICGFPGETDEDFVETVNLIKEYQLPQVHISQFYPRPGTPAARMKKVPSIEVKKRSRELTSVFEAFSPYEGLKGKVERIWITEIATDGVHLVGHTKGYIQVLVIAPDSMLGTSADAKITSVGRWSLFGEVIEGTVAIKEAALEQNSAEVQVKNSPNRVEEAACSTNTCDSCACSGAESVAQQCTPQRCEGPSDAPTNCGDATRQETPQSTLVRRNVEGAGKTSGSDTEKSRGDDQQVNVITRGAVNIDRILWGGLAVSFATTVAILVLLTCKIFYTSS

SEQ ID NO: 6957 - protein, 549 aa, Pennisetum glaucum
MSGQLSAFGYAITEEPEGADLWLINTCTVKNPSQSAMTTLISKCKNANKPLVVAGCVPQGSQGLKELEGISIIGVQQIDRVVEVVEETLKGHEVRLLSRKTLPSLDLPKVRKNKFIEILPINVGCLGACTYCKTKHARGHLGSYSIGSLVDRVKIVVSEGVREIWLSSEDTGAYGRDIGTNLPNLLNAIVAELPADRSTMLRVGMTNPPFILEHLKEIAAVLRHPCVYSFLHVPVQSGSDAVLTGMNREYTVGEFRKVVDTLCELVPGMQIATDIICGFPGETDEDFAETVNLVKDYQFPQVHISQFYPRPGTPAARMKKVPSNDVKKRSRELTSVFESFSPYQGMEGKVERIWITEIATDGVHLVGHTKGYIQVLVIAPDSMLGTSADVKITSVGRWSVFGEVIEGSVVVEAPKQTSSEPQKEHSQNQVEEAGCCGTNSCGTCACSDPVQHCSPERCDNTPNAPQTIGDVNCEEAIQPTLVRRNVEGSTKASENSAVARSVGQEQEVNLVTRRGVDVDTILWCGLAVSFAATVALIVLLTSKISSTSS

SEQ ID NO: 6958 - protein, 624 aa, Brachypodium distachyon
MEDIEDVLGPAGFSGGGAPPGLRLPLSTVAVKPKRRSSRLAQTQQQPEARIPGTQTIYVKTFGCSHNQSDSEYMSGQLSAFGYAITEEPEGADLWLINTCTVKNPSQSAMTTLISKCKNANKPLVVAGCVPQGSRDLKELEGISIIGVQQIDRVVEVVEETLKGHEVRLLSRKTLPSLDLPKVRKNKFIEILPINVGCLGACTYCKTKHARGHLGSYSIDGLVDRVKIVVSEGVREIWLSSEDTGAYGRDIGTNLPNLLSAIVAELPADRSTMLRIGMTNPPFILEHLNEIASVLRHPCVYTFLHVPVQSGSDAVLKAMNREYTVSEFRMVVDTLCELVPGMQIATDIICGFPGETDEDFAQTVKLIKEYKLPQVHISQFYPRPGTPAARMKKVPSIEVKKRSRELTSVFEAFSPYQGLEGKVERIWITEIATDGVHLVGHTKGYIQVLVIAPDSMLGTSANVKITSVGRWSVFGEVIEGSIAAKEVLKQNPAEAQEEYRENHAEEATCSTNSCGSCACSGAENVAQQCGPHRSEDPSDAPTDCGDATCEEAAQYTLVRRNVERTMKTRESDTGKPVVKDQQVNLANRRVINIDRILWVGLAVSFATTLALFVLLSYKIFWSSY

SEQ ID NO: 6959 - protein, 550 aa, Panicum virgatum
MSGQLSAFGYAITEEPEGADLWLINTCTVKNPSQSAMTTLISKCKNANKPLVVAGCVPQGSQGLKELEGISIIGVQQIDRVVEVVEETLKGHEVRLLSRKTLPSLDLPKVRKNKFIEILPINVGCLGACTYCKTKHARGHLGSYTIDSLVDRVKTVVSEGVREIWLSSEDTGAYGRDISTNLPNLLNAIVQELPVDRSTMLRIGMTNPPFILEHLKEIAAVLRHPCVYSFLHVPVQSGSDAVLTAMNREYTVGEFRKVVDTLCELVPGMQIATDIICGFPGETDEDFAETVNLVKEYQFPQVHISQFYPRPGTPAARMKKVPSNDVKKRSRELTSVFESFSPYKGMEGKVERIWITEIATDGVHLVGHTKGYIQVLVIAPDSMLGTSANVKITSVGRWSVFGEVIEGSVVAGEAPKQTSSEPQKEHIQNQAEDAGCCATDSCGACACSDVAQHCGPERCEDIPDAPQTSGNVNQQGAVQSTLVRRNVEGSTKASESNAAQSVGKEQQVNIVTRRGVNVDTILWCGLAVSFAAIVALLVLLTGRISSTSSY

SEQ ID NO: 6960 - protein, 70 aa, Zea mays
MAGGNLFGRALSYVVNELLVEGLANNRAFQRFAVKTNRTLESLSSKAKEVREELSEQLKEARGQKDHFKQ

SEQ ID NO: 6961 - protein, 70 aa, Panicum virgatum
MAGGNLLGRALSYVVNEFLVEGLANSRAFQRFAVKTNRTLESLSSKAKEVREELSEQLKDARGQNDHFKR

SEQ ID NO: 6962 - protein, 70 aa, Panicum virgatum
MAAGNLFGRALSYVVNEFLVEGLANSRAFQRFAVKTNRTLENLSSKAKEVREELSEQLKDARGQNDHFKR

SEQ ID NO: 6963 - protein, 70 aa, Zea mays
MAGGNLFGRALSYVVNEFFVQGLANNRAVQRFAVKTNKTLESLSSKAKEMREELSEQFKDARGQKDHFKQ

SEQ ID NO: 6964 - protein, 70 aa, Avena sativa
MAGGNLFGRALSYVVNQFLVEGLANNRAFQRFAVRTNRTFENLSSKAKEVKQEVSEKWRDVRGQDDHFRQ

SEQ ID NO: 6965 - protein, 71 aa, Oryza sativa
MAGGGNLFGRVLSYVVNEFIVEGLANNRTFQRFAVRTNKSLENLSSKAKEVREELSEQWRNSRGNDDHFRQ

SEQ ID NO: 6966 - protein, 70 aa, Lolium multiflorum
MAGGNLFGRALSYVVNQFLVEGLANNRAFQRFAVRTNRTFENLSSKAKEVKQDVSEKWRDVRGQDDHFRQ

SEQ ID NO: 6967 - protein, 217 aa, Panicum virgatum
MPARPLLVLAALLLAALLLSAASAADSKNNPADQLVSLINSNRTASKASSLSDNQGLGCIALQYIKAYEGQCSDVRDKKPPETSFAEIFAPSCGVQVATLSKITGRLVGCQSKYPSPPEAFDILVNDAKDLQVLHSKNHTEIGVAVSGTDGGGPYFWCVLFSGGKPATSFKVDGEVPKTAMHPGCFSGNNDDCAGPKNGAIPISAGASRLAAALLFV

SEQ ID NO: 6968 - protein, 218 aa, Panicum virgatum
LVLAVLLLPALLLSAASAADSKNNPADELVALINSNRTASKASSLSDNQGLGCIALQYIKAYEGQCSDVRDKKPPETSFAEIFAPGCGVQVATLSKITGRLVGCQSKYPSPPEAFDILVNDAKDLQVLHSKNHTEIGAAVSGTDGGGPYFWCVLFSGGKPATSFKVEGEVPKTAMHPGCFSGNNDDCAGPKNGATPISAGASRLVAALLFVVACAVTL

SEQ ID NO: 6969 - protein, 328 aa, Panicum virgatum
MSWCTIESDPGVFTELIQQMQVKGVQVEELYSLDVDSLSELRPVYGLIFLFKWIPGEKDERPVVRDPNPNLFFAQQVINNACATQAILSVLMNRPEIDIGPELSQLKEFTGAFTPDLKGLAISNSESIRTAHNSFARPEPFISDEQRAATKDDDVYHFISYLPFEGVLYELDGLKEGPVNLGQCDGSDDLDWLRMVQPVIQERIECYSQSEIRFNLMAIIKNRKEVYSAELEELEKRREQILQEMNNTSATESLNNSLTEVISAIETVSEKIIIEEEKFKKWKTENIRRKHNYIPFLFNLLKMLAEKQQLKPLVEKAKQQKSSSASTR

SEQ ID NO: 6970 - protein, 328 aa, Sorghum bicolor
MSWCTIESDPGVFTELIQQMQVKGVQVEELYSLDVDSLSQLRPVYGLIFLFKWIPGEKDERLVVRDPNPNLFFAHQVITNACATQAILSVLMNRPEIDIGPELSQLKEFTGAFTPDLKGLAISNSESIRTAHNSFARPEPFISDEQRAATKDDDVYHFISYLPFEGVLYELDGLKEGPVNLGQCGGADDLDWLRMVQPVIQERIERYSQSEIRFNLMAIIKNRKEVYSAELEELEKRREQILQEMNKTAATESLNNSLTEVISAIETVREKMVMEEEKFKKWKTENIRRKHNYIPFLFNLLKMLAEKQQLKPLVEKAKQQKSSSPSTR

SEQ ID NO: 6971 - protein, 328 aa, Panicum virgatum
MSWCTIESDPGVFTELIQQMQVKGVQVEELYSLDVDSLSELRPVYGLIFLFKWIPGEKDERPVVRDPNPNLFFAQQVINNACATQAILSVLMNRPEIDIGPELSQLKEFTGAFTPDLRGLAISNSESIRTAHNSFARPEPFISDEQRAATKDDDVYHFISYLPFEGVLYELDGLKEGPVNLGQCDGSDDLDWLRMVQPVIQERIERYSQSEIRFNLMAIIKNRKEVYSAELEELEKRREQILQEINNTSATESLNNSLTEVISAIETVSEKIIMEEEKFKKWKTENIRRKHNYIPFLFNLLKVLAEKQQLKPLVEKAKQQKSSSSGTK

SEQ ID NO: 6972 - protein, 327 aa, Saccharum officinarum
MSWCTIESDPGVFTELIQQMQVKGVQVEELYSLDVDSLSLLRPVYGLIFLFKWIPGEKDERPVVRDPNPNLFFAHQVITNACATQAILSVLMNRPEIDIGPELSQLKEFTGAFTPDLKGLAISNSESIRTAHNSFARPEPFISDEQRAVTKDDDVYHFISYLPFEGVLYELDGLKEGPVNLGQCGGADDLDWLRMVQPVIQERIERYSQSEIRFNLMAIIKNRKEVYSAELEELERRREQILQENKTSATESLNNSLTEVISAMETVTEKMIMEEEKFKKWKTENIRRKHNYIPFLFNLLKMLAEKQQLKPLVEKAKQQKSSSRSTR

SEQ ID NO: 6973 - protein, 328 aa, Zea mays
MSWCTIESDPGVFTELIQQMQVKGVQVEELYSLDVGSLSQLRPVYGLIFLFKWIPGEKDERPVVRDPNPNLFFAHQVITNACATQAILSVLMNRPEIDIGPELSQLKEFTGAFTPDLKGLAISNSESIRTAHNSFARPEPFISDEQRAATKDDDVYHFISYLPFEGVLYELDGLKEGPVNLGQCDGADDLDWLRMVQPVIQERIERYSQSEIRFNLMAIIKNRKEVYSAELEELEKRREQILQEMNNASSTESLSSSLTEVISAIETVTEKVIMEEEKFKKWKKENIRRKHNYIPFLFNLLKMLAEKQQLKPLVEKAKQQKSASPSTS

SEQ ID NO: 6974 - protein, 331 aa, Pennisetum glaucum
MSWCTIESDPGVFTELIQQMQVKGVQVEELYSLDVDSLSELRPIYGLIFLFKWIPGEKDERPVVRDPNPNLFFAHQVINNACATQAILSVLMNRPEIDIGPELSQLKEFTGAFTPDLKGLAIGNSESIRAAHNGFARPEPFISDEQRAATKDDDVYHFISYLPFEGVLYELDGLKEGPVNLGQCGGLDDLDWLRMVQPVIQERIERYSQSEIRFNLMAIIKNRKDVYSAELEELEKRREEILQEMNKAPAAAESLNSSLTEVVSAIETVRERIIMEEEKLKKWKAENVRRKHNYIPFLFNLLKTLAEKQQLRPLVEKARQQHKSPSPSTTR

SEQ ID NO: 6975 - protein, 331 aa, Oryza sativa
MSWCTIESDPGVFTELIQEMQVKGVQVEELYSLDVDSISELRPVYGLIFLFKWMAGEKDERPVVKDPNPNLFFASQVIPNACATQAILSILMNRPEIDIGPELSNLKEFTGAFAPDMKGLAINNSDSIRTAHNSFARPEPFVSDEQRAAGKDDEVYHFISYLPFEGVLYELDGLKEGPISLGQCSGGPDDLDWLRMVQPVIQKRIERYSQSEIRFNLMAIIKNRKDVYTAELKELEKRRDQLLQEMNESSAAESLNSELAEVTSAIETVSEKIIMEEEKFKKWRTENIRRKHNYIPFLFNFLKMLAEKKQLKPLVEKAKQQKASSTSTSAR

SEQ ID NO: 6976 - protein, 329 aa, Brachypodium distachyon
MSWCTIESDPGVFTELIQEMQVKGVQVEELYSLDVDSLSELRPVYGLIFLFKWVAGGKDERPVVNDPNPNLFFARQVITNACATQAILSILMNRPEIDIGPELSNLKEFTGAFAPDMKGLAINNSDSIRAAHNSFARPEPFVSDEQKVAGKDDDVYHFISYLPFEGVLYELDGLKEGPISLGQYSGGPNDLGWLQMVQPVIQERIERYSQSEIRFNLMAIIKNRKDVYTAELKELEKKREQILQEMNKTTAAESLNSELSEVASAIETVGEKIMMEEEKFMKWKTENVRRKHNYIPFLFNLLKTLAEKKQLKPLVEKARQQKTPSASTS

SEQ ID NO: 6977 - protein, 338 aa, Triticum aestivum
MSWCTIESDPGVFTELIQEMQVKGVQVEELYSLDVDSLSQLQPVYGLIFLFKWMPGGNDERPVVSDPNPNLFFARQVITNACATQAILSILMNRPEIDIGPELSNLKEFTGAFAPDMKGLAINNSDSIRAAHNSFARPEPFVSDEQKAATKDDEVYHFISYIPFEGVLYELDGLKEGPISLGQYPGGPEDLGWLQMVQPVIQERIERYSQSEIRFNLMAIIKNRKDVYTAELKELEKKREQILQELSNEATAAAEKESLNGTLAEVALAVEAVGEKIAMEEEKFRKWKTENVRRKHNYIPFLFNLLKALAEKKQLTPLVEKARQQKAPATAGASASTS

SEQ ID NO: 6978 - protein, 339 aa, Leymus cinereus x Leymus triticoides
MSWCTIESDPGVFTELIQEMQVKGVQVEELYSLDVDSLSQLRPVYGLIFLFKWMPGGNDERPVVSDPNLNLFFARQVITNACATQAILSILMNRPEIDIGPELSNLKEFTGAFAPDMKGLAINNSDSIRAAHNSFARPEPFVSDEQKAATKDNEVYHFISYIPFEGVLYELDGLKEGPISLGQYSGGPEDLGWLQMVQPVIQERIERYSQSEIRFNLMAIIKNRKDVYTAELKELEKKREHILQELSNEATATAEKESLNGALAEVASAVEAVGEKIAMEEEKFRKWKTENVRRKHNYIPFLFNLLKALAEKQQLKPLVEKARQQKAPATTTGASASTS

SEQ ID NO: 6979 - protein, 334 aa, Secale cereale
MSWCTIESDPGVFTELIQEMQVKGVQVEELYSLDVDSLSQLQPVYGLIFLFKWMPGGNDERPVVSDPNPNLFFARQVITNACATQAILSILMNRPEIDIGPELSNLKEFTGAFAPDMKGLAINNSDSIRAAHNSFARPEPFVSDEQKVATKDDEVYHFISYIPFEGVLYELDGLKEGPVSLGQYTGGPEDLGWLQMVQPVIQERIERYSQSEIRFNLMAIIKNRKDVYTAELKELEKKREQILQELSNEAADKEALNGALAEVALAVEAVGEKIAMEEEKFRKWKTENVRRKHNYIPFLFNLLKALAEKKQLTPLVEKARQQKAPATGASASTS

SEQ ID NO: 6980 - protein, 340 aa, Triticum aestivum
MSWCTIESDPGVFTELIQEMQVKGVQVEELYSLDVDSLSQLQPVYGLIFLFKWMPGGNDERPVVSDPNPNLFFARQVITNACATQAILSILMNRPEIDIGPELSNLKEFTGAFAPDMKGLAINNSDSIRAAHNSFARPEPFVSDEQKAATKDDEVYHFISYIPFEGVLYELDGLKEGPISLGQYPGGPEDLGWLQMVQPVIQERIERYSQSEIRFNLMAIIKNRKDVYTAELKELEKKREQILQELSNEATAAAEKEPLNGALAEVALAVEAVGEKIAMEEEKFRKWKTENVRRKHNYIPFLFNLLKALAEKKQLTPLVEKARQQKAPAAAGASASASTS

SEQ ID NO: 6981 - protein, 534 aa, Pennisetum glaucum
EIKAAAEPAADQNSKPKDAKTHEPTAEAEAGFAEEEYEEDGEEYEEDEDEDEELDGPAAAAAERERMQSVFRRLSSDPVGIRVHDVIIKGNTKTRDELIEAEVFDLLRAAPTVQDLLRAASVATGRLHRLDVFDAVKITLDAGPPELPGTTNVVVEVVEAANPLTGTAGVYSKPEARSWSLEGSLKLKNPLGYGDIWDASGSYGWDQTTEVGVGVYLPRFKSIPTPLMARASLSSQDWLKFSSYKERLLGLSFGLISTMNHDLSYNLTWRTLTDPSRASSKAIRRQLGHNLLSALKYTYKIDERDSLLRPTKGYAFQSTSQVGGLWGNKGLRFFRQEFDVRGAVPLGFYNAALNVGVGAGVILPLGRGFMNSSSPVPDRFFLGGHSSPVCNLSGLSSLLGFKTRGVGPTEARRLVPNESDSGSAPAPGRDYLGGDLAVSAFADLSFALPLKLFRDAGIHGHAFLTAGNLAKLSEGEYKNFSVSDFKRTFRSSAGAGIILPTKLFRVEVNYCYILKQAEHDSGKTGIQFSFSSPM

SEQ ID NO: 6982 - protein, 537 aa, Panicum virgatum
MAAAADRAADQNPKPRDAETHVPAAETEPEFAEGYEEDGEEEYEEDGEEYEDDEEELDGPAAAAAERERVQSVFKRLSSDPVAIRVHDVVIKGNTKTRDELIEAEVADLLRAAPTVQELLRAASVATSRLHRLDVFDAVKITLDAGPPELPGTTNVVIEVVEAANPLTGSAGVYSKPEARSWSLEGSLKLKNLFGYGDIWDASGSYGWDQTTEVGVGVYLPRFKSVPTPLMARASLSSQDWLKFSSYKERLLGLSFGLLSTMNHDLSYNLTWRALTDPSRASSKAIRRQLGHNLLSALKYTYKIDQRDSLLRPTKGYAFQSTSQVGGLWDNKGLKFFRQEFDVRGAVPLGFYNAALNVGIGAGVILPLGRGFMNSSSPVPDRFFLGGHSSPVCSLGGLSSLLGFRTRGVGPTEARRLVPSESDSDSAASPGRDYLGGDLAVSAFADLSFDLPLKLFRDAGIHGHAFLTAGNLAKLSEGEYKNFSVSEFQRTFRSSAGVGIILPTKLFRVEVNYCYILKQAEHDSGKTGIQFSFSSPM

SEQ ID NO: 6983 - protein, 530 aa, Sorghum bicolor
MAAAADSAAGQNPKDDERHVLTADSDARFSEEEYEEDGEEEYEEEEEEEELDGPAAEAAERERVQSVFRRLSSNPVGIRVHDVLIKGNTKTRDELIEAEVADLLRAAPTVQDLLRAASVATARLHSLDVFDTVKITLDAGPPELPGTTNVVIEVVEAANPLTGTAGVYSKPEARSWSLEGSLKLKNLFGYGDIWDASGSFGWDQTTEVGVGVYLPRFKSIPTPLMARASLSSQDWLKFSSYKERLLGLSFGLLSTRNHDLSYNLTWRTLTDPSHVSSKAIRRQLGHNLLSALKYIYKIDKRDSHLRPTKGYAFQSTSQVGGLWNSKGLRYFRQEFDVRGAVPLGFYNAALNVGVGAGVILPLGGGFMNSTSPVPERFYLGGNSSPVCSLGGLSSLLGFRLRGVGPTEARRHVLDKPESGSGDPGRDYLGGDLAVSAFADLSFDLPLKIFRDAGIHGHAFLTAGNLAKLSEGEYKNFTASEFQRTFRSSAGVGIILPTKLFRVEVNYCHILKQAEHDSSKTGIQFSFSSPM

SEQ ID NO: 6984 - protein, 527 aa, Zea mays
MAAAADSASDQNPKDAERHVLTAESDADFSEEDYDEDGEEEYEEEEELDGPAAAAAERERMQSVLRRLSSDPVGIRVHDVIIKGNTKTQDELIEAEVAELLRAAPTVQDLLRAASVATARLHDLDIFDAVKITLDAGPPELPGTTNVVIEVVEVANPLTGTAGVYSKPEARSWSLEGSLKLKNLFGYGDIWDASGSFGWDQTTEVGVGVCLPRFKSIPTPLMARASLSSQDWLKFSSYKERLLGLSFGLLSTRNHDLSYNLAWRTLTDPSRVSSKAIRRQLGHNLLSALKYTYKIDKRDSHLRPTKGYAFQSTSQVGGLWNSKGLRYFRQEFDVRGAVPLGFYSAALNVGVGAGVILPLAGGFMNSTSSVPERFYLGGNSSPVCSLGGPSSLLGFRLRGVGPTEARRHVLNNSESGSADPGRDYLGGDLAVSAFADLSFDLPLKIFRDAGIHGHAFLTAGNLAKLSEGEYKNFSASEFRQTFRSSAGVGIILPTKLFRVEVNYCRILKQAEHDSAKTGIQFSFSSPM

SEQ ID NO: 6985 - protein, 215 aa, Saccharum officinarum
DAWAAADSATGQNPKDTERHVLTAESDAEFSEEEYDEDGEEEYEEEEELDGPAAEAAERERVQSVLRRLSSNPVGIRVHDVIIKGNTKTRDELIEAEVAALLRAAPTVQDLLRAASVATARLHSLDVFDAVKITLDAGPPELPGTTNVVIEVVEAANPLTGTGGVYSKPDARSWSLEGSLKLKNLFGYGDIWDASGSFGWDQTTEVGVGVYLPRF

SEQ ID NO: 6986 - protein, 520 aa, Oryza sativa
MATAADQNPNDAEHREAAAGANAAAEEYEEEDEEEEEVELDGPAAVAAEREKVQAVFKRLSSDPVGIRVHDVIIKGNAKTKEELIEAEVAELLRAAPTVQDLLRNASIASARLRQLDVFDSVNITLDAGPPELPGTTNVVVEVVEAANPITGSAGVYSKPEARSWSLEGSVKLKNLFGYGDIWDASGAYSWDQTSEVGIGVSLPRFKSISTPLMARASLSSQDWLKFSSYKERLLGLSFGLISTMQHDLSYNLTWRTLTDPSQVSSKSIRRQLGHNLLSALKYTYKIDQRNSHLRPTKGYAFLSTSQVGGLWDSKGLRFFRQEFDVRGAVPLGFYNSALNVGLGVGAILPLGRGFMNLSSSVPDRFYLGGHSSPVCSLSGLSSLLGFRTRGIGPTEPRRLVPSESEDGSAASPGRDYLGGDLAVSAFADLSFDLPLKIFRDAGIHGHAFLTAGNLAKLSEGEYKKFSLSEFGRTFRSSAGVGIILPTKLFRVEVNYCYILKQAEHDSGRTGIQFSFSSPL

SEQ ID NO: 6987 - protein, 556 aa, Panicum virgatum
ATGAHVLLNTKKRRSPPASPKPQPWQPPSTPPPTKTLSLGTPIPTCPPPKWSPSSRRSTKRMGRRSTTMRRRGEELDGPAAAAAERERVQSVFKRLSSDPVAIRVHDVVVKGNTKTRDELIEAEVGDLLRAVPTVQELLRASSVATSRLHRLDVFDAVKITLDAGPPELPGTTNVVIEVVEAANPLTGNAGVYSKPEARSWSLEGSLKLKNLFGYGDIWDASGSYGWDQTTEVGVGVYLPRFKSVPTPLMARASLSSQDWLKFSSYKERLLGLSFGLISTMNHDLSYNLTWCALTDPSHASSKAIRRQLGHNLLSALKYTYKIDQRDSLLRPTKGYAFQSTSQVGGLWDNKGLKFFRQEFDVRGAVPLGFYNAALNVGVGAGVILPLGQGFMNSSSPVPDRFFLGGHSSPVCSLSGLSSLLGFRTRGVGPTEARRLVPSESDSDSAVAPGRDYLGGDLAVSAFADLSFDLPLKLFRDAGIHGHAFLTAGNLAKLSEGEYKNFSVSEFQRTFRSSAGVGIILPTKLFRVEVNYCYILKQAEHDSGKTGIQFSFSSPM

SEQ ID NO: 6988 - protein, 132 aa, Oryza sativa
MLTESNTSSWRRRALAMLALRSRSCTVGAARRSSATSASMSSSFVLALPLMITSWTRMPTGSDDSRLNTACTFSRSAATAAGPSSSTSSSSSSSSSYSSAAALAPAAASRCSASLGFWSAAVAMVGDLGFGR

SEQ ID NO: 6989 - protein, 526 aa, Brachypodium distachyon
MAAAAADPDSAADQNPNTPNTGTHVPEPWVESDELAEEEYDEEEEELDGPAAAAVEREKVQSVFRRLSSDPVEIRVHDVIIKGNRKTREELIEAEVAELLRAAVTVQDLLRAATIASARLRGLDVFDAVNITLDAGPPELPGTTNVVVEVVEAANPVSGTAGVYSKPEARSWSLEGSLKLKNLAGYGDLWDASVAYGWDQTSELGIGVRLPRFKSISTPLMARASLLSQDWLKFSSYKERLLGLSFGLVSTMHHDLSYNLMWRTLTDPTHGASKSIRRQLGHNFLSALKYTYKIDRRDSHLRPTQGYAFLSTSQVGGLWDNKGLRFFRQEFDVRCAVPFGFYNAALNVGLGAGVILPLGRGFMNSSSPVTDRFNLGGHSSPVCSLGGISSLLGFRTRGVGPTEPRRLVPSASENDSALPGRDYLGGDLAVSAFADLSFDLPLKLFRDAGIHGHAFLTAGNLAKLSENEYKNFSFAEFQRTFRSSAGVGIILPTKLFRVEVNYCYILKQSEHDCGKTGIQFSFSSPL

SEQ ID NO: 6990 - protein, 416 aa, Sorghum bicolor
MAAPSSSLASSCHISRRATATATAAAQSHSPPLPQQLRLGCFQRGARAQSACRAASRRRTPGVCFVVSPSQPGLAAIDVPAAPNATTVPDRTSVSSLLEVVSDDLLKLNNNLKSLVGAENPVLVSAAEQIFGAGGKRLRPALVFLVSRATAELAGLSELSTEHQRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTRSAAIFSGVSTSICEQMYEYGRNLGLSFQVVDDILDFTQSAEQLGKPAGSDLAKGNLTAPVIFALQDEPELREIIDSEFSETDSLAAAIELVHRSGGIRRAHELAREKGDMAIQNLQCLPRSDFRSTLESMVKYNLERIE

SEQ ID NO: 6991 - protein, 400 aa, Panicum virgatum
MAAPSSSLASTSHLSRRATAAVGPCSTRRQLRIRCCWAGGRVASRWRAPGVCFVVSPSQPGLAAVDVPAATMSERTSVSSLLEVVSDDLLKLNNNLKSLVGAENPVLVSAAEQIFGAGGKRLRPALVFLVSRATAELAGLSELSTEHQRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTRSAAIFSGVSTAVCEQMYEYGRNLGLSFQVVDDILDFTQSAEQLGKPAGSDLAKGNLTAPVIFALQDEPELREIIDSEFSETDSLAAAIDLVHRSGGIRRAHELAREKGDLAIQNLQCLPRSDFQSTLEKMVKYNLERIE

SEQ ID NO: 6992 - protein, 414 aa, Saccharum officinarum
MAAPSSSLASSSHLSRRATATAAAQSHSPHLLQQLRLGCFQRGARAQNVRLRHSWACRAASKRRTPGVCFVVSPSQPGLAAIDVPAATIPNATTVPDRTSVSSLLEVVSDDLLKLNNNLKSLVGAENPVLVSAAEQIFGAGGKRLRPALVFLVSRATAELAALSELTTEHQRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTRSAAIFSGVSTTICEQMYEYGRNLGLSFQVVDDILDFTQSAEQLGKPAGSDLAKGNLTAPVIFALQDEPELREIIDSEFSETDSLAAAIELVHRSGGIRRAHELAREKGDLAIPNLQCLPRSDFRSSLESL

SEQ ID NO: 6993 - protein, 424 aa, Zea mays
MAAAPSSLASSSHIPRRATATAPAQSHSPPLPQQLRPARSFKRGALAQHVRYSFAGREASRRRTPGACFVVSSSQPGLAAIDVPAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 6994 - protein, 414 aa, Oryza sativa
MAAPSSLASSSHLSRRATAAASPSIPPPSPPPPPQRLRCGWVGRAAPPTRRAPGVCSVVSPSKPGVAAVDVPAATIPDAAATGVGVAERISVSSLLEVVADDLLKLNNNLKSLVGAENPVLVSAAEQIFGAGGKRLRPALVFLVSRATAELAGLLELTTEHQRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTRSAAIFSGVSTAICEQMYEYGRNLGLSFQVVDDILDFTQSAEQLGKPAGSDLAKGNLTAPVIFALQDEPQLREIIDSEFSETNSLATAIELVHRSGGIKRAHELAREKGEIAIQSLQCLPRSEFRSTLENMVKYNLERID

SEQ ID NO: 6995 - protein, 410 aa, Brachypodium distachyon
MAAPSSLAASSHLSAPSQQRVAVAAAVHAAGKARRRCRWSGRTRRAPGVCFVASPSQPAGLAAVDLPPAAHTTIPSATAASVPDRTSVSSLLEVVSDDLLNLNNNLKSLVGAENPVLVSAAEQIFGAGGKRLRPALVFLVSRATAELAGLSELTTEHQRLAEIIEMIHTASLIHDDVIDDSGMRRGKETIHQLYGTRVAVLAGDFMFAQSSWFLANLENIEVIKLISQVIKDFASGEIKQQSTLFDCDVTLDDYLLKSYYKTASLIAASTRSSAIFSGVSTAICEQMYEYGRNLGLSFQVVDDILDFTQSAEQLGKPAASDLAKGNLTAPVIFALQDETQLREIIDSEFSETDSLAAAIELVHRSGGIRRAHELAREKGDLAIQNLQCLPRSEFRDALENMVRYNLQRIE

SEQ ID NO: 6996 - protein, 403 aa, Oryza sativa
MLSVSCPRVYMSRKALDFGQLASCRCRWAGRSGMRVAPRRRMPCVCFVASPSQPGLAAVDVPAEAISSARTTTMIPERISVSSLLEVVSDDLLKLNNNLKSLVGAENPVLVSAAEQIFGAGGKRLRPALVFLVSRATAELAGLLELTTEHQRLAEIIEMIHTASLIHDDVIDDSGMRRGKETIHQLYGTRVAVLAGDFMFAQSSWFLANLENIEVIKLISQVIKDFASGEIKQASTLFDCDVTLDDYLLKSYYKTASLLASSTRSAAIFSGVSTTICEQMYEYGRNLGLSFQVVDDILDFTQSAEQLGKPAGSDLAKGNLTAPVIFALQDEPKLREIIDSEFSESDSLATAIDLVHRSGGIRRAQELAKEKGDLALQNLQCLPKSQFRSTLENVVKYNLQRID

SEQ ID NO: 6997 - protein, 294 aa, Panicum virgatum
MVIPVAFSSSLVVRSAVGALLAALIAARAVRRRSLDASGGIAGFVVMAVHIACGYRYGALLLAFFLSSSKVTKIGEDRKRRVEEDFKEGGQRNWIQVLANSIVATILVVIFEIMTGGQDQCLDSNGSKIITGIIGGIIGHYCCCNGDTWSSEIGVLSNEQPRLITTLKPVRKGTNGGVTLQGLLAATGGGLIIGLTFVIVGLLTAECSFDMALRQLLVLPISVAAGLLGSLIDSLLGATLQFSGYCSVRKKVVSKRGPTVTKISGITVLDNDAVNAVSILITTALTAYACIYIF

SEQ ID NO: 6998 - protein, 293 aa, Panicum virgatum
MVIPPAFSSLVVRSAVGASLAALIAARAVRRGSLDASGGIAGFVVMAVHIACGYRYGALLLAFFLSSSKVTKIGEDRKRRVEDDFKEGGQRNWIQVLANSTVATILVVIFQIMTGGQDQCLDSNGSKIITGIIGGIIGHYCCCNGDTWSSEIGVLSNEQPRLITTLKPVRKGTNGGVTLQGLLAATGGGLIIGLTFVIIGLLTAECSFDMALRQLLVLPISAAAGLLGSLIDSLLGATLQFSGYCSVRKKVVSKRGPTVTKISGITVLDNDAVNAVSVLITTALTAYACIYIF

SEQ ID NO: 6999 - protein, 294 aa, Sorghum bicolor
MAIPTAFASPLAVRSAVGAALAAVIAARAVRRRSLDASGGAAGFVVMAVHIACGYRYGALLLAFFFSSSKVTKIGEDRKRRVEEDFKEGGQRNWIQVLANSTIATVLVVIFALLTGGQDQCLDSNGSKLITGIIGGIIGHYCCCNGDTWSSEIGVLSNEQPRLITTLKPVRKGTNGGVTLQGLLAATGGGLIIGLTFVVVGLLTAECSSDMALLQLLVLPISAAAGLLGSLIDSLLGATLQFSGYCSVRKKVVSKRGPTVTKISGMTILDNDAVNAVSVLLTTVLTAYVCIYIF

SEQ ID NO: 7000 - protein, 294 aa, Zea mays
MAIPNAFDSPLAARSAVGAALAAVIAVRAVRRRSLDASGGVAGFVVMAVHISCGYRYGALLLAFFFSSSKVTKIGEDHKRRIEENFKEGGQRNWIQVLANSTIATVLVVIFALMTGGQDQCMDSNGSKLITGIIGGIIGHYCCCNGDTWSSEIGVLSNEQPRLITSLKPVRKGTNGAVTLQGLLAATGGGLIIGLTFVVVGLLTAECSSDMAIRQLLVLPISAAAGLLGSLIDSLLGATLEFSGYCSVRKKVVSKRGPTVTKISGMTILDNDAVNAVSILLTTVLTAYVCICIF

SEQ ID NO: 7001 - protein, 289 aa, Pseudoroegneria spicata
MATASLAVRSAVGVALAALIAARAVRRRSLDASGGAAGFAVMALHLACGYRYGALLLAFFFTSSKVTKIGEDRKRRVEEDFKEGGQRNWIQVLANSAIATVLVILLAIMTGGEDQCLDSNGSKVITGIIGAIIGHYCCCNGDTWSSEIGVLSDEQPRLVTTLKPVRKGTNSGVTLQGLLAATAGGLTIGLTFVAVGLMTAECSFDMSLQQLLVIPISAAAGLLGSLIDSLLGATLQFSGYCSVRNKVVSKRGPTVTKISGMTILDNDAVNAVSVLLTSVITAYACIFFF

SEQ ID NO: 7002 - protein, 289 aa, Triticum aestivum
MATASLAVRSAFGVALAALIAARAVRRRSLDASGGAAGFAVMALHLACGYRYGALLLAFFVTSSKVTKIGEDRKRRVEEDFKEGGQRNWIQVLANSAIATVLVILLAIMTGGQDQCLDSNGSKVITGIIGAIIGHYCCCNGDTWSSEIGVLSDEQPRLVTTLKPVRKGTNGGVTLQGLLAATAGGLTIGLTFVAVGLMTAECSFDMSFQQLLVIPISAAAGLLGSLIDSLLGATLQFSGYCSVRNKVVSKRGPTVTKISGMTILDNDAVNAVSVLLTSVITAYACIFFF

SEQ ID NO: 7003 - protein, 289 aa, Secale cereale
MATASLAVRSAFVVALAALIAARAVRRRSLDASGGAAGFAVMALHLACGYRYGALLLAFFFTSSKVTKIGEDRKRRVEEAFKEGGQRNWIQVLANSAIATVLVILLAIMTGGQDQCLDSNSSKVITGIIGAIIGHYCCCNGDTWSSEIGVLSDEQPRLVTTLKPVRKGTNGGVTLQGLLAATAGGLTIGLTFVAVGLMTAECSFDMSLQQLLVIPISAAAGLLGSLIDSLLGATLQFSGYCSVRNKVVSKRGPTVTKISGMTILDNDAVNAVSVLLTSVITAYACIFLF

SEQ ID NO: 7004 - protein, 289 aa, Triticum aestivum
MATASLAVRSAFGVALAALIAARAVRRRSLDASGGAAGFAVMALHLACGYRYGALLLAFFVTSSKVTKIGEDRKRRVEEDFKEGGQRNWIQVLANSAIATVLVILLAIMTGGQDQCLDSNGSKVITGIIGAIIGHYCCCNGDTWSSEIGVLSDEQPRLVTTLKPVRKGTNGGVTLQGLLAATAGGLTIGLTFVAVGLMTAECSFDMSFQQLLVIPISATAGLLGSLIDSLLGATLQFSGYCSVRNKVVSKRGPTVTKISGMTILDNDAVNAVSVLLTSVITAYACIFFF

SEQ ID NO: 7005 - protein, 289 aa, Brachypodium distachyon
MAAASLAVRWAVGAALAAVIAARAVRRRSLDASGGVAGFAVMAIHLACGYRYGALLLAFFFTSSKVTKIGEDRKRRLEEDFKEGGQRNWIQVLANSAIATVLVIVLAIMTGGQDQCLDSNDSKVITGIIGAIIGHYCCCNGDTWSSEIGVLSDEQPRLITTLKPVRKGTNGGVTFQGLLAATGGGLTIGLTFTAVGLMTAKCSFDMALRQLLVIPISAAAGLLGSLIDSLLGATLEFSGYCSVRKKVVSKPGPTVTKISGMTILDNDAVNAISVLLTAAITAYVCICLF

SEQ ID NO: 7006 - protein, 280 aa, Pennisetum glaucum
MAGKRNGYDDDNVNPFAGGSVPPATNSRLSPLSHEPADFYNVDIPLDSTKDLKKKEKELQAMEAELNKRERELKRKEEAASRAGIVIEEKNWPPLFPLIHHDISNEIPIHLQRTQYLAFSSFLGLVGCLFFNVIATTTAWIKGEGVIIWLLAIIYFISGAPGAYVLWYRPLYNAMRTESALKFGWFFLFYMIHIIFCVWAAVAPPFPFKGKSLAGILPAIDVISKSAIVGIFYFVGFGLFCLESLLSIAVIQQVYMYFRGSGKAAEMKREAARGALSSAF

SEQ ID NO: 7007 - protein, 282 aa, Panicum virgatum
MAGKHGRNGYDDDNVNPFAGGSVPPATNSRLSPLSHEPADFYNVDIPLDSTKDLKKKEKELQAMEAELNKRERELKRKEEAASRAGIVIEEKNWPPFFPLIHHNISNEIPIHLQRMQYLAFSSFLGLIACLFFNIIATTTAWIKGEGVIIWLLAIIYFISGAPGAYVLWYRPLYNAMRTESALKFGWFFLFYMIHIIFCVWAAVAPPFPFKGKSLAGILPAIDVISKSAIVGIFYFVGFGLFCLESLLSIAVIQQVYMYFRGSGKAAEMKREAARGALSSAF

SEQ ID NO: 7008 - protein, 282 aa, Zea mays
MAGKHGRNGFDDDNVNPFAGGSVPPATNSRLSPLSHEPADFYNVDIPLDSSKDLKKKEKELQAMEAELNKRERELKRKEEAASRAGVVIEEKNWPPFFPLIHHDISNEIPIHLQRMQYLAFSSFLGLIACLFWNVIATTTAWIKGEGVMIWLLAIIYFISGAPGAYVLWYRPLYNAMRTESALKFGWFFLFYMIHIIFCVWAAVAPPFPFKGKSLAGILPAIDVISKNAIVGIFYFVGFGLFCLESLLSIGVIQQVYMYFRGSGKAAEMKREAARSALSSAF

SEQ ID NO: 7009 - protein, 282 aa, Unknown
  Sequence found in Organisms: Sorghum bicolor, Saccharum officinarum
MAGKHGRNGYDDDNVNPFAGGSVPPATNSRLSPLSHEPADFYNVDIPLDSSKDLKKKEKELQAMEAELNKRERELKRKEEAASRAGIVIEEKNWPPFFPLIHHDISNEIPIHLQRMQYLAFSSFLGLVACLFWNIIATTTAWIKGEGVMIWLLAIIYFISGAPGAYVLWYRPLYNAMRTESALKFGWFFLFYMIHIIFCVWAAVAPPFPFKGKSLAGILPAIDVISKNAIVGIFYFVGFGLFCLESLLSIGVIQQVYMYFRGSGKAAEMKREAARSALSSAF

SEQ ID NO: 7010 - protein, 282 aa, Zea mays
MAGKHGRNGFDDDNVNPFAGGSVPPATNSRLSPLSHEPADFYNVDIPLESSKDLKKKEKELQAMEAELNKRERELKRKEDAASRAGIVIEEKNWPPFFPLIHHDISNEIPIHLQRMQYLAFSSFLGLIACLFWNIIATTTAWIKGEGVMIWLLAIIYFISGVPGAYVLWYRPLYNAMRTESALKFGWFFLFYMIHIIFCVWAAVAPPFPFKGKSLAGILPAIDVIGKNAIVGIFYFVGFGLFCLESLMSIGVIQQVYMYFRGSGKAAEIKREAARSALSSAF

SEQ ID NO: 7011 - protein, 282 aa, Oryza sativa
MAGKHGRNGFEDDDVNPFAGGSVPPANNSRLPPLSHEPADFYNVDIPLDSSKDLKKKEKELQAMEAELNKRERELKRKEEAAAQAGIVIEDKNWPPFFPLIHHNISNEIPIHLQRMQYLAFSSFLGLAACLFWNIIATTTAWVKGEGVIIWLLAIIYFISGVPGAYVLWYRPLYNAMRTESALKFGWFFLFYLIHIIFCVWAAVAPPFPFKGKSLAGILPAIDVIGRSAIVGIFYFVGFGLFCLESLLSIGVIQQVYMYFRGSGKAAEMKREAARGALSSAF

SEQ ID NO: 7012 - protein, 279 aa, Leymus cinereus x Leymus triticoides
MAGRNGFEDDDVNPFAGGSVPPASNSRLSPLSHEPAGFYNVDIPMDSTKDVKKKEKELQAMEAELNKRERELKRKEEAASRAGIVIEEKNWPPFFPLIHHNISNEIPIHLQKMQYLAFSSFLGIALCLFFNIIATTTAWIKGEGVMIWLLAIIYFISGVPGAYVLWYRPLYNAMRTESALKFGWFFLFYMIHIIFCVWSAVSPPFPFKGNSLTGILPAIDVITKSLIVGIFYFVGFGLFCLESLLSIGVIQQVYMYFRGSGKAQEMKQQAARGALSSAF

SEQ ID NO: 7013 - protein, 280 aa, Festuca arundinacea
MAGRGRNGFEDDDVNPFAGGSVPPASNSRLSPLSHEPAGFYNVDIPMDSTKDKKKEKELQAMEAELNKREKELQRREEAASRAGIVIEEKNWPPLFPLIHHNISNEIPIHLQKMQYLAFSSFLGIAACLFFNIIATTTAWIKGEGVMIWLLAIIYFISGVPGAYVLWYRPLYNAMRTESALKFGWFFLFYMIHIIFCVWSAVSPPFPFKGNSLTGILPAIDVITKSAIVGIFYFVGFGLFCLESLLSIAVIQQVYMYFRGSGKAQEMKQQAARGALSSAF

SEQ ID NO: 7014 - protein, 279 aa, Hordeum vulgare
MAGRNGFEDDDVNPFAGGSVPPASNSRLSPLSHEPAGFYNVDIPMDSTKDVKKKEKELQAMEAELNKREKELKRKEEAASRAGIVIEDKNWPPFFPLIHHNISNEIPIHLQKMQYLAFSSFLGIALCLFFNIIATTTAWIKGEGVMVWLLAIIYFISGVPGAYVLWYRPLYNAMRTESALKFGWFFLFYMIHIIFCVWSAVSPPFPFKGNSLTGILPAIDVITKSLIVGIFYFVGFGLFCLESLLSIGVIQQVYMYFRGSGKAQEMKQQAARGALSSAF

SEQ ID NO: 7015 - protein, 282 aa, Brachypodium distachyon
MAGKHGRNGFEDDDVNPFAGGSVPAASNARLSPLSHEPAGFYNVDIPMDSAKDVKKKEKELQAMEAELNKREKELKRKEEAASRAGIVIEEKNWPPLFPLIHHNISNEIPIHLQRMQYLAFSSFLGLTACLFWNIIATTTAWVKGEGVMIWLLAIIYFISGVPGAYVLWYRPLYNAMRTESALKFGWFFMFYMIHIIFCVWSAVSPPFPFKGNSLTGILPAIDVITKSAIVGIFYFVGFGLFCLESLLSIGVIQQVYMYFRGSGKAAEMKQQAARSALSSAF

SEQ ID NO: 7016 - protein, 280 aa, Avena sativa
MAGRGRNGFEDDDVNPFAGGSVPPASNSRLSPLSHEPAGFYNVDIPMDSTKDKKKEKELQALEAELNKREKELKRREEAASRAGIVIEEKNWPPLFPLIHHNISNEIPIHLQKMQYLAFSSFLGIATCLFFNIIATTTAWIKGEGVMIWLLAIIYFISGVPGAYVLWYRPLYNAMRTESALKFGWFFLFYMLHIIFCVWSAVSPPFPFKGNSLTGILPAIDVITKSAIVGIFYFVGFGLFCLESLLSIAVIQQVYMYFRGSGKAQEMKQQAARSALSNAF

SEQ ID NO: 7017 - protein, 279 aa, Secale cereale
MAGRNGFEDDDVNPFAGGSVPPASNSRLSPLSHEPAGFYNVDIPMDSTKDVKKKEKELQAMEAELNKREKELKRKEEAASRAGIVIEEKNWPPFFPLIHHNISNEIPIHLQKMQYLAFSSFLGIALCLFFNIIATTTAWVKGEGVMVWLLAIIYFISGVPGAYVLWYRPLYNAMRTESALKFGWFFLFYMIHIVFCVWSAVSPPFPFKGNSLTGILPAIDVITKSLIVGIFYFVGFGLFCLESLLSIAVIQQVYMYFRGSGKSQELKQQAARGALSSAF

SEQ ID NO: 7018 - protein, 279 aa, Triticum aestivum
MAGRNGFEDDDVNPFAGGSVPPASNSRLSPLSHEPAGFYNVDIPMDSTKDVKKKEKELQAMEAELNKREKELKRKEEAASRAGIVIEDKNWPPFFPLIHHNISNEIPIHLQKMQYLAFSSFLGIALCLFFNIIATTTAWIKGEGVMVWLLAIIYFISGVPGAYVLWYRPLYNAMRTESALKFGWFFLFYMIHIIFCVWSAVSPPFPFKGNSLTGILPAIDVITKSLIVGIFYFVGFGLFCLESLLSIGVIQQVYMYFRGSGKSQELKQQAARGALSSAF

SEQ ID NO: 7019 - protein, 104 aa, Pseudoroegneria spicata
MAGRNGFEDDDVNPFAGGSVPPASNSRLSPLSHEPAGFYNVDIPMDSTKDVKKKEKELQAMEAELNKREKELKRKEEAASRAGIVIEDKNWPPFFPSHSPQYFK

SEQ ID NO: 7020 - protein, 64 aa, Secale cereale
MAGRNGFEDDDVNPFAGGSVPPASNSRLSPLSHEPAGFYNVDIPMDSTKDVKKKEKNSRRWKPS

SEQ ID NO: 7021 - protein, 203 aa, Eragrostis curvula
  misc_feature (2)..(2): Xaa can be any naturally occurring amino acid
  misc_feature (157)..(157): Xaa can be any naturally occurring amino acid
AXTARRDTSTIRGRKFPPATNSRLSPLSHEPADFYNVDIPLDSTKDLKKKEKELQAMEAELNKRERELKRKEEAASRAGIVIEEKNWPPFFPLIHHNISNEIPIHLQRMQYLAFSSFLGLVGCLFWNIIATTTAWIKGDGVMIWLLAIIYFISGVPXAYVLWYRPLYNAMRTESALKFGWFFSVLHSSYNLLCVVSCVSSVSF

SEQ ID NO: 7022 - protein, 287 aa, Setaria italica
MAGRYDRNPFDEDDVNPFAGGSVPPASNSRMPPLPHEPAGFYNDRGATVDIPLDSTKDMNKKEKELQAKEAELNKRERELKRKEEAAARAGIVIEDKNWPPFMPIIHHDISNEIPVHLQRMQYLAFSSLLGLTACLFWNIIATTAAWIKGEGVMIWLLAIIYFISGVPGAYVLWYRPLYNAMRTESALKFGWFFLFYLLHILFCVWSAVAPPFPFKGKSLAGILPAIDVIGRSAIVGIFYFIGFGLFCLESLLSIAVIQQVYMYFRGSGKEAEMKREAARGALRNAF

SEQ ID NO: 7023 - protein, 287 aa, Pennisetum glaucum
MAGRYDRNPFDEDDVNPFAGGSVPPASNSRMPPLPHEPAGFYNDRGATVDIPLDSSKDMSKKEKELQAKEAELNKRERELKRKEEAAARAGIVIEDKNWPPFMPIIHHDISNEIPVHLQRMQYLAFSSLLGLTACLFWNIIATTAAWIKGEGVIIWLLAIIYFISGVPGAYVLWYRPLYNAMRTESALKFGWFFLFYLLHILFCVWSAVAPPFPFKGKSLAGILPAIDVIGRSAIVGIFYFIGFGLFCLESLLSIAVIQQVYMYFRGSGKEAEMKREAARGALRNAF

SEQ ID NO: 7024 - protein, 286 aa, Oryza sativa
MAGRYDRNPFDEDDVNPFAGGSVPPASNSRMPPLPHEPGFYNDRGATVDIPLDSTKDMKKKEKELQAKEAELNKRESELRRREEAASRAGIVIEEKNWPPFFPIIHHDISNEIPIHLQRMQYLAFSSLLGLAACLFWNIIATTAAWIKGAGVMIWLLAIIYFISGVPGAYVLWYRPLYNAMRTESALKFGWFFLFYLIHILFCIWSAVAPPFPFKGKSLAGILPAIDVIGNNAIVGIFYFIGFGLFCLESLLSVVVIQQVYMYFRGSGKAAEMKREAARGAMRSAF

SEQ ID NO: 7025 - protein, 287 aa, Panicum virgatum
MAGRYDRNPFDEDDVNPFAGGSVPPASNSRMPPLPHEPAGFYNDRGATVDIPLDSAKDLSKKEKELQAKEAELNKRERELKRKEEAAARAGIVIEDKNWPPFMPIIHHDISNEIPVHLQRMQYLAFSSLLGLTACLFWNIIATTAAWIKGEGVMIWLLAIIYFISGVPGAYVLWYRPLYNAMRTESALKFGWFFLFYLLHILFCVWSAVAPPFPFKGKSLAGILPAIDVIGRSVIVGIFYFIGFGMFCLESLLSIAVIQQVYMYFRGSGKEAEMKREAARGAMRNAF

SEQ ID NO: 7026 - protein, 287 aa, Zea mays
MAGRYDRNPFEEDDVNPFAGGSVPPASNSRMSALPHEPAGFYNDRGATVDIPLDSTKDLSKKEKELQAKEAELNKRERELKRKEEAAARAGIVIEDKNWPPFMPIIHHDISNEIPIHLQRMQYLAFSSLLGLTACLFWNIIATTAAWIKSEGVMIWLLAIIYFISGVPGAYVLWYRPLYNAMRTESALKFGWFFLFYLLHILFCVWSAVAPPFPFKGKSLAGILPAIDIIGRSAIVGIFYFIGFGMFCLESLLSIVVIQQVYMYFRGSGKAAEMKREAARGAMRNAF

SEQ ID NO: 7027 - protein, 287 aa, Panicum virgatum
MAGRYDRNPFDEDDVNPFAGGRVPPASNSRMPPLPHEPAGFYNDRGATVDIPLDSTKDLSKKEKELQAKEAELNKRERELKRKEEAAARAGIVIEDKNWPPFMPIIHHDISNEIPVHLQRMQYLAFSSLLGLTACLFWNIIATTAAWIKGEGVMIWLLAIIYFISGVPGAYVLWYRPLYNAMRTASALKFGWFFLFYLLHILFCVWSAVAPPFPFKGKSLAGILPAIDVIGRSVIVGIFYFIGFGMFCLESLLSIAVIQQVYMYFRGSGKEAEMKREAARGAMRNAF

SEQ ID NO: 7028 - protein, 283 aa, Cenchrus ciliaris
  misc_feature (23)..(23): Xaa can be any naturally occurring amino acid
  misc_feature (35)..(36): Xaa can be any naturally occurring amino acid
  misc_feature (49)..(49): Xaa can be any naturally occurring amino acid
  misc_feature (84)..(84): Xaa can be any naturally occurring amino acid
  misc_feature (130)..(130): Xaa can be any naturally occurring amino acid
  misc_feature (278)..(278): Xaa can be any naturally occurring amino acid
  misc_feature (282)..(282): Xaa can be any naturally occurring amino acid
YDRNPFDEDDVNPFAGGSVPPAXNSRMPPLPHEPXXFYNDRGATVDIPXDSSKDLSKKEKELQAKEAELNKRERELKRKEEAAXRAGIVIEDKNWPPFMPIIHHDISNEIPVHLQRMQYLAFSSLLGLTXCLFWNIIATTAAWIKGEGVIIWLLAIIYFISGVPGAYVLWYRPLYNAMRTESALKFGWFFLFYLLHILFCVWSAVAPPFPFKGKSLAGILPAIDVISRSAIVGIFYFIGFGMFCLESLLSIAVIQQVYMYFRGSGKEAEMKREAARGXLRNXF

SEQ ID NO: 7029 - protein, 286 aa, Triticum aestivum
MAGRYDRNPFDEDDVNPFAGGGVPPASNSRMPPLPHEPAGFYNDRATVDIPLGSSKDLKQKEKELQSKEAELNKRERELKRREEAAARAGIVIETKNWPPFMPIIHHDISNEIPIHLQRMQYLAFCSLLGLTLCLFWNIIATTAAWIKGAGVVIWLLAIIYFISGVPGAYVLWYRPLYNAMRTESALKFGWFFLLYLIHIIFCIWSAVSPPFPFKGKSIAGFLPAIDVIGSNAIVGIFYFVGFGLFCLEALLSIVVIQQVYMYFRGSGKAAQMRQEAARGAMRSAF

SEQ ID NO: 7030 - protein, 88 aa, Panicum virgatum
MVSSSSPVVNVYPLANYTFGTKEPKMEKDTSVADRLARMKVNYMKEGMRTSVEAILLVQEHNHPPHTAPANRKYILQTSWWTVEAWRK

SEQ ID NO: 7031 - protein, 202 aa, Sorghum bicolor
MVSSSSPVVNVYPLANYTFGTKEPKMEKDTSVADRLARMKVNYMKEGMRTSVEAILLVQEHNHPHILLLQIGNTFCKLPGGRLKPGENEIEGLKRKLCSKLAVNSPSFPPNWQIGECVAVWWRPNFETVMYPYCPPHITKPKECKKLFIVHLSEREYFAVPRNLKLLAVPLFELYDNVQRYGPVISTIPQQLSRFQFNMVSS

SEQ ID NO: 7032 - protein, 202 aa, Zea mays
MVSSSSSVVNVYPLANYTFGTKEPKMEKDTSVADRLARMKVNYMKEGMRTSVEAILLVQEHNHPHILLLQIGNTFCKLPGGRLKPGENEIEGLKRKLCSKLAVNSPSFPPNWQVGECVAVWWRPNFETVMYPYCPPHITKPKECKKLFIVHLSEREYFAVPRNLKLLAVPLFELYDNIQRYGPVISTIPQQLSRFQFNMVSS

SEQ ID NO: 7033 - protein, 203 aa, Brachypodium distachyon
MVSGSSSSVVNVYPLANYTFGTKEPKMEKDTSVADRLARMKVNYMKEGMRTSVEAILLVQEHNHPHILLLQIGNTFCKLPGGRLKPGENEIDGLKRKLCSKLAVNSPSFPPNWQVGECVAVWWRPNFETVMYPYCPPHITKPKECKKLFIVHLTEREYFAVPRNLKLLAVPLFELYDNVQRYGPVISTIPQQLSRFQFNMVSS

SEQ ID NO: 7034 - protein, 203 aa, Unknown
  Sequence found in Organisms: Avena sativa, Pseudoroegneria spicata
MVGASSSSVVNVYPLANYTFGTKEPKMEKDTSVADRLARMKVNYMKEGMRTSVEAILLVQEHNHPHILLLQIGNTFCKLPGGRLKPGENEIEGLKRKLCSKLAVNSPSFPPNWQVGECVAVWWRPNFETVMYPYCPPHITKPKECKKLFIVHLTEREYFAVPRNLKLLAVPLFELYDNVQRYGPVISTIPQQLSRFQFNMVSS

SEQ ID NO: 7035 - protein, 203 aa, Unknown
  Sequence found in Organisms: Secale cereale, Triticum aestivum
MVGASTSSVVNVYPLANYTFGTKEPKMEKDTSVADRLARMKVNYMKEGMRTSVEAILLVQEHNHPHILLLQIGNTFCKLPGGRLKPGENEIEGLKRKLCSKLAVNSPSFPPNWQVGECVAVWWRPNFETVMYPYCPPHITKPKECKKLFIVHLTEREYFAVPRNLKLLAVPLFELYDNVQRYGPVISTIPQQLSRFQFNMVSS

SEQ ID NO: 7036 - protein, 203 aa, Hordeum vulgare
MVGAPTSSVVNVYPLANYTFGTKEPKMEKDTSVADRLARMKVNYMKEGMRTSVEAILLVQEHNHPHILLLQIGNTFCKLPGGRLKPGENEIEGLKRKLCSKLAVNSPSFPPNWQVGECVAVWWRPNFETVMYPYCPPHITKPKECKKLFIVHLTEREYFAVPRNLKLLAVPLFELYDNVQRYGPVISTIPQQLSRFQFNMVSS

SEQ ID NO: 7037 - protein, 203 aa, Triticum aestivum
MVGTPSSPVVNVYPLANYTFGTKEPKMEKDTSVADRLARMKVNYMKEGMRTSVEAILLVQEHNHPHILLLQIGNTFCKLPGGRLKPGESEIEGLKRKLCSKLAVNSPSFPPNWQVGECVAEWWRPNFETVMYPYCPPHITKPKECKKLFIVHLTEREYFAVPRNLKLLAVPLFELYDNVQRYGPVISTIPQQLSRFQFNMVSS

SEQ ID NO: 7038 - protein, 203 aa, Triticum aestivum
MVGTPSSPVVNVYPLANYTFGTKEAKMEKDTSVADRLARMKVNYMKEGMRTSVEAILLVQEHNHPHILLLQIGNTFCKLPGGRLKPGESEIEGLKRKLCSKLAVNSPSFPPNWQVGECVAEWWRPNFETVMYPYCPPHITKPKECKKLFIVHLTEREYFAVPRNLKLLAVPLFELYDNVQRYGPVISTIPQQLSRFQFNMVSS

SEQ ID NO: 7039 - protein, 203 aa, Hordeum vulgare
MVGAPSSPVVNVYPLANYTFGTKEAKMEKDTSVADRLARMKVNYMKEGMRTSVEAILLVQEHNHPHILLLQIGNTFCKLPGGRLKPGESEIEGLKRKLCSKLAVNSPSFPPNWQVGECVAEWWRPNFETVMYPYCPPHISKPKECKKLFIVHLTEREYFAVPRNLKLLAVPLFELYDNVQRYGPVISTIPQQLSRFQFNMVSS

SEQ ID NO: 7040 - protein, 203 aa, Secale cereale
MVGAPSSPVVNVYPLANYTFGTKEAKMEKDTSVADRLARMKVNYMKEGMRTSVEAILLVQEHNHPHILLLQIGNTFCKLPGGRLKPGESEIEGLKRKLCSKLAVNSPSFPPNWQVGECVAEWWRPNFETVMYPYCPPHITKAKECKKLFIVHLTEREYFAVPRNLKLLAVPLFELYDNVQRYGPVISTIPQQLSRFQFNMVSS

SEQ ID NO: 7041 - protein, 203 aa, Festuca arundinacea
  misc_feature (9)..(9): Xaa can be any naturally occurring amino acid
  misc_feature (42)..(42): Xaa can be any naturally occurring amino acid
  misc_feature (69)..(70): Xaa can be any naturally occurring amino acid
  misc_feature (84)..(84): Xaa can be any naturally occurring amino acid
MVSASSSAXVNVYPLANYTFGTKEPKMEKDTSVADRLARMKXNYMKEGMRTSVEAILLVQEHNHPHILXXQIGNTFCKLPGGRXKPGENEIEGLKRKLSSKLAVNSPTFPPNWQVGECVAVWWRPNFETVMYPYCPPHIAKPKECKKLFIVHLTEKEYFAVPRNLKLLAVPLFELYDNVQRYGPVISTIPQQLSKFQFNMVSS

SEQ ID NO: 7042 - protein, 200 aa, Musa acuminata
MVTSSVVNTYPLSNYTFGTKEPKMEKDTSVADRLARMKVNYMKEGMRTSVEGILLVQEHNHPHILLLQIGNTFCKLPGGRLKPGENELEGLKRKLCSKLAANSPSFLPNWQIGECVATWWRPNFETVMYPYCPPHITKPKECKKLFLVHLSEREYFAVPKNLKLLAVPLFELYDNVQRYGPVISTIPQQLSRFQFNMVTS

SEQ ID NO: 7043 - protein, 200 aa, Musa acuminata
MVNSSVVNMYPLSNYTFGTKEAKMEKDTSVADRLARMKVNYMKEGMRTSVEGILLVQEHNHPHILLLQIGNTFCKLPGGRLKPGENEIEGLRRKLCSKLAANSPSFQPNWQIGECVAIWWRPNFETVMYPYCPPHITKPKECKKLFLVHLSEREYFAVPKNLKLLAVPLFELYDNVQRYGPVISTIPQQLSRFQFNMVSS

SEQ ID NO: 7044 - protein, 198 aa, Musa acuminata
MVTSSVVNTYPLSNYTFGTKEPKMEKDTSVADRLARMKVNYMKEGMRTSVEGILLVQEHNHPHILLLQIGNTFCKLPGGRLKPGENEIEGLKRKLCSKLAANSPSFLPNWQIGECVATWWRPNFETVMYPYCPPHITKPKECKKLFLVHLSEREYFAVPKNFKLLAVPLFELYDNVQRYGPVISTIPQQLSRFQFNMV

SEQ ID NO: 7045 - protein, 200 aa, Musa acuminata
MVNSSVVNMYPLSNYTFGTKEAKMEKDTSVADRLARMKVNYMKEGMRTSVEGILLVQEHNHPHILLLQIGNTFCKLPGGRLKPGENEIEGLRRKLCSKLAANSPSFQPNWQIGECVAIWWRPNFETVMYPYCPPHITKPKECKKLFLVHLSEREYFAVPKNLELLAVPLFELYDNVQRYGPVISTIPQQLSRFQFNMVSS

SEQ ID NO: 7046 - protein, 160 aa, Phalaenopsis aphrodite
MVSPVVNTYPLSNYTFGMKEPKMEKDTSVADRLARMKVNYMKEGMRLSVEAILLVQEHNHPHILLLQIGNTFCKLPGGRLKPGENEVEGLKRKLCSKLAVNSPAFQPNWQVGECVAIWWRPNFETVMYPYCPPHITKPKECKKLFIVHLSEREYFAVPKT

SEQ ID NO: 7047 - protein, 200 aa, Elaeis guineensis
MGVLPVVNTYPLSSYTFGTKEPKMEKDTSVADRLARMKVNYMKEGMRTSVEAILLVQEHNHPHILLLQIGNTFCKLPGGRLKPGENEIEGLKRKLSSKLAANSPSHQPNWQVGECVAVWWRPNFETVMYPYCPPHITKPKECKKLFLVHLSEREYFAVPKNLKLLAVPLFELYDNVQRYGPVISTIPQQLSRFQFNMVNA

SEQ ID NO: 7048 - protein, 200 aa, Elaeis guineensis
MVTSPVVNMYPLSNYTFGTKEPKMEKDTSVADRLARMKVNYMKEGMRMSAEAILLVQEHNHPHILLLQIGNTFCKLPGGRLKPGENEIEGLKRKLSSKLGANSPSFQQNWQIGECVAVWWRPNFETIMYPYCPPHITKPKECKKLFLVHLPEREYFAVPRNLKLLAVPLFELYDNVTRYGPVISTIPQQLSRFQFNMVSS

SEQ ID NO: 7049 - protein, 200 aa, Unknown
  Sequence found in Organisms: Ambrosia trifida, Helianthus annuus
MVSSSVVNTYPLSSYSFGTKEPKMEKDTSVADRLARMKLNYMKEGMRTSVEAILLVQEHNHPHILLLQIGNTFCKLPGGRLKPGENEVEGLKRKLSSKLAANSPNMQPNWQIGECVAVWWRPNFETIMYPYCPPHITKPKECKKLYVVHLSEREYFAVPKNLKLLAVPLFELYDNVQRYGPVISTIPQQLSRFQFNMISS

SEQ ID NO: 7050 - protein, 200 aa, Euonymus alatus
MVSSPVVNTYPLSSYTFGTKEPKMEKDTSVADRLARMKVNYMKEGMRTSVEAILLVQEHNHPHILLLQIGNTFCKLPGGRLKPGENEIEGLKRKLTSKLGANSPAMVPDWQIGECVAIWWRPNFETIMYPYCPPHITKPKECKKLFIVHLSEREYFAVPKNLKLLAVPLFELYDNVQRYGPVISTIPQQLSRFQFNMITM

SEQ ID NO: 7051 - protein, 200 aa, Flaveria ramosissima
MVGSSVVNTYPLSSYSFGTKEPKMEKDTSVADRLARMKLNYMKEGMRTSVEAILLVQEHNHPHILLLQIGNTFCKLPGGRLKPGENEIEGLKRKLSSKLAANSPNMQPNWQIGECVAVWWRPNFETIMYPYCPPHITKPKECKKLYVVHLSEREYFAVPKNLKLLAVPLFELYDNVQRYGPVISTIPQQLSRFQFNMISS

SEQ ID NO: 7052 - protein, 200 aa, Elaeis guineensis
MVTSTAVNMYPLANYTFGTKEPKMEKDTSVADRLARMKVNYMKEGMRTSVEAILLVQEHNHPHILLLQIGNTFCKLPGGRLKPGENEIEGLKRKLSSKLGANSPSFQQNWQIGECVAVWWRPNFETAMYPYCPPHITKPKECKKLFLVHLPEREFFAVPKNLKLLAVPLFELYDNVSRYGPIISTIPQQLSRFQFNMVSS

SEQ ID NO: 7053 - protein, 202 aa, Phalaenopsis aphrodite
MLSPTSPVVNVYPLSSYTFGVKEPKMEKDTSVADRLARMKVNYMKEGMRTSVEAILLVQEHNHPHILLLQIGNTFCKLPGGRLKPGENEIEGLKRKLSSKLAANSSVHQPNWQIGECAAVWWRPNFETVMYPYCPPHITKPKECKKLFVVHLSEREYFAVPKNLKLLAVPLFELYDNVQRYGPVISTIPQQLSRFQFKMVNP

SEQ ID NO: 7054 - protein, 200 aa, Capsicum annuum
MVTSSVVNTYPLSSYTFGTKEPKMEKDTSVADRLARMKVNYMKEGMRTSVEGILLVQEHNHPHILLLQIGNTFCKLPGGRLKPGENEIEGLKRKLSSKLAANSPGLQPNWQIGECVAIWWRPNFETIMYPYCPPHITKPKECKKLFVVHLSEREYFAVPKNLKLLAVPLFELYDNVQRYGPVISTIPQQLSRFQFNMIHP

SEQ ID NO: 7055 - protein, 200 aa, Zostera marina
MVTSAVVNAYPLSSYTFGQKEPKMEKDTSVADRLARMKVNYMKEGMRTSVEAILLVQEHNHPHILLLQIGNTFCKLPGGRLKPGENEIEGLKRKLSSKLAANVPTLQPNWQIGECVATWWRPNFETVMYPYCPPHITKPKECKKLFLVHLSEREYFAVPKNLKLLAVPLFELYDNVQRYGPVISTIPQQLSRFQFNMVNP

SEQ ID NO: 7056 - protein, 197 aa, Amorphophallus konjac
MVNSSVNIYPLSSYTFGTKEPKMEKDTSVADRLARMKVNYMKEGMRTSVEAILLVHEHNHPHILLLQIGNTFCKLPGGRLKPGENEIEGLKRKLSSKLAASSFQPNWQIGECVATWWRPNFETIMYPYCPPHITKPKECKKLFLVHLSEREYFAVPKNLKLLAVPLFELYDNVQRYGPVISTIPQQLSRFQFNMVSP

SEQ ID NO: 7057 - protein, 200 aa, Malus domestica
MVMSAVVNTYPLSSYTFGTKEPKMEKDTSVADRLARMKVNYMKEGMRTSVEAILLVQEHNHPHILLLQIGNTFCKLPGGRLKPGENEIEGLKRKLTSKLGANSPALVPDWQIGECVAIWWRPNFETIMYPYCPPHITKPKECKKLFLVHLSEREYFAVPKNLKLLAVPLFELYDNVQRYGPVISTIPQQLSRFQFNMISS

SEQ ID NO: 7058 - protein, 200 aa, Unknown
  Sequence found in Organisms: Cucumis sativus, Cucumis melo, Citrullus lanatus
MVTSPVVNTYPLSSYTFGTKEPKLEKDTSVADRLARMKVNYMKEGMRTSVEAILLVQEHKHPHILLLQIGNTFCKLPGGRLKPGENEIEGLKRKLTSKLGANSPSLQPDWQIGECVAIWWRPNFETVMYPYCPPHITKPKECKKLFIVHLSEREYFAVPKNLKLLAVPLFELYDNVQRYGPVISTIPQQLSRFQFNMITT

SEQ ID NO: 7059 - protein, 161 aa, Curcuma longa
MVSSPVVNTYPLSNYTFGAKEPKMEKDTSVADRLARMKLNYMKEGMRTSVEGILLVQEHNHPHILLLQIGNTFCKLPGGRLKPGENEIEGLKRKLSSKLAPSSASFQPNWQIGECVATWWRPNFETVRYPYCPPHISKPKECKKLFIVHLSEREYFAVPKN

SEQ ID NO: 7060 - protein, 200 aa, Euonymus alatus
MVTSPVVNTYPLSSYTFGTKEPKMEKDTSVADRLARMKVNYMKEGMRTSVEAILLVQEHNHPHILLLQIGNTFCKLPGGRLKPGENEIEGLKRKLTSKLGANSPAMVPDWQIGECVAIWWRPNFETIMYPYCPPHITKPKECKKLFIVHLSEREYFAVPKNLKLLAVPLFELYDNVQRYGPVISTIPQQLSRFQFNMITM

SEQ ID NO: 7061 - protein, 200 aa, Vitis vinifera
MVTSPVVNTYPLSSYTFGTKEPKMEKDTSVADRLARMKVNYMKEGMRTSVEAILLVQEHNHPHILLLQIGNTFCKLPGGRLKPGENEIEGLKRKLSSKLAANSLALQPDWQIGECVAIWWRPNFETIMYPYCPPHITKPKECKKLFIVHLSEREYFAVPKNLKLLAVPLFELYDNVQRYGPVISTIPQQLSRFQFNMMTV

SEQ ID NO: 7062 - protein, 200 aa, Tropaeolum majus
MVMSSVVNTYPLSSYTFGTKEPKMEKDTSVADRLARMKVNYMKEGMRTSVEAILLVQEHNHPHILLLQIGNTFCKLPGGRLKPGENEIEGLKRKLTSKLGANSHALVPEWQIGECVAVWWRPNFETIMYPYCPPHITKPKECKKLFIVQLSEKEYFAVPKNLKLLAVPLFELYDNVQRYGPVISTIPQQLSRFQFNMISS

SEQ ID NO: 7063 - protein, 200 aa, Solanum phureja
MVTSSVVNTYPLSSYTFGTKEPKMEKDTSVADRLARMKVNYTKEGMRTSVEGILLVQEHNHPHILLLQIGNTFCKLPGGRLKPGENEIEGLKRKLSSKLAANSPGIQPNWQIGECVAIWWRPNFETIMYPYCPPHITKPKECKKLFVVHLSEREYFAVPKNLKLLAVPLFELYDNVQRYGPVISTIPQQLSRFQFNMIHS

SEQ ID NO: 7064 - protein, 200 aa, Nicotiana benthamiana
MVTSSVVNTYPLSSYTFGTKEPKMEKDTSVADRLARMKVNYFKEGMRTSVEGILLVQEHNHPHILLLQIGNTFCKLPGGRLKPGENEIEGLKRKLSSKLAANSPGLQPNWQIGECVATWWRPNFETIMYPYCPPHITKPKECKKLFVVHLSEREYFAVPKNLKLLAVPLFELYDNVQRYGPVISTIPQQLSRFQFNMIHP

SEQ ID NO: 7065 - protein, 200 aa, Unknown
  Sequence found in Organisms: Nicotiana benthamiana, Nicotiana tabacum
MVTSSVVNTYPLSSYTFGTKEPKMEKDTSVADRLARMKVNYFKEGMRTSVEGILLVQEHNHPHILLLQIGNTFCKLPGGRLKPGENEIEGLKRKLSSKLAANSPGLQPNWQIGECVAIWWRPNFETIMYPYCPPHITKPKECKKLFVVHLSEREYFAVPKNLKLLAVPLFELYDNVQRYGPVISTIPQQLSRFQFNMIHP

SEQ ID NO: 7066 - protein, 200 aa, Olea europaea
MVSSAVVNTYPLPSYTFGAKEPKMEKDTSVADRLARMKVNYMKEGMRTSVEGILLVEEHNHPHILLLQIGNTFCKLPGGRLKPGENEIEGLKRKLSSKLAVNSPGLEPDWQIGECVATWWRPNFETTMYPYCPPHIAKPKECKKLFIVHLSEREYFAVPKNLKLLAVPLFELYDNVQRYGPVISTIPQQLSRFQFNMIHS

SEQ ID NO: 7067 - protein, 200 aa, Unknown
  Sequence found in Organisms: Prunus persica, Prunus mume
MVTSAVVNTYPLSSYTFGTKEPKMEKDTSVADRLARMKINYMKEGMRTSVEAILLVQEHNHPHILLLQIGNTFCKLPGGRLKPGENEIEGLKRKLTSKLGANSPALVPDWQIGECVAIWWRPNFETIMYPYCPPHITKPKECKKLFLVHLSEREYFAVPKNLKLLAVPLFELYDNVQRYGPVISTIPQQLSRFQFNMISS

SEQ ID NO: 7068 - protein, 200 aa, Ambrosia trifida
MVSSSVVNTYPLSSYSFGTKEPKMEKDTSVADRLARMKLNYMKEGMRTSVEAILLVQEHNHPHILLLQIGNTFCKLPGGRLKPGENEVEGLKRKLSSKLAANSPNMQPNWQIGECVAVWWRPNFETIMYPYCPPHITKPKECKKLYVVHLSEREYFAVPKNLKLLAVPLFELYDNVQRYGPMISTIPQQLSRFQFNMILS

SEQ ID NO: 7069 - protein, 200 aa, Unknown
  Sequence found in Organisms: Amsonia hubrichtii, Catharanthus roseus, Tabernaemontana elegans
MVTSPVVNTYPLSSYTFGTKEPKMEKDTSVADRLARMKVNYMKEGMRTSVEGILLVQEHNHPHILLLQIGNTFCKLPGGRLKPGENEIEGLKRKLSSKLAANSPGLQPDWQIGECVAIWWRPNFETIMYPYCPPHITKPKECKKLFLVHLSEREYFAVPKNLKLLAVPLFELYDNVQRYGPVISTIPQQLSRFQFNMIHP

SEQ ID NO: 7070 - protein, 199 aa, Malus domestica
MVTSAVVNTYPLSSYTFGTKEPKMEKDTSVADRLARMKVNYMKEGMRTSVEAILLVQEHNHPHILLLQIGNTFCKLPGGRLKPGENEIEGLKRKLTSKLGANSPTLVPDWQIGECVAIWWRPNFETIMYPYCPPHITKPKECKKLFLVHLSEREYFAVPKNLKLLAVPLFELYDNVQRYGPVISTIPQQLSRFQFNMIS

SEQ ID NO: 7071 - protein, 201 aa, Aristolochia fimbriata
MVATSPLVNIYPLSSYTFGTKEPKMEKDTSVADRLARMKVNYMKEGMRTSVEAILLVQEHNHPHILLLQIGNTFCKLPGGRLKPGENEIEGLKRKLSSKLAANQPSLQPDWQIGECVAIWWRPNFETIMYPYCPPHIIKPNECKKLFIVHLSEREYFAVPKNLKLLAVPLFELYDNVQRYGPVISTIPQQLSRFQFNMINS

SEQ ID NO: 7072 - protein, 200 aa, Vaccinium corymbosum
MVTSPVVNTYPLSSYTFGTKEPKMEKDTSVADRLARMKLNYMKEGMRTSVEAILLVQEHNHPHILLLQIGNTFCKLPGGRLKPGENEIEGLQRKLSSKLGANSPSLQPNWQIGECVAIWWRPNFETIMYPYCPPHITKPKECKKLFVVHLSEREYFAVPKNLKLLAVPLFELYDNVQRYGPVISTIPQQLSRFHFNMMQS

SEQ ID NO: 7073 - protein, 200 aa, Cannabis sativa
MVTSPVVNTYPLSSYTFGTKEPKMEKDTSVADRLARMKVNYMKEGMRTSVEAILLVQEHNHPHILLLQIGNTFCKLPGGRLKPGENEIEGLKRKLTSKLGANSPTLVPDWQIGECVAIWWRPNFETIMYPYCPPHITKPKECKKLFLVHLSEREYFAVPKNLKLLAVPLFELYDNVQRYGPVISTIPQQLSRFQFNMITT

SEQ ID NO: 7074 - protein, 200 aa, Ricinus communis
MVNSSVVNTYPLSSYTFGTKEPKMEKDTSVADRLARMKVNYMKEGMRTSVEAILLVQEHNHPHILLLQIGNTFCKLPGGRLKPGENEIEGLKRKLTSKLGANSPALVPDWQIGECVAIWWRPNFETIMYPYCPPHITKPKECKKLFLVHLSEREYFAVPKNLKLLAVPLFELYDNVQRYGPVISTIPQQLSRFQFNMITT

SEQ ID NO: 7075 - protein, 200 aa, Unknown
  Sequence found in Organisms: Citrus clementina, Citrus sinensis
MVTSPVVNTYPLSSYTFGTKEPKMEKDTSVADRLARMKVNYMKEGMRTSVEAILLVQEHNHPHILLLQIGNTFCKLPGGRLKPGENEIEGLKRKLTSKLGANSPALVPDWQIGECVAIWWRPNFETIMYPYCPPHITKPKECKKLFLVHLSEREYFAVPKNLKLLAVPLFELYDNVQRYGPVISTIPQQLSRFQFNMITA

SEQ ID NO: 7076 - protein, 200 aa, Unknown
  Sequence found in Organisms: Gossypium hirsutum, Gossypium raimondii
MVSSPVVNTYPLSSYTFGTKEPKMEKDTSVADRLARMKVNYMKEGMRTSVEAILLVQEHNHPHILLLQIGNTFCKLPGGRLKPGENEIEGLKRKLTSKLGANSPALVPDWQIGESVAIWWRPNFETMMYPYCPPHITKPKECKKLFLVHLSEKEYFAVPKNLKLLAVPLFELYDNVQRYGPVISTIPQQLSRFQFNMISI

SEQ ID NO: 7077 - protein, 200 aa, Cucurbita pepo
MVTSPVVNTYPLSSYTFGTKEPKLEKDTSVADRLARMKVNYMKEGMRTSVEAILLVQEHNHPHILLLQIGNTFCKLPGGRLKPGENEIEGLKRKLTSKLGANSPALQPDWQIGECVATWWRPNFETVMYPYCPPHITKAKECKKLFIVHLSEREYFAVPKNLKLLAVPLFELYDNVQRYGPVISTIPQQLSRFQFNMITT

SEQ ID NO: 7078 - protein, 200 aa, Eschscholzia californica
MVTSPVVNTYPLSSYTFGTKEPKMEKDTSVADRLARMKVNYMKEGMRTSVDAILLVQEHNHPHILLLQIGNTFCKLPGGRLKPGENEIEGLKRKLSSKLAANSTTMQPDWQIGECVAVWWRPNFETTMYPYCPPHITKPKECKKLYLVHLSEREYFAVPKNLKLLAVPLFELYDNVQRYGPVISTIPQQLSRFQFNMISG

SEQ ID NO: 7079 - protein, 200 aa, Lippia dulcis
MVTSQVVNTYPLSSYTFGTKEPKMEKDTSVADRLARMKVNYMKEGMRTSVEGILLVQEHNHPHILLLQIGNTFCKLPGGRLKPGENEIDGLKRKLSSKLAANSPSLQPDWQVGECVAIWWRPNFETIMYPYCPPHITKPKECKKLFVVHLSEREYFAVPKNLKLLAVPLFELYDNVQRYGPVISTIPQQLSRFQFNMIHP

SEQ ID NO: 7080 - protein, 200 aa, Rosa hybrid cultivar
MVTSAVVNTYPLSSYTFGTKEPKMEKDTSVADRLARMKVNYMKEGMRTSVEAILLVQEHNHPHILLLQIGNTFCKLPGGRLKPGENEIEGLKRKLTSKLGANSANLVPDWQIGECVAIWWRPNFETIMYPYCPPHITKPKECKKLFLVHLSEREYFAVPKNLKLLAVPLFELYDNVQRYGPVISTIPQQLSRFQFNMISS

SEQ ID NO: 7081 - protein, 200 aa, Tripterygium wilfordii
MVTSSVVNTYPLSSYTFGTKEPKMEKDTSVADRLARMKVNYMKEGMRTSVEAILLVQEHNHPHILLLQIGNTFCKLPGGRLKPGENEIEGLKRKLTSKLGANSSALVPNWQIGECVAIWWRPNFETIMYPYCPPHITKPKECKKLFLVHLSEREYFAVPKNLKLLAVPLFELYDNVQRYGPVISTIPQQLSRFQFNMITI

SEQ ID NO: 7082 - protein, 200 aa, Unknown
  Sequence found in Organisms: Abies balsamea, Pseudotsuga menziesii
MLSGPVVNAYPLSSYTFGTKEPKMEKDTSVADRLARMKVNYMKEGMRTSVEAILLVQEHNHPHILLLQIGNTFCKLPGGRLKPGENEIEGLKRKLSSKLAANSSALQPDWQIGECVAVWWRPNFETLMYPYCPPHITKPKECKKLFLVHLSEREYFAVPKNLKLLAVPLFELYDNVQRYGPVISTIPQQLSRFTFNMVNA

SEQ ID NO: 7083 - protein, 200 aa, Theobroma cacao
MVTSPVVNTYPLSSYTFGTKEPKMEKDTSVADRLARMKVNYMKEGMRTSVEAILLVQEHNHPHILLLQIGNTFCKLPGGRLKPGENEIEGLKRKLTSKLGANSPALVPDWQIGECVAIWWRPNFETIMYPYCPPHITKPKECKKLFLVHLSEKEYFAVPKNLKLLAVPLFELYDNVQRYGPVISTIPQQLSRFQFNMITT

SEQ ID NO: 7084 - protein, 200 aa, Unknown
  Sequence found in Organisms: Cichorium intybus, Cirsium arvense, Carthamus tinctorius
MVTSSVVNTYPLSSYSFGTKEPKMEKDTSVADRLARMKLNYMKEGMRTSVEAILLVQEHNHPHILLLQIGNTFCKLPGGRLKPGENEIEGLKRKLSSKLAANSPNMQPNWQIGECVAVWWRPNFETIMYPYCPPHISKPKECKKLYVVHLSEREYFAVPKNLKLLAVPLFELYDNVQRYGPVISTIPQQLSRFQFNMIPA

SEQ ID NO: 7085 - protein, 200 aa, Cichorium intybus
MVMSSVVNTYPLSSYTFGTKEPKMEKDTSVADRLARMKVNYMKEGMRTSVEGILLVQEHNHPHILLLQIGNTFCKLPGGRLKPGENEVEGLKRKLSSKLAANSTGLQPDWQIGECVAVWWRPNFETIMYPYCPPHITKPKECKKLFLVHLSEREYFAVPKNLKLLAVPLFELYDNVQRYGPVISTIPQQLSRFQFNMIHT

SEQ ID NO: 7086 - protein, 200 aa, Coffea canephora
MVTSSVVNTYPLSSYTFGTKEPKMEKDTSVADRLARMKVNYMKEGMRTSVEGILLVQEHNHPHILLLQIGNTFCKLPGGRLKPGENEIEGLKRKLSSKLAANSAALQPDWQIGECVAIWWRPNFETIMYPYCPPHITKPKECKKLFLVHLSEREYFAVPKNLKLLAVPLFELYDNVQRYGPVISTIPQQLSRFQFNMIHP

SEQ ID NO: 7087 - protein, 200 aa, Unknown
  Sequence found in Organisms: Gossypium hirsutum, Gossypium raimondii
MVMSPVVNTYPLSSYTFGTKEPKMEKDTSVADRLARMKVNYMKEGMRTSVEAILLVQEHNHPHILLLQIGNTFCKLPGGRLKPGENEIEGLKRKLTSKLGANSPALVPDWQIGECVAIWWRPNFETIMYPYCPPHITKPKECKKLFLVHLSEKEYFAVPKNLKLLAVPLFELYDNVQRYGPVISTIPQQLSRFQFNMITT

SEQ ID NO: 7088 - protein, 200 aa, Euonymus alatus
MVTSPVVNTYPLSSYTFGTKEPKMEKDTSVADRLARMKVNYMKEGMKTSVEAILLVQEHNHPHILLLQIGNTFCKLPGGRLKPGENEIEGLKRKLTSKLGANSPAMVPDWQIGECVAMWWRPNFETIMYPYCPPHITKPKECKKLFLVHLSEREYFAVPKNLKLLAVPLFELYDNVQRYGPVISTIPQQLSRFQFNMITM

SEQ ID NO: 7089 - protein, 200 aa, Euphorbia peplus
MVNSSVVNTYPLSSYTFGTKEPKMEKDTSVADRLARMKVNYMKEGMRTSVEAILLVQEHNHPHILLLQIGNTFCKLPGGRLKPGENEIEGLKRKLTSKLGANSPALVPDWQIGECVAIWWRPNFETIMYPYCPPHITKPKECKKLYLVHLSEREYFAVPKNLKLLAVPLFELYDNVQRYGPVISTIPQQLSRFQFNMITT

SEQ ID NO: 7090 - protein, 200 aa, Unknown
  Sequence found in Organisms: Pinus pinaster, Pinus taeda
MLSGPVVNAYPLSSYTFGTKEPKMEKDTSVADRLARMKVNYMKEGMRTSVEAILLVQEHNHPHILLLQIGNTFCKLPGGRLKPGENEIEGLKRKLSSKLAANSSTLQPDWQIGECVAVWWRPNFETLMYPYCPPHITKPKECKKLFLVHLSEREYFAVPKNLKLLAVPLFELYDNVQRYGPVISTIPQQLSRFTFNMVNA

SEQ ID NO: 7091 - protein, 200 aa, Quercus alba
MVTSSVVNTYPLSSYTFGTKEPKMEKDTSVADRLARMKVNYMKEGMRTSVEGILLVQEHNHPHILLLQIGNTFCKLPGGRLKPGENEIEGLKRKLTSKLGATVPALVPDWQIGECVAVWWRPNFETIMYPYCPPHITKPKECKKLFIVHLSEREYFAVPKNLKLLAVPLFELYDNVQRYGPVISTIPQQLSRFQFNMIAK

SEQ ID NO: 7092 - protein, 200 aa, Platanus occidentalis
MVTTPVVNTYPLSSYTFGTKEPKMEKDTSVADRLARMKVNYMKEGMRTSVEAILLVQEHNHPHILLLQIGNTFCKLPGGRLKPGENEIEGLKRKLSSKLAANSTALQPDWQIGECVAIWWRPNFETIMYPYCPPHITKPKECKKLFLVHLSEREYFAVPKNLKLLAVPLFELYDNVQRYGPVISTIPQQLSRFQFNMINA

SEQ ID NO: 7093 - protein, 200 aa, Scabiosa columbaria
MVMAPVVNTYPLSSYTFGTKEPKMEKDTSVADRLARMKTNYMKEGMRTSVEAILLVQEHNHPHILLLQIGNTFCKLPGGRLKPGENEIEGLKRKLSSKLAANTPSLQPNWQVGECVATWWRPNFETIMYPYCPPHITKPKECKKLYLVYLSEREYFAVPKNLKLLAVPLFELYDNVQRYGPVISTIPQQLSRFQFNMINT

SEQ ID NO: 7094 - protein, 200 aa, Fragaria vesca
MVTSAMVNTYPLSSYTFGTKEPKMEKDTSVADRLARMKVNYMKEGMRTSVEAILLVQEHNHPHILLLQIGNTFCKLPGGRLKPGENEIEGLKRKLTSKLGANSANLVPDWQIGECVAIWWRPNFETIMYPYCPPHITKPKECKKLFLVHLSEREYFAVPKNLKLLAVPLFELYDNVQRYGPVISTIPQQLSRFQFNMISS

SEQ ID NO: 7095 - protein, 200 aa, Nicotiana tabacum
MVTSSVVNTYPLSSYTFGTKEPKMEKDTSVADRLARMKVNYFKEGMRTSVEGILLVQEHNHPHILLLQIGNTFCKLPGGRLKPGENEIEGLKRKLSSKLAANSPGLQPDWQIGECVAIWWRPNFETIMYPYCPPHITKPKECKKLFVVHLSEREYFAVPKNLKLLAVPLFELYDNVQRYGPVISTIPQQLSRFQFNMIHP

SEQ ID NO: 7096 - protein, 200 aa, Solanum lycopersicum
MVTTSVVNTYPLSSYTFGTKETKMEKDTSVADRLARMKVNYTKEGMRTSVEGILLVQEHNHPHILLLQIGNTFCKLPGGRLKPGENEIEGLKRKLSSKLAANSPGIQPNWQVGECVAIWWRPNFETIMYPYCPPHITKPKECKKLFVVHLSEREYFAVPKNLKLLAVPLFELYDNVQRYGPVISTIPQQLSRFQFNMIHP

SEQ ID NO: 7097 - protein, 200 aa, Tragopogon dubius
MVASSVVNTYPLSSYSFGTKEPKMEKDTSVADRLARMKLNYMKEGMRTSVEAILLVQEHNHPHILLLQIGNTFCKLPGGRLKPGENEIEGLKRKLSSKLAANSPNMQPNWQIGECVAVWWRPNFETIMYPYCPPHISKPKECKKLYVVHLSEREYFAVPKNLKLLAVPLFELYDNVQRYGPVISTIPQQLSRFQFNMIPA

SEQ ID NO: 7098 - protein, 199 aa, Tripterygium wilfordii
MVTSPVVNTYPLSSYTFGTKEPKMEKDTSVADRLARMKVNYMKEGMRTSVEAILLVQEHNHPHILLLQIGNTFCKLPGGRLKPGENEIEGLKRKLTSKLGANSPALVPDWQIGECVAIWWRPNFETIMYPYCPPHIMKPKECKKIFLVHLSEREYFAVPKNLKLLAVPLFELYDNVQRYGPVISTIPQQLSRFQFNMIS

SEQ ID NO: 7099 - protein, 199 aa, Olea europaea
MVTSPLVNTYPLASYTFGTKEPKMEKDTSVADRLARMKVNYMKEGMRTSVDGILLVQEHNHPHILLLQIGNTFCKLPGGRLKPGENEIEGLKRKLSSKLAANSSLQPDWQIGECVAIWWRPNFETTMYPYCPPHITKPKECKKLFLVHLSEREYFAVPKNLKLLAVPLFELYDNVQRYGPVISTIPQQLSRFQFNMIHQ

SEQ ID NO: 7100 - protein, 174 aa, Allium cepa
MVVSCNNMEVVNTYPLSNYTFGVKEPKMEKDTSVADRLARMKQNYYKEGMRTSVEAILLVQEHNHPHILLLQIGNTFCKLPGGRLKPGENEIEGLKRKLSSKLAVSSSSFQPNWQIGECVGVWYRPNFETIMYPYCPPHITKPKECKKLFLVHLSEKEYFAVPKKPEIACCSII

SEQ ID NO: 7101 - protein, 173 aa, Fraxinus spp
MVTSPLVNTYPLASYTFGTKEPKMEKDTSVADRLARMKVNYMKEGMRTSVEGILLVQEHNHPHILLLQIGNTFCKLPGGRLKPGENEIEGLKRKLSSKLAANSSSLQPDWQIGECVAIWWRSNFETTMYPYCPPHITKPKECKKLFLVHLSEREYFAVPKNLKLLAVPLFRTI

SEQ ID NO: 7102 - protein, 205 aa, Olea europaea
RERERENGDVTASEHISSRKLHFRHQRAQDGEDTSVADRLARMKVNYMKEGMRTSVDGILLVQEHNHPHILLLQIGNTFCKLPGGRLKPGENEIEGLKRKLSSKLAANSSLQPDWQIGECVAIWWRPNFETTMYPYCPPHITKPKECKKLFLVHLSEREYFAVPKNLKLLAVPLFELYDNVQRYGPVISTIPQQLSRFQFNMIHQ

SEQ ID NO: 7103 - protein, 200 aa, Lactuca sativa
MVTSSVVNTYPLSSYSFGTKEPKMEKDTSVADRLARMKLNYMKEGMRTSVEAILLVQEHNHPHILLLQIGNTFCKLPGGRLKPGENEVEGLKRKLSSKLAANSPNMQPNWQIGECVAVWWRPNFETIMYPYCPPHISKPKECKKLYVVHLSEREYFAVPKNLKLLAVPLFELYDNVQRYGPVISTIPQQLSRFQFNMIPA

SEQ ID NO: 7104 - protein, 201 aa, Beta vulgaris
MVASSSVVAVYPLSSYTFGTKEPKLEKDTSVADRLARMKVNYFKEGMRTSVEGILLVQEHNHPHILLLQIGNTFCKLPGGRLKPGENEIDGLKRKLSSKLGANSTAHQPNWQIGECVANWWRPNFETVMYPYCPPHITKPKECKKLFMVHLPEREYFAVPKNLKLLAVPLFELYDNVQRYGPVISTIPQQLSRFQFNMISP

SEQ ID NO: 7105 - protein, 200 aa, Manihot esculenta
MVNSAVVNTYPLSSYTFGTKEPKMEKDTSVADRLARMKVNYMKEGMRTSVEAILLVQEHNHPHILLLQIGNTFCKLPGGRLKPGENEIEGLKRKLTSKLGANSAALVPDWQIGECVAIWWRPNFETIMYPYCPPHITKPKECKKLFLVHLSEREYFAVPKNLKLLAVPLFELYDNVQRYGPVISTIPQQLSRFQFNMITT

SEQ ID NO: 7106 - protein, 200 aa, Unknown
  Sequence found in Organisms: Centaurea maculosa, Cirsium arvense
MVTSAVVNTYPLSSYTFGTKEPKMEKDTSVADRLARMKVNYMKEGMRTSVEGILLVQEHNHPHILLLQIGNTFCKLPGGRLKPGENEIEGLKRKLSSKLAANSTGLQPDWQIGECVAIWWRPNFETIMYPYCPPHITKPKECKKLFLVHLSEREYFAVPKNLKLLAVPLFELYDNVQRYGPVISTIPQQLSRFQFNMIHA

SEQ ID NO: 7107 - protein, 200 aa, Centaurea maculosa
  misc_feature (32)..(32): Xaa can be any naturally occurring amino acid
MVTSSVVNTYPLSSYSFGTKEPKMEKDTSVAXRLARMKLNYMKEGMRTSVEAILLVQEHNHPHILLLQIGNTFCKLPGGRLKPGENEIEGLKRKLSSKLAANSPNMQPNWQIGECVAVWWRPNFETIMYPYCPPHISKPKECKKLYVVHLSEREYFAVPKNLKLLAVPLFELYDNVQRYGPVISTIPQQLSRFQFNMIPA

SEQ ID NO: 7108 - protein, 200 aa, Unknown
  Sequence found in Organisms: Cephalotaxus harringtonia, Distylium racemosum, Podocarpus macrophillus
MLSGPVVNAYPLSSYTFGTKEPKMEKDTSVADRLARMKVNYMKEGMRTSVEAILLVQEHNHPHILLLQIGNTFCKLPGGRLKPGENEIEGLKRKLSSKLAANSSALQPDWQIGECVAVWWRPNFETLMYPYCPPHITKPKECKKLFLVHLSEREYFAVPKNLKLLAVPLFELYDNVQRYGPVISTIPQQLSRFTFNMINA

SEQ ID NO: 7109 - protein, 200 aa, Cirsium arvense
MVMSAVVNTYPLSSYTFGTKEPKMEKDTSVADRLARMKVNYMKEGMRTSVEGILLVQEHNHPHILLLQIGNTFCKLPGGRLKPGENEIEGLKRKLSSKLAANSTGLHPDWQIGECVAIWWRPNFETIMYPYCPPHITKPKECKKLFLVHLSEREYFAVPKNLKLLAVPLFELYDNVQRYGPVISTIPQQLSRFQFNMIHA

SEQ ID NO: 7110 - protein, 200 aa, Cirsium arvense
MVTSVVVNTYPLSSYTFGTKEPKMEKDTSVADRLARMKVNYMKEGMRTSVEGILLVQEHNHPHILLLQIGNTFCKLPGGRLKPGENEIEGLKRKLSSKLAANSTGLQPDWQIGECVAIWWRPNFETIMYPYCPPHITKPKECKKLFLVHLSEREYFAVPKNLKLLAVPLFELYDNVQRYGPVISTIPQQLSRFQFNMIHA

SEQ ID NO: 7111 - protein, 200 aa, Unknown
  Sequence found in Organisms: Vigna unguiculata, Lotus japonicus
MVSSQVVNTYPLSSYTFGTKEPKMEKDTSVADRLARMKVNYMKEGMRTSVEGILLVQEHNHPHILLLQIGNTFCKLPGGRLKPGENEIEGLKRKLTSKLGANSPALVPDWQIGECVAIWWRPNFETIMYPYCPPHITKPKECKKLFLVHLSEREYFAVPKNLKLLAVPLFELYDNVQRYGPVISTIPQQLSRFQFKMITN

SEQ ID NO: 7112 - protein, 200 aa, Cynara scolymus
MVTSAVVNTYPLSSYTFGTKEPKMEKDTSVADRLARMKVNYMKEGMRTSVEGILLVQEHNHPHILLLQIGNTFCKLPGGRLKPGENEIEGLKRKLSSKLAANSTGLQSDWQIGECVAIWWRPNFETIMYPYCPPHITKPKECKKLFLVHLSEREYFAVPKNLKLLAVPLFELYDNVQRYGPVISTIPQQLSRFQFNMIHS

SEQ ID NO: 7113 - protein, 200 aa, Eucalyptus grandis
MVGSPVVNMYPLSSYTFGTKEPKMEKDTSVADRLARMKVNYMKEGMRTSVEGILLVQEHRHPHILLLQIGNTFCKLPGGRLKPGENEIEGLKRKLSSKLGANSLSLQPDWQIGECAAIWWRPNFETVMYPYCPPHITKPKECKKLFIVHLSEREYFAVPKNLKLLAVPLFELYDNVHRYGPVISTIPQQLSRFQFNMMTT

SEQ ID NO: 7114 - protein, 200 aa, Euonymus alatus
MVTSPVVNTYPLSSYTFGTKEPKMEKDTSVADRLARMKVNYMKEGMKTSVEAILLVQEHNHPHILLLQIGNTFCKLPGGRLKPGENEIEGLKRKLTSKLGANSPAMVPDWQIGECVAMWWRPNFETIMYPYCPPHITKPKECKKLFLVHLSEKEYFAVPKNLKLLAVPLFELYDNVQRYGPVISTIPQQLSRFQFNMITM

SEQ ID NO: 7115 - protein, 200 aa, Guizotia abyssinica
MVASPAVNTYPLSSYSFGTKEPKMEKDTSVADRLARMKLNYMKEGMRTSVEAILLVQEHNHPHILLLQIGNTFCKLPGGRLKPGENEVEGLKRKLSSKLAANSSNMQPNWQIGECVAVWWRPNFETIMYPYCPPHISKPKECKKLYVVHLSEREYFAVPKNLKLLAVPLFELYDNVQRYGPVISTIPQQLSRFQFNMISS

SEQ ID NO: 7116 - protein, 202 aa, Populus trichocarpa
MVGAGSAVVNTYPLSSYTFGTKEPKMEKDTSVADRLARMKVNYMKEGMRTSVEAILLVQEHNHPHILLLQIGNTFCKLPGGRLKPGENEIEGLKRKLTSKLGANSPALVPDWQIGECVATWWRPNFETIMYPYCPPHITKPKECKKLYLVHLSEREYFAVPKNLKLLAVPLFELYDNVQRYGPVISTIPQQLSRFQFNMITT

SEQ ID NO: 7117 - protein, 200 aa, Rhizophora mangle
MVNSSVVNTYPLSSYTFGTKEPKMEKDTSVADRLARMKINYMKEGMRTSVEAILLVQEHNHPHILLLQIGNTFCKLPGGRLKPGENEIEGLKRKLTSKLGANSPALVPDWQIGECVAIWWRPNFETIMYPYRPPHITKPKECKKLFLVHLSEREYFAVPKNLKLLAVPLFELYDNVQRYGPVISTIPQQLSRFQFNMITT

SEQ ID NO: 7118 - protein, 200 aa, Picea glauca
MLSGPVVNAYPLSSYTFGTKEPKMEKDTSVADRLARMKVNYMKEGMRTSVEAILLVQEHNHPHILLLQIGNTFCKLPGGRLKPGENEVEGLKRKLSSKLAANSTTLQPDWQIGECVAVWWRPNFETLMYPYCPPHITKPKECKKLFLVHLSEREYFAVPKNLKLLAVPLFELYDNVQRYGPVISTIPQQLSRFTFNMVNA

SEQ ID NO: 7119 - protein, 204 aa, Allium cepa
MVVSCNNMEVVNTYPLSNYTFGVKEPKMEKDTSVADRLARMKQNYYKEGMRTSVEAILLVQEHNHPHILLLQIGNTFCKLPGGRLKPGENEIEGLKRKLSSKLAVSSSSFQPNWQIGECVGVWYRPNFETIMYPYCPPHITKPKECKKLFLVHLSEKEYFAVPKNLKLLAVPLFELYDNVQRYGPVISTIPQQLSRFQFNMVQS

SEQ ID NO: 7120 - protein, 203 aa, Populus trichocarpa
MVGAGSAVVNTYPLSSYTFGTKEPKMEKDTSVADRLARMKVNYMKEGMRTSVEAILLVQEHNHPHILLLQIGNTFCKLPGGRLKPGENEIEGLKRKLTSKLGANSPALVPDWQIGECVATWWRPNFETIMYPYCPPHITKPKECKKLYLVHLSEREYFAVPKNLKLLAVPLFELYDNVQRYGPVISTIPQQLSRFQFNMITTA

SEQ ID NO: 7121 - protein, 177 aa, Papaver somniferum
MEKDTSVSDRLARMKVNYMKEGMRTSVEAILLVQEHNHPHILLLQIGNTFCKLPGGRLKPGENEIDGLKRKLSSKLAANSTALQPDWQIGECVAIWWRPNFETIMYPYCPPHITKPKECKKLFLVHLSEREYFAVPKNLKLLAVPLFELYDNVQRYGPVISTIPQQLSRFQFNMING

SEQ ID NO: 7122 - protein, 200 aa, Phaseolus coccineus
MVSSQVVNTYPLSSYTFGTKEPKMEKDTSVADRLARMKVNYMKEGMRTSVEGILLVQEHNHPHILLLQIGNTFCKLPGGRLKPGENEMEGLKRKLTSKLGANSPALVPDWQIGECVAIWWRPNFETIMYPYCPPHITKPKECKKLFLVHLSEREYFAVPKNLKLLAVPLFELYDNVQRYGPVISTIPQQLSRFQFKMITN

SEQ ID NO: 7123 - protein, 200 aa, Amborella trichopoda
MVTSSVVNAYPLSSYTFGTKEPKMEKDTSVAERLARMRVNYMKEGMRTSVEAILLVQEHNHPHILLLQIGNTFCKLPGGRLKPGENEIEGLKRKLSSKLAANAAALQPDWQIGECVAIWWRPNFETIMYPYCPPHITKPKECKKLFLVHLSEREYFAVPKNLKLLAVPLFELYDNVQRYGPVISTIPQQLSRFQFNMINA

SEQ ID NO: 7124 - protein, 200 aa, Unknown
  Sequence found in Organisms: Castanea mollissima, Quercus alba
MVSSTVVNTYPLSSYTFGTKEPKIEKDSSVADRLARMKLNYFKEGMRTSVEAILLVQEHKHPHILLLQIGNTFCKLPGGRLKPGENEIEGLKRKLTSKLGANQPSLQPNWQIGECVAIWWRPNFETVMYPYCPPHITKPKECKKLYIVHLSEREYFAVPKNLKLLAVPLFELYDNVQRYGPVISTIPQQLSRFQFNMITT

SEQ ID NO: 7125 - protein, 200 aa, Taraxacum officinale
MLTSSVVNTYPLSSYSFGTKEPKMEKDTSVADRLARMKLNYMKEGMRTSVEAILLVQEHNHPHILLLQIGNTFCKLPGGRLKPGENEVEGLKRKLSSKLAANSPNMQPNWQIGECVAVWWRPNFETIMYPYCPPHISKPKECKKLYVVHLSEREYFAVPKNLKLLAVPLFELYDNVQRYGPVISTIPQQLSRFQFNMIPA

SEQ ID NO: 7126 - protein, 200 aa, Mimulus guttatus
MVTSSVVNTYPLSSYTFGTKEPKMEKDTSVADRLARMKINYMKEGMRTSVEGILLVQEHNHPHILLLQIGNTFCKLPGGRLKPGENEIEGLKRKLSSKLAANSPSLQPDWQIGDCVATWWRPNFETTMYPYCPPHITKAKECKKLYLVHLSEREYFAVPKNLKLLAVPLFELYDNVQRYGPVISTIPQQLSRFQFNMIHQ

SEQ ID NO: 7127 - protein, 200 aa, Carica papaya
MVASTVVNTYPLSSYTFGTKEPKMEKDTSVADRLARMKVNYMKEGMRTSVEGILLVQEHNHPHILLLQIGNTFCKLPGGRLKPGENEIEGLRRKLTSKLGANSPGLVPDWQIGECVAIWWRPNFETIMYPYCPPHITKPKECKKLFVVHLAEKEYFAVPKNLKLLAVPLFELYDNVQRYGPVISTIPQQLSRFQFNMISS

SEQ ID NO: 7128 - protein, 200 aa, Petunia hybrida
MVTSGIVNTYPLSSYTFGTKEPKMEKDTSVADRLARMKLNYMKEGMRTSVEGILLVQEHNHPHILLLQIGNTFCKLPGGRLKPGENEIEGLKRKLSSKLAANSPGLQPDWQIGECVALWWRPNFETIMYPYCPPHITKPKECKKLFLVHLSEREYFAVPKNLKLLAVPLFELYDNVQRYGPVISTIPQQLSRFQFNMIHP

SEQ ID NO: 7129 - protein, 200 aa, Lippia dulcis
MVASQVVNTYPLSSYTFGTKEPKMEKDTSVADRLARMKVNYMKEGMRTSVEGILLVQEHNHPHILLLQIGNTFCKLPGGRLKPGENEIEGLKRKLSSKLAANSPTLQPDWQIGECVAMWYRPNFETIMYPYCPPHIAKPKECKKLFLVHLSEREYFAVPKNLKLLAVPLFELYDNVQRYGPVISTIPQQLSRFQFNMIQP

SEQ ID NO: 7130 - protein, 200 aa, Sciadopitys verticillata
MLSGPVVNAYPLSSYTFGTKEPKMEKDTSVADRLARMKVNYMKEGIRTSVEAILLVQEHNHPHILLLQIGNTFCKLPGGRLKPGENEIEGLKRKLSSKLAANSSALQPDWQIGECVAVWWRPNFETLMYPYCPPHITKPKECKKLFLVHLSEREYFAVPKNLKLLAVPLFELYDNVQRYGPVISTIPQQLSRFTFNMINA

SEQ ID NO: 7131 - protein, 200 aa, Glycine max
MVSSQVVNTYPLSSYTFGTKEPKMEKDTSVADRLARMKVNYMKEGMRTSVEGILLVQEHNHPHILLLQIGNTFCKLPGGRLKPGENEIEGLKRKLTSKLGANSPALVPDWQISECVAIWWRPNFETIMYPYCPPHITKPKECKKLFLVHLSEREYFAVPKNLKLLAVPLFELYDNVQRYGPVISTIPQQLSRFQFKMITN

SEQ ID NO: 7132 - protein, 200 aa, Glycine max
MVSSQVVNTYPLSSYTFGTKEPKMEKDTSVADRLARMKVNYMKEGMRTSVEGILLVQEHNHPHILLLQIGNTFCKLPGGRLKPGENENEGLKRKLTSKLGANSPALVPDWQIGECVAIWWRPNFETIMYPYCPPHITKPKECKKLFLVHLSEREYFAVPKNLKLLAVPLFELYDNVQRYGPVISTIPQQLSRFQFKMITN

SEQ ID NO: 7133 - protein, 200 aa, Taxus baccata
MLSGPVVNAYPLSSYTFGTKEPKMEKDTSVADRLARMKVNYLKEGMRTSVEAILLVQEHNHPHILLLQIGNTFCKLPGGRLKPGENEIEGLKRKLSSKLAANSSALQPDWQIGECVAVWWRPNFETLMYPYCPPHITKPKECKKLFLVHLSEREYFAVPKNLKLLAVPLFELYDNVQRYGPVISTIPQQLSRFSFNMINA

SEQ ID NO: 7134 - protein, 200 aa, Triphysaria pusilla
MVASQVVNTYPLSSYTFGTKEPKMEKDTSVHDRLARMKVNYMKEGVRTSVEAILLVQEHNHPHILLLQIGNTFCKLPGGRLKPGENEIEGLKRKLSSKLAANSPGLQPDWQIGECVAMWWRPNFETIMYPYCPPHITKPKECKKLYLVHLSEREYFAVPKNLKLLAVPLFELYDNVQRYGPVISTIPQQLSRFQFNMIQQ

SEQ ID NO: 7135 - protein, 158 aa, Artemisia annua
MVSSSIVNTYPLSSYSFGTKEPKMEKDTSVADRLARMKLNYMKEGMRTSVEAILLVQEHNHPHILLLQIGNTFCKLPGGRLKPGENEIEGLKRKLSSKLAANSPNMQPNWQIGECVAVWWRPNFETIMYPYCPPHISKPKSFMLYTCQKESTLRCPKI

SEQ ID NO: 7136 - protein, 198 aa, Aquilegia formosa
MVPVVNTYPLSSYTFGTKEPKMEKDTSVADRLARMKVNYMKEGMRTSVEAILLVQEHNHPHILLLQIGNTFCKLPGGRLKPGENEIEGLKRKLSSKLAANATALQPDWQIGECVAIWWRPNFETIMYPYCPPHITKPKECKKLFLVHLSEREYFAVPKNLKLLAVPLFELYDNVQRYGPVISTIPQQLSRFQFNMING

SEQ ID NO: 7137 - protein, 197 aa, Aquilegia formosa
VPVVNTYPLSSYTFGTKEPKMEKDTSVADRLARMKVNYMKEGMRTSVEAILLVQEHNHPHILLLQIGNTFCKLPGGRLKPGENEIEGLKRKLSSKLAANATALQPDWQIGECVAIWWRPNFETIMYPYCPPHITKPKECKKLFLVHLSEREYFAVPKNLKLLAVPLFELYDNVQRYGPVISTIPQQLSRFQFNMING

SEQ ID NO: 7138 - protein, 201 aa, Eucalyptus grandis
MVTSSAAANIYPLSSYTFGTKEPKMEKDTSVADRLARMKVNYMKEGMRTSVEAILLVQEHNHPHILLLQIGNTFCKLPGGRLKPGENEIEGLKRKLTSKLGANSPALVPDWQIGECVAIWWRPNFETIMYPYCPPHITKPKECKKLFLVHLSEREYFAVPKNLKLLAVPLFELYDNVQRYGPVISTIPQQLSRFHFKMITQ

SEQ ID NO: 7139 - protein, 201 aa, Fagopyrum esculentum
MVPSSSVVNIHPLASYSFGTKEPKMEKDTSVADRLARMKVNYMKEGMRTSVEGILLVQEHNHPHILLLQIGNTFCKLPGGRLKPGENEVEGLKRKLSSKLGANSLNLQPNWQVGECVANWWRPNFETMLYPYCPPHITKPKECKKLYIVHLPEREYFAVPKNLKLLAVPLFELYDNVQRYGPVISTIPQQLSRFNFKMVTQ

SEQ ID NO: 7140 - protein, 200 aa, Ipomoea nil
MITSPVVNTYPLASYSFGTKEPKMEKDTSVADRLARMKVNYMKEGMRTSVEGILLVQEHNHPHILLLQIGNTFCKLPGGRLKPGENEIEGLKRRLSSKLAANNSAVQPDWQIGECVAIWWRPNFETIMYPYCPPHITKPKECKKLFLVHLSEREYFAVPKNLKLLAVPLFELYDNVQRYGPVISTIPQQLSRFQFNMIHP

SEQ ID NO: 7141 - protein, 200 aa, Unknown
  Sequence found in Organisms: Medicago truncatula, Trigonella foenum-graecum
MIPSQVVNTYPLSSYTFGTKEPKMEKDTSVADRLARMKVNYMKEGMRTSVEGILLVQEHNHPHILLLQIGNTFCKLPGGRLKPGENEIEGLKRKLTSKLGANSPGLVPDWQIGECVAIWWRPNFETIMYPYCPPHITKPKECKKLFLVHLSEREYFAVPKNLKLLAVPLFELYDNVQRYGPVISTIPQQLSRFQFKMITN

SEQ ID NO: 7142 - protein, 200 aa, Cajanus cajan
MVSSKVVNTYPLSSYTFGTKEPKMEKDTSVADRLARMKVNYMKEGMRTSVEGILLVQEHNHPHILLLQIGNTFCKLPGGRLKPGENETEGLKRKLTSKLGANSPALVPDWEIGECVAIWWRPNFETIMYPYCPPHITKPKECKKLFLVHLSEREYFAVPKNLKLLAVPLFELYDNVQRYGPVISTIPQQLSRFQFKMITN

SEQ ID NO: 7143 - protein, 198 aa, Thalictrum flavum
MVPVVNTYPLSSYTFGTKEPKMEKDTSVADRLARMKVNYMKEGMRTSVEAILLVQEHNHPHILLLQIGNTFCKLPGGRLKPGENEIEGLKRKLSSKLAANATALQPDWQIGECVAIWWRPNFETIMYPYCPPHITKPKECKKLFLVHLSEREYFAVPKNLKLLAVPLFELYDNVQRYGPVISTIPQQLSRFQFNMINA

SEQ ID NO: 7144 - protein, 199 aa, Tripterygium wilfordii
MVTSPVVNTYPLSSYTFGTKEPKMEKDSSVADRLARMKVNYTKEGMKTSVEAILLVQEHNHPHILLLQIGNTFCKLPGGRLKPGENEIEGLKRKLTSKLGANSPAMVPDWQIGECVAMWWRPNFETIMYPYCPPHIMKPKECKKIFLVHLSEREYFAVPKNLKLLAVPLFELYDNVQRYGPVISTIPQQLSRFQFNMIS

SEQ ID NO: 7145 - protein, 204 aa, Allium cepa
MVVSCNNMEVVNTYPLSNYTFGVKEAKMEKDTSVADRLARMKQNYFKEGMRTSVEAILLVQEHSHPHILLLQIGNTFCKLPGGRLKPGENEVEGLKRKLSSKLAVSSPAFQPNWQIGECVAVWYRPNFETIMYPYCPPHITKPKECKKLFLVHLSEKEYFAVPKNLKLLAVPLFELYDNVQRYGPVISTIPQQLSRFQFNMVHS

SEQ ID NO: 7146 - protein, 177 aa, Fagus grandifolia
MEKDTSVADRLARMKINYMKEGMRTSVEGILLVQEHNHPHILLLQIGNTFCKLPGGRLKPGENEIEGLKRKLTSKLGATVPALVPDWQIGECVAVWWRPNFETIMYPYCPPHITKPKECKKLFLVHLSEREYFAVPKNLKLLAVPLFELYDNVQRYGPVISTIPQQLSRFEFNMITK

SEQ ID NO: 7147 - protein, 113 aa, Vinca minor
TSPVVNTYPLSSYTFGTKEPKMEKDTSVADRLARMKVNYTKEGMRTSVEGILLVQEHNHPHILLLQIGNTFCKLPGGRLKPGENEIEGLKRKLLASLQLIHPVCSQIGRSANV

SEQ ID NO: 7148 - protein, 202 aa, Cicer arietinum
MVSAQSQVVNTYPLSSYTFGTKEPKMEKDTSVADRLARMKLNYMKEGMRTSVEGILLVQEHNHPHILLLQIGNTFCKLPGGRLKPGENEVEGLKRKLTSKLGANSAALVPDWQIGECVAIWWRPNFETIMYPYCPPHITKPKECKKLFLVHLSEREYFAVPKNLKLLAVPLFELYDNVQRYGPVISTIPQQLSRFQFKMITN

SEQ ID NO: 7149 - protein, 200 aa, Cleome spinosa
MVFSPVVNTYPLSNYSLGTKEPKLEKDTSVADRLARMKVNYMKEGMRTSVEGILLVQEHNHPHILLLQIGNTFCKLPGGRLKPGENEIEGLKRKLTSKLGANSPTLAPDWKIGECVATWWRPNFETMMYPYCPPHITKPKECKRLFIVYLSEKEYFAVPKNLKLLAVPLFELYDNIQRYGPVISTIPQQLSRFHFNMVSS

SEQ ID NO: 7150 - protein, 201 aa, Fagopyrum esculentum
MVPSSPVVNIHPLSNYSFGTKEPKMEKDTSVADRLARMKVNYMKEGMRTSVEGILLVQEHNHPHILLLQIGNTFCKLPGGRLKPGENEVEGLKRKLSSKLGANSLNLQPNWQVGECVANWWRPNFETMLYPYCPPHITKPKECKKLYIVHLPEREYFAVPKNLKLLAVPLFELYDNVQRYGPVISTIPQQLSRFNFKMITQ

SEQ ID NO: 7151 - protein, 201 aa, Linum usitatissimum
MVVGFAVVNTYPLSSYTFGTKEPKMEKDTSVADRLARMKLNYMKEGMRTSVEAIFLVQEHNHPHILFLQIGNTFCKLPGGRLKPGENEIEGLKRKLTSKLGANSPTLVPDWQIGECVATWWRPNFETTMYPYCPPHITKPKECKKLYIVHLSEREYFAVPKNLKLLAVPLFELYDNVQRYGPVISTIPQQLSRFQFNMITT

SEQ ID NO: 7152 - protein, 200 aa, Vitis vinifera
MLTSPVVNTYPLSSYTFGTKEPKMEKDTSVADRLARMRVNYMKEGMRTTVDAILLVQEHTHPHILLLQIGNTFCKLPGGRLKPGENEIEGLKRKLSSKLAANSPGLQPDWQIGECVAIWWRPNFETVMYPYCPPHITKPKECKKLFIVHLSEREYFAVPKNLKLLAVPLFELYDNVQRYGPVISTIPLHLSRFQFNMIAA

SEQ ID NO: 7153 - protein, 200 aa, Carthamus tinctorius
  misc_feature (70)..(70): Xaa can be any naturally occurring amino acid
  misc_feature (112)..(112): Xaa can be any naturally occurring amino acid
  misc_feature (186)..(186): Xaa can be any naturally occurring amino acid
MVTSAVVNTYPLSSYTFGTKEPKMEKDTSVADRLARMKVNYMKEGMRTSVEGILLVQEHNHPHILLLQIXNTFCKLPGGRLKPGENEVEGLKRKLSSKLAANSTGLQPDWQXGECVAIWWRPNFETIMYPYCPPHITKPKECKKLFLVHLSEREYFAVPKNLKLLAVPLFELYDNVQRYGPVISTXPQQLSRFQFNMIHA

SEQ ID NO: 7154 - protein, 161 aa, Fagus grandifolia
MLTSTVVNTYPLSSYTFGTKEPKIEKDSSVADRLARMKLNYFKEGMRTSVEAILLVQEHKHPHILLLQIGNTFCKLPGGRLKPGENEIEGLKRKLTSKLGANQPSLQPDWQIGECVAIWWRPNFETVMYPYCPPHITKPKEVKKLFIVHLSEREYFAVPKI

SEQ ID NO: 7155 - protein, 94 aa, Sarracenia psittacina
MVTSTVVNTYPLSSYTFGTKEPKMEKDTSVADRLARMKINYMKEGMRTSVEAILLVQEHNHPHILLLQIGNTFCKLPGGRLKPGENEIEGLKRN

SEQ ID NO: 7156 - protein, 200 aa, Solanum melongena
MVTSAMVNTYPLSSYTFGTKEPKMEKDSSVADRLARMKVNYMKEGVRTSVEGILLVQEHNHPHILLLQIGNTFCKLPGGRLKPGENEIEGLKRKLSSKLAANSPTHQPDWQIGECVATWWRPNFETMMYPYCPPHITKPKECRKLYLVHLSEREYFAVPKNLKLLAVPLFELYDNVQRYGPVISTIPQQLSRFQFNMIHQ

SEQ ID NO: 7157 - protein, 200 aa, Unknown
  Sequence found in Organisms: Solanum tuberosum, Solanum phureja
MVSSAIVNTYPLSSYTFGTKEHKMEKDSSVADRLARMKVNYMKEGMRTSVEGILLVQEHNHPHILLLQIGNTFCKLPGGRLKPGENEIEGLKRKLSSKLAANPPANQPNWKIGECVATWWRPNFETIMYPYCPPHITKPKECKKLYLVHLSEREYFAVPKNLKLLAVPLFELYDNVQRYGPVISTIPQQLSRLQFNMIHQ

SEQ ID NO: 7158 - protein, 200 aa, Solanum tuberosum
MVSSAIVNTYPLSSYTFGTKEHKMEKDTSVADRLARMKVNYMKEGVRTSVEGILLVQEHNHPHILLLQIGNTFCKLPGGRLKPGENEIEGLKRKLSSKLAANPPANQPNWKIGECVATWWRPNFETIMYPYCPPHITKPKECKKLYLVHLSEREYFAVPKNLKLLAVPLFELYDNVQRYGPVISTIPQQLSRLQFNMIHQ

SEQ ID NO: 7159 - protein, 200 aa, Nicotiana tabacum
  misc_feature (16)..(16): Xaa can be any naturally occurring amino acid
  misc_feature (42)..(42): Xaa can be any naturally occurring amino acid
  misc_feature (51)..(51): Xaa can be any naturally occurring amino acid
MVTSAIVNTYPLSSYXFGTKEPKMEKDTSVADRLARMKLNYXKEGMRTSVXGILLVQEHNHPHILLLQIGNTFCKLPGGRLKPGENEIEGLKRKLSSKLAANSPGLQPDWQIGECVATWWRPNFETIMYPYCPPHISKPKECKKLFIVHLSEREYFAVPKNLKLLAVPLFELYDNVQRYGPVISTIPQQLSRFQFNMIQP

SEQ ID NO: 7160 - protein, 204 aa, Arachis hypogaea
MVVVSSQNTVVNTYPLSSYTFGTKEPKMEKDTSVADRLARMKINYMKEGMRTSVEGILLVQEHNHPHILLLQIGNTFCKLPGGRLKPGENEVEGLKRKLTSKLGANSPTLVPDWQIGECVANWWRPNFETIMYPYCPPHITKPKECKKLFLVHLSEREYFAVPKNLKLLAVPLFELYDNVQRYGPVISTIPQQLSRFQFKMITN

SEQ ID NO: 7161 - protein, 168 aa, Utricularia gibba
VVNTYPLSNYSFGSKEPKMEKDTSVADRLARMRVNYMKEGMRTSVEGILLVQEHNHPHILLLQIGNTFCKLPGGRLKPGENEVEGLKRKLSSKLGANSPNLQPNWQVGECVATWWRPNFETTMYPYCPPHITKPKECKKLFVVHLSEREYFAVPKNLKLLAVPLFVTI

SEQ ID NO: 7162 - protein, 200 aa, Tropaeolum majus
MLTSPVVNTYPLSSYTFGTKEPKMEKDTSVADRLARMKVNYFKEGMRTSVEAILIVQEHKHPHILLLQIGNTFCKLPGGRLKPGENEIDGLKRKLSSKLGPNSPAHQPDWQIGECVGIWWRPNFETIMYPYCPPHITKPKECKKLFIVHLSEKEYFAVPRNLKLLAVPLFELYDNVQRYGPVISTIPQQLSRFHFNMMTI

SEQ ID NO: 7163 - protein, 195 aa, Platanus occidentalis
VVNTYPLSSYTFGTKEPKMEKDTSVADRLARMKVNYMKEGMRSSVDAILLVQEHNHPHILLLQIGNTFCKLPGGRLKPGENEIEGLKRKLSSKLAANSTALQPDWQIGECVAIWWRPNFETIMYPYCPPHITKPKECKKLYLVHLSEREYFAVPKNLKLLAVPLFELYDNVQRYGPVISTIPQQLSRFQFNMINT

SEQ ID NO: 7164 - protein, 200 aa, Raphanus sativus
MAMSQVVNTYPLSNYSFGTKEPKLEKDTSVADRLARMKVNYMKEGMRTSVEGILLVQEHNHPHILLLQIGNTFCKLPGGRLKPGENEVEGLKRKLTSKLGGNSAGFVPDWKVGECVATWWRPNFETMMYPYCPPHITKPKECKRLYIVHLSEKEYFAVPKNLKLLAVPLFELYDNVQRYGPVISTIPQQLSRFHFNMISS

SEQ ID NO: 7165 - protein, 200 aa, Solanum phureja
MVSSAIVNTYPLSSYTFGTKEHKMEKDSSVADRLARMKVNYMKEGVRTSVEGILLVQEHNHPHILLLQIGNTFCKLPGGRLKPGENEIEGLKRKLSSKLAANPPANQPNWKIGECVATWWRPNFETIMYPYCPPHITKPKECKKLYLVHLSEREYFAVPKNLKLLAVPLFELYDNVQRYGPVISTIPQQLSRLQFNMIHQ

SEQ ID NO: 7166 - protein, 200 aa, Unknown
  Sequence found in Organisms: Eutrema halophilum, Eutrema parvulum
MAMSQVVNTYPLSNYSFGTKEPKLEKDTSVADRLARMKVNYMKEGMRTSVEGILLVQEHNHPHILLLQIGNTFCKLPGGRLKPGENEVEGLKRKLTSKLGGNSAALVPDWKVGECVATWWRPNFETMMYPYCPPHITKPKECKRLFIVHLSEKEYFAVPKNLKLLAVPLFELYDNVQRYGPVISTIPQQLSRFHFNMISS

SEQ ID NO: 7167 - protein, 200 aa, Capsicum annuum
MVTSSIVNTYPLSSYTFGTKEPNMEKDSSVVDRLARMKVNYMKEGVRSSVEGILLVQEHNHPHILLLQIGNTFCKLPGGRLKPGENEIEGLKRKLSSKLAANSPALQPDWQIGECVATWWRPNFETSMYPYCPPHITKPKECKKLYLVHLSEKEYFAVPKNLKLLAVPLFELYDNVQRYGPVISTIPQQLSRFQFNMIHQ

SEQ ID NO: 7168 - protein, 200 aa, Brassica napus
MAMSQVVNTYPLSNYSFGTKEPKLEKDTSVADRLARMKVNYMKEGMRTSVEGILLVQEHNHPHILLLQIGNTFCKLPGGRLKPGENEVEGLKRKLTSKLGGNSAGIVPDWKVGECVATWWRPNFETMMYPYCPPHITKPKECKRLYIVHLSEKEYFAVPKNLKLLAVPLFELYDNVQRYGPVISTIPQQLSRFHFNMISS

SEQ ID NO: 7169 - protein, 200 aa, Primula obconica
MVTSPPVNIYPLSSYSFGAKEPKMEKDTSVADRLARMKLNYTKEGMRTSVEAILLVQEHNHPHILLLQIGNTFCKLPGGRLKPGENEIEGLKRKLNSKLGANTPGFQQDWKIGECVATWWRPNFETIMYPYCPPHITKPKECKKLYIVHLSEREYFAVPKNLKLLAVPLFELYDNMQRYGPVISTIPQQLSRFQFKMIQS

SEQ ID NO: 7170 - protein, 200 aa, Raphanus sativus
  misc_feature (26)..(26): Xaa can be any naturally occurring amino acid
MAMSQVVNTYPLSNYSFGTKEPKLEXDTSVADRLARMKVNYMKEGMRTSVEGILLVQEHNHPHILLLQIGNTFCKLPGGRLKPGENEVEGLKRKLTSKLGGNSAGFVPDWKVGECVATWWRPNFETMMYPYCPPHITKPKECKRLYIVHLSEKEYFAVPKNLKLLAVPLFELYDNVQRYGPVISTIPQQLSRFHFNMISS

SEQ ID NO: 7171 - protein, 201 aa, Silene vulgaris
MVAQSSSIVAVHPLSSYSFGTKEPKLEKDTSVADRLSRMRVNYMKEGMRTSVEGILLVQEHNHPHILLLQIGNTFCKLPGGRLKPGENEIDGLKRKLSSKLGANSSIQPNWQIGECVATWWRPNFETVMYPYCPPHITKPKECKKLYMVHLPEREYFAVPKNLKLLAVPLFELYDNIQRYGPVISTIPQQLSRFQFNMISQ

SEQ ID NO: 7172 - protein, 200 aa, Silene vulgaris
MQTCPVVNTYPLSSYSFGTKEPKMEKDTSVADRLARMKLNYMKEGMRTSVEAILLVQEHNHPHILLLQIGNTFSKLPGGRLKPGENEIEGLKRKLSSKLAANQPGMQPEWQIGECVAMWWRPNFETIMYPYCPPHIMKPKECKKLYIVHLSEREYFAVPKNLKLLAVPLFELYDNVQRYGPVLSSIPQQLSRFQFKMISS

SEQ ID NO: 7173 - protein, 200 aa, Triphysaria pusilla
MVAPQIVNTYPLSSYTFGTKEPKMEKDSSVSERLARMKVNYMKEGVRTSVEGILLVQEHNHPHILLLQIGNTFCKLPGGRLKPGENEIEGLKRKLSSKLAANSPGLQPDWQIGECVAQWWRPNFETIMYPYCPPHITKPKECKKLYLVHLSEREYFAVPKNLKLLAVPLFELYDNVQRYGPVISTIPQQLSRFQFNMIQQ

SEQ ID NO: 7174 - protein, 73 aa, Carpinus betulus
MYPYCPPHITKPKECKKLYLVHLSEREYFAVPKNLKLLAVPLFELYDNVQRYGPVISTIPQQLSRFQFNMIAK

SEQ ID NO: 7175 - protein, 200 aa, Brassica juncea
MAMSQVVNTYPLSNYSFGTKEPKLEKDTSVADRLARMKVNYMKEGMRTSVDAILLVQEHNHPHILLLQIGNTFCKLPGGRLKPGENEVEGLKRKLTSKLGGNSAALVPDWKVGECVATWWRPNFETMMYPYCPPHITKPKECKRLYVVHLSEKEYFAVPKNLKLLAVPLFELYDNVQRYGPVISTIPQQLSRFHFNMISS

SEQ ID NO: 7176 - protein, 200 aa, Unknown
  Sequence found in Organisms: Brassica napus, Brassica juncea, Brassica oleracea, Brassica rapa
MAMSQVVNTYPLSNYSFGTKEPKLEKDTSVADRLARMKINYMKEGMRTSVDAILLVQEHNHPHILLLQIGNTFCKLPGGRLKPGENEVEGLKRKLTSKLGGNSAALVPDWKVGECVATWWRPNFETMMYPYCPPHITKPKECKRLYIVHLSEKEYFAVPKNLKLLAVPLFELYDNVQRYGPVISTIPQQLSRFHFNMISS

SEQ ID NO: 7177 - protein, 200 aa, Arabidopsis lyrata
MAMSQVVNTYPLSNYSFGTKEPKLEKDTSVADRLARMKINYMKEGMRTSVEGILLVQEHNHPHILLLQIGNTFCKLPGGRLKPGENEVDGLKRKLTSKLGGNSAALVPDWKVGECVATWWRPNFETMMYPYCPPHITKPKECKRLFIVHLSEKEYFAVPKNLKLLAVPLFELYDNVQRYGPVISTIPQQLSRFHFNMISS

SEQ ID NO: 7178 - protein, 200 aa, Brassica rapa
MAMSQVVNTYPLSNYSFGTKEPKLEKDTSVADRLARMKVNYMKEGMRTSVEGILLVQEHNHPHILLLQIGNTFCKLPGGRLKPGESEVEGLKRKLTSKLGGNSAGIVPDWKVGECVATWWRPNFETMMYPYCPPHITKPKECKRLYIVHLSEKEYFAVPKNLKLLAVPLFELYDNVQRYGPVISTIPQQLSRFHFNMISS

SEQ ID NO: 7179 - protein, 200 aa, Raphanus sativus
MAMSQVVNTYPLSNYSFGTKEPKLEKDTSVADRLARMKINYMKEGMRTSVDAILLVQEHNHPHILLLQIGNTFCKLPGGRLKPGENEVEGLKRKLTSKLGGNSAGLVPDWKVGECVATWWRPNFETMMYPYCPPHITKPKECKRLYIVHLSEKEYFAVPKNLKLLAVPLFELYDNVQRYGPVISTIPQQLSRFHFNMISS

SEQ ID NO: 7180 - protein, 200 aa, Solanum lycopersicum
MASSAIVNTYPLSSYTFGTKEHKMEKDTSVADRLARMKVNYMKEGVRTSVEGILLVQEHNHPHILLLQIGNTFCKLPGGRLKPGENEIEGLKRKLSSKLAANPPANQPNWKIGECIATWWRPNFETIMYPYCPPHITKPKECKKLYLVHLSEREYFAVPKNLKLLAVPLFELYDNVQRYGPVISTIPQQLSRLQFNMINQ

SEQ ID NO: 7181 - protein, 200 aa, Arabidopsis thaliana
MAMSQVVNTYPLSNYSFGTKEPKLEKDTSVADRLARMKINYMKEGMRTSVEGILLVQEHNHPHILLLQIGNTFCKLPGGRLKPGENEADGLKRKLTSKLGGNSAALVPDWTVGECVATWWRPNFETMMYPYCPPHITKPKECKRLYIVHLSEKEYFAVPKNLKLLAVPLFELYDNVQRYGPVISTIPQQLSRFHFNMISS

SEQ ID NO: 7182 - protein, 200 aa, Brassica juncea
MAMSQVVNTYPLSNYSFGTKEPKLEKDTSVADRLARMKINYMKEGMRTSVDAILLVQEHNHPHILLLQIGNTFCKLPGGRLKPGENEVEGLKRKLTSKLGGNSAGLVPDWKVGECVATWWRPNFETMMYPYCPPHITKPKECKRLYVVHLSEKEYFAVPKNLKLLAVPLFELYDNVQRYGPVISTIPQQLSRFHFNMISS

SEQ ID NO: 7183 - protein, 208 aa, Gnetum gnemon
MYSSGPVVNAYPLSSYTFGTKEPKMEKDTSVADRLARMKVNYMKEGMRTSVEAILLVQEHNHPHILLLQIGNTFCKLPGGRLKPGENEIEGLKRKLSSKLAANSVALQPDWKIGECVAVWWRPNFETLMYPYCPPHITKPKECKKLFLVQLSEREYFAVPKNLKLLAVPLFELYDNVQRYGPVISTIPQQLSRFTVKMVNNEHRKDVF

SEQ ID NO: 7184 - protein, 196 aa, Solanum tuberosum
MVTSSVVNTYPLSSYTFGTKEPKMEKDTSVADRLARMKVNYTKEGMRTSVEGILLVQEHNHPHILLLQIGNTFCKLPGGRLKPGENEIEGLKRKLSSKLAANSPGIQPNWQIGECVAIWWRPNFETIMYPYCPPHITKPKECKKLFVVHLSEREYFAVPKNLKLLAVPLFELYDNVQRYGPVISTIPHSFPDSSST

SEQ ID NO: 7185 - protein, 200 aa, Raphanus sativus
MAMSQIVNTYPLSNYSFGTKEPKLEKDTSVADRLARMKINYMKEGMRTSVDAILLVQEHNHPHILLLQIGNTFCKLPGGRLKPGENEVEGLKRKLTSKLGGNSAGLVPDWKVGECVATWWRPNFETMMYPYCPPHITKPKECKRLFVVHLSEKEYFAVPKNLKLLAVPLFELYDNVQRYGPVISTIPQQLSRFHFNMISS

SEQ ID NO: 7186 - protein, 200 aa, Unknown
  Sequence found in Organisms: Brassica napus, Brassica juncea, Brassica rapa
MAMSQIVNTYPLSNYSFGTKEPKLEKDTSVADRLARMKINYMKEGMRTSVDAILLVQEHNHPHILLLQIGNTFCKLPGGRLKPGENEVEGLKRKLTSKLGGNSAGLVPDWKVGECVATWWRPNFETMMYPYCPPHITKPKECKRLYVVHLSEKEYFAVPKNLKLLAVPLFELYDNVQRYGPVISTIPQQLSRFHFNMISS

SEQ ID NO: 7187 - protein, 200 aa, Cynara scolymus
  misc_feature (3)..(3): Xaa can be any naturally occurring amino acid
  misc_feature (8)..(11): Xaa can be any naturally occurring amino acid
  misc_feature (13)..(13): Xaa can be any naturally occurring amino acid
  misc_feature (17)..(17): Xaa can be any naturally occurring amino acid
  misc_feature (21)..(21): Xaa can be any naturally occurring amino acid
  misc_feature (23)..(25): Xaa can be any naturally occurring amino acid
  misc_feature (34)..(34): Xaa can be any naturally occurring amino acid
  misc_feature (44)..(44): Xaa can be any naturally occurring amino acid
MVXSSVVXXXXLXSYSXGTKXPXXXKDTSVADRXARMKLNYMKXGMRTSVEAILLVQEHNHPHILLLQIGNTFCKLPGGRLKPGENEIEGLKRKLSSKLAANSPNMQPNWQIGECVAVWWRPNFETIMYPYCPPHISKPKECKKLYVVHLSEREYFAVPKNLKLLAVPLFELYDNVQRYGPVISTIPQQLSRFQFNMIPA

SEQ ID NO: 7188 - protein, 200 aa, Raphanus sativus
  misc_feature (74)..(74): Xaa can be any naturally occurring amino acid
  misc_feature (197)..(197): Xaa can be any naturally occurring amino acid
MAMSQVVNTYPLSNYSFGTKEPKLEKDTSVADRLARMKINYMKEGMRTSVDAILLVQEHNHPHILLLQIGNTFXKLPGGRLKPGENEVEGLKRKLTSKLGGNSAGLVPDWKVGECVATWWRPNFETMMYPYCPPHITKPKECKRLYIVHLSEKEYFAVPKNLKLLAVPLFELYDNVQRYGPVISTIPQQLSRFHFNXISS

SEQ ID NO: 7189 - protein, 190 aa, Cycas rumphii
MLSAPVVNAFPLSSYTFGTKEPKMEKDTSVADRLARMKVNYMREGMRTSVEAILLVHERNHPHILLLQIGNTFCKLPGGRLKPGENEIEGLKRKLSSKLAANSTALQPDWQIGECVAVWWRPNFETLMYPYCPPHITKPKECKKLFLVHLSEREYFAVPKNLKLLAVPLFELYDNVQRYGPVISTIPQQL

SEQ ID NO: 7190 - protein, 164 aa, Ambrosia trifida
VNTYPLSGYSFGTKDPKLEKDTSVADRLARMKHNYMKEGMRTSVEGILLVQEHNHPHILLLQIGNTFCKLPGGRLKPGENEIEGLKRKLSSKLAADSTGLQPDWQIGECVAIWWRPNFETMMYPYCPPHITKPKECKKLFVVHLSEREYFAVPKKSKTSCRSIV

SEQ ID NO: 7191 - protein, 91 aa, Triticum aestivum
MLAVNSPSFPPNWQVGECVAEWWRPNFETVMYPYCPPHITKSQECKNASIVHLSEREYLAVPRHLKLLAVPLCELYDNVQRYGSEISTIPQ

SEQ ID NO: 7192 - protein, 188 aa, Trifolium pratense
SSYTFGTKEPKMEKDTSVADRLARMKVNYMKEGMRTSVEGILLVQEHNHPHILLLQIGNTFCKLPGGRLKPGENEIDGLKRKLTSKLGANSPALVPDWQIGECVAIWWRPNFETIMYPYCPPHITKPKECKKLFLVHLSEREYFAVPKNLKLLAVPLFELYDNVQRYGPVISTIPQQLSRFQFKMITN

SEQ ID NO: 7193 - protein, 177 aa, Arnica chamissonis
MEKDTSVADRLARMKLNYMKEGMRTSVDAILLVQEHNHPHILLLQIGNTFCKLPGGRLKPGENEIEGLKRKLSSKLAANSPNMQPNWQIGECVAVWWRPNFETIMYPYCPPHISKPKECKKLYVVHLSEREYFAVPKNLKLLAVPLFELYDNVQRYGPVISTIPQQLSRFQFNMIPA

SEQ ID NO: 7194 - protein, 177 aa, Vinca minor
MEKDTSVADRLARMKVNYMKEGMRTSVEGILLVQEHNHPHILLLQIGNTFCKLPGGRLKPGENEIEGLKRKLSSKLAANSPGLQPDWQIGESVAIWWRPNFETIMYPYCPPHITKPKECKKLFLVHLSEREYFAVPKNLKLLAVPLFELYDNVQRYGPVISTIPQQLSRFQFNMIHP

SEQ ID NO: 7195 - protein, 65 aa, Centaurea maculosa
MEKDTSVADRLARMKLNYMKEGMRTSVEAILLVQEHNHPHILLLQIGNTFCKLPGGHIEAWRKRN

SEQ ID NO: 7196 - protein, 200 aa, Unknown
  Sequence found in Organisms: Ceratodon purpureus, Physcomitrella patens
MVSGPVVNVYPLSSYTFGSKEAKMEKDTSVADRLARMKQNYMKEGMRTSVEGILLVQEHNHPHVLLLQIGNTFFKLPGGRLKTGENEIEGLKRKLTSKLAPTASSIQPEWQIGECAAMWWRPNFETLLYPYQPPHITKPKECKKLFVVCLSERQYFAVPKNLKLLAVPLFELYDNVQRYGPVISAIPQQLSRFNFNAINN

SEQ ID NO: 7197 - protein, 200 aa, Marchantia polymorpha
MVSGPVVNVYPLSSYTFGSKEAKMEKDTSVADRLARMKQNYMKEGMRTSVEGILLVQEHNHPHVLLLQIGNTFFKLPGGRLKTGENEIEGLKRKLTSKLAPTASSIQPDWQIGECAGVWWRPNFETLLYPYCPPHITKPKECKKLFVVPLAERQYFAVPKNLKLLAVPLFELYDNVQRYGPVISAIPQQLSRFNFNAINN

SEQ ID NO: 7198 - protein, 184 aa, Eschscholzia californica
TPPAVNVYPLSSYTFGTKEPKMEKDTSVADRLARMKLNYMKEGMRTSVEAILLVQEHNHPHILLLQIGNTFCKLPGGRLKPGENEIDGLKRKLSSKLAANSPGMQPDWQIGECVAMWWRPNFETILYPYCPPHIAKPKECKKLFLVHLSEREYFAVPKNLKLLAVPLFELYDNVQRYGPVISTI

SEQ ID NO: 7199 - protein, 177 aa, Olea europaea
MEKDTSVADRLARMKVNYMKEGMRTSVEGILLVQEHNHPHILLLQIGNTFCKLPGGRLKPGENEIEGLKRKLSSKLAANSPSLQPDWQIGECVAIWWRPNFETIMYPYCPPHITKPKECKKLFMVHLSEREYFAVPKNLKLLAVPLFELYDNVQRYGPVISTIPQQLSRFHFNMIHS

SEQ ID NO: 7200 - protein, 200 aa, Selaginella moellendorffii
MVSGPVVNVYPLSSYTFGSKEVKMEKDTSVSDRLARMKTNYMKEGMRTSVEGILLVQEHNHPHLLLLQIGNTFFKLPGGRLKTGENEVEGLKRKLTSKLAPTAASIQPDWQIGECAAIWWRPNFETLLYPYCPPHITKPKECKKLFVVLLPEKQYFAVPKNLKLLAVPLFELYDNVQRYGPVISAIPQQLSRFTFNAING

SEQ ID NO: 7201 - protein, 68 aa, Ambrosia trifida
IRIHCRGTSFGDQGPQRLEKDSSVADRLARMKHNYMKEGMRTSVVRNFVWYKSIITTYTAFANWEHFL

SEQ ID NO: 7202 - protein, 177 aa, Cedrus atlantica
MEKDTSVADRLARMKVNYMKEGIRTSVEAILLVQEHNHPHILLLQIGNTFCKLPGGRLKPGENEIEGLKRKLSSKLAANSSALQPDWQIGECVAVWWRPNFETLMYPYCPPHITKPKECKKLFLVHLSEREYFAVPKNLKLLAVPLFELYDNVQRYGPVISTIPQQLSRFTFNMVNA

SEQ ID NO: 7203 - protein, 175 aa, Pennisetum glaucum
MGSLLTRTGVLPWLQSKIVDPVMQVIRRGAEPKQLAFSAALGLTIGIFPICGTTVILGGVAVAMLGSRCNAVTVMVLNLAATPIELSLIVPFLRLGEAVTGSGHFPLTADALKNVLTGHASTEVLMSIVHAMLGWLIAAPFVLGALYIVSVPCFKILVDRFGGIPSSPRTPIKAV

SEQ ID NO: 7204 - protein, 175 aa, Panicum virgatum
MGSFLTRTGVLPWLQSKIVDPVLQVIRRGAEPKQLAFSAALGITIGIFPICGTTVILGGVAVAMLGSRCNAVTVMVLNLAATPLELSLIIPFLRLGEAITGSGHFPLTADALKNVLTGHASKDVLLSIVHAMLGWLIAAPFALGILYTVSLPCFKVLVDRFGGIPSSPRTPIKAV

SEQ ID NO: 7205 - protein, 175 aa, Panicum virgatum
MGSFFTRTGVLPWLQSKIVDPVLQVIRRGAEPKQLAFSAALGITIGIFPICGTTVILGGVAVAMLGSRCNAVTVMVLNLAATPLELSLIIPFLRLGEAITGSGHFPLTADALKNVLTGHASKDVLLSIVHAMLGWLIAAPFVLGVLYMVSLPCFKVLVDRFGGIPSSPRTPIKAV

SEQ ID NO: 7206 - protein, 175 aa, Sorghum bicolor
MGSLLARTGVLPWLQAKIVDPVLQVIRRGAEPKQLAFSAALGVTIGIFPICGTTVILGAVAVAMLGSRCNAVTVMVLNLAATPIELSLIIPFLRLGETITGSGHFPLTADALKNVLTGHASKDVLLSIVHAMLGWLIAAPFVLAVLYAVSFPCFKVLVNRFGGIPSSPRTPIKAV

SEQ ID NO: 7207 - protein, 175 aa, Zea mays
MGSLLTRTGILPWLQAKIVDPVLQVIRRGAEPKQLAFSAALGVTIGIFPICGTTVILGAVVVAMLGSRCNAVTLMVLNLAATPIELSLIVPFLRLGEAVTGSGHFPLTADALKNVLTGHASKDVLMSIVHAMLGWLIAAPIVLVVLYAVSFPCFKVLVNRFGGIPSSPRTPIKAV

SEQ ID NO: 7208 - protein, 175 aa, Cynodon dactylon
MASLLTRIGVLPWLQSKIVDPLLLVIRRGAEPKQLAFSAALGITIGIFPICGTTVILGGIAVAMLGSRCNAVTVMVLNLAATPLELSLIIPFLRLGEAVTGSGHFPLTSDALKNVLTGHASKEVLMSIVHAMLGWLIAAPFVMGALYTVSLPCFKILVDRFGGTPSSPRTPIKLV

SEQ ID NO: 7209 - protein, 173 aa, Saccharum officinarum
MGSLLTRAGAWLQAKIVDPVLQVIRRGAEPKQLAFSAALGVTIGIFPICGTTVILGAVAVAMLGSRCNAVTVMVLNLAATPIELSLIIPFLRLGETITGSGHFPLTTDALKNVLTGHASKDVLLSIVRAMLGWLIAAPFVLAVLYAVSIPCFKVLVNRFGGIPSSPRTPIKAV

SEQ ID NO: 7210 - protein, 173 aa, Sorghum bicolor
MGSLLTRTGAWLQAKIFDPVLQVIRRGAEPKELAFSAALGVTIGIFPICGTTVILGAVAVAMLGSRCNAVTVMVLNLAATPIELSLIIPFLRLGETITGSGHFALTADALKNVLTGHASKDVLLSIVRAMLGWLVAAPFVLAVLYVISFPCFKVLVNRFGGIPSSPRTPIKAV

SEQ ID NO: 7211 - protein, 59 aa, Zea mays
MGSLLTRTGVLPWLHAKIVDPMLQVIRRGAEPKQLAFSAALGITIGIFPGQLLFLVLLL

SEQ ID NO: 7212 - protein, 621 aa, Panicum virgatum
MKSSLRKLRGFALQRHEQRVDSDRGRGHSTAAVAAADELLLAAQDMADMRSCYDNLLSVAAAIANSAYEFSEALQEMGTCLIKRVTPNKDGINDKVLLLLGKSQFELRKLVDSYRVHVLNTITTPSQSLLNELQTVEVMKRQCDEKRELYEFMLNAQKERGRSKGAKGDTGASEQLKQAQEDYQEEATLFLFRLKSLKQGQFRSLFTQAARHHAAQLNLFRKGLKSLEAVEPHVRLAAEQQHIDHQFSALEEEDYFVEDENDDDYNDSHDGELSFDYGENKEVEESVNASRSHTEDFFNRTKEEYSSIPRERQRIVSQSAPLFPEKKLETEDKIKDLRRSATRKLNTYVLPTPNDVRATSQIVSGNPTSGPLDSRGAFPSPPHPSAEMGDLRDNKLHSPARLSNAQSVLKESNINTAETRKLLPVGDMALPGYYDLKTSDNKKVKRGSFSGPIASRPRSTENIDVLSAAPRHSSAHQPIHVRVSPGNSPPPISSPKIKELHELPRPPVNSSKHTAFPSLVAHSAPLVPNSASLVPKVQDHFRARQTPPSTASPLPTPPTPPGPIARSFSIPSRGMRTDSKETEEHQDKGAARMSLSSLPSTQTFLEDRQPLSAAAESVSKT

SEQ ID NO: 7213 - protein, 621 aa, Panicum virgatum
MKSSLRKLRGFALQRHEQRVDRDRGRGHSTAAVAAADELLLASQDMADMRSCYDNLLSVAAAIANSAYEFSEALQEMGTCLLKRVTPNKDGINDKVLLLLGKSQFELRKLVDSYRVHVLNTITTPSQSLLNELQTVEAMKSQCDEKRELYEFMLNAQKERGRSKGAKGDTGASEQLKQAQEDYQEEATLFLFRLKSLKQGQFRSLFTQAARHHAAQLNLFRKGLKSLEAVEPHVRLAAEQQHIDHQFSALEEEDYFVEDENDDDYNDSHDGELSFDYGENKEVEESVNASRSHTEDFFNRTKEEYSSIPRERQRIVSQSAPLFPEKKLETEDKIKDLRRSATRKLNTYVLPTPNDVRATSQIVSGNPTSGPLDSRGAFPSPPHPSAEMGDLRDNKLHSPARLSNAQSVLKESNINTAETRKLLPVGDMALPGYYDLKTSDNKKVKRGSFSGPIASRPRSTENIDVLSAAPRHSSAHQPIHVRVSPGNSPPPISSPKIKELHELPRPPVNSSKHTAFPSLVAHSAPLVPNSASLVPKVQDHFRARQTPPSTASPLPTPPTPPGPIARSFSIPSRGMRTDSKETEEHQDKGAARMSLSSLPSTQTFLEDRQPLSAAAESVSKT

SEQ ID NO: 7214 - protein, 622 aa, Panicum virgatum
MKSSLRKLRGFALQRHEQRVDRDRGRGHSTAAVAAADELLLASQDMADMRSCYDNLLSVAAAIANSAYEFSEALQEMGTCLLKRVTPNKDGINDKVLLLLGKSQFELRKLVDSYRVHVLNTITTPSQSLLNELQTVEAMKSQCDEKRELYEFMLNAQKERGRSKGAKGDTGASEQLKQAQEDYQEEATLFLFRLKSLKQGQFRSLFTQAARHHAAQLNLFRKGLKSLEAVEPHVRLAAEQQHIDHQFSALEEEDYFVEDENDDDYNDSHDGELSFDYGENKEVEESVNASRSHTEEFFNRAKEEYSSIPHERQRIVSQSAPLFPEKKLETEDKIKDLRRSAMRKLNTYVLPTPNDVRATSQIVSGNPTSGPLDSRGAFPSPPHPSAEMGDLRDNKLPSPARLSNAQSVLKESNINTAETRKLLPVGDMALPGYHDLKTSDNKKVKRGSFSGPIASRPRSTENIDVLSAAPRHSSAHQPIHVRVSPGNSPPPISSPKIKELHELPRPPVNSSKHTAFPSLVAHSAPLVPNSASLVPKVQDHFRARQTPPSTASPLPTPPGPIARSFSIPSRGMRTSSISDSKETEEHQDKGAARMSLSSLPSTQTFLEDGQLLSAAAESVSKT

SEQ ID NO: 7215 - protein, 619 aa, Sorghum bicolor
MKSSLRKLRGFALQRHEQRVDRDRGGRGHSTAAAATAADELLAAAQDMADMRSCYDNLLSVAAAIANSAYEFSEALQEMGTCLLKRVTPNKDGINDKVLLLLGKSQFELRKLVDSYRVHVLNTITTPSLSLLNELQTVEEMKRQCDEKRELYEFMLNAQKEKGRSKNAKGDNGASEQLKQAQEDYQEEATLFLFRLKSLKQGQFRSLFTQAARHHAAQLNLFRKGVKSLEAVEPHVRLAAEQQHIDHQFSALEEEDYLVEDENDDDYNDSHDGELSFDYGENKEAEESGNVSRNHTEEFFNRSKEEYSSVPHERQRIVSQSAPLFPEKKLNTEERIKDLRRSATRKLNTYVLPTPNDVRATSQIASGNPTSGPLESKGAFHSSPLHPSADNKLPSPTRLSNVQSVLKESNTNTAETRKVLPVSDLALPGYYDLKTSDNKKVKRGSFSGPIASRPRSTENIDVISAAPRHSSAHQPVHMRVSPGNSPPPISSPKIKELHELPRPPVNASKNTTFPSLVAHSAPLVPNPASLTPKVQDHFRARQTLPSTASPLPTPPPGSIARSFSIPSRGRTSGISDSKETDDQQDKGAARMSLSSLPSAETFLEDRQPLSAAAESVSKT

SEQ ID NO: 7216 - protein, 619 aa, Saccharum officinarum
MKSSLRKLRGFALQRHEQRVDRDRGGRGHSAAAAATAADELLAAAQDMADMRSCYDNLLSVAAAIANSAYEFSEALQEMGTCLLKRVTPNKDGINDKVLLLLGKSQFELRKLVDSYRVHVLNTITTPSLSLLNELQTVEEMKRQCDEKRELYEFMLNAQKEKGRSKNAKGDNGASEQLKQAQEDYQEEATLFLFRLKSLKQGQFRSLFTQAARHHAAQLNLFRKGVKSLEAVEPHVRLAAEQQHINHQFSALEEEDYLVEDDNDDDYNDSHDGELSFDYGENKEAEESDNASRNHTEEFFNRSKEEYSSVPHERQRIVSQSAPLLPEKKLNTEERIKDLRRSATRKSNTYVLPTPNDVRATSQIASGNPTSGPLESKGAFHSSPLHPSADNKLPSPTRLSNVQSVLKESNTNTAETRKVLPVGDLALPGYYDLKTSDNKKVKRGSFSGPIASRPRSTENIDVISAAPRHSSAHQPVHMRVSPGNSPPPISSPKIKELHELPRPPVNASKNTTFPSLVAHSAPLVPNPASLAPKVQDHFRARQTLPSTASPLPTPPPGSIARSFSIPSRGRASGISDSKETEDQQDKGAARMSLSSLPSAQTFLEDCQPLSAAAESVSKT

SEQ ID NO: 7217 - protein, 618 aa, Zea mays
MKSSLRKLRGFALQRQEQRVDRDRGRGHATAAATAADELLAAAQDMADMRSCYDNLLSVAAAIANSAYEFSEALQEMGTCLLKRVTPNKDGINDKVLLLLGKSQFELRKLLDSYRVHVLNTITTPSLSLLNELQTVEEMKHQCDEKKELYEFMVNTQKEKGRSKNAKGDNGASEQLKQAQEDYQEEATLFLFRLKSLKQGQFRSLFTQAARHHAAQLNLFRKGVKSLEAVEPHVRLAAEQQHIDHQFSALEEEDYLVEDENDDDYNGSHDGELSFDYGENKEVEESGNASRNHTEGFFNRSKEEYSSVPHERQRIVSQSAPLFPEKKLNTEERIKDLRRSATRKLNTYVLPTPNDVGATSQRASGNPTSEPLESKGAFHSSPLHSSADIRDLGDSNLPSPTRLSNVQSVLKDSNTNKTETRKVLPVGDLALPSYHDLKTSDNKKVKRGSFSGPIASRPRSTENIDVISAAPRHSSAHQPVHMRVSPGNSPPPISSPKIKELHELPRPPVNTSKNIAFPSLVAHSAPLAPNPASLTPKVQDHFRTKQTLQRTASPLPTPPPGSIARSFSIPSRGISDSKETEDQHKGAARMSLSSLPSAQTFLEDRQPLSSAAGSVSKT

SEQ ID NO: 7218 - protein, 618 aa, Zea mays
MKSSLRKLRGFALQRHEQRVDRDRGRGHSTTAAEELLAAAQDMTDMRSCYDNLLSVAAAIANSAYEFSEALQDMGACLLKRITPNKDGINDKVLLLLGKSQFELRKLVDSYRVHVLNTITTPSLSLLNELQTVEEMKRQCDEKRELYEFMLNAQKEKGRSKNAKGDNVASEQLKQAQEDYQEEATLFLFRLKSLKQGQFRSLFTQAARHHAAQLNLFRKGVKSLEAVEPHVRLAAEQQHIDHQFSALEEEDYVVEDENDDEYNDSHDGELSFDYGENKETEKSGIASRNHTEDFFNSSKEDYSSVPHERQRIESQSAPLFPGKKVNTEERIKDLRRSATRKLNTYVLPTPNDVRATSQIASGNPISGPLESKGAFHSSPLHPSADIRDLRDNKLPSPARLSNVQSVLKESNTNTAETRKVLPVGDLALPGYYDLKTLDNNKVKRGSFSGPIASRPRPTENNDVISAAPRHSSAHQPVHMRVSPGNSPPPISSPKIKELHELPRPPVNTSKNTTFPSLVAHSAPLVANPASLTPKVQDHFRARQMLPSTASPLPTPPPGSISRSFSIPSRGRTGSDGKEIEDQQDKGAARMSLSSLPSAQTLLEDRQPLSAAAGSVSKT

SEQ ID NO: 7219 - protein, 627 aa, Oryza sativa
MKSSLRKLRGFALQRHEQRVDRRGGHSPAAAAAANELLAASQDMADMRSCYDNLLSVAAAIANSAYEFSEALQEMGTCLLKRVTPNKDGINDKVLLLLGKAQFELRKLVDSYRVHVLNTITTPSQSLLNELQTVEEMKHQCDEKRELFEFLLNAQKEKGRSKNAKSDIGASEQLKQAQDDYQEEATLFLFRLKSLKQGQFRSLFTQAARHHAAQLNLFRKGLKSLEAVEPHVRLAAEQQHIDHQFSALDEEDYSVDEENEDDYNDSHEDLSFDYGENKEGTEAGHASRSPTEELLDRSKAEYSSFPGERQRSGSQSAPLFPEKKLEAAERIKELRRSATRKLYTYVLPTPNDVRDTSQTVTANPTSGSPLGNKGAFYSSPLQPSTNVGDLRDNKLPSPTRLSNAHSVLKESNTNTTDTRTMLVLPLGDLSLPGYHDSKASDNKKVKRGSFSGPIVPRSRSTENIDVVSVPPRHSSSHQPSIHVRVSPNTSPPLLSSPKIKELHELPRPPANASKHTTFPSLVAHSAPLVPNSAPLAPRGQDHFRPRQTPPSAPQTASPLPTPPGPISRSFSIPSRGMRTSGISDGKETEDLQDKGPARMSLSSLPSAQTSLEDHRPLSGATESVSKT

SEQ ID NO: 7220 - protein, 225 aa, Avena sativa
MKSSLRKLRGFALQRHEQRVDRHRDHSTAAKAADELLAAAQDMADMRNCYDNLLSVAAAIANSSYEFSEALQEMGTCLVKRVTPNKEGINDKVLLLLGKSQFELRKLVDSYRVHVLNTITTPSQSLLNELQTVEEMKRQCDEKRELFEYMLNAQKEKGRSKNSKGDNSASEQQLKQAQDDYQEEATLFLFLVKVIEARTVPKSFHTSCSAPCCAAKLVQKGRQVS

SEQ ID NO: 7221 - protein, 628 aa, Triticum aestivum
MKSSLRKLRGFALQRHEQRVDRHRDHSTAAKAADELLAAAQDMADMRNCYDNLLAVAAAIANSSYEFSEALQEMGTCLLKRVTPTKDGINDKVLLLLGKSQFELRKLVDSYRVHVLTTITTPSQSLLNELQTVEEMKRQCDEKRELFEVLLNAQKEKGRSKNSKGDPAASQQLKQAQEDYQEEATLFLFRLKSLKQGQFRSLFTQAARHHAAQLNLFRKGVKSLEAVEPHVRLAAEQQHIDHQFSALEDEDYSVEDENDDDYNDSHDGELSFDYGESKETAEAGHASRSPTEEFFDRSKGDYSSFPGERQRPVSQSAPLFPEKKLETAERVKELRRSATRKLHTYVLPTPNDVQATSQTVAGNPTSGSPIESKSVFHSSPLNPSTHMGDLRDNKLPSPARLSNAQSVLKESNTNTAEIRTMLPAVDPALPGYNNLKTSSDNKKVKRGSFSGPIPLRSRSTENIDAAAARHSSAHQPTIHVRVSPSSSPPPISSPRIKELHELPRPPTGASRNTAFSSLVAHSAPLVPNSAPLASRGHAGQDHFNFRARQTPPSAPQTASPLPTPPGPISRSFSIPSRGIRTGISDGKETEDHQDKGAARMSLSSLPSTQTFLEDRQPLPAAAESVSRT

SEQ ID NO: 7222 - protein, 526 aa, Pennisetum glaucum
MGTCLLKRVTPNKDGMNDKVLLLLGKSQFELRKLVDSYRVHVLNTITTPSQSLLNELQTVEVMKRQCDEKRELYEFMRNAQKEKGRSKSAKGDTGASEQLRQAQEDYQEEATLFLFRLKSLKQGQFRSLFTQAARHHAAQLNLFRKGLKSLEAVEPHVRLAAEQQHIDHQFSALEEEDYFVEDENDDEYNDSHDGRLSFDYGENKEAEESGNATRSHTEDFFNRSKEEYSSITRERQRIVSQSAPLFPEKKLETEERIKDLRRSATRKLNTYVLPTPNDVRATSQIVSGNPTSGPLDSRGPLPSPPHTSADMRDNKLPSPTRLSNAQSVLKESNTNTAETRKTLPVGDIALPGYYDLKASDNKKVKRGSFSGPIASRPQSTENIDVLSAAPRHSSAHQPIHIRVSPGNSPPPICSPKIKELHELPRPPVNTSKNTAFPSLVAHSAPLVPNSASSVPKVQDHFRARQTPPSTASPLPTPPTPPGPIARSFSIPSRGMRTSGISDSKETEEHQDKGAARMSLSSLPSA

SEQ ID NO: 7223 - protein, 628 aa, Hordeum vulgare
MKSSLRKLRGFALQRHEQRVDRHRDHSTAAKAADELLAAAQDMADMRNCYDNLLAVAAAIANSSYEFSEALQEMGTCLLKRVTPTKDGINDKVLLLLGKSQFELRKLVDSYRVHVLTTITTPSQSLLNELQTVEEMKRQCDEKRELFEVLLNAQKEKGRSKNSKGDPVASEQLKQAQEDYQEEATLFLFRLKSLKQGQFRSLFTQAARHHAAQLNLFKKGVKSLEAVEPHVRLAAEQQHIDHQFSALEDEDYSVEDENDDDYNDSHDGELSFDYGESKETAEAGHASHSPTEEFFDRNKGDYSSFPGERQRPVSQSAPLFPEKKLETAERVKELRRSATRKLHTYVLPTPNDVQATSQTIAGNPTSGSPIESKSVFHSSPLNPSTHMGALRDNKLPSPARLSNAQSVLKESNTNTAEIRTMLPAVDPALPGYNNLKTSSDNKKVKRGSFSGPIPLRSRSTENIDAAAARHSSAHQPAIHVRVSPSSSPPPISSPRIKELHELPRPPTGASRNTAFSSLVAHSAPLVPNSAPLASRGHSGQDHFNFRARQTPPSAPQTASPLPTPPGPISRSFSIPSRGIRTGISDGKETEDHQDKGAARMSLSSLPSAQTFLEDRQPLPAAAESVSRT

SEQ ID NO: 7224 - protein, 150 aa, Triticum aestivum
MKSSLRKLRGFALQRHEQRVDRHRDHSTAAKAADELLAAAQDMADMRNCYDNLLAVAAAIANSSYEFSEALQEMGTCLLKRVTPTKDGINDKVLLLLGKSQFELRKLVDSYRVHVLTTITTPSQSLLNELQTVEEMKRQCDEKRECSKSC

SEQ ID NO: 7225 - protein, 621 aa, Brachypodium distachyon
MKSSLRKLRGFALQRQEQRVDRHRDHSTAAKVAADELLAAAKDMADMRSCYDNLLAVAAAIANSSYEFSEALQEMGTCLLKRVTPNKEGINDKVLLLLGKSQFELRKLVDSYRVHVLSTITAPSQSLLNELQTVEEMKRQCDEKRELFEFMLNAQKEKGRSKNSKGDSASEQLKQAQEDYQEEATLFLFRLKSLKQGQFRSLFTQAARHHAAQLNLFRKGVKSLEAVEPHVRIAAEQQHIDHQFSALEEDCSVEDENDDDYNDSHDGELSFDYGESKEGTEAGHASRSPSEEFFDRSERQRPVSQSAPLFPEKKLEAAERVKELRRSATRKLNTYVLPTPNDVQATSHTVSGNPTSGSHVETKGAFHSSPLNQSTNMGDLRDNNKLPSPTRLSNAQSVLKESNTNTAEIKTMLPVSDLALPGYHELKTSSDNRKVKRGSFSGPIPPRSRSTENIDVISAPPRHSSAHQPTVHVRLSPSSSPPPISSPKIKELHELPRPPASASKTTAFPSLVAHSAPLVPNSAPLAHRGHLGHDHFNFRARQTPPSAPQTASPLPTPPGPIARSFSIPSRGMRTGISDGKETEDHHDKGAARMSLSSLPSAQTFLDDRQPSSAAAESVSKI

SEQ ID NO: 7226 - protein, 266 aa, Pennisetum glaucum
MASDVPMSPELEQVDGEIQDIFRALQNGFQKMDKIKDSNRQSKQLEDLTGKMRECKRLIKEFDRILKDEEKKNTPDVNKQLNDKKQFMIKELNSYVTLRKTYQSSLGNKRIELFDTGNDQVAEDTPVQMASEMSNQELISAGRRQMDQTDQAIERSKMVVAQTVEVGAQTAATLTQQTEQMKRIGNELDSVHFSLKKASQMVKEIGRQVATDKCIMAFLFLIVCGVIAIIVVKIVNPHNKNIRDIPGLAPPAMNRKLLSIDPFGGL

SEQ ID NO: 7227 - protein, 266 aa, Cenchrus ciliaris
MATDVPMSPELEQVDGEIQDIFRALQNGFQKMDKIKDSNRQSKQLEDLTGKMRECKRLIKEFDRIFKDEEKKNPPDVNKQLNDKKQFMIKELNSYVTLRKTYQSSLGNKRIELFDTGNDQVAEDTPVQMASEMSNQELISAGRKQMDQTDQAIERSKMVVAQTVEVGAQTAATLTQQTEQMKRIGNELDSVHFSLKKASQMVKEIGRQVATDKCIMAFLFLIVCGVIAIIVVKVVNPHNKSIRDIPGLAPPAMNRKLLSIDPFGGL

SEQ ID NO: 7228 - protein, 266 aa, Panicum virgatum
MASDVPMSPELEQVDGEIQDIFRALQNGFQKMDKIKDSNRQSKQLEDLTGKMRECKRLIKEFDRILKDEEKNNPPDVNKQLNDKKQFMIKELNSYVTLRKTYQSSLGNKRIELFDTGNDQVAEDTPAQMASEMSNQELISAGRKQMDQTDQAIERSKMVVAQTVEVGAQTAASLAQQTEQMKRIGNELDSVHFSLKKASQMVKEIGRQVATDKCIMAFLFLIVCGVIAIIVVKIVNPHNKSIRDIPGLAPPAMNRKLLSIDPFGGL

SEQ ID NO: 7229 - protein, 266 aa, Panicum virgatum
MASDVPMSPELEQVDGQIQDIFRALQNGFQKMDKIKDSNRQSKQLEDLTGKMRECKRLIKEFDRILKDEEKNNPPDVNKQLNDKKQFMIKELNSYVTLRKTYQSSLGNKRIELFDTGNDQVAEDTPAQMASEMSNQELISAGRKQMDQTDQAIERSKMVVAQTVEVGAQTAANLAQQTEQMKRIGNELDSVHFSLKKASQMVKEIGRQVATDKCIMAFLFLIVCGVIAIIVVKIVNPHNKSIRDIPGLAPPAMNRKLLSIDPFGGL

SEQ ID NO: 7230 - protein, 266 aa, Saccharum officinarum
MASDVPMSPELEQVDGEIQDIFRALQNGFQKMDKIKDSSRQSKQLEDLTAKMRECKRLIKEFDRILKDEEKKNTPDVNKQLNDKKQFMIKELNSYVTLRKTYQSSLGNKRIELFDTGNDQVADETPVQMASEMSNQELISAGRKQMDQTDQAIERSKMVVAQTVEVGAQTAATLSQQTEQMKRIGNELDSVHFSLKKASQMVKEIGRQVATDKCIMAFLFLIVCGVIAIIVVKIVNPHNKNIRDIPGLAPPAMNRKLLSIDAFGGL

SEQ ID NO: 7231 - protein, 265 aa, Zea mays
MSTDVPMSPELEQVDGEIQDIFRALQNGFQKMDKIKDSSRQSKQLEDLTAKMRECKRLIKEFDRILKDEEKKNTPDVNKQLNDKKQFMIKELNSYVTLRKTYQSSLGNKRIELFDTGNDQVAEGTPVQMASEMSNQELISTGRKQMDQTDQAIERSKMVVAQTVEVGAQTAATLTQQTEQMKRIGNELDSVHFSLKKASQMVKEIGRQVATDKCIMAFLFLIVCGVIAIIVVKIVNPHNKNIRDIPGLAPPAMNRKLLSIDAAGL

SEQ ID NO: 7232 - protein, 269 aa, Sorghum bicolor
MGSDVPMSPELEQVDGEIQDIFRALQNGFQKMDKIKDSSRQSKQLEDLTAKMRECKRLIKEFDRILKDEEKKNTPDVNKQLNDKKQFMIKELNSYVTLRKTYQSSLGNKRIELFDTGNDQVADETPVQMASEMSNQELISAGRKQMDQTDQAIERSKMVVAQTVEVGAQTAATLSQQTDQMKRIGNELDSVHFSLKKASQMVKEIGRQVATDKCIMAFLFLIVCGVIAIIVVKIVNPHNKNIRDIPGLAPPAMNRKLLSVDAFGGLRAL

SEQ ID NO: 7233 - protein, 265 aa, Cynodon dactylon
MASDVPMSPELERVDGEIQDIFRALQNGFQKIDKIKDSNRQSKQLEDLTAKMRECKRLIKEFDRILKEEEKKNPPDVNKQLNEKKQFMIKELNSYVTLRKTYQSSLGNKRIELFDTGNDQVAEDTVQMASEMSNQELIHAGRKQMDQTDQAIERSKMVVAQTVEVGAQTAANLTQQTEQMKRIGNELDSVHFSLKKASQMVKEIGRQVATDKCIMAFLFLIVCGVIAIIVVKIVNPHNKNIPDIPGLAPPAMNRRLLSIEAFGGR

SEQ ID NO: 7234 - protein, 265 aa, Zea mays
MASDVPMSPELEQVDGEIQDIFRALQNGFQKMDKIKDSSRQSKQLEDLTAKMRECKRLIKEFDRILKDEEKKDTPEANKQLNDKKQFMIKELNSYVTLRKTYQSSLGNKRIELFDTGTDQVADKSPVQMASEMSNQELISAGRKQMDQTDQAIERSKMVVAQTVEVGAQTAATLSQQTEQMKRIGNELDSVHFSLKKASQMVKEIGRQVATDKCIMAFLFLIVCGVIAIIVVKIVNPHNKNIRDIPGLAPPAMNRRLLSIDALGL

SEQ ID NO: 7235 - protein, 266 aa, Oryza sativa
MASDVPMSPELEQVDGEIQDIFRALQNGFQKMDKIKDSNRQSKQLEDLTGKMRECKRLIKEFDRILKEDEKKNSADVNKQLNDKKQLMIKELNSYVTLRKTYQSSLGNKRIELFDTGNDQVAEDNTVQMASEMSNQQLMDAGRKQMDQTDQVIERSKKVVAQTVEVGSQTAAALSQQTEQMKRIGNELDSVHFSLKKASQMVKEIGRQVATDKCIMAFLFLIVCGVIAIIVVKIVNPHNKNIRDIPGLAPPAQNRKLLSIESFGSL

SEQ ID NO: 7236 - protein, 269 aa, Pseudoroegneria spicata
MAASDVPMSPELEQVDGEIQDIFRVLQNGFQKIDKIKDSNRQSKQLEELTGKMRECKRLIKEFDRVLKDEEKRNTSEVNKQLNDKKQFMIKELNSYVTLRKTYQSSLGNKRIELFDAGNDQVAEDNVQMASEMSNQQLIDSGMKQMDQTDQAIERSKMVVAQTVEVGAQTATTLTQQTDQMKRIGNELDSVHFSLKKASQMVKEIGRQVATDKCIMAFLFLIVCGVIAIIVVKIVNPHNKSIPDIPGLAPPAPPAQNRKLLSVDPFRML

SEQ ID NO: 7237 - protein, 269 aa, Hordeum vulgare
MAASDVPMSPELEQIDGEIQDIFRALQNGFQKIDKIKDSNRQSKQLEELTGKMRECKRLIKEFDRVLKDEEKRNTSEVNKQLNDKKQFMIKELNSYVTLRKTYQSSLGNKRIELFDAGNDQVAEDNVQMASEMSNQQLIDSGVRQMDQTDQAIERSKMVVAQTVEVGAQTATTLTQQTDQMKRIGNELDSVHFSLKKASQMVKEIGRQVATDKCIMAFLFLIVCGVIAIIVVKIVNPHNKSIPDIPGLAPPAPPAQNRKLLSIDAFRML

SEQ ID NO: 7238 - protein, 269 aa, Festuca arundinacea
MAASDVPMSPELEQVDGEIQDIFRALQNGFQKIDKIKDSNRQSKQLEELTGKMRECKRLIKEFDRVLKDEEKRNTSEVNKQLNDKKQFMIKELNSYVTLRKTYQSSLGNKRIELFDAGNDHVAEDNVQMASEMSNQQLIDSGMKQMDQTDQAIERSKMVVAQTVEVGAQTATTLTQQTDQMKRIGNELDSVHFSLKKASQMVKEIGRQVATDKCIMAFLFLIVCGVIAIIVVKIVNPHNKNIPDIPGLAPPAPPAQNRKLLSIDSFRML

SEQ ID NO: 7239 - protein, 269 aa, Avena sativa
MAASDVPMSPELEQVDGEIQDIFRALQNGFQKIDKIKDSNRQSKQLEELTGKMRECKRLIKEFDRVLKDEEKRNTAEVNKQLNDKKQFMIKELNSYVTLRKTYQSSLGNKRIELFDAGNDHVAEDNVQMASAMSNQQLIDSGTKQMDQTDQAIERSKMVVAQTVEVGAQTATTLTQQTDQMKRIGNELDSVHFSLKKASQMVKEIGRQVATDKCIMAFLFLIVCGVIAIIVVKIVNPHNKNIPDIPGLAPPAPPAQNRKLLSIDTFRML

SEQ ID NO: 7240 - protein, 269 aa, Secale cereale
MAASDVPMSPELEQVDGEIQDIFRALQNGFQKIDKIKDSNRQSKQLEELTGRMRECKRLIKEFDRVLKDEEKRNTSEVNKQLNDKKQLMIKELNSYVTLRKTYQSNLGNKRIELFDAGNDQVAEDNVQMASEMSNQQLIDSGTKQMDQTDQAIERSKMVVAQTVEVGAQTATTLTQQTDQMKRIGNELDSVHFSLKKASQMVKEIGRQVATDKCIMAFLFLIVCGVIAIIVVKIVNPHNKSIPDIPGLAPPAPPAQNRKLLSVDPFRML

SEQ ID NO: 7241 - protein, 269 aa, Triticum aestivum
MAASDVPMSPELEQIDGEIQDIFRALHNGFQKIDKIKDSNRQSKQLEELTGKMRECKRLIKEFDRVLKDEEKRNTSEVNKQLNDKKQFMIKELNSYVTMRKTYQSSLGNKRIELFDAGNDQVAEDNVQMASEMSNQQLIDSGMKQMDQTDQAIERSKMVVAQTVEVGAQTATTLTQQTDQMKRIGNELDSVHFSLKKASQMVKEIGRQVATDKCIMGFLFLIVCGVIAIIVVKIVNPHNKSIPDIPGLAPPAPPVQNRKLLSVDPFRML

SEQ ID NO: 7242 - protein, 269 aa, Leymus cinereus x Leymus triticoides
  misc_feature (33)..(33): Xaa can be any naturally occurring amino acid
  misc_feature (78)..(78): Xaa can be any naturally occurring amino acid
  misc_feature (251)..(251): Xaa can be any naturally occurring amino acid
  misc_feature (257)..(257): Xaa can be any naturally occurring amino acid
  misc_feature (263)..(263): Xaa can be any naturally occurring amino acid
  misc_feature (265)..(266): Xaa can be any naturally occurring amino acid
MAASDVPMSPELEQVDGEIQDIFRALQNGFQKXDKIKDSNRQSKQLEELTGKMRECKRLIKEFDRVLKDEEKRNTSEXNKQLNDKKQFMIKELNSYVTLRKTYQSSLGNKRIELFDAGNDQVAEDNVQMASEMSNQQLIDSGMKQMDQTDQAIERSKMVVAQTVEVGAQTATTLTQQTDQMKRIGNELDSVHFSLKKASQMVKEIGRQVATDKCIMAFLFLIVCGVIAIIVVKIVNPHNKSIPDIPGLAPXAPPAQXRKLLSXDXXRML

SEQ ID NO: 7243 - protein, 269 aa, Secale cereale
MAASDVPMSPELEQVDGEIQDIFRALQNGFQKIDKIKDSNRQSKQLEELTGRMRECKRLIKEFDRVLKDEEKRNTSEVNKQLNDKKQLMIKELNSYVTLRKTYQSNLGNKRIELFDAGNDQVAEDNVQMASEMSNQQLIDSGTKQMDQTDQAIERSKMVVAQTVEVGAQTATALTQQTDQMKRIGNELDSVHFSLKKASQMVKEIGRQVATDKCIMAFLFLIVCGVIAIIVVKIVNPHNKSIPDIPGLAPPAPPAQNRKLLSVDPFRML

SEQ ID NO: 7244 - protein, 269 aa, Triticum aestivum
MAASDVPMSPELEQVDGEIQDIFRALHNGFQKIDKMKDSNRQSKQLEELTGKMRECKRLIKEFDRVLKDEEKRNTSEVNKQLNDKKQFMIKELNSYVTMRKTYQSSLGNKRIELFDAGNDQVAEDNVQMASEMSNQQLIDSGMKQMDQTDQAIERSKMVVAQTVEVGAQTATTLTQQTDQMKRIGNELDSVHFSLKKASQMVKEIGRQVATDKCIMGFLFLIVCGVIAIIVVKIVNPHNKSIPDIPGLAPPAPPAQNRKLLSVDPFRML

SEQ ID NO: 7245 - protein, 269 aa, Triticum aestivum
MAASDVPMSPELEQVDGEIQDIFRALHNGFQKIDKMKDSNRQSKQLEELTGKMRECKRLIKEFDRVLKDEEKSNTSEVNKQLNDKKQFMIKELNSYVTMRKTYQSSLGNKRIELFDAGNDQVAEDNVQMASEMSNQQLIDSGMKQMDQTDQAIERSKMVVAQTVDVGAQTATTLTQQTDQMKRIGNELDSVHFSLKKASQMVKEIGRQVATDKCIMGFLFLIVCGVIAIIVVKIVNPHNKSIPDIPGLAPPAPPAQNRKLLSVDPFRML

SEQ ID NO: 7246 - protein, 267 aa, Brachypodium distachyon
MAASDVPMSPELEQVDGEIQDIFRALQNGFQKIDKIKDSNRQSKQLEELTGKMRECKRLIKEFDRVLKVEEKKSTSEVNKQLNDKKQFMIKELNSYVTLRKTYQSSLGNKRIELFDTGNDDQLAGVNVQMASEMSNQQLIDSGMKQMDETDQALERSKMVVKQTVEVGAQTAATLTQQTDQIKRIGNELDSVHFSLKKASQMVKEIGRQVATDKCIMAFLFLIVCGVIAIIVVKVVNPHNKNIPDIPGLAPPAQNRKLLSIEAYRML

SEQ ID NO: 7247 - protein, 251 aa, Secale cereale
IQDIFRALQNGFQKIDKIKDSNRQSKQLEELTGRMRECKRLIKEFDRVLKDEEKRNTSEVNKQLNDKKQLMIKELNSYVTLRKTYQSNLGNKRIELFDAGNDQVAEDNVQMASEMSNQQLIDSGTKQMDQTDQAIERSKMVVAQTVEVGAQTATTLTQQTDQMKRIGNELDSVHFSLKKASQMVKEIGRQVATDKCIMAFLFLIVCGVIAIIVVKIVNPHNKSIPDIPGLAPPAPPAQNRKLLSVDPFRML

SEQ ID NO: 7248 - protein, 275 aa, Setaria italica
MATDLPMSPELEQIDGEIHDIFRVLQNGFQKMDKIKDSNRQAKQLEDLTGKMKECKRLIKEFDRVLKDEESNNPPEINKQLNDRKQFMIKELNSYVTLRKTYQSSLGNTNKRVELFDMGAGSSEPAAEDNIQMASAMTNQQLIDAGRNQMDQTDQAIERSKMVVAQTVETGAQTAATLTQQTEQMKRIGNELDSVHFSLKKASQLVKEIGRQVATDKCIMAFLFLIVLGVIAIIVVKIVHPNNKNIRDIPGLAPPAQNYQIHNRRLLWAEDFIGL

SEQ ID NO: 7249 - protein, 277 aa, Pennisetum glaucum
MATDLPMSPELEQIDGEIHDIFRALQNGFQKMDKIKDSNRQAKQLEDLTGKMKECKRLIKEFDRILKDEESNNPPEINKQLNDRKQFMIKELNSYVTLRKTYQSSLGNNNKRVELFDMGAGSSEPAAEDNIQMASAMTNQQLIAAGRDQMDQTDQAIERSKMVVAQTVETGAQTAATLTQQTEQMKRIGNELDSVHFSLKKASQLVKEIGRQVATDKCIMAFLFLIVVGVIAIIVVKIVHPNNKNIRDIPGLAPPAQNYQIHSRRLLWAEAFVGLMN

SEQ ID NO: 7250 - protein, 273 aa, Pseudoroegneria spicata
MASDVPMTPELEQIDGEIQDIFRALQNGFQKMDKIKDSNRQAKQLEDLTGKMKECKRLIKEFDRILKDEESKNPPEVNKQLNDRKQYMIKELNSYVTLRKTYQSSLGNNKRVELFDMGATSSEPAADDNIQMASAMTNQQLIDSGRNQMDQTDEAIARSKMVVAQTVEVGSQTATTLTQQTEQMKRIGNELDSVHFSLKKASQLVKEIGRQVATDKCIMGLLALIVFGVIAIIVVKIVNPHNKNIPDIPGMAPPAQNFQTNRRLLSAKAFRGL

SEQ ID NO: 7251 - protein, 275 aa, Panicum virgatum
MATDLPMSPELEQIDGEIHDIFRALQNGFQKMDKIKDSNRQAKQLEDLTGKMKECKRLIKEFDRILKDEESNNPPEIHKQLNDRKQFMIKELNSYVTLRKTYQSSLGNNNKRVELFDMGAASSEPVAEDNIQMASAMTNQQLIDVGRNQMDQTDQAIERSKMVVAQTVETGTQTAATLTQQTEQMKRIGNELDSVHFSLKKASQLVKEIGRQVATDKCIMAFLFLIVLGVIAIIVVKIVHPNNKNIRDIPGLAPPAQNYQINNRRLLWTEAFIGV

SEQ ID NO: 7252 - protein, 275 aa, Panicum virgatum
MATDLPMSPELEQIDGEIHDIFRALQNGFQKMDKIKDSNRQAKQLEDLTGKMKECKRLIKEFDRILKDEESNNPPEIHKQLNDRKQFMIKELNSYVTLRKTYQSSLGNNNKRVELFDMGAASSEPAAEDNIQMASAMTNQQLIDVGRNQMDQTDQAIERSKMVVAQTVETGAQTAATLTQQTEQMKRIGNELDSVHFSLKKASQLVKEIGRQVATDKCIMAFLFLIVLGVIAIIVVKIVHPNNKNIRDIPGLAPPAQNYQINNRRLLWTEAFIGV

SEQ ID NO: 7253 - protein, 722 aa, Panicum virgatum
MGTERKRKVSLFDVVDETSVSAKLGRGATNGAAAAVGGANPTVNRWNGRPYSARYFEILEKRRTLPVWQQKEEFLRALRDNQALILVGETGSGKTTQIPQFVLETEGLGNRSMVACTQPRRVAAMSVSRRVAEEMDVTIGEEVGYSIRFEDCSSHKTVLKYLTDGMLLREAMADPLLEKYKVIVLDEAHERTLATDVLFGLLKEVLKNRPDLKLVVMSATLEAEKFQGYFSGAPLMKVPGRLHPVEIFYTQEPERDYLEAAIRTVVQIHMCEPAGDILVFLTGEEEIEDACRKINKEINNMGDQVGPVKVVPLYSTLPPAMQQKIFEPAPAPLKEGGPPGRKIVVSTNIAETSLTIDGIVYVIDPGFSKQKVYNPRIRVESLLVSPISKASAHQRAGRAGRTQPGKCFRLYTEKSFNEDLQPQTYPEILRSNLANTVLTLKKLGIDDLVHFDFMDPPAPETLMRALEVLNYLGALDDDGNLTQLGEMMSEFPLDPQMSKMLVISPKYNCSNEILSISAMLSVPNCFLRPREAQKAADEAKARFGHIDGDHLTLLNVYHAYKQNNEDPQWCYENFINARALKSADNVRQQLVRIMTRFNLKMCSTDFNSREYYVNIRKALLAGYFMQVAHLERTGHYLTVKDNQVVHLHPSNCMDHKPEWVIYNEYVLTTRNFIRTVTDIRGEWLIDIAPHYYDLSNFPSCEAKRVLERLYNKRERERATNRG

SEQ ID NO: 7254 - protein, 722 aa, Panicum virgatum
MGTERKRKVSLFDVVDETSISAKLGRGATNGAAAAAGGANPTVNRWNGRPYSARYFEILEKRRTLPVWQQKEEFLRALRDKQTLILVGETGSGKTTQIPQFVLETEGLGNRSMVACTQPRRVAAMSVSRRVAEEMDVTIGEEVGYSIRFEDCSSHKTVLKYLTDGMLLREAMADPLLEKYKVIVLDEAHERTLATDVLFGLLKEVLKNRPDLKLVVMSATLEAEKFQGYFSGAPLMKVPGRLHPVEIFYTQEPERDYLEAAIRTVVQIHMCEPAGDILVFLTGEEEIEDACRKINKEINNMGDQVGPVKVVPLYSTLPPAMQQKIFEPAPAPLKEGGPPGRKIVVSTNIAETSLTIDGIVYVIDPGFSKQKVYNPRIRVESLLVSPISKASAHQRAGRAGRTQPGKCFRLYTEKSFNEDLQPQTYPEILRSNLANTVLTLKKLGIDDLVHFDFMDPPAPETLMRALEVLNYLGALDDDGNLTQLGEMMSEFPLDPQMSKMLAISPKYNCSNEILSISAMLSVPNCFLRPREAQKAADEAKARFGHIDGDHLTLLNVYHAYKQNNEDPQWCYENFINARALKSADNVRQQLVRIMTRFNLKMCSTDFNSREYYVNIRKALLAGYFMQVAHLERTGHYLTVKDNQVVHLHPSNCMDHKPEWVIYNEYVLTTRNFIRTVTDIRGEWLIDIAPHYYDLSNFPSCEAKRVLERLYNKRERERATNRG

SEQ ID NO: 7255 - protein, 722 aa, Panicum virgatum
MGTERKRKVSLFDVVDETSISAKLGRGATNGATAAVGGANPTVNRWNGRPYSARYFEILEKRHTLPVWQQKEEFLRALRDNQTLILVGETGSGKTTQIPQFVLETEGLGNRSMVACTQPRRVAAMSVSRRVAEEMDVTIGEEVGYSIRFEDCSSHKTVLKYLTDGMLLREAMADPLLEKYKVIVLDEAHERTLATDVLFGLLKEVLKNRPDLKLVVMSATLEAEKFQGYFSGAPLMKVPGRLHPVEIFYTQEPERDYLEAAIRTVVQIHMCEPAGDILVFLTGEEEIEDACRKINKEINNMGDQVGPVKVVPLYSTLPPAMQQKIFEPAPAPLKEGGPPGRKIVVSTNIAETSLTIDGIVYVIDPGFSKQKVYNPRIRVESLLVSPISKASAHQRAGRAGRTQPGKCFRLYTEKSFNEDLQPQTYPEILRSNLANTVLTLKKLGIDDLVHFDFMDPPAPETLMRALEVLNYLGALDDDGNLTQLGEMMSEFPLDPQMSKMLVISPKYNCSNEILSISAMLSVPNCFLRPREAQKAADEAKARFGHIDGDHLTLLNVYHAYKQNNEDPQWCYENFINARALKSADNVRQQLVRIMTRFNLKMCSTDFNSREYYVNIRKALLAGYFMQVAHLERTGHYLTVKDNQVVHLHPSNCMDHKPEWVIYNEYVLTTRNFIRTVTDIRGEWLIDIAPHYYDLSNFPSCEAKRVLERLYNKRERERATNRG

SEQ ID NO: 7256 - protein, 550 aa, Sorghum bicolor
MGTERKRKVSLFDVVDETSVSAKLGRAASNGAAATAAGGNPSVNRWNGRPYTARYFEILEKRRTLPVWQQKEEFLRSLRDNQTLILVGETGSGKTTQIPQFVLEAEGLSNRSMVACTQPRRVAAMSVSRRVAEEMDVTIGEEVGYSIRFEDCSSHKTVLKYLTDGMLLREAMADPLLEKYKVIVLDEAHERTLATDVLFGLLKEVLKNRPDLKLVVMSATLEAEKFQGYFSGAPLMKVPGRLHPVEIFYTQEPERDYLEAAIRTVVQIHMCEPAGDILVFLTGEEEIEDACRKINKEINNMGDQVGTVKVVPLYSTLPPAMQQKIFEPAPAPLKEGGPPGRKIVVSTNIAETSLTIDGIVYVIDPGFSKQKVYNPRIRVESLLVSPISKASAHQRAGRAGRTQPGKCFRLYTEKSFNEDLQPQTYPEILRSNLANTVLTLKKLGIDDLVHFDFMDPPAPETLMRALEVLNYLGALDDEGNLTQLGEMMSEFPLDPQMSKMLVISPKYNCSNEILSISAMLSVPIASSGLGRLKRLLMRRRLDLAILMGTI

SEQ ID NO: 7257 - protein, 722 aa, Zea mays
MGTERKRKVSLFDVVDETSVSGKLGRAASNGAAATAAGTNPSVNRWNGRPYTARYFEILEKRRTLPVWQQKEEFLRRLRDNQTLILVGETGSGKTTQIPQFVLETEGLGNRSMVACTQPRRVAAMSVSRRVAEEMDVTIGEEVGYSIRFEDCSSHKTVLKYLTDGMLLREAMADPLLEKYKVIVLDEAHERTLATDVLFGLLKEVLKNRPDLKLVVMSATLEAEKFQGYFSDAPLMKVPGRLHPVEIFYTQEPERDYLEAAIRTVVQIHMCEPAGDILVFLTGEEEIEDACRKINKEINNMGDQVGPVKVVPLYSTLPPAMQQKIFEPAPAPLKERGPPGRKIVVSTNIAETSLTIDGIVYVIDPGFSKQKVYNPRIRVESLLVSPISKASAHQRAGRAGRTQPGKCFRLYTEKSFNEDLQPQTYPEILRSNLANTVLTLKKLGIDDLVHFDFMDPPAPETLMRALEVLNYLAALDDEGNLTQLGEMMSEFPLDPQMSKMLVISPKYNCSNEILSISAMLSAPNCFLRPREAQKAADEAKARFGHIDGDHLTLLNVYHAYKQNNEDPQWCYENFINSRALKSADNVRQQLVRIMTRFNLKMCSTDFNSREYYVNIRKTLLAGYFMQVAHLERTGHYLTVKDNQVVHLHPSNCMDHKPEWVIYNEYVLTTRNFIRTVTDIRGEWLIDIAPHYYDLSNFPSCEAKRVLERLYNKRERERAANRG

SEQ ID NO: 7258 - protein, 721 aa, Zea mays
MGTERKRKVSLFDVVDETSVSAKLRAASNGAAATATGGNPSVNRWNGRPYTARYFDILEKRRTLPVWQQKEEFLRSLRDNQTLILVGETGSGKTTQIPQFVLETEGLGNRSMVACTQPRRVAAMSVSRRVAEEMDVTIGEEVGYSIRFEDCSSHKTVLKYLTDGMLLREAMADPLLEKYKVIVLDEAHERTLATDVLFGLLKEVLKNRPDLKLVVMSATLEAEKFQGYFNGAPLMKVPGRLHPVEIFYTQEPERDYLEAAIRTVMQIHMCEPAGDILVFLTGEEEIEDACRKINKETNNMGDQVGPVKVVPLYSTLPPAMQQKIFEPAPAPLKEGGPPGRKIVVSTNIAETSLTIDGIVYVIDPGFSKQKVYNPRIRVESLLVSPISKASAHQRAGRAGRTQPGKCFRLYTEKSFNEDLQPQTYPEILRSNLANTVLTLKKLGIDDLVHFDFMDPPAPETLMRALEVLNYLGALDDEGNLTQLGEMMSEFPLDPQMSKMLVISPKYNCSNEILSVSAMLSAPNCFLRPRDAQKAADEAKARFGHIDGDHLTLLNVYHAYKQNNEDPQWCYENFVNSRALKSADNVRQQLVRIMTRFNLKMCSTDFNSREYYVNIRKAMLAGYFMQVAHLERTGHYLTVKDNQVVHLHPSNCMDHKPEWVIYNEYVLTTRNFIRTVTDIRGDWLIDIAPHYYDLSNFPSCEAKRVLERLYNKRERERAANRG

SEQ ID NO: 7259 - protein, 721 aa, Unknown
  Sequence found in Organisms: Secale cereale, Triticum aestivum
MGTERKRKVSLFDVVDETSVSAKLGRAGINGAAAAAAANPSINRWNGRPYSARYLEILEKRRTLPVWQQKDEFLRVLRDNQTLILVGETGSGKTTQIPQFVLEAEGLSNRSMVACTQPRRVAAMSVSRRVAEEMDVTIGEEVGYSIRFEDCSSHKTVLKYLTDGMLLREAMADPLLERYKVIVLDEAHERTLATDVLFGLLKEVLKNRPDLKLVVMSATLEAEKFQGYFSGAPLMKVPGRLHPVEIFYTQEPERDYLEAAIRTVVQIHMCEPAGDILVFLTGEEEIEDACRKINKEVNNMGDQVGPVKVVPLYSTLPPAMQQKIFDPAPPPLKEGGPAGRKIVVSTNIAETSLTIDGIVYVIDPGFSKQKVYNPRIRVESLLVSPISKASAHQRAGRAGRTQPGKCFRLYTEKSFNGDLQPQTYPEILRSNLANTVLTLKKLGIDDLVHFDFMDPPAPETLMRALEVLNYLGALDDEGNLTSLGEMMSEFPLDPQMSKMLVISPRYNCSNEILSISAMLSVPNCFLRPREAQKAADEAKARFGHIDGDHLTLLNVYHAYKQNNEDPTWCYENFVNARAMKSADNVRQQLVRIMTRFNLKMCSTDFNSREYYVNIRKAMLSGYFMQVAHLERTGHYLTVKDNQVVHLHPSNCMDHKPEWVIYNEYVLTTRNFIRTVTDIRGEWLIDIAPQYYDLTNFPSCEAKRVLERLHNKRERERAASRN

SEQ ID NO: 7260 - protein, 719 aa, Triticum aestivum
MGTERKRKVSLFDVVDETSVSAKLGRAGINGAAAAANPSINRWNGRPYSARYLEILEKRRTLPVWQQKDEFLRVLRDNQTLILVGETGSGKTTQIPQFVLEAEGLSNRSMVACTQPRRVAAMSVSRRVAEEMDVTIGEEVGYSIRFEDCSSHKTVLKYLTDGMLLREAMADPLLERYKVIVLDEAHERTLATDVLFGLLKEVLKNRPDLKLVVMSATLEAEKFQGYFSGAPLMKVPGRLHPVEIFYTQEPERDYLEAAIRTVVQIHMCEPAGDILVFLTGEEEIEDACRKINKEVNNMGDQVGPVKVVPLYSTLPPAMQQKIFDPAPPPLKEGGPAGRKIVVSTNIAETSLTIDGIVYVIDPGFSKQKVYNPRIRVESLLVSPISKASAHQRAGRAGRTQPGKCFRLYTEKSFNGDLQPQTYPEILRSNLANTVLTLKKLGIDDLVHFDFMDPPAPETLMRALEVLNYLGALDDEGNLTSLGEMMSEFPLDPQMSKMLVISPRYNCSNEILSISAMLSVPNCFLRPREAQKAADEAKARFGHIDGDHLTLLNVYHAYKQNNEDPTWCYENFVNARAMKSADNVRQQLVRIMTRFNLKMCSTDFNSREYYVNIRKAMLSGYFMQVAHLERTGHYLTVKDNQVVHLHPSNCMDHKPEWVIYNEYVLTTRNFIRTVTDIRGEWLIDIAPQYYDLTNFPSCEAKRVLERLHNKRERERAASRN

SEQ ID NO: 7261 - protein, 719 aa, Brachypodium distachyon
MGTERKRKVSLFDVVDETSVSAKLGRAGVNGAAAAANPSINKWNGRPYSARYLEILEKRRTLPVWQQKEEFLRALRDNQTLILVGETGSGKTTQIPQFVLEAEGLSNRSMVACTQPRRVAAMSVSRRVAEEMDVTIGEEVGYSIRFEDCSSHKTVLKYLTDGMLLREAMADPLLERYKVIVLDEAHERTLATDVLFGLLKEVLKNRPDLKLVVMSATLEAEKFQGYFSSAPLMKVPGRLHPVEIFYTQEPERDYLEAAIRTVVQIHMCEPAGDILVFLTGEEEIEDACRKINKEVNNMGDQVGPVKVVPLYSTLPPAMQQKIFEPAPAPLKEGGPPGRKIVVSTNIAETSLTIDGIVYVIDPGFSKQKVYNPRIRVESLLVSPISKASAHQRAGRAGRTQPGKCFRLYTEKSFNDDLHPQTYPEILRSNLANTVLTLKKLGIDDLVHFDFMDPPAPETLMRALEVLNYLGALDDEGNLTSLGEMMSEFPLDPQMSKMLVISPRYNCSNEILSISAMLSVPNCFLRPREAQKAADEAKARFGHIDGDHLTLLNVYHAYKQNNEDPTWCYENFVNARAMKNADNVRQQLVRIMTRFNLRMCSTDFNSREYYVNIRKAMLSGYFMQVAHLERTGHYLTVKDNQVVHLHPSNCMDHKPEWVIYNEYVLTTRNFIRTVTDIRGEWLIDIAPQYYDLTNFPTCEAKRVLERLHNKRERERAASRN

SEQ ID NO: 7262 - protein, 720 aa, Festuca arundinacea
MGTERKRKVSLFDVVDQTSVSAKLGRAGINGAAAAAANPSINPWNGRPYSARYFEILEKRRTLPVWQQKDDFLRVLRDNQTLILVGETGSGKTTQIPQFVLEAEGLSNRSMVACTQPRRVAAMSVSRRVAEEMDVTIGEEVGYSIRFEDCSSHKTVLKYLTDGMLLREAMADPLLERYKVIVLDEAHERTLATDVLFGLLKEVLKNRPDLKLVVMSATLEAEKFQSYFSSAPLMKVPGRLHPVEIFYTQEPERDYLEAAIRTVVQIHMCEPPGDILVFLTGEEEIEDACRKINKEVNNMGDQVGPVKVVPLYSTLPPAMQQKIFDAAPPPLREGGPAGRKIVVSTNIAETSLTIDGIVYVIDPGFSKQKVYNPRIRVESLLVSPISKASAHQRAGRAGRTQPGKCFRLYTEKSFSDDLQEQTYPEILRSNLANTVLTLKKLGIDDLVHFDFMDPPAPETLMRALEVLNYLGALDDEGNLTPLGEMMSEFPLDPQMSKMLVISPKYNCSNEILSVSAMLSVPNCFLRPREAQKAADEAKARFGHIDGDHLTLLNVYHAYKQNNEDPTWCYENFVNARAMKSADNVRQQLVRIMTRFNLKMCSTDFNSREYYVNIRKAMLSGYFMQVAHLERTGHYLTVKDNQVVHLHPSNCMDHKPEWVIYNEYVLTTRNFIRTVTDIRGEWLVDIAPQYYDLTNFPSCEAKRVLERLHNKRERERAANRS

SEQ ID NO: 7263 - protein, 695 aa, Triticum aestivum
AGINGAAAAAAANPSINRWNGRPYSARYLEILEKRRTLPVWQQKDEFLRVLRDNQTLILVGETGSGKTTQIPQFVLEADGLSNRSMVACTQPRRVAAMSVSRRVAEEMDVTIGEEVGYSIRFEDCSSHKTVLKYLTDGMLLREAMADPLLERYKVIVLDEAHERTLATDVLFGLLKEVLKNRPDLKLVVMSATLEAEKFQGYFSGAPLMKVPGRLHPVEIFYTQEPERDYLEAAIRTVVQIHMCEPAGDILVFLTGEEEIEDACRKINKEVNNMGDQVGPVKVVPLYSTLPPAMQQKIFDPAPPPLKEEGPAGRKIVVSTNIAETSLTIDGIVYVIDPGFSKQKVYNPRIRVESLLVSPISKASAHQRAGRAGRTQPGKCFRLYTEKSFNGDLQPQTYPEILRSNLANTVLTLKKLGIDDLVHFDFMDPPAPETLMRALEVLNYLGALDDEGNLTSLGEMMSEFPLDPQMSKMLVISPRYNCSNEILSISAMLSVPNCFLRPREAQKAADEAKARFGHIDGDHLTLLNVYHAYKQNNEDPTWCYENFVNARAMKSADNVRQQLVRIMTRFNLKMCSTDFNSREYYVNIRKAMLSGYFMQVAHLERTGHYLTVKDNQVVHLHPSNCMDHKPEWVIYNEYVLTTRNFIRTVTDIRGEWLIDIAPQYYDLTNFPSCEAKRVLERLHNKRERERAASRN

SEQ ID NO: 7264 - protein, 726 aa, Musa acuminata
MSTERKRKVSLFDVVDDTSVSVKLGKANGSLSAKTAALPPGVNRWSGRPYSQRYHEILEKRKTLPVWQQKEEFLHVLKANQTLILVGETGSGKTTQIPQFVLECEDLGKRPMVACTQPRRVAAMSVSRRVAEEMDVTIGEEVGYSIRFEDCSSHRTILKYLTDGMLLREAMADPLLERYKVIILDEAHERTLATDVLFGLLKEVLRNRPDLKLVVMSATLEAEKFQGYFSGAPLMKVPGRLHPVEIFYTQEPERDYLEAAIRTVVQIHMCEPSGDILVFLTGEEEIEDACRKITKEINNMGDQVGPVKVVPLYSTLPPAMQQKIFEPAPAPLEEGGPPGRKIVVSTNIAETSLTIDGIVYVIDPGFSKQKVYNPRIRVESLLVSPISKASAHQRAGRAGRTQPGKCFRLYTERSFKNDLQEQTYPEILRSNLANTVLTLKKLGIDDLVHFDFMDPPAPETLMRALEVLNYLGALDDDGNLTKLGELMSEFPLDPQMAKMLVVSPEFNCSNEIVSISAMLSVPNCFLRPREAQKAADEAKARFGHIDGDHLTLLNVYHAYKQNSEDSSWCYENFINQRTLKAADNVRQQLVRIMARFNLKLCSTDFNSRDYYINIRKAMLAGYFMQVAHLERTGHYLTVKDNQVVHLHPSTCLDHKPEWVIYNEYVLTSRNFIRTVTDIRGEWLIDIAPHYYDLSNFPSCEAKRVLERLYNKRDKEKGESKTRNKPL

SEQ ID NO: 7265 - protein, 727 aa, Unknown
  Sequence found in Organisms: Citrus clementina, Citrus sinensis
MGTERKRKVSLFDVVDETSVSAKLVKTNGVGPGAMMNNNNSLINRWNGKPYSQRYYEILEKRKSLPVWQQKEEFLQVLKANQVIILVGETGSGKTTQIPQFVLEGVDIETPDRRRKMMIACTQPRRVAAMSVSRRVAEEMDVTIGEEVGYSIRFEDCSSARTVLKYLTDGMLLREAMTDPLLERYKVIVLDEAHERTLATDVLFGLLKEVLKNRPDLKLVVMSATLEAEKFQGYFYGAPLMKVPGRLHPVEIFYTQEPERDYLEAAIRTVVQIHMCEPSGDILVFLTGEEEIEDACRKITKEITNMGDQVGPVKVVPLYSTLPPAMQQKIFEPAPPPSKEGGPPGRKIVVSTNIAETSLTIDGIVYVIDPGFAKQKVYNPRVRVESLLVSPISKASAHQRSGRAGRTQPGKCFRLYTEKSFNNDLQPQTYPEILRSNLANTVLTLKKLGIDDLVHFDFMDPPAPETLMRALEVLNYLGALDDDGNLTEMGEKMSEFPLDPQMSKMLVESPKYNCSNEILSISAMLSVPNCFVRPREAQKAADEAKARFGHIDGDHLTLLNVYHAYKQNNEDPSWCYDNFVNHRALKSADNVRQQLVRIMARFNLKLCSNDFNSRDYYVNIRKAMLAGYFMQVAHLERTGQYLTVKDNQVVHLHPSNCLDHKPEWVIYNEYVLTSRNFIRTVTDVRGEWLIDIAPHYYDLSNFPQCEAKRVLERLYRKREKERENNRK

SEQ ID NO: 7266 - protein, 721 aa, Glycine max
MGTERKRKVSLFDVVDDSAAKMAKSNGGAAANNLTNHWTARPYSQRYFEILEKRKTLPVWHQKEEFLQVLKDNQTLILVGETGSGKTTQIPQFVLDAVELETPDKRRKMMVACTQPRRVAAMSVSRRVAEEMDVTIGEEVGYSIRFEDCSSAKTVLKYLTDGMLLREAMTDPLLERYKVIILDEAHERTLATDVLFGLLKEVLKNRPDMKLVVMSATLEAEKFQGYFFGAPLMKVPGRLHPVEIFYTQEPERDYLEAGIRTVVQIHMCEPPGDILVFLTGEEEIEDACRKITKEISNLGDQVGPVKVVPLYSTLPPAMQQKIFEPAPPPLKEGGPPGRKIVVSTNIAETSLTIDGIVYVIDPGFAKQKVYNPRIRVESLLVSPISKASAHQRSGRAGRTQPGKCFRLYTEKSFNNDLQPQTYPEILRSNLANTVLTLKKLGIDDLVHFDFMDPPAPETLMRALEVLNYLGALDDDGNLTKLGEIMSEFPLDPQMSKMLVVSPEFNCSNEILSVSAMLSVPNCFVRPREAQKAADEAKARFGHIDGDHLTLLNVYHAYKQNNEDPSWCYDNFVNHRALKSADNVRQQLVRIMSRFNLKLCSTDFNSRDYYVNIRKAMLAGYFMQVAHLERTGHYLTVKDNQVVHLHPSNCLDHKPEWVIYNEYVLTSRNFIRTVTDIRGEWLVDIAPHYYDLSNFPQCEAKRVLERLYKKREKEKEEARSRR

SEQ ID NO: 7267 - protein, 724 aa, Cajanus cajan
MGTERKRKVSLFDVVDDSVAKMAKTNGGANNSVVNALINRWNAKPYSQRYFDILEKRKTLPVWHQKDDFLKVLKDNQTLILVGETGSGKTTQIPQFVLDAVELETPDKRKKMMIACTQPRRVAAMSVSRRVAEEMDVTIGEEVGYSIRFEDCSSARTVLKYLTDGMLLREAMTDPLLERYKVIILDEAHERTLATDVLFGLLKEVLKNRPDMKLVVMSATLEAEKFQGYFFGAPLMKVPGRLHPVEIFYTQEPERDYLEAGIRTVVQIHMCEPPGDILVFLTGEEEIEDACRKINKEIANLGDQVGPVKVVPLYSTLPPAMQQKIFEPPPPPLKEGGPPGRKIVVSTNIAETSLTIDGIVYVIDPGFAKQKVYNPRVRVESLLVSPISKASAHQRSGRAGRTQPGKCFRLYTEKSFNNDLQPQTYPEILRSNLANTVLTLKKLGIDDLVHFDFMDPPAPETLMRALEVLNYLGALDDEGNLTKLGEIMSEFPLDPQMSKMLVVSPEFNCSNEILSVSAMLSVPNCFVRPREAQKAADEAKARFGHIDGDHLTLLNVYHAYKQNNEDPSWCYDNFVNHRALKSADNVRQQLVRIMSRFNLKLCSTDFNSRDYYVNIRKAMLAGYFMQVAHLERTGHYLTVKDNQVVHLHPSNCLDHKPEWVIYNEYVLTSRNFIRTVTDIRGEWLVDIAPHYYDLSNFPQCEAKRVLEKLYKKREKEKEEARSRR

SEQ ID NO: 7268 - protein, 722 aa, Glycine max
MGTERKRKVSLFDVVDDAAAKMSKSNGGAVAANNLINRWNGKPYSQRYHDILEKRKTLPVWHQKEEFLQALKDNQTLILVGETGSGKTTQIPQFVLEAVDIETTDKRRKMMIACTQPRRVAAMSVSRRVAEEMDVSIGEEVGYSIRFEDCSSARTVLKYLTDGMLLREAMTDPLLERYKVIILDEAHERTLATDVLFGLLKEVLRNRPDLKLVVMSATLEAEKFQGYFSGAPLMKVPGRLHPVEIFYTQDPERDYLEAAIRTVVQIHMCEPSGDILVFLTGEEEIEDACRKINKEISNMGDQVGPVKVVPLYSTLPPAMQQKIFEPAPPPVKEGGPPGRKIVVSTNIAETSLTIDGIVYVIDPGFAKQKVYNPRVRVESLLVSPISKASAHQRSGRAGRTQPGKCFRLYTEKSFNNDLQPQTYPEILRSNLANTVLTLKKLGIDDLVHFDFMDPPAPETLMRALEVLNYLGALDDDGNLTKLGQIMSEFPLDPQMSKMLVVSPEFNCSNEILSVSAMLSVPNCFVRPREAQKAADEAKARFGHIDGDHLTLLNVYHAYKQNNEDPSWCYDNFVNHRALKSADNVRQQLVRIMARFNLKLCSTDFNSRDYYVNIRKAMLAGYFMQVAHLERTGHYLTVKDNQVVHLHPSNCLDHKPEWVIYNEYVLTSRNFIRTVTDIRGEWLVDVAPHYYDLSNFPQCEAKRVLERLYKKREKEKEEARSRK

SEQ ID NO: 7269 - protein, 727 aa, Cajanus cajan
MGTERKRKVSLFDVVDDPAAKMAKTNGGRADGGCAVANNLINRWNGKPYSQRYHEILEKRKTLPVWHQKEEFLQVLKDNQTLILVGETGSGKTTQIPQFVLEAVDIETPDKRRKMMVACTQPRRVAAMSVSRRVAEEMDVNIGEEVGYSIRFEDCSSARTVLKYLTDGMLLREAMTDPLLERYKVIVLDEAHERTLATDVLFGLLKEVLRNRPDLKLVVMSATLEAEKFQGYFNGAPLMKVPGRLHPVEIFYTQEPERDYLEAAIRTVVQIHMCEPSGDILVFLTGEEEIEDACRKINKEVSNMGDQVGPVKVVPLYSTLPPAMQQKIFEPAPPPLKEGGPPGRKIVVSTNIAETSLTIDGIVYVIDPGFAKQKVYNPRVRVESLLVSPISKASAHQRSGRAGRTQPGKCFRLYTEKSFNNDLQPQTYPEILRSNLANTVLILKKLGIDDLVHFDFMDPPAPETLMRALEVLNYLGALDDDGNLTKLGEIMSEFPLDPQMSKMLVVSPEFNCSNEILSISAMLSVPNCFVRPREAQKAADEAKARFGHIDGDHLTLLNVYHAYKQNNEDSSWCYDNFVNHRALKSADNVRQQLVRIMARFNLKLCSTDFNSREYYVNIRKAMLAGYFMQVAHLERSGHYLTVKDNQVVHLHPSNCLDHKPEWVIYNEYVLTSRNFIRTVTDIRGEWLVDIAPHYYDLSNFPQCEAKRVLERLYKKREKEKEEARSRK

SEQ ID NO: 7270 - protein, 720 aa, Glycine max
MGTERKRKVSLFDVVDDSAAKMAKTNGGAANNLINHWTSRPYSQRYFEILEKRKTLPVWHQKEEFLQVLKDNQTLILVGETGSGKTTQIPQFVLDAVELETPDKRKKMMIACTQPRRVAAMSVSRRVAEEMDVTIGEEVGYSIRFEDCSSAKTVLKYLTDGMLLREAMTDPLLERYKVIILDEAHERTLATDVLFGLLKEVLKNRPDMKLVVMSATLEAEKFQGYFFGAPLMKVPGRLHPVEIFYTQEPERDYLEAGIRTVVQIHMCEPPGDILVFLTGEEEIEDACRKITKEISNLGDQVGPVKVVPLYSTLPPAMQQKIFEPAPPPLKEGGPPGRKIVVSTNIAETSLTIDGIVYVIDPGFAKQKVYNPRVRVESLLVSPISKASAHQRSGRAGRTQPGKCFRLYTEKSFNNDLQPQTYPEILRSNLANTVLTLKKLGIDDLVHFDFMDPPAPETLMRALEVLNYLGALDDDGNLTKLGEIMSEFPLDPQMSKMLVVSPEFNCSNEILSVSAMLSVPNCFVRPREAQKAADEAKARFGHIDGDHLTLLNVYHAYKQNNEDPSWCYDNFVNHRALKSADNVRQQLVRIMSRFNLKLCSTDFNSRDYYVNIRKAMLAGYFMQVAHLERTGHYLTVKDNQVVHLHPSNCLDHKPEWVIYNEYVLTSRNFIRTVTDIRGEWLVDVAPHYYDLSNFPQCEAKRVLERLYKKREKEKEEARSRR

SEQ ID NO: 7271 - protein, 603 aa, Zostera marina
MSVSRRVAEEMDVTIGEEVGYSIRFEDCSSNKTMLKYLTDGMLLREAMADPLLERYKVIVLDEAHERTLATDVLFGLLKEVLRNRPDLKLVVMSATLEAEKFQGYFNGAPLMKVPGRLHPVEIFYTQEPERDYLEAGIRTVVQIHMCEPAGDILVFLTGEEEIEDACRKITKEVNNLGDQVGPIKVVPLYSTLPPAMQQKIFDNAPAPITEGGPAGRKIVVSTNIAETSLTIDGIVYVIDPGFSKQKVYNPRIRVESLLVSPISKASAHQRSGRAGRTQPGKCFRLYTERSFNNDLQPQTYPEILRSNLANTVLTLKKLGIDDLVHFDFMDPPAPETLMRALEVLNYLGALDDEGNLTKLGEIMSEFPLDPQLSKMLVVSSDFNCSNEILSISSMLSAPNCFLRPREAQKAADEAKARFGHIDGDHLTLLNVYHAYKQNSEDPSWCYENFINQRAMKSADNVRQQLVRIMTRFNLKLCSTDFNSRDYYINIRKAMLSGYFMQVAHLERTGHYLTVKDNQVVHLHPSNCLDHKPEWVIYNEYVLTSRNFIRTVTDVRGEWLIDIAPHYYDLSNFPPCEAKRVLEKLYQKREREKSESKNRSKIQ

SEQ ID NO: 7272 - protein, 721 aa, Medicago truncatula
MGTERKRKVSLFDVVDDAAAKMVKTNGGLIGNNLINRWNGKPYSQRYHEILEKRKTLPVWHQKEDFLKVLKDNQTLILVGETGSGKTTQIPQFVLEAVELEAPDKRKKMMIACTQPRRVAAMSVSRRVAEEMDVSIGEEVGYSIRFEDCSSARTVLKYLTDGMLLREAMTDPLLERYKVIILDEAHERTLATDVLFGLLKEVLKNRPDLKLVVMSATLEAEKFQGYFFGAPLMKVPGRLHPVEIFYTQEPERDYLEAAIRTVVQIHMCEPAGDILVFLTGEEEIEDACRKISKEVANMGDQVGPVKAVPLYSTLPPAMQQKIFEPAPPPVKEGGPPGRKIVVSTNIAETSLTIDGIVYVIDPGFAKQKVYNPRVRVESLLVSPISKASAHQRSGRAGRTQPGKCFRLYTERSFNNDLQPQTYPEILRSNLANTVLTLKKLGIDDLVHFDFMDPPAPETLMRALEVLNYLGALDDEGNLTKLGEIMSEFPLDPQMSKMLVVSPEFNCSNEILSISAMLSVPNCFIRPREAQKAADEAKARFGHIDGDHLTLLNVYHAYKQNNEDASWCYDNFVNNRALKSADNVRQQLVRIMARFNLKLCSTDFNSRDYYVNIRKAMLAGYFMQVAHLERTGHYLTVKDNQVVHLHPSNCLDHKPEWVIYNEYVLTSRNFIRTVTDIRGEWLVDIAPHYYDLSNFPQCEAKRVLEKLYKKREKEKDEARNRK

SEQ ID NO: 7273 - protein, 730 aa, Eucalyptus grandis
MGTERKRKVSLFDVVDETSVSAKLTKSNGVMAGGGGNGNASSLINRWNGRVYSQRYYEILEKRRTLPVWHQKEEFLEVLKNNQTLILVGETGSGKTTQIPQFVLEAIDIETPDKRRKMMIACTQPRRVAAMSVSRRVAEEMDVTIGEEVGYSIRFEDCSSARTVLKYLTDGMLLREAMTDPLLERYKVIILDEAHERTLATDVLFGLLKEVLRNRPDLKLVVMSATLEAEKFQGYFSGAPLMKVPGRLHPVEIFYTQEPERDYLEAAIRTVVQIHTCEPPGDILVFLTGEEEIEDACRKITKEIGNAGDQVGPVKPVPLYSTLPPAMQQKIFEPAPPPLKEGGPPGRKIVIATNIAETSLTIDGIVYVIDPGFAKQKVYNPRVRVESLLVSPISKASAHQRAGRAGRTQPGKCFRLYTEKSFHGDLQPQTYPEILRSNLANTVLTLKKLGIDDLVHFDFMDPPAPETLMRALEVLNYLGALDDEGNLTKLGEIMSEFPLDPQMSKMLVVSPEFNCSNEILSVSAMLSVPNCFVRPREAQKAADEAKARFGHIDGDHLTLLNVYHAYKQNNEDSSWCYENFVNHRALKAADNVRQQLVRIMARFNLKLCSTDFNSRDYYVNIRKAMLAGYFMQVAHLERTGHYLTVKDNQVVHLHPSTCLDHKPEWVIYNEYVLTSRNFIRTVTDVRGDWLVDIAPHYYDLANFPQCEAKRVLEKLYKKKEREKEESKNRK

SEQ ID NO: 7274 - protein, 714 aa, Amborella trichopoda
MATERKRKVSLFDVVGDPSVAAKKLSVNGSADVNRWNGRPYSQRYFEILEKRKTLPVWQQKQEFLDTLEKHQTLILVGETGSGKTTQIPQFVVEAGYTSNRKQIACTQPRRVAAMSVSRRVAEEMDVTIGEEVGYSIRFEDCTGPKTILKYLTDGMLLREAMTDPLLERYRVIILDEAHERTVATDVLFGLLKEVLKNRADLKLVVMSATLEAEKFQGYFYGAPLMKVPGRLHPVEIFYTQDPERDYLEAAIRTVVQIHTCEPHGDILVFLTGEEEIEDACRKITKEINNMGDQVGPVKVVPLYSTLPPSMQQKIFEPAPPPSKEDGPPGRKIVVSTNIAETSLTIDGIVYVIDPGFAKQKVYNPRVRVESLLVSPISKASAHQRSGRAGRTQPGKCFRLYTEKSFSDDLQPQTYPEILRSNLANVVLTLKKLGIDDLVHFDFMDPPAPETLMRALEVLNYLGALDDDGNLTKLGEIMSEFPLDPQMSKMLVVSQEFNCSNEILSISAMLSVPNCFLRPREAQKAADEAKARFGHIDGDHLTLLNVYHAYKQNNEDPTWCYENFINQRAMKAADNVRQQLVRIMARFNLKLCSTDFNSRDYYPNIRKAMLTGYFMQVAHLERTGHYLTVKDNQVVHLHPSNCLDHKPEWVIYNEYVLTSRNFIRTVTDVRGEWLIDIAPHYYDLSNFPNCEAKRVLERLYQKRERDRGESKGRK

SEQ ID NO: 7275 - protein, 724 aa, Phaseolus coccineus
MGMERKRKVSLFDVVDDSVAKIAKYNGGANNSVANALINHWNARPYTQRYFEILEKRKTLPVWHQKEEFLKVLKDNQTLILVGETGSGKTTQIPQFVLEAVQLETPDKRRKMMIACTQPRRVAAMSVSRRVAEEMDVTIGEEVGYSIRFEDCSSARTVLKYLTDGMLLREAMTDPLLERYKVIILDEAHERTLATDVLFGLLKEVLKNRPDLKLVVMSATLEAEKFQGYFFGAPLMKVPGRLHPVEIFYTQDPERDYLEAGIRTVVQIHMCEPPGDILVFLTGEEEIEDACRKITKEISNLGDQVGPVKVVPLYSTLPPAMQQRIFEPPPPPLKEGGPPGRKIVVSTNIAETSLTIDGIVYVIDPGFAKQKVYNPRVRVESLLVSPISKASAHQRSGRAGRTQPGKCFRLYTERSFNNDLQPQTYPEILRSNLANTVLTLKKLGIDDLVHFDFMDPPAPETLMRALEVLNYLGALDDDGNLTKLGEIMSEFPLDPQMSKMLVVSPEFNCSNEILSVSAMLSVPNCFVRPREAQKAADEAKARFGHIDGDHLTLLNVYHAYKQNNEDPSWCYDNFVNHRALKSADNVRQQLVRIMARFNLKQCSTDFNSRDYYVNIRKAMLAGYFMQVAHLERTGHYLTVKDNQVVHLHPSNCLDHKPEWVIYNEYVLTSRNFIRTVTDIRGEWLVDIAPHYYDLSNFPQCEAKRVLEKLYKSREKEKEQTRSRR

SEQ ID NO: 7276 - protein, 727 aa, Sesamum indicum
MGTERKRKVSLFDVVDETAVSGKMSRANGGGTATAAVASTINRWNGRPYSQRYYEILEKRKSLPVWHQKEEFLQALRTNQTLILVGETGSGKTTQIPQFVLDAVEIETADKRRKFMVGCTQPRRVAAMSVSRRVAEEMDVTIGEEVGYSIRFEDCSSARTVLKYLTDGMLLREAMTDPLLERYKVIILDEAHERTLATDVLFGLLKEVLKNRPDLKLVVMSATLEAEKFQGYFFGAPLMKVPGRLHPVEIFYTQEPERDYLEAAIKTVYQIHACEPPGDILVFLTGEEEIEDACKKLAKEIANAGDQVGPAKIVPLYSTLPPAMQQKIFEPAPPPAVEGGPPGRKIVVSTNIAETSLTIDGIVYVIDPGFAKQKVYNPRIRVESLLVSPISKASAHQRSGRAGRTQPGKCFRLYTEKSFHNDLAPQTYPEILRSNLANTVLTLKKLGIDDLVHFDFMDPPAPETLMRALEVLNYLGALDDDGNLTKLGEIMSEFPLDPQMAKMLVVSPEFNCSNEILSISAMLSVPNCFVRPREAQKAADEAKARFGHIDGDHLTLLNVYHAYKQNKEDPQWCYENFINHRALKSADNVRQQLARIMARFNLKLCSTDFNSRDYYVNIRKAMLAGYFMQVAHLERTGHYLTVKDNQVVHLHPSNCLDHKPEWVIYNEYVLTSRNFIRTVTDIRGEWLVDVAPHYYDLSNFPNCEAKRQLEKLYKKRENAREESRNKK

SEQ ID NO: 7277 - protein, 725 aa, Gossypium hirsutum
MGTERKRKVSLFDVVDEPSAKIAKSNGLGLTETNANSSINKWNGRPYSQRYYDILEKRKTLPVWRQKEEFLQVLRANQTLILVGETGSGKTTQIPQFVLDAVDIETPDKRRKMMIACTQPRRVAAMSVSRRVAEEMDVTIGEEVGYSIRFEDCSSARTVLKYLTDGMLLREAMTDPLLERYKVIILDEAHERTLATDVLFGLLKEVLKNRPDLKLVVMSATLEAEKFQGYFNGAPLMKVPGRLHPVEIFYTQEPERDYLEAAIRTVVQIHMCEPPGDILVFLTGEEEIEDACRKITKEVGNMGDQVGPVKVVPLYSTLPPAMQQKIFEPAPPPVKEGGPPGRKIVVSTNIAETSLTIDGIVYVIDPGFSKQKVYNPRVRVESLLVSPISKASAHQRSGRAGRTQPGKCFRLYTEKSFNNDLQPQTYPEILRSNLANTVLILKKLGIDDLVHFDFMDPPAPETLMRALEVLNYLGALDDEGNLTKLGEIMSEFPLDPQMSKMLVVSSEFNCSNEILSVAAMLSVPNCFVRPREAQKAADEAKARFGHIDGDHLTLLNVYHAYKQNNEDQSWCYENFINHRALKAADNVRQQLVRIMSRFNLKLCSTDFNSRDYYVNIRKAMLAGYFMQVAHLERTGHYLTVKDNQVVHLHPSNCLDHKPEWVIYNEYVLTSRNFIRTVTDIRGEWLVDIAPHYYDLENFPQCEAKRVLEKLYRKKEKDREESRNRR

SEQ ID NO: 7278 - protein, 729 aa, Arabidopsis lyrata
MGTERKRKVSLFDVMEDPSLSSKNTKSNGLGVAAAAGGGSNLINKWNGKAYSQRYFEILEKRRDLPVWLQKDEFLNTLKSNQTLILVGETGSGKTTQIPQFVLDAVVADKSDKGKKWLVGCTQPRRVAAMSVSRRVADEMDVTIGEEVGYSIRFEDCTSSRTMLKYLTDGMLLREAMADPLLERYKVIILDEAHERTLATDVLFGLLKEVLRNRPDLKLVVMSATLEAEKFQQYFSGAPLMKVPGRLHPVEIFYTQEPERDYLEAAIRTVVQIHMCEPPGDILVFLTGEEEIEDACRKINKEVSNLGDQVGPVKVVPLYSTLPPAMQQKIFDPAPEPLTEGGPAGRKIVVSTNIAETSLTIDGIVYVIDPGFAKQKVYNPRIRVESLLVSPISKASAHQRSGRAGRTRPGKCFRLYTEKSFNNDLQPQTYPEILRSNLANTVLTLKKLGIDDLVHFDFMDPPAPETLMRALEVLNYLGALDDEGNLTKTGEIMSEFPLDPQMSKMLIVSPEFNCSNEILSVSAMLSVPNCFVRPREAQKAADEAKARFGHIDGDHLTLLNVYHAYKQNNEDPNWCFENFVNNRAMKSADNVRQQLVRIMSRFNLKMCSTDFNSRDYYVNIRKAMLAGYFMQVAHLERTGHYLTVKDNQVVHLHPSNCLDHKPEWVIYNEYVLTTRNFIRTVTDIRGEWLVDVAPHYYDLSNFPNCEAKRVLEKLYKKREREKDGSKNRK

SEQ ID NO: 7279 - protein, 725 aa, Gossypium raimondii
MGTERKRKVSLFDVMDEPSAKIAKSNGLGLTETNANSSINKWNGRPYSQRYYDILEKRKTLPVWQQKEEFLQVLRANQTLILVGETGSGKTTQIPQFVLDAVDIETPDKRRKMMIACTQPRRVAAMSVSRRVAEEMDVTIGEEVGYSIRFEDCSSARTVLKYLTDGMLLREAMTDPLLERYKVIILDEAHERTLATDVLFGLLKEVLRNRPDLKLVVMSATLEAEKFQGYFNGAPLMKVPGRLHPVEIFYTQEPERDYLEAAIRTVVQIHMCEPPGDILVFLTGEEEIEDACRKITKEVGNMGDQVGPVKVVPLYSTLPPAMQQKIFEPAPPPVKEGGPPGRKIVVSTNIAETSLTIDGIVYVIDPGFSKQKVYNPRVRVESLLVSPISKASAHQRSGRAGRTQPGKCFRLYTEKSFNNDLQPQTYPEILRSNLANTVLILKKLGIDDLVHFDFMDPPAPETLMRALEVLNYLGALDDEGNLTKLGEIMSEFPLDPQMSKMLVVSSEFNCSNEILSVAAMLSVPNCFVRPREAQKAADEAKARFGHIDGDHLTLLNVYHAYKQNNEDQSWCYENFINHRALKAADNVRQQLVRIMSRFNLKLCSTDFNSRDYYVNIRKAMLAGYFMQVAHLERTGHYLTVKDNQVVHLHPSNCLDHKPEWVIYNEYVLTSRNFIRTVTDIRGEWLVDIAPHYYDLENFPQCEAKRVLEKLYRKKEKDREESRNRR

SEQ ID NO: 7280 - protein, 728 aa, Vitis vinifera
MGTERKRKVSLFDVVDETSVSAKISKSNGSGAINNNNNNNLVNRWNGRPYSQRYYEILEKRRTLPVWHQKEEFLQVLKANQSLILVGETGSGKTTQIPQFVLEAVDIETPDKRKKMMIACTQPRRVAAMSVSRRVAEEMDVTIGEEVGYSIRFEDCSSARTVLKYLTDGMLLREAMTDPLLERYKVIILDEAHERTLATDVLFGLLKEVLKNRPDLKVVVMSATLEAEKFQGYFNGAPLMKVPGRLHPVEIFYTQEPERDYLEAAIRTVVQIHMCEGAGDILVFLTGEEEIEDACKKISKEIANLGDQVGPVKAVPLYSTLPPAMQQKIFEPAPPPLTEGGPPGRKIVVSTNIAETSLTIDGIVFVIDPGFAKQKVYNPRVRVESLLVSPISKASAHQRSGRAGRTQPGKCFRLYTEKSFNNDLQPQTYPEILRSNLANTVLTLKKLGIDDLVHFDFMDPPAPETLMRALEVLNYLGALDDDGNLTKLGEIMSEFPLDPQMSKMLVVSPEFNCSNEILSISAMLSVPNCFVRPREAQKAADEAKARFGHIDGDHLTLLNVYHAYKQNNEDPSWCYENFVNQRALKAADNVRQQLVRIMARFNLKLCSTDFNSRDYYINIRKAMLAGYFMQVAHLERTGHYLTVKDNQVVHLHPSNCLDHKPEWVIYNEYVLTSRNFIRTVTDVRGEWLVDVAPHYYDLANFPNCEAKRVLEKLYKKREKDREESRNRK

SEQ ID NO: 7281 - protein, 424 aa, Trigonella foenum-graecum
MGDQVGPVKAVPLYSTLPPAMQQKIFEPAPPPVKEGGPPGRKIVVSTNIAETSLTIDGIVYVIDPGFAKQKVYNPRVRVESLLVSPISKASAHQRSGRAGRTQPGKCFRLYTERSFNNDLQPQTYPEILRSNLANTVLTLKKLGIDDLVHFDFMDPPAPETLMRALEVLNYLGALDDEGNLTKLGEIMSEFPLDPQMSKMLVVSPEFNCSNEILSISAMLSVPNCFIRPREAQKAADEAKARFGHIDGDHLTLLNVYHAYKQNNEDASWCYDNFVNNRALKSADNVRQQLVRIMARFNLKLCSTDFNSRDYYINIRKAMLAGYFMQVAHLERTGHYLTVKDNQVVHLHPSNCLDHKPEWVIYNEYVLTSRNFIRTVTDIRGEWLVDIAPHYYDLSNFPQCEAKRVLEKLYKKREKEKDEARNRK

SEQ ID NO: 7282 - protein, 725 aa, Theobroma cacao
MGTERKRKVSLFDVVDETSAKISKSNGGGIAAMNVNSSINKWNGRPYSQRYYEILEKRKTLPVWQQKEEFLQVLKANQTLILVGETGSGKTTQIPQFVLDAVDIETPDKRRKMMIACTQPRRVAAMSVSRRVAEEMDVTIGEEVGYSIRFEDCSSARTVLKYLTDGMLLREAMTDPLLERYKVIILDEAHERTLATDVLFGLLKEVLKNRPDLKLVVMSATLEAEKFQGYFNGAPLMKVPGRLHPVEIFYTQEPERDYLEAAIRTVVQIHMCEPAGDILVFLTGEEEIEDACRKITKEAGNMGDQVGPVKVVPLYSTLPPAMQQKIFEPAPPPVKEDGPPGRKIVVSTNIAETSLTIDGIVYVIDPGFAKQKVYNPRVRVESLLVSPISKASAHQRSGRAGRTQPGKCFRLYTEKSFNNDLQPQTYPEILRSNLANSVLTLKKLGIDDLVHFDFMDPPAPETLMRALEVLNYLGALDDDGNLTKLGEIMSEFPLDPQMSKMLVVSSEFNCSNEILSVAAMLSVPNCFVRPREAQKAADEAKARFGHIDGDHLTLLNVYHAYKQNNEDSSWCYENFVNHRALKAADNVRQQLVRIMARFNLKLCSTDFNSRDYYINIRKAMLAGYFMQVAHLERTGHYLTVKDNQVVHLHPSNCLDHKPEWVIYNEYVLTSRNFIRTVTDIRGEWLVDIAPHYYDLENFPQCEAKRVLEKLYKKKEKDREESRNRR

SEQ ID NO: 7283 - protein, 732 aa, Cucumis sativus
MGAERKRKVSLFDVVDETSVSAKLNKVNGGVAPLNNGGGNAGNSLINRWTGRQFSQRYYEILEKRKTLPVWHQKEEFFQVLKSSQTLILVGETGSGKTTQIPQFVLEAVDLDSPDKRKKMMVACTQPRRVAAMSVSRRVAEEMDVTIGEEVGYSIRFEDCSSARTVLKYLTDGMLLREAMTDPLLERYKVIILDEAHERTLATDVLFGLLKEVLKNRPDLKLVVMSATLEAEKFQGYFYGAPLMKVPGRLHPVEIFYTQEPERDYLEAAIRTVVQIHLCEPPGDILVFLTGEEEIEDACRKINKEIGNLGDQVGPVKVVPLYSTLPPAMQQKIFEPAPPPVKEDGPAGRKIVVSTNIAETSLTIDGIVYVIDPGFSKQKVYNPRVRVESLLVSPISKASAHQRSGRAGRTQPGKCFRLYTEKSFQNDLQPQTYPEILRSNLANTVLTLKKLGIDDLVHFDFMDPPAPETLMRALEVLNYLGALDDDGNLTKLGEIMSEFPLDPQMSKMLVVSPEFKCSNEILSVSAMLSVPNCFVRPREAQKAADEAKARFGHIDGDHLTLLNVYHAYKQNNEDQSWCYENFINHRAMKAADNVREQLVRIMSRFNLKLCSTDFNNREYYVNIRKAMLSGYFMQVAHLERTGHYLTVKDNQVVHLHPSNCLDHKPEWVIYNEYVLTSRNFIRTVTDIRGEWLVDIASHYYDLENFPQCEAKRVLERLYKKREKDREESRNRK

SEQ ID NO: 7284 - protein, 731 aa, Ricinus communis
MGTDRKRKVSLFDVVDETSVSAKIAKSNGGGGAAMNNNGSSNSLINSWNGKPYSQRYYEILEKRKTLPVWHQKEEFLSVLKKNQVLILVGETGSGKTTQIPQFVLEAVDIETPDKRRKMMIACTQPRRVAAMSVSRRVAEEMDVTIGEEVGYSIRFEDCSSAKTVLKYLTDGMLLREAMTDPLLERYKVIILDEAHERTLATDVLFGLLKEVLRNRPDLKLVVMSATLEAEKFQGYFNDAPLMRVPGRLHPVEIFYTQDPERDYLEAAIRTVVQIHMCEPLGDILVFLTGEEEIEDACRKITKEISNMGDQVGPVKVVPLYSTLPPAMQQKIFEPAPPPLNEGGPAGRKIVVSTNIAETSLTIDGIVYVIDPGFAKQKVYNPRVRVESLLVSPISKASAHQRSGRAGRTQPGKCFRLYTEKSFHQDLQPQTYPEILRSNLANTVLTLKKLGIDDLVHFDFMDPPAPETLMRALEMLNYLGALDDDGNLTKLGEIMSEFPLDPQMAKMLVVSPEFNCSNEILSVSAMLSVPNCFVRPREAQKAADEAKARFGHIDGDHLTLLNVYHAYKQNNEDPSWCYENFINHRALKAADNVRQQLVRIMTRFNLKLCSTDFNSRDYYVNIRKAMLAGYFMQVAHLERTGHYLTVKDNQVVHLHPSNCLDHKPEWVIYSEYVLTSRNFIRTVTDIRGEWLVDIAPHYYDLDNFPNCEAKRVLEKLYKKREREKEESKNRK

SEQ ID NO: 7285 - protein, 732 aa, Citrullus lanatus
MGAERKRKVSLFDVVDETSLSAKSHKANGGVAALNNGGGNAGNSLINRWTGRQFSPRYYEILEKRKTLPVWHQKEEFFQALKSSQTLILVGETGSGKTTQIPQFVLEAVDLDSPDKRKKMMVACTQPRRVAAMSVSRRVAEEMDVTIGEEVGYSIRFEDCSSARTVLKYLTDGMLLREAMTDPLLERYKVIILDEAHERTLATDVLFGLLKEVLKNRPDLKLVVMSATLEAEKFQGYFYGAPLMKVPGRLHPVEIFYTQEPERDYLEAAIRTVVQIHLCEPPGDILVFLTGEEEIEDACRKINKEIANLGDQVGPVKVVPLYSTLPPAMQQKIFEPAPPPVKEDGPAGRKIVVSTNIAETSLTIDGIVYVIDPGFSKQKVYNPRVRVESLLVSPISKASAHQRSGRAGRTQPGKCFRLYTEKSFQNDLQPQTYPEILRSNLANTVLTLKKLGIDDLVHFDFMDPPAPETLMRALEVLNYLGALDDDGNLTKLGEIMSEFPLDPQMSKMLVVSPEFKCSNEILSISAMLSVPNCFVRPREAQKAADEAKARFGHIDGDHLTLLNVYHAYKQNNEDQSWCYENFINHRAMKAADNVREQLVRIMSRFNLKLCSTDFNSRDYYVNIRKAMLSGYFMQVAHLERTGHYLTVKDNQVVHLHPSNCLDQKPEWVIYNEYVLTSRNFIRTVTDIRGEWLVDIAAHYYDLENFPQCEAKRVLERLYKKREKDREESRNRK

SEQ ID NO: 7286 - protein, 730 aa, Papaver somniferum
MSTERKRKVSLFDVVDETSVSAAAKLVKMNGFGGGLIHNNPLVNRWNGRPYSQRYMDILEKRKTLPVWQQKDEFLQVLKNNQTLILVGETGSGKTTQIPQFVIDAVELENPGKRKKMMVACTQPRRVAAMSVSRRVAEEMDVTIGEEVGYSIRFEDCSSAKTVLKYLTDGMLLREAMTDPLLENYKVIILDEAHERTLATDVLFGLLKEVLKNRPDLKLVVMSATLEAEKFQAYFSGAPLMKVPGRLHPVEIFYTQDPERDYLEAAIRTVVQIHICEGPGDILVFLTGEEEIEDACRKITKEIGNQGEQVGPVKVVPLYSTLPPAMQQKIFDAAPPPLKEGGPPGRKIVVSTNIAETSLTIDGIVYVIDPGFAKQKVYNPRVRVESLLVSPISRASAHQRSGRAGRTQPGKCFRLYTEGSFNNDLQPQTYPEILRSNLANTVLTLKKLGIDDLVHFDFMDPPAPETLMRALEVLNYLGALDDEGNLTKLGEIMADFPLDPQMSKMLVVSPSFNCSNEILSISAMLSVPNCFVRPREAQKAADEAKARFGHIDGDHLTLLNVYHAYKQNNEDPSWCYDNFVNARALKSADNVRQQLMRIMTRFNLKLCSTDFNSRDYYINIRKAMLSGYFMQVAHLERTGHYLTVKDNQVVHLHPSNCLDHKPEWVIYNEYVLTSRNFIRTVTDVRGEWLVDIAPHYYDLENFPQCEAKRVLERLYQKREKDKENSKNKKQ

SEQ ID NO: 7287 - protein, 721 aa, Cicer arietinum
MGTERKRKVSLFDVVDDSAAKMVKTNGVSIGNSLINRWNGKAYSQRYYEILEKRKTLPVWHQKEDFLQVLRDNQTLILVGETGSGKTTQIPQFVLEAVELETADKRKKMMIACTQPRRVAAMSVSRRVAEEMDVSIGEEVGYSIRFEDCSSARTVLKYLTDGMLLREAMTDPLLERYKVIILDEAHERTLATDVLFGLLKEVLKNRPDLKLVVMSATLEAEKFQGYFFGAPLMKVPGRLHPVEIFYTQEPERDYLEAAIRTVVQIHMCEPPGDILVFLTGEEEIEDACRKISKEVANLGDQVGPVKAVPLYSTLPPAMQQKIFEPAPPPVKEGGPAGRKIVVSTNIAETSLTIDGIVYVIDPGFAKQKVYNPRVRVESLLVSPISKASAHQRSGRAGRTQPGKCFRLYTERSFNNDLQPQTYPEILRSNLANTVLTLKKLGIDDLVHFDFMDPPAPETLMRALEVLNYLGALDDDGNLTKLGEIMSEFPLDPQMSKMLVVSPEFNCSNEILSISAMLSVPNCFIRPREAQKAADEAKARFGHIDGDHLTLLNVYHAYKQNNEDASWCYDNFVNNRALKSADNVRQQLVRIMARFNLKLCSTDFNSRDYYINIRKAMLAGYFMQVAHLERTGHYLTVKDNQVVHLHPSNCLDHKPEWVIYNEYVLTSRNFIRTVTDIRGEWLVDIAPHYYDLSNFPQCEAKRVLEKLYKKREKDKDEARNRK

SEQ ID NO: 7288 - protein, 727 aa, Cannabis sativa
MGTERKRKVSLFDVVDETSVSAKITKSNGGLMSNNAGNSLINMWNGKPYSQRYFDILEKRKTLPVWQQKEEFLQVLKANQTLILVGETGSGKTTQIPQFVLEAVDIETPDKRRKMMIACTQPRRVAAMSVSRRVAEEMDVTIGEEVGYSIRFEDCSSAKTVLKYQTDGMLLREAMTDPLLERYKVIILDEAHERTLATDVLFGLLKEVLRNRPDLKLVVMSATLEAEKFQGYFSGAPLMKVPGRLHPVEIFYTQEPERDYVEAAIRTVVQIHMCEPPGDILVFLTGEEEIEDACRKINKEVANLGDQVGPVKAVPLYSSLPPAMQQKIFDPAPPPLNEGGPPGRKIVVSTNIAETSLTIDGIVYVIDPGFAKQKVYNPRVRVESLLVSPISKASAHQRSGRAGRTQPGKCFRLYTERSFNNDLQPQTYPEILRSNLANTVLTLKKLGIDDLVHFDFMDPPAPETLMRALEVLNYLGALDDEGNLTKLGQIMSEFPLDPQMSKMLVVSPEFNCSNEILSISAMLSVPNCFVRPREAQKAADEAKARFGHIDGDHLTLLNVYHAYKQNNEDQSWCYENFVNARALKSADNVRQQLVRIMARYNLKLCSTDFSSRDYYINIRKAMLAGYFMQVAHLERTGHYLTVKDNQVVHLHPSNCLDHKPEWVIYNEYVLTSRNFIRTVTDVRGEWLVDIAPHYFDLENFPQCEAKRVLERLYKKREREKEESRNRK

SEQ ID NO: 7289 - protein, 725 aa, Eutrema parvulum
MGTERKRKISLFDVMDDPSAPAKTANTNGLADGGINSLINKWNGKPYSQKYYEILEKRRTLPVWLQKEEFLRTLRDNQTLILVGETGSGKTTQIPQFVIDAVDAETSDKRRKWLVGCTQPRRVAAMSVSRRVADEMDVAIGEEVGYSIRFEDCSSPRTVLKYLTDGMLLREAMADPLLERYKVIILDEAHERTLATDVLFGLLKEVLRNRPDLKLVVMSATLEAEKFQEYFSGAPLMKVPGRLHPVEIFYTQEPERDYLEAAIRTVVQIHMCEPPGDILVFLTGEEEIEDACRKINKEVGNLGDQVGPVKAVPLYSTLPPAMQQKIFDPAPEPVTEGGPPGRKIVVSTNIAETSLTIDGIVYVIDPGFAKQKVYNPRIRVESLLVSPISKASAHQRSGRAGRTRPGKCFRLYTEKSFNNDLQPQTYPEILRSNLANTVLTLKKLGIDDLVHFDFMDPPAPETLMRALEVLNYLGALDDEGNLTRTGEIMSEFPLDPQMAKMLIVSPEFNCSNEILSVSAMLSVPNCFIRPREAQKAADEAKARFGHIDGDHLTLLNVYHAFKQNNEDPNWCYENFINNRAMKSADNVRQQLVRIMSRFNLKMCSTDFNSRDYYINIRKAMLAGYFMQVAHLERTGNYLTVKDNQVVHLHPSNCLDHKPEWVIYNEYVLTSRNFIRTVTDIRGEWLVDVAPHYYDLSNFPNCEAKRVLEKLYKKREREKDDSKNRK

SEQ ID NO: 7290 - protein, 732 aa, Lactuca sativa
MGTERKRKVSLFDVVDEATATAKVNKANGGGAVHGINNSTGGMSLVNSWNGRPYSQRYFDILEKRKTLPVWHQKEEFLKVLKENQTLILVGETGSGKTTQIPQFVLEAVEVESADRRKKYMVGCTQPRRVAAMSVSRRVAEEMDVTIGEEVGYSIRFEDCSSAKTVLKYLTDGMLLREAMTDPLLERYKVIILDEAHERTLATDVLFGLLKEVLKNRPDLKLVVMSATLEAEKFQGYFFGAPLMKVPGRLHPVEIFYTQEPERDYLEAAIRTVVQIHMCEPPGDILVFLTGEEEIEDACRKITKEVGNMGDQVGPVKVVPLYSTLPPAMQQKIFEPAPPPLTEGGPAGRKIVISTNIAETSLTIDGIVYVIDPGFAKQKVYNPRVRVESLLVSPISKASAHQRSGRAGRTQPGKCFRLYTEKSFNNDLQPQTYPEILRSNLANTVLTLKKLGIDDLVHFDFMDPPAPETLMRALEVLNYLGALDDEGNLTKLGEIMSEFPLDPQMGKMLVVSPEFNCSNEILSISAMLSVPNCFVRPREAQKAADEAKARFGHIDGDHLTLLNVYHAYKQNNEDQSWCYENFVNQRALKSADNVRQQLARIMARFNLKLCSTDFNSRDYYINIRKAMLAGYFMQVAHLERTGHYLTVKDNQVVHLHPSNCLDHKPEWVIYNEYVLTSRNFIRTVTDVRGEWIVDIAPHYYDLDNFPQCEAKRVLEKLYKKREKDKEESRSRR

SEQ ID NO: 7291 - protein, 730 aa, Prunus mume
MGTERKRKVSLFDVVDETSVSSAKMSKSNGGAGATANHNAVSNLINRWTGKPYSQRYYEILEKRKTLPVWHQKEEFLQALKASQSLILVGETGSGKTTQIPQFVLEAVDSETPDKRKKMMIACTQPRRVAAMSVSRRVAEEMDVTIGEEVGYSIRFEDCSSARTVLKYLTDGMLLREAMTDPLLERYSVIILDEAHERTLATDVLFGLLKEVLRNRPDLKLVVMSATLEAEKFQGYFSGAPLMKVPGRLHPVEIFYTEEPERDYLEAAIRTVVQIHMYETPGDILVFLTGEEEIEDACRKINKEVGNLGDQVGPVKVVPLYSTLPPAMQQKIFDPAPPPINEGGIPGRKIVVSTNIAETSLTIDGIVYVIDPGFAKQKVYNPRVRVESLLVSPISKASAHQRSGRAGRTQPGKCFRLYTEKSFHNDLQPQTYPEILRSNLANTVLTLKKLGIDDLVHFDFMDPPAPETLMRALEVLNYLGALDDDGNLTKLGEIMSEFPLDPQMSKMLVVSPEFNCSNEILSISAMLSVPNCFVRPREAQKAADEAKARFGHIDGDHLTLLNVYHAYKQNNEDPSWCYENFVNQRALKSADNVRQQLVRIMARFNLKLCSTDFNSRDYYINIRKAMLAGYFMQVAHLERTGHYLTVKDNQVVHLHPSNCLDHKPEWVIYNEYVLTSRNFIRTVTDIRGEWLVDIASHYYDLANFPQCEAKRVLEKLYKKREDRDENKNRK

SEQ ID NO: 7292 - protein, 500 aa, Lactuca sativa
MGTERKRKVSLFDVVDEATATAKVNKANGGGAVHGINNSTGGMSLVNSWNGRPYSQRYFDILEKRKTLPVWHQKEEFLKVLKENQTLILVGETGSGKTTQIPQFVLEAVEVESADRRKKYMVGCTQPRRVAAMSVSRRVAEEMDVTIGEEVGYSIRFEDCSSAKTVLKYLTDGMLLREAMTDPLLERYKVIILDEAHERTLATDVLFGLLKEVLKNRPDLKLVVMSATLEAEKFQGYFFGAPLMKVPGRLHPVEIFYTQEPERDYLEAAIRTVVQIHMCEPPGDILVFLTGEEEIEDACRKITKEVGNMGDQVGPVKVVPLYSTLPPAMQQKIFEPAPPPLTEGGPAGRKIVISTNIAETSLTIDGIVYVIDPGFAKQKVYNPRVRVESLLVSPISKASAHQRSGRAGRTQPGKCFRLYTEKSFNNDLQPQTYPEILRSNLANTALTLKKLGIDDLVHFDFMDPPAPETLMRALEVLNYLGALDDEGNLTKLGEIMSEFH

SEQ ID NO: 7293 - protein, 709 aa, Amsonia hubrichtii
MGTERKRKVSLFDVVDESSASKLAKANGGPMNNASGGMTPLVNRWNGRPYSQRYYEILEKRKTLPVWQQKEEFLRVLKENQTLILVGETGSGKTTQIPQFVLEAVEIESQDKRKKYMIGCTQPRRVAAMSVSRRVAEEMDVTIGEEVGYSIRFEDCSSARTVLKYLTDGMLLREAMTDPLLERYKVIILDEAHERTLATDVLFGLLKEVLKNRPDLKLVVMSATLEAEKFQGYFYGAPLMKVPGRLHPVEIFYTQEPERDYLEAAIRTVVQIHMYEPPGDILVFLTGEEEIEDACRKINKEINNIGDQVGPIKVVPLYSTLPPALQQKIFEPAPPPLVEGGPPGRKIVVSTNIAETSLTIDGIVYVIDPGFAKQKVYNPRVRVESLLVSPISKASAHQRSGRAGRTQPGKCFRLYTERSFSNDLQPQTYPEILRSNLANTVLQLKKLGIDDLVHFDFMDPPAPETLMRALEVLNYLGALDDDGNLTKLGEIMSEFPLDPQMSKMLVVSPEFNCSNEILSVSAMLSVPNCFVRPREAQKAADEAKARFGHIDGDHLTLLNVYHAYKQNKEDPQWCFDNFVNQRALKSADNVRQQLARIMARFNLKLCSTDFNSRDYYVNIRKAMLAGYFMQVAHLERTGHYLTVKDNQVVHLHPSNCLDHKPEWVIYNEYVLTSRNFIRTVTDVRGEWLVDVAPHYYDLTNFPNCEAKRV

SEQ ID NO: 7294 - protein, 730 aa, Malus domestica
MGTERKRKVSLFDVVDEASITSAKMNKSNGSGGAAANQNAVNSLINRWTGKPYSQRYYEILEKRKTLPVWHQKEEFLQAFKASQSLILVGETGSGKTTQIPQFVLEAVHSESSDKRKKMMVACTQPRRVAAMSVSRRVAEEMDVTIGEEVGYSIRFEDCSSARTVLKYLTDGMLLREAMTDPLLERYSVVILDEAHERTLATDVLFGLLKEVLRNRPDLKVVVMSATLEAEKFQGYFSGAPLMKVPGRLHPVEIFYTEEPERDYLEAAIRTVVQIHMYETPGDILVFLTGEEEIEDACRKINKEVGNLGDQVGPVKVVPLYSTLPPAMQQKIFDPAPPPIKEGGIPGRKIVVSTNIAETSLTIDGIVYVIDPGFAKQKVYNPRVRVESLLVSPISKASAHQRSGRAGRTQPGKCFRLYTEKSFNNDLQPQTYPEILRSNLANTVLTLKKLGIDDLVHFDFMDPPAPETLMRALEVLNYLGALDDEGNLTKLGEIMSEFPLDPQMSKMLVVSPEFNCSNEILSVSAMLSVPNCFVRPREAQKAADEAKARFGHIDGDHLTLLNVYHAYKQNNEDPSWCYENFVNQRALKSADNVRQQLVRIMARFNLKLCSTEFNSRDYYINIRKAMLAGYFMQVAHLERTGHYLTVKDNQVVHLHPSNCLDHKPEWVIYNEYVLTSRNFIRTVTDVRGEWLVDIAPHYYDLANFPQCEAKRVLEKLYRKREDKDENKNRK

SEQ ID NO: 7295 - protein, 715 aa, Cicer arietinum
MGTERKRKVSLFDVVDDSAAKMVKTNGVSIGNSLINRWNGKAYSQRYYEILEKRKTLPVWHQKEDFLQVLRDNQTLILVGETGSGKTTQIPQFVLEAVELETADKRKKMMIACTQPRRVAAMSVSRRVAEEMDVSIGEEVGYSIRFEDCSSARTVLKYLTDGMLLREAMTDPLLERYKVIILDEAHERTLATDVLFGLLKEVLKNRPDLKLVVMSATLEAEKFQGYFFGAPLMKVPGRLHPVEIFYTQEPERDYLEAAIRTVVQIHMCEPPGDILVFLTGEEEIEDACRKISKEVANLGDQVGPVKAVPLYSTLPPAMQQKIFEPAPPPVKEGGPAGRKIVVSTNIAETSLTIDGIVYVIDPGFAKQKVYNPRVRVESLLVSPISKASAHQRSGRAGRTQPGKCFRLYTERSFNNDLQPQTYPEILRSNLANTVLTLKKLGIDDLVHFDFMDPPAPETLMRALEVLNYLGALDDDGNLTKLGEIMSEFPLDPQMSKMLVVSPEFNCSNEILSISAMLSVPNCFIRPREAQKAADEAKARFGHIDGDHLTLLNVYHAYKQNNEDASWCYDNFVNNRALKSADNVRQQLVRIMARFNLKLCSTDFNSRDYYINIRKAMLAGYFMQVAHLERTGHYLTVKDNQVVHLHPSNCLDHKPEWVIYNEYVLTSRNFIRTVTDIRGEWLVDIAPHYYDLSNFPQCEAKRVLEKLYKKREKDKD

SEQ ID NO: 7296 - protein, 724 aa, Eschscholzia californica
MSTERKRKVSLFDVVDETSVSAKLAKMNGGGLAQNPLINRWNARPYSQRYFDILEKRKTLPVWQQKDEFLQVLKANQTLILVGETGSGKTTQIPQFVLESVELENPEKRKKMMVACTQPRRVAAMSVSRRVAEEMDVTIGEEVGYSIRFEDCSSSKTVLKYLTDGMLLREAMTDPLLEQYKVIILDEAHERTLATDVLFGLLKEVLRNRPDLKLVVMSATLEAEKFQAYFSGAPLMKVPGRLHPVEIFYTQEPERDYLEAAIRTVVQIHLCEGPGDILVFLTGEEEIEDACRKITKEIGNQGDQVGPVKVVPLYSTLPPAMQQKIFDPAPPPLKEGGPPGRKIVVSTNIAETSLTIDGIVYVIDPGFAKQKVYNPRVRVESLLVSPISRASAHQRSGRAGRTQPGKCFRLYTERSFNNDLQPQTYPEILRSNLANTVLTLKKLGIDDLVHFDFMDPPAPETLMRALEVLNYLGALDDEGNMTKLGEIMSDFPLDPQMSKMLVVSPSFNCSNEILSITAMLSVPNCFVRPREAQKAADEAKARFAHIDGDHLTLLNVYHAYKQNDEDSSWCYDNFVNQRALKSADNVRQQLMRIMARFNLKLCSPDFNSRDYYLNIRKAMLAGYFMQVAHLERTGHYLTVKDNQVVHLHPSNCLDHKPEWVIYNEYVLTSRNFIRTVTDVRGEWLVDIASHYYDLENFPQCEAKRVLEKLYQKKGKDKEESRNRK

SEQ ID NO: 7297 - protein, 445 aa, Gnetum gnemon
MSSERKRKLSLFDVTDENLVQQAKKLNSSSNGVAASAAGTPAIQGINRWNARPYSNRYFEILEKRKTLPVWQQRQEFLDMLEKSQTVILVGETGSGKTTQIPQFVVEAGYTANRKQIACTQPRRVAAMSVSRRVAEEMDVTIGEEVGYSIRFEDCSSSKTILKYLTDGMLLREAMTDPLLERYRVIILDEAHERTLATDVLFGLLKEVLRNRQDLKLVVMSATLEAEKFQTYFSGAPLMKVPGRLHPVEIFYTQEPERDYLEAAIRTVVQIHMCEPAGDILVFLTGEEEIEDACKKINREIQNLGDQVGPVKAVPLYSTLPPAMQQKIFEPAPAPTKEGGPPGRKIVVSTNIAETSLTIDGIVYVIDPGFAKQKVLQSSYTCRITAVSPISKASAHQRSGRAGRTQPGKCFRLYTEKSFHNDLQAQTYPEILRSNLANVVLQLKS

SEQ ID NO: 7298 - protein, 722 aa, Nicotiana benthamiana
MGTERKRKVSLFDVVDETPAQKVNVGSVNGSMTPSINKWNGKPYSQRFYEILEKRKTLPVWHQKEEFLQALKSNQTLILVGETGSGKTTQIPQFVLDAVEVETTEKRRKYMIGCTQPRRVAAMSVSRRVAEEMDVAIGEEVGYSIRFEDCSSARTVLKYLTDGMLLREAMADPLLERYKVIILDEAHERTLATDVLFGLLKEVLKNRPDLKLVVMSATLEAEKFQGYFFGAPLMKVPGRLHPVEIFYTQEPERDYIEAAIRTVVQIHTCEPPGDILVFLTGEEEIEDACRKINKEVSNLGDQVGPVKVVPLYSTLPPAMQQKIFESAPPPVVEGGPAGRKIVVSTNIAETSLTIDGIVYVIDPGFAKQKVYNPRVRVESLLVSPISKASAHQRSGRAGRTQPGKCFRLYTEKSFHNDLQPQTYPEILRSNLANTVLTLKKLGIDDLVHFDFMDPPAPETLMRALEVLNYLGALDDEGNLTRLGEIMSEFPLDPQMAKMLVVSSEFNCSNEILSISAMLSVPNCFVRPREAQKAADEAKNRFGHIDGDHLTLLNVYHAYKQNTEDPQWCYENFINQRALKSADNVRQQLSRIMARFNLKLCSTDFNSRNYYVNIRKAMLAGYFMQVAHLERTGHYLTVKDNQVVHLHPSNCLDHKPEWVIYNEYVLTSRNFIRTVTDIRGEWLVDIAPHYYDLANFPQCEAKRVLERLYKKREREKDESKSKR

SEQ ID NO: 7299 - protein, 722 aa, Ambrosia trifida
MGTERKRKVSLFDVVEDTSTAKLNKSNGVDNMSTLVNRWNLRPYSQRYYDILEKRKTLPVWHQKEEFLKALRDNQTLILVGETGSGKTTQIPQFVLEAVELESADRRKKFMVGCTQPRRVAAMSVSRRVAEEMDVTIGEEVGYSIRFEDCSSAKTVLKYLTDGMLLREAMTDPLLERYKVIILDEAHERTLATDVLFGLLKEVLKNRPDLKLVVMSATLEAEKFQGYFFGAPLMKVPGRLHPVEIFYTQDPERDYLEAAIRTVVQIHMCEPPGDILVFLTGEEEIEDACRKITKEVGNLGDQVGPVKVVPLYSTLPPAMQQKIFEPAPPPLTEGGPAGRKIVISTNIAETSLTIDGIVYVIDPGFAKQKVYNPRVRVESLLVSPISKASAHQRSGRAGRTQPGKCFRLYTEKSFNNDLQPQTYPEILRSNLANTVLTLKKLGIDDLVHFDFMDPPAPETLMRALEVLNYLGALDDEGNLTKLGEIMSEFPLDPQMGKMLVVSPEFKCSNEILSIAAMLSVPNCFVRPREAQKAADEAKARFGHIDGDHLTLLNVYHAYKQNNEDQSWCYENFVNQRALKSADNVRQQLSRIMARFNLKLCSTDFNSRDYYINIRKAMLAGYFMQVAHLERTGHYLTVKDNQVVHLHPSNCLDHKPEWVIYNEYVLTSRNFIRTVTDVRGEWIVDIAPHYYDLENFPNCEAKRVLEKLYKKREKDKDESRNKR

SEQ ID NO: 7300 - protein, 731 aa, Arnica chamissonis
MGTERKRKVSLFDVVDEDSAAAKFKKANAGAAVNGVNNIGGISLVNRWNGRPYSQRYYDILEKRKTLPVWHQKEEFLKALKENQTLILVGETGSGKTTQIPQFVLEAVELESADRRKKFMVACTQPRRVAAMSVSRRVAEEMDVTIGEEVGYSIRFEDCSSARTVLKYLTDGMLLREAMTDPLLERYKVIILDEAHERTLATDVLFGLLKEVLKNRPDLKLVVMSATLEAEKFQGYFFGAPLMKVPGRLHPVEIFYTQDPERDYLEAAIRTVVQIHLCEPPGDILVFLTGEEEIEDACRKITKEVGNLGDQVGPVKVVPLYSTLPPAMQQKIFEPAPSPLTEDGPAGRKIVISTNIAETSLTIDGIVYVIDPGFAKQKVYNPRVRVESLLVSPISKASAHQRSGRAGRTQPGKCFRLYTEKSFNNDLQPQTYPEILRSNLANTVLTLKKLGIDDLVHFDFMDPPAPETLMRALEVLNYLGALDDEGNLTKLGEIMSEFPLDPQMSKMLVVSSEFNCSNEILSISAMLSVPNCFVRPREAQKAADEAKSRFGHIDGDHLTLLNVYHAYKQNNEDQSWCYENFVNHRALKSADNVRQQLARIMARFNLKLCSTDFNSRDYYINIRKAMLAGYFMQVAHLERTGHYLTVKDNQVVHLHPSNCLDHKPEWVIYNEYVLTSRNFIRTVTDVRGEWIVDIAPHYYDLENFPNCEAKRVLERMYRKREKDKEESRNKR

SEQ ID NO: 7301 - protein, 730 aa, Prunus persica
MGTERKRKVSLFDVVDETSVSSAKMSKSNGGAGATANHNAVSNLINRWTGKPYSQRYYEILEKRKTLPVWHQKEEFLQALKASQSLILVGETGSGKTTQIPQFVLEAVDSETPDKRRKMMIACTQPRRVAAMSVSRRVAEEMDVTIGEEVGYSIRFEDCSSARTVLKYLTDGMLLREAMTDPLLERYSVIILDEAHERTLATDVLFGLLKEVLRNRPDLKLVVMSATLEAEKFQGYFSGAPLMKVPGRLHPVEIFYTEEPERDYLEAAIRTVVQIHMYETPGDILVFLTGEEEIEDACRKINKEVGNLGDQAGPVKVVPLYSTLPPAMQQKIFDPAPPPINEGGIPGRKIVVSTNIAETSLTIDGIVYVIDPGFAKQKVYNPRVRVESLLVSPISKASAHQRSGRAGRTQPGKCFRLYTEKSFHNDLQPQTYPEILRSNLANTVLTLKKLGIDDLVHFDFMDPPAPETLMRALEVLNYLGALDDDGNLTKLGEIMSEFPLDPQMSKMLVVSPEFNCSNEILSISAMLSVPNCFVRPREAQKAADEAKARFGHIDGDHLTLLNVYHAYKQNNEDPSWCYENFVNQRALKSADNVRQQLVRIMARFSLKLCSTDFNSRDYYINIRKAMLAGYFMQVAHLERTGHYLTVKDNQVVHLHPSNCLDHKPEWVIYNEYVLTSRNFIRTVTDIRGEWLVDIAPHYYDLANFPQCEAKRVLEKLYKKREDRDENKNRK

SEQ ID NO: 7302 - protein, 723 aa, Eutrema halophilum
MGTERKRKVSLFDVMDDPSVPAKNVKANGLADVHSLINKWNGKPYSPKYYEILEKRRTLPVWLQKEEFLRTLKDNQTLILVGETGSGKTTQIPQFVIDAVDAETPDKRRKWLVGCTQPRRVAAMSVSRRVADEMDVAIGEEVGYSIRFEDCSGPRTVLKYLTDGMLLREAMADPLLERYKVIILDEAHERTLATDVLFGLLKEVLRNRPDLKLVVMSATLEAEKFQEYFSGAPLMKVPGRLHPVEIFYTQEPERDYLEAAIRTVVQIHMCEPPGDILVFLTGEEEIEDACRKINKEVGNLGDQVGPVKAVPLYSTLPPAMQQKIFDPAPEPLTEGGPPGRKIVVSTNIAETSLTIDGIVYVIDPGFAKQKVYNPRIRVESLLVSPISKASAHQRSGRAGRTRPGKCFRLYTEKSFNNDLQPQTYPEILRSNLANTVLTLKKLGIDDLVHFDFMDPPAPETLMRALEVLNYLGALDDEGNLTKTGEIMSEFPLDPQMAKMLIVSPEFNCSNEILSVSAMLSVPNCFIRPREAQKAADEAKARFGHIDGDHLTLLNVYHAFKQNNEDPNWCYENFINSRAMKSADNVRQQLVRIMSRFNLKMCSTDFNSRDYYINIRKAMLAGYFMQVAHLERTGNYLTVKDNQVVHLHPSNCLDHKPEWVIYNEYVLTSRNFIRTVTDIRGEWLVDVAPHYYDLSNFPNCEAKRVLEKLYKKREREKEESKNRK

SEQ ID NO: 7303 - protein, 728 aa, Aquilegia formosa
MGTERKRKVSLFDVVDETSVSAKIVKLNGSGGGLVYTNSQTNNKWNGRPYSANYYSILEKRKTLPVWQQKEDFLQALNANQTLILVGETGSGKTTQIPQFVLDAVNLETPDKRKKMMVACTQPRRVAAMSVSRRVAEEMDVTIGEEVGYSIRFEDCSSGKTVLKYLTDGMLLREAMTDPLLERYKVIILDEAHERTLATDVLFGLLKEVLRNRSDLKVVVMSATLEAEKFQSYFSGAPLMKVPGRLHPVEIFYTQEPERDYLEAAIRTVVQIHMCEPVGDILVFLTGEEEIEDACRKINKEIANLGDQVGPVKVVPLYSTLPPAMQQKIFDAAPPALNDNGPPGRKIVVSTNIAETSLTIDGIVYVIDPGFAKQKVYNPRIRVESLLVSPISRASAHQRSGRAGRTQPGKCFRLYTERSFNNDLQPQTYPEILRSNLANTVLTLKKLGIDDLVHFDFMDPPAPETLMRALEVLNYLGALDDEGNLTKLGEIMSEFPLDPQMSKMLVASTEFNCSNEILSVSAMLSVPNCFVRPREAQKAADEAKARFGHIDGDHLTLLNVYHAYKQNNEDSQWCYDNFVNYRAMKSADNVRQQLVRIMARFNLKLCSTDFNSRDYYVNIRKAMLAGYFMQVAHLERTGQYLTVKDNQVVHLHPSNCLDHKPEWVIYNEYVLTSRNFIRTVTDVRGDWLVDIAPHYYDLANFPTCEAKRVLEKLYKKREKERDESKSRK

SEQ ID NO: 7304 - protein, 729 aa, Arabidopsis thaliana
MGTERKRKVSLFDVMEDPSLSSKNTKSNGLGLAAAAGGGSNLINKWNGKAYSQRYFEILEKRRDLPVWLQKDDFLNTLNSNQTLILVGETGSGKTTQIPQFVLDAVVADNSDKGRKWLVGCTQPRRVAAMSVSRRVADEMDVSIGEEVGYSIRFEDCTSSRTMLKYLTDGMLLREAMADPLLERYKVIILDEAHERTLATDVLFGLLKEVLRNRPDLKLVVMSATLEAEKFQEYFSGAPLMKVPGRLHPVEIFYTQEPERDYLEAAIRTVVQIHMCEPPGDILVFLTGEEEIEDACRKINKEVSNLGDQVGPVKVVPLYSTLPPAMQQKIFDPAPVPLTEGGPAGRKIVVSTNIAETSLTIDGIVYVIDPGFAKQKVYNPRIRVESLLVSPISKASAHQRSGRAGRTRPGKCFRLYTEKSFNNDLQPQTYPEILRSNLANTVLTLKKLGIDDLVHFDFMDPPAPETLMRALEVLNYLGALDDEGNLTKTGEIMSEFPLDPQMSKMLIVSPEFNCSNEILSVSAMLSVPNCFVRPREAQKAADEAKARFGHIDGDHLTLLNVYHAYKQNNEDPNWCFENFVNNRAMKSADNVRQQLVRIMSRFNLKMCSTDFNSRDYYVNIRKAMLAGYFMQVAHLERTGHYLTVKDNQVVHLHPSNCLDHKPEWVIYNEYVLTTRNFIRTVTDIRGEWLVDVAQHYYDLSNFPNCEAKRALEKLYKKREREKNESKNRK

SEQ ID NO: 7305 - protein, 723 aa, Brassica rapa
MGTERKRKVSLFDVMEDPSAKNNKSNVLGAASAAAGINKWNGKPYSQRYYDILEKRRDLPVWLQKDEFLRTLQSSQTLILVGETGSGKTTQIPQFVLDAVEAENTNKHKKWLVGCTQPRRVAAMSVSRRVADEMDVAIGEEVGYSIRFEDCSGPRTMLKYLTDGMLLREAMADPLLERYKVIILDEAHERTLATDVLFGLLKEVLRNRPDLKLVVMSATLEAEKFQEYFSGAPLMKVPGRLHPVEIFYTQEPERDYLEAAIRTVVQIHMCEPPGDVLVFLTGEEEIEDACRKINKEVSNLGDQVGPVKVVPLYSTLPPAMQQKIFDPAPEPLTEGGPAGRKIVVSTNIAETSLTIDGIVYVIDPGFAKQKVYNPRIRVESLLVSPISKASAHQRSGRAGRTRPGKCFRLYTEKSFNNDLQPQTYPEILRSNLANTVLTLKKLGIDDLVHFDFMDPPAPETLMRALEVLNYLGALDDEGNLTRTGEIMSEFPLDPQMSKMLIVSPEFNCSNEILSVSAMLSVPNCFVRPREAQKAADEAKSKFGHIDGDHLTLLNVYHAYKQNNEDPNWCFENFVNNRAMKSADNVRQQLVRIMSRFNLKMCSTDFNSRDYYVNIRKAMLSGYFMQVAHLERTGHYLTVKDNQVVHLHPSNCLDHKPEWVIYNEYVLTTRNFIRTVTDIRGDWLVDVAPHYYDLSNFPNCEAKRVLEKLYKKRERERNESKNRK

SEQ ID NO: 7306 - protein, 727 aa, Helianthus annuus
MGTERKRKVSLFDVVDDSSTAKLNKANGGAAVHGVDGMPVVNRWNLRPYSQRYYDILEKRKTLPVWHQKEEFLKALRENQTLILVGETGSGKTTQIPQFVLEAVELESADKRRKFMVGCTQPRRVAAMSVSRRVAEEMDVTIGEEVGYSIRFEDCSSAKTVLKYLTDGMLLREAMTDPLLERYKVIILDEAHERTLATDVLFGLLKEVLKNRPDLKLVVMSATLEAEKFQGYFFGAPLMKVPGRLHPVEIFYTQEPERDYLEAAIRTVVQIHMCEPPGDILVFLTGEEEIEDACRKITKEVGNLGDQVGPVKVVPLYSTLPPAMQQKIFEPAPAPLTEGGPAGRKIVISTNIAETSLTIDGIVYVIDPGFAKQKVYNPRVRVESLLVSPISKASAHQRSGRAGRTQPGKCFRLYTEKSFNNDLQPQTYPEILRSNLANTVLTLKKLGIDDLVHFDFMDPPAPETLMRALEVLNYLGALDDEGNLTKLGEIMSEFPLDPQMGKMLVVSPEFKCSNEILSIAAMLSVPNCFVRPREAQKAADEAKARFGHIDGDHLTLLNVYHAYKQNNDDQSWCYENFVNHRAMKSADNVRQQLARIMARFNLKLCSTDFNSRDYYINIRKAMLAGYFMQVAHLERTGHYLTVKDNQVVHLHPSNCLDRKPEWVIYNEYVLTSRNFIRTVSEVRGEWIVDIAPHYYDLENFPNCEAKRALEKLYKKREKDKDESRNRR

SEQ ID NO: 7307 - protein, 499 aa, Vinca minor
MSATLEAEKFQGYFNGAPLMKVPGRLHPVEIFYTQEPERDYLEAAIRTVVQIHMYEPPGDILVFLTGEEEIEDACRKINKEVGNMGDQVGPVKVVPLYSTLPPAMQQRIFESAPPPLKEDGPAGRKIVVSTNIAETSLTIDGIVYVIDPGFAKQKVYNPRVRVESLLVSPISKASAHQRSGRAGRTQPGKCFRLYTEKSFNNDLQPQTYPEILRSNLANTVLQLKKLGIDDLVHFDFMDPPAPETLMRALEVLNYLGALDDDGNLTKLGEIMSEFPLDPQMSKMLVVSPEFNCSNEILSISAMLSAPNCFVRPRDNQKAADEAKARFGHIDGDHLTLLNVYHAYKQNKDDPNWCYDNFVNSRALKSADNVREQLQRIMTRFNLKLCSTDFNSRDYYLNIRKAMLAGYFMQVAHLERTGHYLTVKDNQVVHLHPSNCLDHKPEWVIYNEYVLTSRNFIRTVTDIRGEWLVDVAPHYYDLTNFPNCEAKRVLERLYKKREK

SEQ ID NO: 7308 - protein, 728 aa, Aquilegia formosa
MGTERKRKVSLFDVVDETSVAVAAAAGKLSKMNGAASLIQNLNLNRWNGRTYSQRYHDILEKRKTLPVWQQKDEFLQALHANQTLILVGETGSGKTTQIPQFVLEAIELDDKRKKMMVACTQPRRVAAMSVSHRVAEEMDVTIGEEVGYSIRFEDRSSAKTILKYLTDGMLLREAMTDPLLENYKVIILDEAHERTLATDVLFGLLKEVLRNRPDLKLVVMSATLEAEKFQAYFSGAPLMKVPGRLFPVEIFYTQEPERDYLEAAIRTVVQIHMCEPPGDILVFLTGEEEIEDACRKIAKEVGNIGDQVGPVKVVPLYSTLPPAMQQKIFEPAPPPVNEGGPPGRKIVVSTNIAETSLTIDGIVYVIDPGFAKQKVYNPRVRVESLLVSPISRASAHQRSGRAGRTQPGKCFRLYTERSFKNDLQPQTYPEILRSNLANTVLTLKKLGIDDLVHFDFMDPPAPETLMRALEVLNYLGALDDEGNLTKLGEIMSEFPLDPQMSKMLVVSPGFNCSNEILSISAMLSVPNCFVRPREAQKAADEAKAQFGHIDGDHLTLLNVYHAYKQNNEDPSWCYENFVNQRAMKNADNVRQQLLRIMARFNLKLCSTDFSSRDYYVNIRKAMLAGYFMQVAHLERIGHYLTVKDNQVVHLHPSNCLDHKPEWVIYNEYVLTSRNFIRTVTDVRGEWLVDIAPHYYDLENFPQCEAKRVLEKLYKKREKDREENKNRK

SEQ ID NO: 7309 - protein, 730 aa, Malus domestica
MGTERKRKVSLFDVVDETSISLAKMSKSNGGGGAAANQNAVSSIINRWTGKPYSQRYYEILEKRKTLPVWHQKEEFLQALKASQSLILVGETGSGKTTQIPQFVLEAVDSESSDKRKKMMVACTQPRRVAAMSVSRRVAEEMDVTIGEEVGYSIRFEDCSSSRTVLKYLTDGMLLREAMTDPLLERYSVIILDEAHERTLATDVLFGLLKEVLRNRPDLKVVVMSATLEAEKFQGYFSGAPLMKVPGRLHPVEIFYTEEPERDYLEAAIRTVVQIHMYETPGDILVFLTGEEEIEDACRKINKENGNLGDQVGPVKVVPLYSTLPPAMQQKIFDPAPPPVKEGGIPGRKIVVSTNIAETSLTIDGIVYVIDPGFAKQIVYNPRVRVESLLVSPISKASAHQRSGRAGRTQPGKCFRLYTEKSFQNDLQPQTYPEILRSNLANTVLTLKKLGIDDLVHFDFMDPPAPETLMRALEVLNYLGALDDDGNLTKLGEIMSEFPLDPQMSKMLVVSPEFSCSNEILSISAMLSVPNCFVRPREAQKAADEAKARFGHIDGDHLTLLNVYHAYKQNNEDPSWCYENFVNQRALKSADNVRQQLVRIMGRFNLKLCSTEFNSRDYYINIRKAMLAGYFMQVAHLEHTGHYLTVKDNQVVHLHPSNCLDHKPEWVIYNEYVLTSRNFIRTVMDIRGEWLIDIAPHYYDLANFPQCEAKRVLEKLYRKREDKDENKNRR

SEQ ID NO: 7310 - protein, 724 aa, Euonymus alatus
MGTERKRKVSLFDVVDETTVSKISKSNGLVPAINNSGVNNLVNPWTGRPYSQRYYEILEKRKTLPVWHQKEEFLQVLRANQVVVLVGETGSGKTTQIPQFVLDAVEIETPDRRKKMMIGCTQPRRVAAMSVSRRVAEEMDVTIGEEVGYSIRFEDCSGPRTVLKYLTDGMLLREAMTDPLLERYKVIILDEAHERTLATDVLFGLLKEVLKNRPDLKLVVMSATLEAEKFQGYFNGAPLMKVPGRLHPVEIFYTQEPERDYLEAAIRTIVQIHLCEPPGDILVFLTGEEEIEDACRKISKEIANLGDQVGPVKAVPLYSTLPPAMQQKIFDPAPPPLTEGGPPGRKIVVSTNIAETSLTIDGIVYVIDPGFSKQKVYNPRVRVESLLVSPISKASAHQRSGRAGRTQPGKCFRLYTEKSFNDNLQPQTYPEILRSNLANTVLTLKKLGIDDLVHFDFMDPPAPETLMRALEVLNYLGALDDDGNLTKVGEIMSEFPLDPQLSKMLVVSPEFNCSNEILSISAMLSVPNCFVRPKEAQKAADEAKARFGHIDGDHLTLLNVYHAYKQNNEDPSWCYENFVNHRALKGADNVRQQLVRIMARFNLKLCSTDFNSRDYYVNIRKAMLAGYFMQVAHMERTGHYLTVKDNQVVHLHPSNCLDHKPEWVIYNEYVLTSRNFIRTVTDIRGEWLVDIAPHYYDLSNFPQCEAKRKLEKLYKKREDNKSKK

SEQ ID NO: 7311 - protein, 728 aa, Populus trichocarpa
MGTERKRKVSLFDVVDETSLSAKIVKSNGAMGNNNNGGSSLINRWNGKPYSQRYYDILEKRKNLPVWHQKEDFLQVLKKNQAIILVGETGSGKTTQIPQFVLEAVDLESPDKRRKMMIACTQPRRVAAMSVSRRVAEEMDVTIGEEVGYSIRFEDCSSAKTVLKYLTDGMLLREAMTDPLLERYKVIILDEAHERTLSTDVLFGLLKEVLKNRPDLKLVVMSATLEAEKFQGYFGEAPLMKVPGRLHPVEIFYTQDPERDYLEAAIRTVVQIHLCEPLGDILVFLTGEEEIEDACRKITKEIGNLGDQVGPVKVVPLYSTLPPAMQQKIFEPAPPPLQEGGPSGRKIVVSTNIAETSLTIDGIVYVIDPGFSKQKVYNPRVRVESLLVSPISKASAHQRSGRAGRTQPGKCFRLYTEKSFNQDLQPQTYPEILRSNLANTVLTLKKLGIDDLVHFDFMDPPAPETLMRALEVLNYLGALDDEGNLTKLGEIMSEFPLDPQLSKMLVVSPEFNCSNEILSISAMLSVPNCFVRPREAQKAADEAKARFGHIDGDHLTLLNVYHAYKQNNEDPSWCYENFVNHRALKAADNVRQQLVRIMARFNLKLCSTDFNSRDYYINIRKSILAGYFMQVAHLEQSGHYLTVKDNQVVHLHPSNCLDHKPEWVIYNEYVLTSRNYIRTVLDIRGEWLVDIAPHYYDLQNFPQCEAKRVLEKLYRKREREKEENRNRK

SEQ ID NO: 7312 - protein, 379 aa, Ambrosia trifida
MGTERKRKVSLFDVVDDSSTAKLTKSNGVDNMSTVNRWNLRPYSQRYYDILEKRKTLPVWHQKEEFLKALRDNQTLILVGETGSGKTTQIPQFVLEAVELESADRRKKFMVGCTQPRRVAAMSVSRRVAEEMDVTIGEEVGYSIRFEDCSSAKTVLKYLTDGMLLREAMTDPLLERYKVIILDEAHERTLATDVLFGLLKEVLKNRPDLKLVVMSATLEAEKFQGYFFGAPLMKVPGRLHPVEIFYTQEPERDYLEAAIRTVVQIHMCEPPGDILVFLTGEEEIEDACRKITKEVGNLGDQVGPVKVVPLYSTLPPAMQQKIFEPAPPPLTEGGPAGRKIVISTNIAETSLTIDGIVYVIDPGFAKQKFITHVFELSRY

SEQ ID NO: 7313 - protein, 724 aa, Capsicum annuum
MGTERKRKVSLFDVVDDTATKKANLTLNGGNSMMASSINKWTGKPYSQRFYDILEKRKTLPVWHQKEEFLQALKSNQTLILVGETGSGKTTQIPQFVLDAVEVETADKRRKYMIGCTQPRRVAAMSVSRRVAEEMDVVIGEEVGYSIRFEDCTSARTVLKYLTDGMLLREAMADPLLERYKVIILDEAHERTLATDVLFGLLKEVLKNRPDLKLVVMSATLEAEKFQGYFYGAPLMKVPGRLHPVEIFYTQDPERDYLEAAIRTVVQIHTCEPPGDILVFLTGEEEIEDACRKISKEIGNMGDQVGPIKAVPLYSTLPPAMQQKIFEPAPPPVVEGGPPGRKIVVSTNIAETSLTIDGIVYVIDPGFAKQKVYNPRVRVESLLVSPISKASAHQRSGRAGRTQPGKCFRLYTEKSFHNDLQPQTYPEILRSNLANTVLTLKKLGIDDLVHFDFMDPPAPETLMRALEVLNYLGALDDDGNMTKLGEIMSEFPLDPQMGKMLVVSPEFNCSNEILSISAMLSVPNCFVRPREAQKAADEAKNRFGHIDGDHLTLLNVYHAYKQNQEDPQWCYENFINQRALKSADNVRQQLARIMARFNLKLCSTDFNSRDYYVNIRKAMLAGYFMQVAHLERTGHYLTVKDNQVVHLHPSNCLDHKPEWVIYNEYVLTSRNFIRTVTDIRGEWLVDIAPHYYDLANFPQCEAKRVLERLYKKREREKDESKSKK

SEQ ID NO: 7314 - protein, 726 aa, Arabidopsis thaliana
MGTERKRKISLFDVMDDPSAPAKNAKTSGLPDGGINSLINKWNGKPYSQRYYDILEKRRTLPVWLQKEEFLKTLNNNQTLILVGETGSGKTTQIPQFVIDAVDAETSDKRRKWLVGCTQPRRVAAMSVSRRVAEEMDVTIGEEVGYSIRFEDCSSPRTVLKYLTDGMLLREAMADPLLERYKVIILDEAHERTLATDVLFGLLKEVLKNRPDLKLVVMSATLEAEKFQDYFSGAPLMKVPGRLHPVEIFYTQEPERDYLEAAIRTVVQIHMCEPPGDILVFLTGEEEIEDACRKINKEVGNLGDQVGPIKVVPLYSTLPPAMQQKIFDPAPEPVTEGGPPGRKIVVSTNIAETSLTIDGIVYVIDPGFAKQKVYNPRIRVESLLVSPISKASAHQRSGRAGRTRPGKCFRLYTEKSFNNDLQPQTYPEILRSNLANTVLTLKKLGIDDLVHFDFMDPPAPETLMRALEVLNYLGALDDDGNLTKTGEIMSEFPLDPQMAKMLIVSPEFNCSNEILSVSAMLSVPNCFIRPREAQKAADEAKARFGHIEGDHLTLLNVYHAFKQNNEDPNWCYENFINNRAMKSADNVRQQLVRIMSRFNLKMCSTDFNSRDYYINIRKAMLAGYFMQVAHLERTGHYLTVKDNQVVHLHPSNCLDHKPEWVIYNEYVLTSRNFIRTVTDIRGEWLVDVASHYYDLSNFPNCEAKRVIEKLYKKREREKEESKKNRK

SEQ ID NO: 7315 - protein, 725 aa, Brassica napus
MGTERKRKVSLFDVMEDPSAKNNKSNVLGGAAAGISNLINKWNGKPYSQRYYDILEKRRDLPVWLQKDEFLRTLQSNQTLILVGETGSGKTTQIPQFVLDAVEAENTNKHKKWLVGCTQPRRVAAMSVSRRVADEMDVAIGEEVGYSIRFEDCSGPRTMLKYLTDGMLLREAMADPLLERYKVIILDEAHERTLATDVLFGLLKEVLRNRPDLKLVVMSATLEAEKFQEYFSGAPLMKVPGRLHPVEIFYTQDPERDYLEAAIRTVVQIHMCEPPGDVLVFLTGEEEIEDACRKINKEVSNLGDQVGPVKVVPLYSTLPPAMQQKIFDPAPEPLTEGGPAGRKIVVSTNIAETSLTIDGIVYVIDPGFAKQKVYNPRIRVESLLVSPISKASAHQRSGRAGRTRPGKCFRLYTEKSFNNDLQPQTYPEILRSNLANTVLTLKKLGIDDLVHFDFMDPPAPETLMRALEVLNYLGALDDEGNLTRTGEIMSEFPLDPQMSKMLIVSPEFNCSNEILSVSAMLSVPNCFVRPREAQKAADEAKSKFGHIDGDHLTLLNVYHAYKQNNEDPNWCFENFVNNRAMKSADNVRQQLVRIMSRFNLKMCSTDFNSRDYYVNIRKAMLSGYFMQVAHLERTGHYLTVKDNQVVHLHPSNCLDHKPEWVIYNEYVLTTRNFIRTVTDVRGDWLVDVAPHYYDLSNFPNCEAKRVLEKLYKKRERERNESKSRK

SEQ ID NO: 7316 - protein, 723 aa, Brassica napus
MGTERKRKVSLFDVMEDPSAKNNKSNVLGAASAAAGINKWNGKPYSQRYYDILEKRRDLPVWLQKDEFLRTLQSSQTLILVGETGSGKTTQIPQFVLDAVDAENTNKHKKWLVGCTQPRRVAAMSVSRRVADEMDVAIGEEVGYSIRFEDCSGPRTMLKYLTDGMLLREAMADPLLERYKVVILDEAHERTLATDVLFGLLKEVLRNRPDLKLVVMSATLEAEKFQEYFSGAPLMKVPGRLHPVEIFYTQEPERDYLEAAIRTVVQIHMCEPPGDVLVFLTGEEEIEDACRKINKEVSNLGDQVGPVKVVPLYSTLPPAMQQKIFDHAPEPLTEGGPAGRKIVVSTNIAETSLTIDGIVYVIDPGFAKQKVYNPRIRVESLLVSPISKASAHQRSGRAGRTRPGKCFRLYTEKSFNNDLQPQTYPEILRSNLANTVLTLKKLGIDDLVHFDFMDPPAPETLMRALEVLNYLGALDDEGNLTRTGEIMSEFPLDPQMSKMLIVSPEFNCSNEILSVSAMLSVPNCFVRPREAQKAADEAKSKFGHIDGDHLTLLNVYHAYKQNNEDPNWCFENFVNNRAMKSADNVRQQLVRIMSRFNLKMCSTDFNSRDYYVNIRKAMLSGYFMQVAHLERTGHYLTVKDNQVVHLHPSNCLDHKPEWVIYNEYVLTTRNFIRTVTDIRGDWLVDVAPHYYDLSNFPNCEAKRVLEKLYKKRERERNESKNRK

SEQ ID NO: 7317 - protein, 731 aa, Manihot esculenta
MGTERKRKVSLFDVVDETSISAKISKMNGAGGAAMNNNGNNNNLINRWTGKPYSQRYYEILEKRRTLPVWHQREEFLTALKKNQVLVLVGETGSGKTTQIPQFVLEAVDIETPDKRRKMMIGCTQPRRVAAMSVSRRVAEEMDVNIGEEVGYSIRFEDCSSARTVLKYLTDGMLLREAMTDPLLERYKVIILDEAHERTLATDVLFGLLKEVLRNRNDLKLVVMSATLEAEKFQGYFNDAPLMRVPGRLHPVEIFYTQEPERDYLEAAIRTVVQIHMYETPGDILVFLTGEEEIEDACRKITKEVGNMGDQVGPVKVVPLYSTLPPAMQQKIFEPAPLPLTEGGPAGRKIVVSTNIAETSLTIDGIVYVIDPGFAKQKVYNPRVRVESLLVSPISKASAHQRSGRAGRTQPGKCFRLYTEKSFNQDLQPQTYPEILRSNLANTVLTLKKLGIDDLVHFDFMDPPAPETLMRALEMLNYLGALDDDGNLTMLGEIMSEFPLDPQMGKMLVVSPEFNCSNEILSISAMLSVPNCFVRPREAQKAADEAKARFGHIDGDHLTLLNVYHAYKQNNEDSSWCYENFVNHRALKAADNVRQQLVRIMARFNLKLCSTDFNSRDYYVNIRKAMLAGYFMQVAHLERTGHYLTVKDNQVVHLHPSNCLDHKPEWVIYSEYVLTSRNFIRTVTDIRGEWLVDIAPHYYDLANFPNCEAKRVLEKLYRKREREKEENKNRK

SEQ ID NO: 7318 - protein, 333 aa, Chelidonium majus
MSTERKRKVSLFDVVDETSVSAKILKMNGGGGLVQNPLNNRWNGRPYSQRYFDILEKRKTLPVWQQKEEFLQVLKANQTLILVGETGSGKTTQIPQFVLEAVDNEYPDKRKKMMIACTQPRRVAAMSVSRRVAEEMDVTIGEEVGYSIRFEDCSSAKTVLKYLTDGMLLREAMTDPLLEHYKVIILDEAHERTLATDVLFGLLKEVLKNRPDLKLVVMSATLEAEKFQNYFSGAPLMKVPGRLHPVEIFYTAEPERDYLEAAIRTVVQIHQCEGPGDILVFLTGEEEIEDACRKINKEVGNLGDQVGPVKVVPLYSTLPPAMQQKIFDPAHPL

SEQ ID NO: 7319 - protein, 728 aa, Fragaria vesca
MGTERKRKVSLFDVVDESTVAAAKMNKLNGGGGGAMNQNPMSSVINRWTGKPYSQRYYEILEKRKTLPVWHQKEEFFQALKKSQSLILVGETGSGKTTQIPQFVLEAVDPSSDKSRKMVACTQPRRVAAMSVSRRVAEEMDVTIGEEVGYSIRFEDCSSARTVLKYLTDGMLLREAMTDPLLERYSVIILDEAHERTLATDVLFGLLKEVLKNRPDLKLVVMSATLEAEKFQGYFNGAPLMKVPGRLHPVEIFYTEEPERDYLEAAIRTVVQIHMYETPGDILVFLTGEEEIEDACRKINKEISNLGDQVGPVKVVPLYSTLPPAMQQKIFDAAPPPTTEGGPAGRKIVVSTNIAETSLTIDGIVYVIDPGFSKQKVYNPRVRVESLLVSPISKASAHQRSGRAGRTQPGKCFRLYTEKSFHNDLVPQTYPEILRSNLANTVLTLKKLGIDDLVHFDFMDPPAPETLMRALEVLNYLGALDDDGNLTKLGEIMSEFPLDPQMSKMLVVSPEFNCSNEILSISAMLSVPNCFVRPREAQKAADEAKARFGHIDGDHLTLLNVYHAYKQNNEDPSWCYENFVNQRALKSADNVRQQLVRIMARFNLKQCSTDFKSRDYYINIRKAMLAGYFMQVAHLERTGHYLTVKDNQVVHLHPSNCLDHKPEWVIYNEYVLTSRNFIRTVTDIRGEWLVDIAPHYYDLANFPQCEAKRVLEKLYRKRDDKEDNRNRK

SEQ ID NO: 7320 - protein, 733 aa, Silene vulgaris
MGTERKRKVSLFDVVDESAIPGNNNNKLLKSNGTMFNAAAANLNPSVNPWNLRPYSARFFEILEKRKSLPVWQQKKDFLDVLKNNQTIILVGETGSGKTTQIPQFVLEAVELETADKRKKMMVACTQPRRVAAMSVSRRVAEEMDVTLGEEVGYSIRFEDCSSAKTVLKYLTDGMLLREAMTDPLLERYKVIVLDEAHERTLATDVLFGLLKEVLKNRPDLKLVVMSATLEAEKFQGYFSDAPLMKVPGRLHPVEIFYTQEPERDYLEAAIRTVVQIHMCEPVGDILVFLTGEEEIEDACRKINKEVTNLGDQVGPVKVVPLYSTLPPAMQQKIFEAAPPPVKEGGPAGRKIVVSTNIAETSLTIDGIVYVIDPGFSKQKVYNPRVRVESLLVSPISKASAHQRAGRAGRTQPGKCFRLYTEKSFHNDLQPQTYPEILRSNLANTVLTLKKLGIDDLVHFDFMDPPAPETLMRALEVLNYLGALDDEGNLTKLGTIMSEFPLDPQMAKMLVVSPEFNCSNEILSISAMLSVPNCFVRPREAQKAADEAKARFGHIDGDHLTLLNVYHAFKQNQEDSNWCYENFINFRAMKSAENVRMQLERIMVRYNLKCCSTNFNSRDYYLNIRKAMLAGYFMQVAHLERTGHYLTVKDNQVVHLHPSNCLDHKPEWVIYNEYVLTSRSFIRTVTDIRGEWLVDIAPHYYDLINFPNCEAKRVLEKLYKKREKDREESKNKS

SEQ ID NO: 7321 - protein, 724 aa, Valeriana officinalis
MGSERKRKISLFDVVDDTSSLSAKSLKSNNGTMMPLLNRWNGRPYSQRYYEILEVRKNLPVWHQKDEFLKVLKANQTLILVGETGSGKTTQIPQFVLEAIEVESADKRRKFMVGCTQPRRVAAMSVSRRVAEEMDVTIGEEVGYSIRFEDCSSARTVLKYLTDGMLLREAMTDPLLERYKVIILDEAHERTLATDVLFGLLKEVLKNRPDLKLVVMSATLEAEKFQGYFNGAPLMKVPGRLHPVEIFYTQEPERDYLEAAIRTVVQIHVSEPPGDVLVFLTGEEEIEDACRKITKEVGNMGDSVGPVKVVPLYSTLPPAMQQKIFDAAPPPSFQGGPAGRKIVVSTNIAETSLTIDGIVYVIDPGFAKQKVYNPRVRVESLLVSPISKASAHQRSGRAGRTQPGKCFRLYTEKSFNTDLQPQTYPEILRSNLANTVLTLKKLGIDDLVHFDFMDPPAPETLMRALEVLNYLGALDDEGNLTKLGEIMSEFPLDPQMAKMLVVSAEFNCSNEILSISAMLSVPNCFVRPREAQKAADEAKARFGHIDGDHLTLLNVYHAYKQNNEDQSWCYENFVNQRALKSADSVRQQLARIMSRFNLKLCSTDFNSRDYYVNIRKAMLSGYFMQVAHLERTGHYLTVKDNQVVHLHPSNCLDHKPEWVIYNEYVLTSRNFIRTVLDVRGEWLIDIAPHYYDLGNFPNCEAKRAIEKLYKNRERKEDGKNRKYA

SEQ ID NO: 7322 - protein, 701 aa, Amorphophallus konjac
VSAKWAKVNGATVPPGINRWTGRPYSQRYQDILEKRKTLPVWQQKDEFLRVVKDNQTLILVGETGSGKTTQIPQFVLELDDLGKRPMVACTQPRRVAAMSVSRRVAEEMDVTIGEEVGYSIRFEDCSSNKTILKYLTDGMLLREAMADPLLERYKVIILDEAHERTLATDVLFGLLKEVLKNRPDLKLVVMSATLEAEKFQAYFSSAPLMKVPGRLHPVEILYTQDPERDYLEAAIRTVVQIHMCEPPGDILVFLTGEEEIEDACKKITKEVNNLGDQVGLVKAVPLYSTLPPAMQQKIFEPAPTPLKDDGPPGRKIVVSTNIAETSLTIDGIVYVIDPGFSKQKVYNPRIRVESLLVSPISKASAHQRAGRAGRTQPGKCFRLYTEKSFHNDLQPQTYPEILRSNLANTVLTLKKLGIDDLVHFDFMDPPAPETLMRALEVLNYLGALDDDGNLTKLGEIMSEFPLDPQMSKMLVVSPEFNCSNEILSVSAMLSVPNCFLRPREAQKAADEAKARFGHIDGDHLTLLNVYHAYKQNNEDPSWCYENFINQRTLKAADNVRQQLVRIMARFNLKLCSTDFNNRDYYVNIRKATLAGYFMQVAHLERTGHYLTVKDNQVVHLHPSTCLDHKPEWVIYNEFVLTSRNFIRTVMDVRGEWLVDIAPHYFDLSNFPPCEAKRVLERLYNKREKERGDGKNRKTLA

SEQ ID NO: 7323 - protein, 716 aa, Pinus pinaster
MGSERKRKLSLFDVVDEGAITKKLNPNGVPGINRWNGRPYSQRYYEILEKRKTLPVWQQKQEFLDTLEKNQTMILVGETGSGKTTQIPQFVVEAGYTSNRKQIACTQPRRVAAMSVSRRVAEEMDVTIGEEVGYSIRFEDCSSSKTVLKYLTDGMLLREAMTDPLLERYRVIILDEAHERTLATDVLFGLLKEVLRNRQDLKLVVMSATLEAEKFQAYFNVAPLMKVPGRLHPVEIFYTQEPERDYLEAAIRTVVQIHTCETPGDILVFLTGEEEIEDACKKITKEIQNLGDQVGPVKAVPLYSTLPPAMQQKIFEPAPPPLREGGPPGRKVVVSTNIAETSLTIDGIVYVIDPGFAKQKVYNPRIRVESLLVSPISKASAHQRSGRAGRTQPGKCFRLYTEKSFHNDLQAQTYPEILRSNLANVVLNLKKLGIDDLVHFDFMDPPAPETLMRALETLNYLGALDDEGNLTKLGELMSEFPLDPQMSKMLVVSPEFNCSNEILSITAMLSVPNCFLRPREAQKAADEAKARFAHIDGDHLTLLNVYHAYKQNNEDPTWCYENFINTRALKSADNVRQQLVRIMNRYNLKLCSTDFNSRDYYVNIRKAMLAGYFMHAAHMERTGHYLTVKDNQIVHLHPSNCLDHKPEWVIYNEYVLTSRNFIRTVTDVRGEWLIDIAPHYYDLSNFPQCEARRVLERIYIKRERERSESKSKNKSS

SEQ ID NO: 7324 - protein, 716 aa, Pinus taeda
MGSERKRKLSLFDVVDEGAIAKKLNPNGVPGINRWNGRPYSQRYYEILEKRKTLPVWQQKQEFLDTLEKNQTMILVGETGSGKTTQIPQFVVEAGYTSNRKQIACTQPRRVAAMSVSRRVAEEMDVTIGEEVGYSIRFEDCSSSKTVLKYLTDGMLLREAMTDPLLERYRVIILDEAHERTLATDVLFGLLKEVLRNRQDLKLVVMSATLEAEKFQAYFNVAPLMKVPGRLHPVEIFYTQEPERDYLEAAIRTVVQIHTCETPGDILVFLTGEEEIEDACKKITKEIQNLGDQVGPVKAVPLYSTLPPAMQQKIFEPAPPPLREGGPPGRKVVVSTNIAETSLTIDGIVYVIDPGFAKQKVYNPRIRVESLLVSPISKASAHQRSGRAGRTQPGKCFRLYTEKSFHNDLQAQTYPEILRSNLANVVLNLKKLGIDDLVHFDFMDPPAPETLMRALETLNYLGALDDDGNLTKLGELMSEFPLDPQMSKMLVVSPEFNCSNEILSITAMLSVPNCFLRPREAQKAADEAKARFAHIDGDHLTLLNVYHAYKQNNEDPTWCYENFINTRALKSADNVRQQLVRIMNRYNLKLCSTDFNSRDYYVNIRKAMLAGYFMHAAHMERTGHYLTVKDNQIVHLHPSNCLDHKPEWVIYNEYVLTSRNFIRTVTDVRGEWLIDIAPHYYDLSNFPQCEARRVLERIYIKRERERSESKSKNKSS

SEQ ID NO: 7325 - protein, 728 aa, Populus trichocarpa
MGTERKRKVSLFDVVDEASVSAKLLKSNGATNNNNNEGSSSINRWNGKPYSQRYYEILEKRKNLPVWHQKEDFLQVLKKNQVLVLVGETGSGKTTQIPQFVLEAVELESSDRRRKMMIGCTQPRRVAAMSVSRRVAEEMDVTIGEEVGYSIRFEDCSGARTVLKYLTDGMLLREAMTDPLLERYKVIILDEAHERTLATDVLFGLIKEVLKNRPDLKLVVMSATLEAEKFQGYFCEAPLMKVPGRLHPVEIFYTQEPERDYLEAAIRTVVQIHLCEPHGDILVFLTGEEEIEDACRKITKEIGNLGDQVGPVKIVPLYSTLPPAMQQKIFEPAPPPLQEGGPSGRKIVVSTNIAETSLTIDGIVYVIDPGFSKQKVYNPRVRVESLLVSPISKASAHQRSGRAGRTQPGKCFRLYTERSFNQDLQPQTFPEILRSNLANTVLTLKKLGIDDLVHFDFMDPPAPETLMRALEVLNYLGALDDEGNMTKLGEIMSEFPLDPQLSKMLVVSPEFNCSNEILSISAMLSVPNCFVRPREAQKAADEAKARFGHIDGDHLTLLNVYHAFKQNNEDPSWCYENFINHRALKAADNVRQQLVRIMARFNLRLCSTDFNSRDYYINIRKAILAGYFMQVAHLERSGHYLTVKDNQAVHLHPSNCLDHKPEWVIYNEYVLTSRNYIRTVLDIRGEWLVDIASHYYDLDNFPQCEAKRVLEKLYKKREREREDNKNRK

SEQ ID NO: 7326 - protein, 367 aa, Centaurea maculosa
  misc_feature (70)..(70): Xaa can be any naturally occurring amino acid
  misc_feature (102)..(102): Xaa can be any naturally occurring amino acid
  misc_feature (289)..(289): Xaa can be any naturally occurring amino acid
  misc_feature (331)..(331): Xaa can be any naturally occurring amino acid
  misc_feature (366)..(366): Xaa can be any naturally occurring amino acid
MGTERKRKVSLFDVVDEATATAKVNKANGGVAVHGINTTAAAAGAGMPLVNRWNGRPYSQRYYDILEKRXTLPVWHQKEEFLKALKDNQTLILVGETGSGKXTQIPQFVLEAVEVESADRRKKFMVGCTQPRRVAAMSVSRRVAEEMDVTIGEEVGYSIRFEDCSSARTVLKYLTDGMLLREAMTDPLLERYKVIILDEAHERTLATDVLFGLLKEVLKNRPDLKLVVMSATLEAEKFQGYFFGAPLMKVPGRLHPVEIFYTQEPERDYLEAAIRTVVQIHMCEPPGDXLVFLTGEEEIEDACRKITKEVANMGDQVGPVKVVPLYSHYLXLCSRRYLNLLHLRQQRAVLLVGRLSFQPTLQKPLXP

SEQ ID NO: 7327 - protein, 718 aa, Brassica rapa
MGTERKRKVSLFDVMDNPSAPKVAKFNGLVDCGMNKWNGKPYSAKYYEILEKRRTLPVWLQKEEFLKTLKDNQTIILVGETGSGKTTQIPQFVIDAVDAESSDRKWLVACTQPRRVAAMSVSRRVADEMDVAIGEEVGYSIRFEDCSSPRTVLKYLTDGMLLREAMADPLLERYKVIILDEAHERTLATDVLFGLLKEVLRNRPDLKLVVMSATLEAEKFQEYFSGAPLMKVPGRLHPVEIFYTQEPERDYLEAAIRTVVQIHMCEPPGDILVFLTGEEEIEDACRKINKEVGNLGDQVGPVKVVPLYSTLPPAMQQKIFDAAPEPVTKGGPPGRKIVVSTNIAETSLTIDGIVYVIDPGFAKQKVYNPRIRVESLLVSPISKASAHQRSGRAGRTRPGKCFRLYTEKSFNNDLQPQTYPEILRSNLANTVLTLKKLGIDDLVHFDFMDPPAPETLMRALEVLNYLGALDDEGNLTRTGEIMSEFPLDPQMAKMLIVSPEFNCSNEILSVSAMLSVPNCFLRPREYQKAADEAKAKFGHIDGDHLTLLNVYHAFKQNNEDPNWCYENYINNRAMKSADNVRQQLVRIMSRFNLKICSTDFNSRDYYINIRKAMLAGYFMQVAHLERAGSYLTVKDNQVVNLHPSNCLDHKPEWVIYNEYVLTTRNYIRTVTDIRGEWLVDVAPHYYDLTNFPNCEAKRVLEKLYKKREREKADSKNRK

SEQ ID NO: 7328 - protein, 716 aa, Pseudotsuga menziesii
MGSERKRKLSLFDVVDESALAKKINLNGVPGINRWNGRPYSQRYYEILEKRKTLPVWQQKQEFLDTLEKNQTMILVGETGSGKTTQIPQFVVEAGYTSNRKQIACTQPRRVAAMSVSRRVAEEMDVTIGEEVGYSIRFEDCSSSKTVLKYLTDGMLLREAMTDPLLERYRVIILDEAHERTLATDVLFGLLKEVLRNRQDLKLVVMSATLEAEKFQAYFNVAPLMKVPGRLHPVEIFYTQEPERDYLEAAIRTVVQIHTCETPGDILVFLTGEEEIEDACKKITKEIQNLGDQVGPVKAVPLYSTLPPAMQQKIFESAPPPLKEGGPPGRKVVVSTNIAETSLTIDGIVYVIDPGFAKQKVYNPRIRVESLLVSPISKASAHQRSGRAGRTQPGKCFRLYTEKSFHNDLQAQTYPEILRSNLANVVLNLKKLGIDDLVHFDFMDPPAPETLMRALETLNYLGALDDDGNLTKLGELMSEFPLDPQMSKMLVVSPEFNCSNEILSITAMLSVPNCFLRPREAQKAADEAKARFAHIDGDHLTLLNVYHAYKQNSEDPTWCYENFINTRALKSADNVRQQLVRIMNRYNLKLCSTDFNSRDYYVNIRKAMLAGYFMHAAHMERTGHYLTVKDNQIVHLHPSNCLDHKPEWVIYNEYVLTSRNFIRTVTDVRGEWLIDIAPHYYDLSNFPQCEARRVLERIYIKREREKAESKNKSKSS

SEQ ID NO: 7329 - protein, 718 aa, Brassica napus
MGTERKRKVSLFDVMDNPSAPKVAKFNGLVDCGMNKWNGKPYSAKYYEILEKRRTLPVWLQKEEFLKTLKDNQTIILVGETGSGKTTQIPQFVIDAVDAESSDRKWLVACTQPRRVAAMSVSRRVADEMDVAIGEEVGYSIRFEDCSSPRTVLKYLTDGMLLREAMADPLLERYKVIILDEAHERTLATDVLFGLLKEVLRNRPDLKLVVMSATLEAEKFQEYFSGAPLMKVPGRLHPVEIFYTQEPERDYLEAAIRTVVQIHMCEPPGDILVFLTGEEEIEDACRKINKEVGNLGDQVGPVKVVPLYSTLPPAMQQKIFDAAPEPVTKGGPPGRKIVVSTNIAETSLTIDGIVYVIDPGFAKQKVYNPRIRVESLLVSPISKASAHQRSGRAGRTRPGKCFRLYTEKSFNNDLQPQTYPEILRSNLANTVLTLKKLGIDDLVHFDFMDPPAPETLMRALEVLNYLGALDDEGNLTRTGEIMSEFPLDPQMAKMLIVSPEFNCSNEILSVSAMLSVPNCFLRPREYQKAADEAKAKFGHIDGDHLTLLNVYHAFKQNNEDPNWCYENYINNRAMKSADNVRQQLVRIMSRFNLKICSTDFNSRDYYINLRKAMLAGYFMQVAHLERAGSYLTVKDNQVVNLHPSNCLDHKPEWVIYNEYVLTTRNYIRTVTDIRGEWLVDVAPHYYDLTNFPNCEAKRVLEKLYKKREREKTDSKNRK

SEQ ID NO: 7330 - protein, 725 aa, Mimulus guttatus
MGTERKRKVSLFDVVDDTALQGKMPRANGFGGAALPENVNPWNGKQYSQRYFEILEKRKSLPVWHQKDEFFQALKANQTLILVGETGSGKTTQIPQFVLEAIKSETMDKGKKFMVGCTQPRRVAAMSVSRRVAEEMDVAIGEEVGYSIRFEDCSSARTVLKYLTDGMLLREAMTDPLLERYKVIILDEAHERTLATDVLFGLLKEVLRNRPDMKVVVMSATLEAEKFQGYFSGAPLMKVPGRLHPVEIFYTENPERDYLEAAIKTVYQIHTSEPPGDILVFLTGEEEIEDACRKIGKEIAKDGDQAGPVKIVPLYSTLPPAMQQKIFEAAPPPAKEGGPAGRKIVISTNIAETSLTIDGIVYVIDPGFAKQKVYNPRIRVESLLVSPISKASAHQRSGRAGRTQPGKCFRLYTEKSFHNDLVPQTYPEILRSNLANTVLTLKKLGIDDLVHFDFMDPPAPETLMRALEVLNYLGALDDEGNLTKLGEIMSEFPLDPQMGKMLVVSPEFNCSNEILSISAMLSVPNCFIRPRDAQKAADEAKARFGHVDGDHLTLLNVYHAYKQNKEDPQWCYDNFVNHRAMKSADNVRQQLARIMARFNLKLCSTDFSSRDYYVNIRKAMLAGYFMQVAHLEHSGHYLTVKDNQVVHLHPSNCLDHKPEWVIYNEYVLTSRNFIRTVTDIRGEWLVDIAPHYYDLSNFPNCEAKRQLEKLYKKRENSRDESRNRK

SEQ ID NO: 7331 - protein, 734 aa, Euphorbia peplus
MGTERKRKLSLFDVVDETSVSKITRATGWGVAAPPPIMNINGIANGNINRWNGRPYSQRYYDILEKRKTLPVWQQKDEFLKVLSASQVVVLVGETGSGKTTQIPQFVLEAAEIETPDRRRKMMIACTQPRRVAAMSVSRRVADEMDVTIGEEVGYSIRFEDCSGPKTVLKYLTDGMLLREAMTDPLLERYKVIVLDEAHERTLATDVLFGLLKEVLRNRPDLKLVVMSATLEAEKFQGYFNNAPLMRVPGRLHPVEILYTQEPERDYLEAAIRTVVQIHMYEGPGDILVFLTGEEEIEDACRKINKEISSHDGVGPVKVVPLYSTLPPAMQQKIFDPAPPPLVEGGPAGRKIVVSTNIAETSLTIDGIVYVIDPGFAKQKVYNPRVRVESLLVSPISKASAHQRSGRAGRTQPGKCFRLYTERSFEQDLQPQTYPEILRSNLANTVLTLKKLGIDDLVHFDFMDPPAPETLMRALELLNYLGALDDDGNLTKLGEIMSEFPLDPQMGKMLVVSPEFNCSNEILSICAMLSVPNCFVRPREAQKAADEAKARFGHIDGDHLTLLNVYHAYKQNGEEDPSWCYENFVNQRALRSADNVRQQLVRIMTRFNLKLCSTDFNSRDYYVNIRKAMLAGFFMQVAHLERTGHYLTVKDNQAVHLHPSNCLDHKPEWVIYSEYVLTSKNFIRTVTDIRGEWLVDIAPHYYDLANFPNCEGKRVLEKLYKKREREKDENKNKK

SEQ ID NO: 7332 - protein, 715 aa, Physcomitrella patens
MAGERKRKLSLFDVVDESVNGTEKMKANGGPVLNPHTGRPYSAKYFEILEKRRTLPVWQQKAEFLNILAKNQTMILVGETGSGKTTQIPQFVVEAGYTSNRKQVACTQPRRVAAMSVSRRVADEMDVTIGDEVGYSIRFEDCSGPKTTLKYLTDGMLLREAMTDPLLERYRVIILDEAHERTLATDVLFGLLKEVLKNRPDLKLVVMSATLEAEKFQAYFNGAPLMKVPGRLHPVEIFYTQEPERDYLEAAIRTVVQIHICEPAGDILVFLTGEEEIEDACKKIGREVQNLGDQVGPVKAVPLYSTLPPAMQQKIFDAAPPPAKDGGPPGRKIVVSTNIAETSLTIDGIVYVIDPGFAKQKVYNPRIRVESLLVSPISKASAHQRAGRAGRTQPGKCFRLYTEKSFQNDLQPQTYPEILRSNLANVVLTLKKLGIDDLVHFDFMDPPAPETLMRALELLNYLAALDDDGNLTKLGELMSEFPLDPQMSKMLVVSPEFNCSNEILSITAMLSVPNCFLRPRDAQKAADEAKARFSHIDGDHLTLLNVYHAYKQNGEDATWCYDNFINVRAMKSADNVRTQLVRIMNRYNLKMCSTDFNSRDYYVSIRKAMLAGYFMQVAHLERTGHYLTVKDNQMVHLHPSSCLDHKPEWVIYNEFVLTTRNFIRIVTDVRGEWLIDVAPHYYDLSNFPQCEARRVLERLYMKREREKSEANGGKR

SEQ ID NO: 7333 - protein, 724 aa, Plantago ovata
MGTERKRKVSLFDVVDESALAAKTIRMNNGTSNVSPSINKWNNKPYSQRYYDILEKRKSLPVWQQKEEFLKVLRENQTLILVGETGSGKTTQIPQFVLEAIQAENKDTGRKFMVGCTQPRRVAAMSVSRRVAEEMDVTIGEEVGYSIRFEDCSSAKTLLKYLTDGMLLREAMTDPLLERYKVIILDEAHERTLATDVLFGLLKEVLKNRPDLKLVVMSATLEAEKFQGYFGSAPLMKVPGRLHPVEIFYTQEPERDYLEAAIKTVYQIHAFEGPGDILVFLTGEEEIEDACKKLAKEISNAGDQVGPAKIVPLYSTLPPAMQQKIFDPAPPPAVEGGPPGRKIVISTNIAETSLTIDGIVYVIDPGFAKQKVYNPRIRVESLLVSPISKASAHQRSGRAGRTQPGKCFRLYTEKSFHNDLVPQTYPEILRSNLANTVLTLKKLGIDDLVHFDFMDPPAPETLMRALEVLNYLGALDDDGNMTKLGEMMSEFPLDPQMAKMLVVSPEFKCSNEILSISAMLSVPNCFIRPRDAQKAADEAKARFGHIDGDHLTLLNVYHAYKQNKEDPQWCYENFVNARAMKSADNVRQQLARIMGRFNLTMCSTDFNSRDYYVNIRKAMLAGYFMQVAHLERTGHYLTVKDNQTVHLHPSNCLDHKPEWVIYNEYVLTSRNFIRTVTDIRGEWLVDIAPHYYDLTNFPNCEAKRQLEKLYKKRENSREDSRNKK

SEQ ID NO: 7334 - protein, 721 aa, Abies balsamea
GLCEDRGSERKRKLSLFDVVDESTIAKKINPNGVPGINRWNGRPYSQRYYEILEKRKTLPVWQQKQEFIDTLEKNQTMILVGETGSGKTTQIPQFVVEAGYTSNRKQIACTQPRRVAAMSVSRRVAEEMDVTIGEEVGYSIRFEDCSSSKTVLKYLTDGMLLREAMTDPLLERYRVIILDEAHERTLATDVLFGLLKEVLRNRPDLKLVVMSATLEAEKFQAYFNVAPLMKVPGRLHPVEIFYTQEPERDYLEAAIRTVVQIHTCETPGDILVFLTGEEEIEDACKKITKEIQNLGDQVGPVKAVPLYSTLPPAMQQKIFESAPPPLKEGGPPGRKVVVSTNIAETSLTIDGIVYVIDPGFAKQKVYNPRIRVESLLVSPISKASAHQRSGRAGRTQPGKCFRLYTEKSFHNDLQAQTYPEILRSNLANVVLNLKKLGIDDLVHFDFMDPPAPETLMRALETLNYLGALDDDGNLTKLGELMSEFPLDPQMSKMLVVSPEFNCSNEILSITAMLSVPNCFLRPREAQKAADEAKARFAHIDGDHLTLLNVYHAYKQNNEDPTWCYENFINTRALKSADNVRQQLVRIMNRYNLKLCSTDFNSRDYYVNIRKAMLAGYFMHAAHMERTGHYLTVKDNQIVHLHPSNCLDHKPEWVIYNEYVLTSRNFIRTVTDVRGEWLIDIAPHYYDLSNFPQCEARRVLERIYIKREREKAESKSKIKSS

SEQ ID NO: 7335 - protein, 715 aa, Ceratodon purpureus
MAGERKRKLSLFDVVDEAANGAEKTKVNGGPVLNPYTSRPYSAKYFEILEKRRTLPVWQQKAEFLSILAKNQTMILVGETGSGKTTQIPQFVVEAGYTANRKQVACTQPRRVAAMSVSRRVADEMDVTIGDEVGYSIRFEDCTGPKTTLKYLTDGMLLREAMTDPLLERYRVIILDEAHERTLATDVLFGLLKEVLKNRPDLKLVVMSATLEAEKFQSYFNGAPLMKVPGRLHPVEIFYTQEPERDYLEAAIRTVVQIHICEPPGDILVFLTGEEEIEDACKKISREVQNLGDQVGPVKAVPLYSTLPPAMQQKIFDAAPPPAKEGGPPGRKIVVSTNIAETSLTIDGIVYVIDPGFAKQKVYNPRIRVESLLVSPISKASAHQRAGRAGRTQPGKCFRLYTEKSFQTDLQPQTYPEILRSNLANVVLTLKKLGIDDLVHFDFMDPPAPETLMRALELLNYLAALDDDGNLTKLGQLMSEFPLDPQMSKMLVVSPEFNCSNEILSITAMLSVPNCFLRPRDAQKAADEAKARFSHIDGDHLTLLNVYHAYKQNGEDATWCYDNFVNVRALKSADNVRTQLVRIMNRYNLKMCSTDFNSRDYYVNIRKAMLAGYFMQVAHLERTGHYLTVKDNQMVHLHPSSCLDHKPEWVIYNEFVLTTRNFIRIVTDVRGEWLIDIAPHYYDLSNFPQCEARRVLERLYLKREREKTETKTGKR

SEQ ID NO: 7336 - protein, 717 aa, Physcomitrella patens
MAGERKRKLSLFDVVDEAANGSEKSKGNGGGGPVLNPHTGRPYSAKYFEILEKRRTLPVWQQKAEFLSILAKNQTMILVGETGSGKTTQIPQFVVEAGYTTNRKQVACTQPRRVAAMSVSRRVADEMDVTIGDEVGYSIRFEDCSGPKTTLKYLTDGMLLREAMTDPLLERYRVIILDEAHERTLATDVLFGLLKEVLKNRPDLKLVVMSATLEAEKFQAYFSGAPLMKVPGRLHPVEIFYTQEPERDYLEAAIRTVVQIHICEPPGDILVFLTGEEEIEDACKKIGREVQNLGDQVGPVKAVPLYSTLPPAMQQKIFDAAPPPAKEGGPPGRKIVVSTNIAETSLTIDGIVYVIDPGFAKQKVYNPRIRVESLLVSPISKASAHQRAGRAGRTQPGKCFRLYTEKSFQNDLQPQTYPEILRSNLANVVLTLKKLGIDDLVHFDFMDPPAPETLMRALELLNYLAALDDDGNLTKLGELMSEFPLDPQMSKMLVVSPEFNCSNEILSVTAMLSVPNCFMRPRDAQKAADEAKARFSHIDGDHLTLLNVYHAFKQNGEDATWCFENFINARALKSADNVRTQLVRIMNRYNLKMCSTDFNSRDYYVNIRKAMLAGYFMQVAHLERTGHYLTVKDNQMVHLHPSSCLDHKPEWVLYNEFVLTTRNFIRIVTDVRGEWLIDVAPHYYDLSNFPQCEGRRVLERLYLKREREKTETKSGKR

SEQ ID NO: 7337 - protein, 687 aa, Flaveria ramosissima
VNKWNGRPYSQRYYDILEKRKTLPVWHQKEEFLTALKENQTLILVGETGSGKTTQIPQFVLDAVELESADRRKKFMVGCTQPRRVAAMSVSRRVAEEMDVTIGEEVGYSIRFEDCSSAKTVLKYLTDGMLLREAMTDPLLERYKVIILDEAHERTLATDVLFGLLKEVLKNRPDLKLVVMSATLEAEKFQGYFFGAPLMKVPGRLHPVEIFYTQEPERDYLEAAIRTVVQIHMCEPPGDILVFLTGEEEIEDACRKITKEIGNLGDQVGPVKVVPLYSTLPPAMQQKIFEPAPSPLTEGGPAGRKIVISTNIAETSLTIDGIVYVIDPGFAKQKVYNPRVRVESLLVSPISKASAHQRSGRAGRTQPGKCFRLYTEKSFNNDLQPQTYPEILRSNLANTVLTLKKLGIDDLVHFDFMDPPAPETLMRALEVLNYLGALDDEGNLTKLGEIMSEFPLDPQMGKMLVVSPEFNCSNEILSISAMLSVPNCFVRPREAQKAADEAKARFGHIDGDHLTLLNVYHAYKQNNEDQSWCYENFVNHRALKSADNVRQQLARIMARFNLKLCSTDFNSRDYYINIRKAMLAGYFMQVAHLERTGHYLTVKDNQVVHLHPSNCLDHKPEWVIYNEYVLTSRNFIRTVTDVRGEWIVDIAPHYYDLENFPNCEAKRVLEKLYKKREKDKAESKNRR

SEQ ID NO: 7338 - protein, 539 aa, Aristolochia fimbriata
MSSERKRKVSLFDVVDETTVSAKLANVNGSFTGGKANPWNGRPFSQRYFEILEKRKTLPVWQQKEEFIQTLRDNQTLILVGETGSGKTTQIPQFALEAFSHEPNKRKMIACTQPRRVAAMSVSRRVAEEMDVAIGEEVGYSIRFEDCSSAKTILKYLTDGMLLREAMTDPLLERYRVIILDEAHERTLATDVLFGLLKEVLKNRPDLKLVVMSATLEAEKFRGYFNEAPLMKVPGRLHPVEIFYTQEPERDYLEAAIRTVVQIHLCEPPGDILVFLTGEEEIEDACRKINKEVNNHGDQVGPIKVVPLYSTLPPTMQQKIFEPAPPALKEGGPPGRKIVVSTNIAETSLTIDGIVYVIDPGFAKQKVYNPRVRVESLLVSPISKASAHQRSGRAGRTQPGKCFRLYTEKSFSNDLQPQTYPEILRSNLANTVLTLKKLGIDDLVHFDFMDPPAPETLMRALEVLNYLGALDDEGNLTKLGEIMSEFPLDPQMSKMLVVSPEFNCSNEILSISAMLSDSCSYSVFYHEANGVRLSPLCIC

SEQ ID NO: 7339 - protein, 680 aa, Lotus japonicus
MGTERKRKVSLFDVVDDAAAKLVKSNGGAANNSLINHWNARPYSQRYFDILEKRKTLPVWHQKEDFLLTLRNNQTLILVGETGSGKTTQIPQFVLDDVVLESPDKRKKMMVACTQPRRVAAMSVSRRVAEEMDVTIGEEVGYSIRFEDCSSAKTVLKYLTDGMLLREAMTDPLLERYKVIILDEAHERTLATDVLFGLLKEVLKNRPDLKLVVMSATLEAEKFQGYFFGAPLMKVPGRLHPVEIFYTQEPERDYLEAAIRTVVQIHTCEPPGDILVFLTGEEEIEDACRKISKEVSNLGDQVGAVKAVPLYSTLPPAMQQKIFEPAPPPLKEGGPPGRKIVVSTNIAETSLTIDGIVYVIDPGFAKQKVYNPRVRVESLLVSPISKASAHQRSGRAGRTQPGKCFRLYTERSFNNDLQPQTYPEILRSNLANTVLTLKKLGIDDLVHFDFMDPPAPETLMRALEVLNYLGALDDEGNLTKLGEIMSEFPLDPLMSKMLVVSPEFNCSNEMLSIAAMLSVPNCFVRPREAQKAADEAKATFGHIDGDHLTLLNVYHAYKQNNEDPSWCYDNFVNHRALKSADNVRQQLLRIMGRFNLKLCSTDFNSRDYYVNIRKAMLSGYFMQVAHLERTGHYLTVKDNQVVHLHPSTCLDHKPEWVIYNEYVLTSRNFIRTVTDIRGEW

SEQ ID NO: 7340 - protein, 561 aa, Quercus alba
MGTERKRKVSLFDVVDESKIAKINGGAFSSSAAAMSNSVSIIGGGNSSNPAINSWTGRPYSQRYYEILEKRRGLPVWHQKEEFLQVLKANQTLILVGETGSGKTTQIPQFVLEAIDLETPDKRRKMMIACTQPRRVAAMSVSRRVAEEMDVTIGEEVGYSIRFEDCSSARTVLKYLTDGMLLREAMTDPLLERYKVIILDEAHERTLATDVLFGLLKEVLKNRPDLKLVVMSATLEAEKFQGYFFQAPLMKVPGRLHPVEIFYTEEPERDYLEAAIRTVVQIHMCETPGDILVFLTGEEEIEDACRKINKEVANMGDQVGPVKVVPLYSTLPPAMQQKIFEPAPPPVKEGGPAGRKIVVSTNIAETSLTIDGIVYVIDPGFAKQKVYNPRVRVESLLVSPISKASAHQRSGRAGRTQPGKCFRLYTEKSFQNDLQPQTYPEILRSNLANTVLTLKKLGIDDLVHFDFMDPPAPETLMRALEVLNYLGALDDDGNLTKLGEIMSEFPLDPQMSKMLVVSPEFNCSNEILSVSAMLSVSQYSLMKKMVSSRLYASADLRGPPL

SEQ ID NO: 7341 - protein, 561 aa, Solanum phureja
MGTERKRKVSLFDVVDDSAAKKLNGGLNGGNSMTASINKWNGKPYSQRFYDILEKRKTLPVWHQKEEFLQALKSNQTLILVGETGSGKTTQIPQFVLDAVEVETADKRRKYMIGCTQPRRVAAMSVSRRVAEEMDVVIGEEVGYSIRFEDCTSARTVLKYLTDGMLLREAMADPLLERYKVIILDEAHERTLATDVLFGLLKEVLKNRPDLKLVVMSATLEAEKFQGYFFGAPLMKVPGRLHPVEIFYTQDPERDYLEAAIRTVVQIHTCEPPGDILVFLTGEEEIEDACRKITKEIGNMGDQVGPVKPVPLYSTLPPAMQQKIFEPAPPPVVEGGPPGRKIVVSTNIAETSLTIDGIVYVIDPGFAKQKVYNPRVRVESLLVSPISKASAHQRSGRAGRTQPGKCFRLYTEKSFHNDLQPQTYPEILRSNLANTVLTLKKLGIDDLVHFDFMDPPAPETLMRALEVLNYLGALDDDGNMTRLGEIMSEFPLDPQMGKMLVVSPEFNCSNEILSISAMLSVSQYSLMKQMVSSRLYASADLQWASAVITNFFSSTQLLCPA

SEQ ID NO: 7342 - protein, 561 aa, Solanum lycopersicum
MGTERKRKVSLFDVVDDSAAKKLNGGLNGGNSMTASINKWNAKPYSQRFYDILEKRKTLPVWHQKEEFLQALKSNQTLILVGETGSGKTTQIPQFVLDAVEVETADKRRKYMIGCTQPRRVAAMSVSRRVAEEMDVVIGEEVGYSIRFEDCTSARTVLKYLTDGMLLREAMADPLLERYKVIILDEAHERTLATDVLFGLLKEVLKNRPDLKLVVMSATLEAEKFQGYFFGAPLMKVPGRLHPVEIFYTQDPERDYLEAAIRTVVQIHTCEPPGDILVFLTGEEEIEDACRKITKEIGNMGDQVGPVKAVPLYSTLPPAMQQKIFEPAPPPVVEGGPPGRKIVVSTNIAETSLTIDGIVYVIDPGFAKQKVYNPRVRVESLLVSPISKASAHQRSGRAGRTQPGKCFRLYTEKSFHNDLQPQTYPEILRSNLANTVLTLKKLGIDDLVHFDFMDPPAPETLMRALEVLNYLGALDDDGNMTRLGEIMSEFPLDPQMGKMLVVSPEFNCSNEILSISAMLSVSQYSLMKQMVSSRLYASADLQWASAVITNFFSSTQLLCPA

SEQ ID NO: 7343 - protein, 308 aa, Tabernaemontana elegans
QRYYEILEKRKTLPVWQQKEEFLRFLKENQTLILVGETGSGKTTQIPQFVLEAVEIESQDKRKKYMIGCTQPRRVAAMSVSRRVAEEMDVTIGEEVGYSIRFEDCSGARTVLKYLTDGMLLREAMTDPLLERYKVIILDEAHERTLATDVLFGLLKEVLKNRADLKLVVMSATLEAEKFQGYFNSAPLMKVPGRLHPVEIFYTQEPERDYLEAAIRTVVQIHMYEPPGDILVFLTGEEEIEDACRKINKEISNIGDQVGPVKAVPLYSTLPPAMQQVKFLEPRPLPHCLKVVLLGEKLFCQQILLKRL

SEQ ID NO: 7344 - protein, 529 aa, Hordeum vulgare
MGTERKRKVSLFDVVDKTSVSSKLGRAGINGAAAAAAANPSINRWNGRPYSARYLEILEKRRTLPVWQQKDEFLRVLRDNQTLILVGETGSGKTTQIPQFVLEAEGLSNRSMVACTQPRRVAAMSVSRRVAEEMDVTIGEEVGYSIRFEDCSSHKTVLKYLTDGMLLREAMADPLLERYKVIVLDEAHERTLATDVLFGLLKEVLKNRPDLKLVVMSATLEAEKFQGYFSGAPLMKVPGRLHPVEIFYTQEPERDYLEAAIRTVVQIHMCEPAGDILVFLTGEEEIEDACRKINKEVNNMGDQVGPVKVVPLYSTLPPAMQQKIFDPAPPPLKEGGPAGRKIVVSTNIAETSLTIDGIVYVIDPGFSKQKVYNPRIRVESLLVSPISKASAHQRAGRAGRTQPGKCFRLYTEKSFNGDLQPQTYPEILRSNLANTVLTLKKLGIDDLVHFDFMDPPAPETLMRALEVLNYLGALDDEGNLTSLGEMMSEFPLDPQMSKMLVISPRYNCSNEILSISAMLSGMSTNNFSL

SEQ ID NO: 7345 - protein, 281 aa, Pseudotsuga menziesii
MDPPAPETLMRALELLNYLGALDEDGSLTKLGQLMSEFPLDPQMSKMLVVSPNFNCSNEILSITAMLSVPNCFLRPREAQKAADEAKACFAHVDGDHLTLLNVYHAYKQNKEDPNWCYENFINTRALKVADNVRQQLVRIMTRYNLKLCSTDFKSHEYYLNLRKAMLAGYFMQVAHRERSGQYLTVKDNQIVQLHPSTCVDHKPEWVLYNEYVLTSSNFIRVVTDVRGEWLIDIASHYYDLSNFPQCEAKFVLERLYNKRERDKSGRKHKSKRTVHKSAVC

SEQ ID NO: 7346 - protein, 232 aa, Raphanus sativus
  misc_feature (221)..(221): Xaa can be any naturally occurring amino acid
  misc_feature (231)..(231): Xaa can be any naturally occurring amino acid
RYFDILEKRRDLPVWLQKDEFLRTLQSNQTLILVGETGSGKTTQIPQFVLDAVEAGKTDKHKKWLVGCTQPRRVAAMSVSRRVADEMDVTIGEEVGYSIRFEDCSGPRTMFKYLTDGMLLREAMADPLLERYKVIILDEAHERTLATDVLFGLLKEVLRNRPDLKLVVMSATLEAEKFQEYFSGAPLMKVPGRLHPVEIFYTQEPERDYLEAAIRLLFRYXCLSRLEMFLXS

SEQ ID NO: 7347 - protein, 285 aa, Podocarpus macrophillus
MASERKRKLSLFDVVDETTVSKKIVNATANGMPMVNRWTGRPFSQKYYEILEKRKTLPVWHQKQEFLDMLQKHQTMILVGETGSGKTTQIPQFVVEAGYTSNRKQIACTQPRRVAAMSVSRRVAEEMDVTIGEEVGYSIRFEDCSGSKTVLKYLTDGMLLREAMTDPLLERYRVIILDEAHERTLATDVLFGLLKEVLKNRPDLKLVVMSATLEAEKFQAYFSGAPLMKVPGRLHPVEIFYTQEPERDYLEAAIRTVVQIHMCEPAGDILVFLTGEEEIEDACKK

SEQ ID NO: 7348 - protein, 726 aa, Pinus taeda
MGYSENKEKVSFFEGVTEDVDTFNQTNANGMADVMNPWNKRPFSARYYEILDKRKTLPVWQQRHEFLDMLDKSQTLILVGETGSGKTTQIPQFVVEAGYTNNQKQIACTQPRRVAAMSVSRRVAEEMDVTIGEEVGYSIRFEDCSGPKTILKYLTDGMLLREAMTDPLLERYRVIILDEAHERTLATDVLFGLLKEVLKNRPDLKLIVMSATLEAEKFQAYFNGAPVMKVPGRLHPVEIFFTQEPENDYLEAAIKTVVQIHIHEPPGDILIFLTGEEEIEDACRKITREVQNLGDQTGPLKVVPLYSTLPPAMQQKIFEPAPPPAKEGGRPGRKIVVSTNIAETSLTIDGIVYVIDPGFSKQKVYNPRVRVESLLVSPISKASAHQRAGRAGRTRPGKCFRLYTERSFQNDLQAQTYPEILRSNLANVVLTLKKLGIDDLVHFDFMDPPAPETLMRALELLNYLGALDEDGCLTKLGQLMSEFPLDPQMSKMLVVSPEFNCSNEILSITAMLSVPNCFLRPREAQKAADEAKACFAHIDGDHLTLLNVYHAYKQNNEDPNWCYENFINSRALKVANNVRQQLTRIMTRHNLKLCSTDFKSHEYYPNIRKAMLAGYFMQVAHRERSGQYLTVKDNQIVQLHPSTCVDHKPEWVLYNEYVLTSSNFIRMVTDVRGEWLIDIAPHYYDLSNFPQCEARYVLERLYNKRERDKSVRKNKSKKIVLKSAVC

SEQ ID NO: 7349 - protein, 84 aa, Cichorium intybus
ENQTLILVGETGSGKTTQIPQFVLEAVEVESADRRKKFMVGCTQPRRVAAMSVSRRVAEEMDVTIGEEVGYSIRFEIAAVPKLS

SEQ ID NO: 7350 - protein, 97 aa, Unknown
  Sequence found in Organisms: Saccharum officinarum, Panicum virgatum
MAKRLIPSLNRVLVEKLLQPKKSAGGILLPETTKQLNAAKVIAVGPGDRDRDGKLIPVSLSEGDTVLLPEYGGTEVKLAEKEYLLFREHDILGKLEE

SEQ ID NO: 7351 - protein, 97 aa, Pennisetum glaucum
MAKRLIPSLNRVLVEKLLQPKKTAGGILLPETTKQLNAAKVIAVGPGDRGRDGKLIPVSLNEGDTVLLPEYGGTEVKLAEKEYLLFREHDILGKLEE

SEQ ID NO: 7352 - protein, 97 aa, Sorghum bicolor
MAKRLIPSLNRVLVEKLLQPKKSVGGILLPETTKQLNAANVIAVGPGDRDRDGKLIPVSLNEGDTVLLPEYGGTEVKLAEKEYLLFREHDILGKLEE

SEQ ID NO: 7353 - protein, 97 aa, Zea mays
MAKRLIPSLNRVLVEKLLKPSKSAGGILLPETTKQLNAAKVVAVGPGDRDRDGKLIPVSLSEGDTVLLPEYGGTEVKLAEKEYLLFREHDILGKLEE

SEQ ID NO: 7354 - protein, 97 aa, Cynodon dactylon
MAKRLIPSLNRVLVEKLVQPKKSPAGILLPETTKQLNAAKVIAIGPGERDRDGKLIPVSLKEGETVLLPEYGGTEVKLAEKEYLLYREHDILGKLED

SEQ ID NO: 7355 - protein, 98 aa, Oryza sativa
MAARRLIPSMNRVLVEKLLQPNKSAGGILLPETTKQLNSAKVVAVGPGERDRDGKLIPVSLKEGDTVLLPEYGGTEVKLAEKEYLLFREHDILGRLEE

SEQ ID NO: 7356 - protein, 97 aa, Avena sativa
MAKRLIPSLNRVLVEKLVQPNKTAAGILLPETTKQLNSAKVIAVGPGGRDRDGKLVPVSLKEGDTVLLPEYGGTEVKLAEKEYLLFGEHDILGRLEE

SEQ ID NO: 7357 - protein, 97 aa, Lolium multiflorum
MAKRLIPSLNRVLVEKVVQPNKTAAGILLPETTKQLNSAKVIAVGPGVPDRDGKLIPVSLKEGDTVLLPGYGGTEVKLAEKEYLLFGEHDILGRLEE

SEQ ID NO: 7358 - protein, 98 aa, Cenchrus ciliaris
MAKRLLPSLNRVLVEKLVQPKKTAGGILLPETSKQLNAAKVVAVGPGERDREGKLIPVALKEGDTVLLPEYGGTEVKLAADKEYLLFREHDILGTLVD

SEQ ID NO: 7359 - protein, 98 aa, Cynodon dactylon
MAKRLIPSLNRVLVEKLVQPKKTPGGILLPETSKQLNSGKVVAVGPGERDKDGKLIPVSLKEGDTVLLPEYGGLEVKLAPEKEYLLFREHDILGTLVD

SEQ ID NO: 7360 - protein, 98 aa, Setaria italica
MAKRLLPSLNRVLVEKLVQPKKTAGGILLPETSKQLNAAKVVAVGPGERDREGKLIPVALKEGDTVLLPEYGGTEVKLAADKEYLLFREPDILGTLVD

SEQ ID NO: 7361 - protein, 98 aa, Oryza sativa
MARRLIPSLNRVLVEKLVQPKKSAGGILLPETSKQLNSGKVVAVGPGERDKDGKLIPVALKEGDTVLLPEYGGLEVKLAAEKEYLLFREHDILGTLVD

SEQ ID NO: 7362 - protein, 98 aa, Panicum virgatum
MAKRLLPSLNRVLVEKLVQPKKTAAGILLPETSKQLNAAKVVAVGPGERDREGKLIPVALKEGDTVLLPEYGGTEVKLAADKEYLLFREHDILGTLVD

SEQ ID NO: 7363 - protein, 98 aa, Panicum virgatum
MAKRLLPSLNRVLVEKLVQPKKTAGGILLPETSKQLNAAKVVAVGPGERDREGKLIPVALKEGDTVLLPEYGGTEVKLAADKQYLLFREHDILGTLVD

SEQ ID NO: 7364 - protein, 109 aa, Pennisetum glaucum
MTGKAKPKKHTAKEIAAKIDAATTNRGGGKAGQADRLGQEKGGHAKLACPLCRTPAPDVKSMQIHHEARHPKLPFEPEKIVNLHSSTPAAASEATTSKPKPGVRGSLKK

SEQ ID NO: 7365 - protein, 98 aa, Eragrostis curvula
MAKRLIPSLNRVLVEKLVQPKKTPGGILLPETSKQLNSGKVVAVGPGERDKDGKLIPVALKEGDTVLLPEYGGLEVKLAPEKEYLLFREHDILGTLVD

SEQ ID NO: 7366 - protein, 98 aa, Unknown
  Sequence found in Organisms: Zea mays, Sorghum bicolor, Saccharum officinarum
MAKRLLPSLNRVLVEKLVQPKKTAGGILLPETSKQLNAAKVVAVGPGERDKAGNLIPVALKEGDTVLLPEYGGTEVKLAADKEYLLFREHDILGTLVD

SEQ ID NO: 7367 - protein, 100 aa, Brachypodium distachyon
MAAMKRLIPSFNRVLVEKVLQPKKSAGGILLPETSKQLNSGKVVAVGPGDRDKDGKLIPVGFKEGDHVLLPEYGGLEVKLGAEKEYLLFRENDILGTLHE

SEQ ID NO: 7368 - protein, 98 aa, Zea mays
MAKRLLPSLNRVLVEKLVQPKKTAGGILLPETSKQLNAAKVVAVGPGERDKAGNLIPVALKEGDTVLLPEYGGSEVKLAADKEYLLFREDDILGTLVD

SEQ ID NO: 7369 - protein, 426 aa, Panicum virgatum
MALRARLMGPGGGPRVLLLLSAAFTALLVASILLLPSLLLRTGGARGPGFLLSSPAAAAAEQQDPRYPVSFAYLISASSGDAARAARLLAALYHPANTYLLHLDREAPAGEHRRLAELVSARAVYARAGNVWVVGRPNLVTYRGPTMLTTTLHAVALLLRLRRSWDWFVNLSASDYPLVTQDDMMEAFAGLPRDLNFIQHTSHLGWKIKEAGAAGDPGHGAVRGRAGGAHPPGEHHHQPPEVAHGLQALHRVGVDDAVASLRGVRDHGVGQPAPDPPPVPRQHHLLAGVLLPDGGLQLAAVPQRHREPRPALHPVGQPAQAAPAAPHRQGLPPDAAQRRPLRAQVPGGRPGAGPDRPGHPAPAGARPVRLRRVVRRGRGRGRRRGAVRQPTGAREEGGRQGRRRVAPAQGAAGQGARPGEPTEKAV

SEQ ID NO: 7370 - protein, 430 aa, Panicum virgatum
MALRARLMGPGRGPRVLLLLSAAFTALLVASILLLPSLLLRTGGARGPSFLLSSPAAGDLQQEQQDQRYPVSFAYLISAASGDAARAARLLAALYHPANTYLLHLDREAPAGEHRRLAELVSARAVYARAGNVWVVGRPNLVTYRGPTMLTTTLHAVALLLRLRRRWDWFVNLSASDYPLVTQDDMMEAFAGLPRDLNFIQHTSHLGWKIKKRARPVILDTALYEDGRAELIRPENITTNLRRLPTAFKLYTGSAWTMLSRPFAEYVTMGWDNLPRTLLLYHANIVSSPEFYFQTVACNSLRFRNATVNHDLHFIRWDNPPKQHPLHLTARDYRRMLLSGAPFARKFREGDPVLDRIDRDILRRRGPGQFAYGGWCAGDGDGDGGAAALCGNPQEPRRKGAVRAGAGARRLKVLLGKALAPGNLRRRQCR

SEQ ID NO: 7371 - protein, 433 aa, Sorghum bicolor
MVMRPRAMGLSSIRREVLVSAVFTALLVASILLLPSLLLTGSTGPARRWPSFLSPSTAAEDKEQQARYPVRFAYLISASTGDAPRAARLLAALYHPANTYLLHLDREAPAEEHRRLAELVSGPGRGGVYARAGNVWIVGRPNLVTYRGPTMLTTTLHAVAVLLRLRRRWDWFINLSASDYPLVTQDDLMEAFAGLPRDLNFIQHTSHLGWKIKKRARPVILDTALYEDGRAELIRPVNITTNLRRLPTAFKLYTGSAWTMLSRSFAEYVTMGWDNLPRALLLYHANIVSSPEFYFQTVACNSRRFRNATVNSDLHFIRWDNPPKQHPLYLTSRDYRRMLLSGAAFARKFREGDPVLDRIDRDILRRREPGHFAYGGWCSDDGERGGAGAGALCSNPQEHGRRGAVKAGAGSRRLKAMLTKMLSPRNFRRQQCR

SEQ ID NO: 7372 - protein, 186 aa, Zea mays
MVMRARAMGLSSIRREVLVSAVFTALLVASILLLPSLLLTGAGPIRWPSLSPSKDAGIGEEEEQQARYPVTFAYLISASTGDASRAARLLAALYHPGNSYLLHLDREAPAEEHRRLAELVSGRGVYARAGNVWIVGRPNLVTYRGPTMLTTTLHAVAVLLRLRRRWDWFINLSASDYPLVTQDGTL

SEQ ID NO: 7373 - protein, 515 aa, Gossypium hirsutum
MAERPISETTLLSTQDSDLPQIQVSDSSLQCLREDGFSTFKDQAKGVDAPESSKTQILGFTLGTHEEKSTMDENGERINASLSVHTDCNNNEAEEEKFPDTPTSHEGMHYLHNKLLFFGKRQSGIEESLDGSVVTEMESGDPVRTIERLKTSLKAERKALSALYAELEEERSASAIAANQTMAMITRLQEEKAAMQMEALQYQRMMEEQSEYDQEALQLLNELMIKREKEKEELEKELEIYRKKVLYYEAKEKTRIMRISKDGSLGSGKSSAACSYAEDNDELSIDLNREAKDEDSSFSGNQESSSDAVGNLEEMALDCVNHISALDESLTEFEEERLSILDQLKALEDKLLTMGDDQFMEDLKSIQNSFDGLDEKNDLRSKEGNGFSKETSCGKTMASMAKSLLPFLDAADNGTEEGTMYGKQGESDSEPVVMQTYPGPELELDPKKLAIEEEVDHVYERLQALEEDKEFLKNCMSSIKKGDKGMDLLQEILQHLRDLRAVELRTRPLSGDVQG

SEQ ID NO: 7374 - protein, 266 aa, Sorghum bicolor
MVALTAGISVAAGVVFSPAGRRRGRGPDAFRCSASSAGERQALFSRIAPVYDLLNDVLSLGQHRTWKRICVSWSRVKMGDRVLDLCCGSGDLAFLLSQKVGLDGEVMAVDFSRQQLQTAADRQEQRWKLCYKNIKWIEGDALDLPFTDCYFDAVTVGYGLRNVVNKSKAMREIYRVLKPGSRASILDFNKSSSLFTASLQSWAIDNVVVPLASGYGLTEEYKYLKSSIAQYLTGEELEKLAKEAGFCAAKHYELGGGLMGNLVATR

SEQ ID NO: 7375 - protein, 268 aa, Setaria italica
MGTVTASISISAAAAVMSRPAGRRRRRGPAVFRCSSSTAGERQALFSRIAPVYDHLNDVLSLGQHRTWKRICVSWSRAKMGDRVLDLCCGSGDLAFLLSQKVGLDGEVMAVDFSRQQLQTAADRQEQRWKLCYKNIKWIEGDALDLPFTDCYFDAVTIGYGLRNVVDKSRAMQEIFRVLKLGSRASILDFNKSSSLFTASLQSWAIDNVVVPLASGYGLTEEYKYLKSSISQYLTGEELEKLAKEAGFSVAKHYELGGGLMGNLVATR

SEQ ID NO: 7376 - protein, 267 aa, Oryza sativa
MATLAAAISAGPAAPAPAARRRRRRGFAAVSCGSSSAADERQALFSRIAPVYDHLNDVLSLGQHRTWKRICVSWSRARRGDRVLDLCCGSGDLAFLLSQKVGLDGQVMAVDFSSQQLQTAASRQDQRWKPCYKNIKWIEGDALDLPFTDCYFDAVTVGYGLRNVVDKPKAMREIFRVLKPGSRASILDFNKSSSLFTTSLQSWMIDNVVVPLASGYGLTEEYKYLKSSILHYLTEKELEELAKEAGFSAAKHYELGGGLMGDLVATR

SEQ ID NO: 7377 - protein, 267 aa, Brachypodium distachyon
MGTLAAAISVVAVSPASSHAGGRRHRRGSVAIRCSSAANERQALFSRIAPVYDHLNDVLSLGQHRTWKRICVSWSMAKRGDRVLDLCCGSGDLAFLLSQKVGLDGEVMAVDFSRQQLQTAASRRDQRWNSCYKNINWIEGDALDLPFTDCYFDAVTVGYGLRNVVDKPKAMREIFRVLKPGTRASVLDFNKSSSFFTTSLQSWAIDNVVVPLASGYGLTEEYKYLKSSISQYLTGEELEKLAKEVGFSSAKHYELGGGLMGNLVTTR

SEQ ID NO: 7378 - protein, 263 aa, Hordeum vulgare
MGTVTIPVTAPATTAASHAGGRRRYVAVRCSSASDERQALFSRIAPVYDHLNDVLSLGQHRTWKRICVSWSKAKRGDRVLDLCCGSGDLAFLLSQKVGLDGEVMGVDFSGQQLQTAASRQDQRWKACYKNIKWIEGDALDLPFTDRYFDAVTVGYGLRNVVDKPKAMREILRVLKPGSRASVLDFNKSSSFFTASLQSWAIDNVVVPLASSYGLTEEYKYLKSSISQYLTGEELEKLAKEAGFSSAKHYELGGGLMGNLVATR

SEQ ID NO: 7379 - protein, 269 aa, Triticum aestivum
MGTLAAAIPVTAGATAPSRHAGGRRHRPRGSVAVRCSSAADERQALFSRIAPVYDHLNDVLSLGQHWTWKRICVSWSMAKRGDRVLDLCCGSGDLAFLLSQKVGLDGEVMGVDFSGQQLQTAASRQDQRWKACYKNIKWIEGDALDLPFTDRYFDAVTVGYGLRNVVDKPKAMREILRVLKPGSRASVLDFNKSSSFFTASLQSWAIDNVVVPLASSYGLTEEYKYLKSSISQYLTGEELEKLAKEAGFSSAKHYELGGGLMGNLVATR

SEQ ID NO: 7380 - protein, 269 aa, Triticum aestivum
MGTLAAAIPVTAGATAPSRHAGGRRHRPRGSVAVRCSSAADERQALFSRIAPVYDHLNDVLSLGQHWTWKRICVSWSMAKRGDRVLDLCCGSGDLAFLLSQKVGLDGEVMGVDFSGQQLQTAASRQDQRWKACYKNIKWIEGDALDLPFTDRYFDAVTVGYGLRNVVDKPKAMREILRVLKPGSRASVLDFNKSSSFFTASLQSWAINNVVVPLASSYGLTEEYKYLKSSIAQYLTGEELEKLAKEAGFSSAKHYELGGGLMGNLVATR

SEQ ID NO: 7381 - protein, 256 aa, Panicum virgatum
MGTVTAGISVSAAAAVVVPRPAGRQRHRGPAAFRCSASAASERQALFSRISPVYDHLNDVLSLGQHRTWKRICVSWSRAKMGDRILDLCCGSGDLAFLLSQKVGLDGEVMAVDFSRQQLQTAADRQEQRWKLCYKNIKWIEGDALDLPFTDCYFDAVTVGYGLRNVVDKSRAMQEIFRVLKPGSRASILDFNKSSSLFTASLQSWAIDNVVVPLASGYGLTEEYKYLKSSISQYLTGLCVYFLLQEHIHERAGLSF

SEQ ID NO: 7382 - protein, 173 aa, Panicum virgatum
MGDRVLDLCCGSGDLAFLLSQKVGLDGEVMAVDFSRQQLQTAAERQEQRWKLCYKNIKWIEGDALDLPFTDCYFDAVTVGYGLRNVVDKSRAMQEIFRVLKPGSRASILDFNKSSSLFTASLQSWAIDNVVVPLASGYGLTEEYRRRVGEISREAGFTVTKHYELGGGLMGNL

SEQ ID NO: 7383 - protein, 208 aa, Panicum virgatum
MASRTASKDIITLRGSAAIVSEFFGYAANSILYNRAVYPEESFTKVKKYGLTMLLTQDEGVKTFIASLTSQLSEWLEAGKLQRIVLVIMSKATNEVLERWNFNIVTDAEVVEKGAIKEKSDKEIMREIQAIMRQIASCITYLPCLDEPCVFDVLAYTDTDVDAPGTWVESDAKLISNPQMVKLHSFDTKIHKVDTLVSYKKDEWDEEE

SEQ ID NO: 7384 - protein, 208 aa, Panicum virgatum
MASRTASKDIITLRGSAAIVSEFFGYAANSILYNRAVYPEESFTKVKKYGLAMLLTQDEGVKTFIASLTSQLSEWLEAGKLQRIVLVIMSKATNEVLERWNFNIVTDAEVVEKGAIKEKSDKEIMREIQAIMRQIASCITYLPCLDEPCVFDVLAYTDTDVDAPGTWVESDAKLISNPQMVKLHSFDTKIHKVDTLVSYKKDEWDEEE

SEQ ID NO: 7385 - protein, 208 aa, Setaria italica
MASRTASKDIITLRGSAAIVSEFFGYAANSILYNRAVYPEESFTKVKKYGLTMLLTQDEGVKTFIASLTSQLSEWLEAGKLQRIVLVIMSKATNEVLERWNFNIVTDAEVVEKGAIKEKSDKEIMREIQAIMRQIASCITYLPCLDEPCVFDVLAYTDTDVDAPGTWVESDAKLISNPQMVKLHSFDTKIHKVDTLVSYKNDEWDDEE

SEQ ID NO: 7386 - protein, 207 aa, Sorghum bicolor
MASRTASKDIITLRGSAAIVSEFFGYAANSILYNRAVYPEESFTKVKKYGLTMLLTQDEGVKDFIANLTSQLSKWLEAGKLQRIVLVIMSKATSEVLERWNFNIVTDAEVVEKGAIKEKSDKEIMREIQAIMRQITSCITYLPCLDEPCVFDVLAYTDTDVDAPGTWVESDAKLIDNPQMVKLHSFDTKIHKVDTLVSYKKDEWDEE

SEQ ID NO: 7387 - protein, 207 aa, Oryza sativa
MASRTASKDIITLRGSAAIVSEFFGYAANSILYNRGVYPEESFTKVKKYGLTMLLTQDEGVKTFIANLNTQLSEWLEAGKLQRIVLVIMSKATSEVLERWNFSIQTDPEVVDKGVIKEKSDKEIMREIQAIMRQVASCITYLPCLDEPCIFDVLAYTDMDVAVPFTWVESDAKLIENPQMVKLHSFDTKIHKVDTLVSYKVDEWDEE

SEQ ID NO: 7388 - protein, 208 aa, Aristolochia fimbriata
MASKTIAKDIITLRGSAAIVSEFFGYAANSILYNRAVYPEESFAKVKKYGLPMLLTQDEGVKTFITNLTAQLSEWLEAGKLQRIVLVIMSKATSEVLERWNFNIETDKEVVEKGVSREKSDKEIMREIQAIMRQIASSITYLPCLDEPCVFDVLAYTDTDVAVPLAWIESDAKLIKNPQMVKLHSFDTKIHKVDTLVSYKNDDWDEEE

SEQ ID NO: 7389 - protein, 207 aa, Brachypodium distachyon
MASRTASKDIITLKGSAAIVSEFFGYAANSILYNRGVYPEESFAKVKKYGLTMLLTQDEAVKTFITNLTSQLSEWLEAGKLQRIVLVIMSKATGEVLERWNFNIVTDGEVVEKGVVKEKSDKEIMREIQAIMRQVSSCISFLPCLDEPCIFDVLAYTDTDTSVPFTWVESDAKLIDNPQMVKLHSFDTKIHKVDTLVSYKNDDWDEQ

SEQ ID NO: 7390 - protein, 207 aa, Musa acuminata
MGSRTASKDIITLRGSAAIVSEFFGYAANSILYNRGIYPEESFTKVKKYGLPMLLTQDEGVKSFLAGLTSQLTEWLEAGKLQRVVLVIMSKATSEVLERWNFSIETDAEVVEKGVIKEKSDKEIMREIQAIMRQIASSITYLPCLDEPCVFDVLAYTDKDVAVPFTWIESDAKLIKDPQMVKLHSFDTKIHKVDTLVSYKNDDWDEQ

SEQ ID NO: 7391 - protein, 208 aa, Rosa hybrid cultivar
MASSRTATKDIITLRGSAAIVSEFFGYSANSILYNRGVYPEESFVKVKKYGLPMLLTQDEGLKSFIANLTSQLSEWLESGKLQRIVLVIMSKATNEVLERWNFSIETDSEVVEKGVSREKSDKEIMREIQAIMRQIASSITYLPCLDEPCVFDVLAYTDKDVQVPFTWVESDPKLIDNPQMVKLHSFDTKIHKVNTLVSYKNDEWDEE

SEQ ID NO: 7392 - protein, 72 aa, Amorphophallus konjac
MLLTQDEGVKSFLASLTSQLSEWLEAGKLQRVVLVIMSKATSEVLERWNFNIETDAEVSRRASRGRRAIRRS

SEQ ID NO: 7393 - protein, 208 aa, Allium cepa
MASRTLSKDIITLKGSAAIVSEFFGYAANSILYNRGVYPEESFSKVKKYGLSMLLTQDDGVKSFMSSITSQLSEWLEAGKLQRIVLVIMSKATSEVLERWNFSIETDSDVVQKGVVKEKSDKEIMREIQAIMRQIASCITYLPCLDEPCVFDVLAYTDKDTEVPLAWMESDAKLIKNPQMVKLHSFDTKIHKVDTMVSYKNDEWDEED

SEQ ID NO: 7394 - protein, 207 aa, Populus trichocarpa
MASRTVAKDIITLRGSAAIVSEFFGYAANSILYNRGVYPEESFVKVKKYGLPMLLTQDEGVKSFIANLNAQLSEWLEAGKLQRVVLVIMSKATNEVLERWNFSIETDAEVVEKGLSREKSDKEIMREIQAIMRQIASSITYLPCLDEPCVFDVLAYTDKDVTVPFTWIESDPKLIANPQMVKLHSFDTKIHKVDTLVSYKNDEWDEQ

SEQ ID NO: 7395 - protein, 203 aa, Populus trichocarpa
MASRTVAKDIITLRGSAAIVSEFFGYAANSILYNRGVYPEESFVKVKKYGLPMLLTQDEGVKSFIANLNAQLSEWLEAGKLQRVVLVIMSKATNEVLERWNFSIETDAEVVEKGLSREKSDKEIMREIQAIMRQIASSITYLPCLDEPCVFDVLAYTDKDVTVPFTWIESDPKLIANPQMVKLHSFDTKANTQGRHSCFVQER

SEQ ID NO: 7396 - protein, 207 aa, Phaseolus coccineus
MAARTVAKDIITLRGSAAIVSEFFGYAANSILYNRGVYPEESFVKVKKYGLPMLLTEDEGVKSFMTNLTAQLSEWLEAGKLQRVVLVIMSKATSEVLERWNFSIETDGEVVEKGISREKSDKEIMREIQAIMRQIASSITYLPCLDEPCVFDVLAYTDTDVAVPFTWIESDPKLIANPQMVKLHSFDTKIHKVDTLVSYKNDEWDEE

SEQ ID NO: 7397 - protein, 207 aa, Vitis vinifera
MASRTATKDIITLRGSAAIVSEFFGYAANSILYNRGVYPEESFGKVKKYGLPMLLTQDEGVKSFIANLTAQLSEWLETGKLQRVVLVIMSKATNEVLERWNFSIETDGEVVENGVSREKSDKEIMREIQAIMRQIASSITYLPCIDEPCVFDVLAYTDTDVAVPFTWIESDPKLIANPQMVKLHSFDTKIHKVDTLVSYKNDEWDED

SEQ ID NO: 7398 - protein, 207 aa, Glycine max
MASRTVAKDIITLRGSAAIVSEFFGYAANSILYNRGVYPEESFVKVKKYGLPMLLTEDEGVKTFLANLTAQLSEWLEAGKLQRVVLVIMSKATSEVLERWNFSIETDCEVVEKGVSREKSDKEIMREIQAIMRQIASSITYLPCLDEPCIFDVLAYTDKDVAVPFTWVESDPKLIANPQMVKLHSFDTKIHKVDTLVSYKNDEWDEQ

SEQ ID NO: 7399 - protein, 207 aa, Glycine max
MAARTVAKDIITLRGSAAIVSEFFGYAANSILYNRGVYPEESFVKVKKYGLPMLLTEDEGVKSFLANLTAQLSEWLEAGKLQRVVLVIMSKATSEVLERWNFSIETDSEVVEKGVSREKSDKEIMREIQAIMRQIASSITYLPCLDEPCVFDVLAYTDKDVAVPFTWVESDPKLIANPQMVKLHSFDTKIHKVDTLVSYKNDEWDEQ

SEQ ID NO: 7400 - protein, 207 aa, Cicer arietinum
MASRTGSKDIITLRGSAAIVSEFFGYAANSILYNRGVYPEESFVKVKKYGLPMLLTEDEGVKSFIANLTAQLSEWLEAGKLQRIVLVIMSKSTGEVLERWNFSIETDSEVVEKSVSREKSDKEIMREIQAIMRQVASSITYLPCLDEPCVFDVLAYTDTDVAVPFTWIESDPKLIANPQMVKLHSFDTKIHKVDTLVSYKNDEWDEQ

SEQ ID NO: 7401 - protein, 207 aa, Theobroma cacao
MASRTAAKDIITLRGSAAIVSEFFGYAANSILYNRGVYPEESFVKVKKYGLPMLLTEDEGVKSFITNLTAQLSEWLEAGKLQRVVLVIMSKATNEVLERWNFSIETDSEVVEKGVSREKSDKEIMREIQAIMRQIASSITYLPCLDEPCVFDVLAYTDKDVAVPFTWIESDPKLIANPQMVKLHSFDTKIHKVDTLVSYKNDDWDEQ

SEQ ID NO: 7402 - protein, 207 aa, Manihot esculenta
MASKSVARDIITLRGSAAIVSEFFGYAANSILYNRGVYPEESFVKVKKYGLPMLLTQDEGVKSFIANLNAQLSEWLEAGKLQRVVLVIMSKATGEVLERWNFSIETDSEVVEKGVSREKSDKEIMREIQAIMRQIASSITYLPCLDEACVFDVLAYTDKDVAVPFTWIESDPKLIANPQMVKLHSFDTKIHKVDTLVSYKNDEWDEE

SEQ ID NO: 7403 - protein, 207 aa, Unknown
  Sequence found in Organisms: Citrus clementina, Citrus sinensis
MASRTVAKDIITLRGSAAIVSEFFGYAANSILYNRGVYPEESFVKVKKYGLPMLLTEDEGVKSFIANLTAQLSEWLEAGKLQRVVLVIMSKATKEVLERWNFSIETDNEVVEKGVSREKSDKEIMREIQAIMRQIASSITYLPCLDETCVFDVLAYTDKDVAVPFTWIESDPKLIANPQMVKLHSFDTKIHKVDTLVSYKNDEWDEQ

SEQ ID NO: 7404 - protein, 207 aa, Unknown
  Sequence found in Organisms: Gossypium hirsutum, Gossypium raimondii
MASRTVAKDIITLRGSAAIVSEFFGYAANSILYNRGVYPEESFAKVKKYGLPMLLTQDEGVKSFISNLTAQLSEWLEAGKLQRVVLVIMSKATNEVLERWNFSIETDSEVVEKGVSREKSDKEIMREIQAIMRQIASSITYLPCLDEPCVFDVLAYTDKDVAVPFTWIESDPKLIANPQMVKLHSFDTKIHKVDTLVSYKNDEWEEQ

SEQ ID NO: 7405 - protein, 207 aa, Cajanus cajan
MAARTVAKDIITLRGSAAIVSEFFGYAANSILYNRGVYPEESFVKVKKYGLPMLLTEDEGVKSFITNLTAQLSEWLEAGKLQRVVLVIMSKATSEVLERWNFSIETDSEVVEKGVSREKSDKEIMREIQAIMRQIASSITYLPCLDEPCVFDVLAYTDKDVAVPFTWIESDPKLIANPQMVKLHSFDTKIHKVDTLVSYKNDEWDEQ

SEQ ID NO: 7406 - protein, 245 aa, Cicer arietinum
MASRTGSKDIITLRGSAAIVSEFFGYAANSILYNRGVYPEESFVKVKKYGLPMLLTEDEGVKSFIANLTAQLSEWLEAGKLQRIVLVIMSKSTGEVLERWNFSIETDSEVVEKSVSREKSDKEIMREIQAIMRQVASSITYLPCLDEPCVFDVLAYTDTDVAVPFTWIESDPKLIANPQMVNCIPSILRFTRWTHLYHTRMTNGMSSRAEPSVSFLVVLFCFCSLQVNQFSAVRCVSCEFSIHTL

SEQ ID NO: 7407 - protein, 209 aa, Unknown
  Sequence found in Organisms: Brassica napus, Brassica rapa
MASKTAAAKDIITLHGSAAIVSEFFCYAANSILYNRAVYPEESFAKVKKYGLPMLLTQDESVKSFLSNLTSQISEWLEAGKLQRVVLVIMSKATGEVLERWNFRIETDSEVVEKGVSREKSDKEIMREIQAIMRQVASSITYLPCLDEPCVFDVLAYTDTDVAVPFTWVESDPKLIANPQMVKLHAFDTKIHKVDTLVSYKNDEWDEEE

SEQ ID NO: 7408 - protein, 209 aa, Brassica napus
MASKTAAAKDIITLHGSAAIVSEFFCYAANSILYNRAVYPEESFAKVKKYGLPMLLTQDESVKSFLSNLTCQISEWLEAGKLQRVVLVIMSKATGEVLERWNFRIETDAEVVEKGVSSEKSDKEIMREIQAIMRQVASSITYLPCLDEPCVFDVLAYTDTDVAVPFTWVESDPKLIANPQMVKLHAFDTKIHKVDTLVSYKNDEWDEEE

SEQ ID NO: 7409 - protein, 208 aa, Ipomoea nil
MASRTASKDIITLRGSAAIVSEFFGYAANSILYNRGLYPEESFAKVKKYGLPMLLTQDEGVKTFISNLTAQISEWLEAGKLQRVVLVIMSKASGEVLERWNFSIETDSEVVEKGVSREKSDKEIMREIQAIMRQIASSITYLPCLDEACVFDVLAYTDTDVAVPFTWIESDPKLIANPQMVKLHSFDTKIHKVDTLVSYKNDDEWDEA

SEQ ID NO: 7410 - protein, 155 aa, Olea europaea
MLLTQDEGVKSFISNLTAQLSEWLKSGKLQRIVLVIMSKATGEVLERWNFSIETDKEVVEKGVSREKNDKEIMREIQAIMRQIASSITYLPCLDEPCVFDVLAYTDTDVAVPFSWIESDPKLIANPQMVKLHSFDTKIHKVDTLVSYKNDEWDEA

SEQ ID NO: 7411 - protein, 207 aa, Sesamum indicum
MASKTATKDIITLRGSAAIVSEFFGYAANSILYNRGVYPEESFARVKKYGLPMLLTQDEGVKSFISNLTSQLSEWLEAGKLQRVVLVIMSKATGEVLERWNFSIETDSEVVEKGVSREKSDKEIMREIQAIMRQIASSITYLPCLDEPCIFDVLVYTDKDCAVPFTWVESDPKLIANPQMVKLHSFDTKIHKVDTLVSYKNDEWDEA

SEQ ID NO: 7412 - protein, 207 aa, Hordeum vulgare
MASRSASKDIITLKGSAAIVSEFFGYAANSILYNRGVYPEESFAKVKKYGLPMLLTQDEAVKTFLTNLTSQLSEWLEGGKLQRIVLVIMSKATSEVLERWNFSIITDGEVVEKGVVKEKSDKEIMREIQAIMRQVNSCISFLPCLDEPCIFDVLAYTDSDTTVPFTWMESDAKLIDNPQMVKLHSFDTKIHKVDTLVSYKVDDLDEQ

SEQ ID NO: 7413 - protein, 207 aa, Centaurea maculosa
MASRTASKDIITLRGSTAIVSEFFGYAANSILYNRGVYPEESFGRVKKYGLPLLLSQDEGVKTFIANLNAQLSEWLEAGKLQRIVLVIMSKATNEVLERWNFSIETDGEVVEKGVSREKSDKEIMREIQAIMRQIASSITYLPCLDEPCIFDVLAYTDTDVAVPFTWTESDPKLIANPQTVKLHSFDTKIHKVDTLVSYKNDEWDEQ

SEQ ID NO: 7414 - protein, 207 aa, Gossypium hirsutum
MASRTVAKDIITLRGSAAIVSEFFGYAANSILYNRGVYPEESFAKVKKYGLPMLLTQDEGVKSFITNLTAQLSEWLEAGKLQRVVMVIMSKATKEVLERWNFSIETDSDVVEKGVSREKSDREIMREIQAIMRQIASSITYLPCLDEPCVFDVLAYTDTDVPVPFTWIESDPKLIANPQMVKLHSFDTKIHKVDTLVSYKNDEWDEQ

SEQ ID NO: 7415 - protein, 207 aa, Gossypium raimondii
MASRTVAKDIITLRGSAAIVSEFFGYAANSILYNRGVYPEESFAKVKKYGLPMLLTQDEGVKSFITNLTAQLSEWLEAGKLQRVVMVIMSKATNEVLERWNFSIETDSDVVEKGVSREKSDREIMREIQAIMRQIASSITYLPCLDEPCVFDVLAYTDTDVPVPFTWIESDPKLIANPQMVKLHSFDTKIHKVDTLVSYKNDEWDEQ

SEQ ID NO: 7416 - protein, 207 aa, Medicago truncatula
MASKTVTKDIITLRGSAAIVSEFFGYAANSILYNRGVYPEESFVKVKKYGLPMLLTEDEGVKSFITNLTAQLSEWLEAGKLQRIVLVIMSKSTGEVLERWNFSIETDNEVVEKGESREKSDKEIMREIQAIMRQIASSITYLPCLDEPCVFDVLAYTNTDVEVPFTWTESDPKLIANPQMVKLHSFDTKIHKVDTLVSYKNDEWDEQ

SEQ ID NO: 7417 - protein, 207 aa, Quercus alba
MASKTVAKDIITLRGSAAIVSEFFGYAANSILYNRGVYPEESFVKVKKYGLPMLLTQDEGVKSFIANLNSQLSEWLEAGQLQRIVLVIMSKATNEVLERWNFTIETDSEVVEKGVSREKSDKEIMREIQAIMRQIASSITYLPCLDEACVFDVLAYTDKDVAVPFTWIESDPKLIANPQMVKLHSFDTKIHKIDTLVSYKNDEWDEQ

SEQ ID NO: 7418 - protein, 207 aa, Ambrosia trifida
MASKTASKDIITLRGSTAIVSEFFGYAANSILYNRGVYPEESFGRVKKYGLPLLLSQDEGVKTFIANLNTQLSEWLEAGKLQRIVLVIMSKATNEVLERWNFSIETDKEVVEKGVSREKSDKEIMREIQAIMRQIASSITYLPCLDEPCIFDVLAYTDMDVAVPFTWTESDPKLIANPQMVKLHSFDTKIHKVDTLVSYKNDEWDEQ

SEQ ID NO: 7419 - protein, 207 aa, Malus domestica
MASKTATKDIITLRGSAAIVSEFFGYSANSILYNRGVYPEESFVKVKKYGLPMLLTQDEGLKSFIANLTAQLSEWLESGKLQRVVLVIMSKATSEVLERWNFSIETDSEVVEKGMSREKSDKEIMREIQAIMRQIASSITYLPCLDEPCVFDVLAYTDKDVAVPFTWIESDPKLITNPEIVKLHSFDTKIHKVDTLVSYKNDEWDEQ

SEQ ID NO: 7420 - protein, 207 aa, Ricinus communis
MASKTVAKDIITLRGSAAIVSEFFGYAANSILYNRGVYPEESFAKVKKYGLPMLLTQDEGVKSFIANLNAQLSEWLEAGKLQRVVLVIMSKATNEVLERWNFSIETDSEVVQKGVSREKSDKEIMREIQAIMRQIASSITYLPCLDEACVFDVLAYTDKDVAVPFTWIESDPKLIANPQMVKLHSFDTKIHKVDTLVSYKNDEWDEQ

SEQ ID NO: 7421 - protein, 207 aa, Cynara scolymus
  misc_feature (19)..(19): Xaa can be any naturally occurring amino acid
  misc_feature (127)..(127): Xaa can be any naturally occurring amino acid
  misc_feature (168)..(168): Xaa can be any naturally occurring amino acid
MASRTASKDIITLRGSTAXVSEFFGYAANSILYNRGVYPEESFGRVKKYGLPLLLSQDEGVKTFIANLNAQLSEWLEAGKLQRIVLVIMSKATNEVLERWNFSIETDGEVVEKGVSREKSDKEIMRXIQAIMRQIASSITYLPCLDEPCIFDVLAYTDTDVAVPFTWXESDPKLIANPQMVKLHSFDTKIHKVDTLVSYKNDEWDEQ

SEQ ID NO: 7422 - protein, 207 aa, Secale cereale
MASRTASKDIITLKGSAAIVSEFFGYAANSILYNRGVYPEESFAKVKKYGLPMLLTQDEAVKTFLTNLTSQLSEWLEGGKLQRIVLVIMSKATGEVLERWNFNIITDGEVVEKGVVKEKSDKEIMREIQAIMRQVNSCISFLPCLDEPCIFDVLAYTDSDTTVPFTWMESDAKLIDNPQMVKLHSFDTKIHKVDTLVSYKVDDLDEQ

SEQ ID NO: 7423 - protein, 207 aa, Helianthus annuus
MASKTASKDIITLRGSTAIVSEFFGYAANSILYNRGVYPEESFGRVKKYGLPLLLSQDEGVKTFIANLNTQLSEWLEAGKLQRIVLVIMSKATNEVLERWNFSIETDSEVVEKGVSREKSDKEIMREIQAIMRQIASSITYLPCLDEPCIFDVLAYTDADVAVPFTWTESDPKLIANPQMVKLHSFDTKIHKVDTLVSYKNDEWDEQ

SEQ ID NO: 7424 - protein, 207 aa, Trigonella foenum-graecum
MASKTVTKDIITLRGSAAIVSEFFGYAANSILYNRGVYPEESFVKVKKYGLPMLLTEDEGVKSFITNLTAQLSEWLEAGKLQRIVLVIMSKSTGEVLERWNFSIETDNVVVEKGESREKSDKEIMREIQAIMRQIASSITYLPCLDEPCVFDVLAYTNTDVEVPFTWTESDPKLIANPQMVKLHSFDTKIHKVDTLVSYKNDEWDEQ

SEQ ID NO: 7425 - protein, 207 aa, Triticum aestivum
MASRTASKDIITLKGSAAIVSEFFGYAANSILYNRGVYPEESFGKVKKYGLPMLLTQDEAVKTFLTNLTSQLSEWLEGGKLQRIVLVIMSKATGEVLERWNFNIITDGEVVEKGAVKEKSDKEIMREIQAIMRQVNSCISFLPCLDEPCIFDVLAYTDSDTTVPFTWMESDAKLIENPQMVKLHSFDTKIHKVDTLVSYKVDDLDEQ

SEQ ID NO: 7426 - protein, 208 aa, Capsicum annuum
MASRTASKDIITLRGSAAIVSEYFGYASNSILYNRGVYPEESFKKVKKYGLTMLLTEDEGVKTFISNLTAQLAEWLETGKLQRVVLVIMSKASGEVLERWNFSIETDSEVVEKGVSREKSDKEIMREIQAIMRQIASSITYLPCLEEPCVFDVLAYTDTDVAVPFTWIESDPKLIANPQMVKLHSFDTKIHKVDTLVSYKNDDEWDES

SEQ ID NO: 7427 - protein, 252 aa, Helianthus annuus
HGGPHFYLIIPSAHNLFDKIPHRNILDLFIHLNKSIKFEHFPLQKWLTKTASKDIITLRGSTAIVSEFFGYAANSILYNRAVYPEESFGKVKKYGLPLLLSQDEGVKTFIANLNTQLSEWLEAGKLQRIVLVIMSKATNEVLERWNFSIETDKEVVEKGVSREKSDKEIMREIQAIMRQIASSITYLPCLDEPCIFDVLAYTDMDVAVPFTWTESDPKLIANPQMVKLHSFDTKIHKVDTLVSYKNDEWDEQ

SEQ ID NO: 7428 - protein, 207 aa, Vaccinium corymbosum
MGSRTATKDIITLRGSAAIVSEFFGYSANSILYNRGVYPEESFTKVKKYGLPLLLTQDEGVKTFIANLTAQLSEWLESGKLQRVVLVIMSKATGEVLERWNFSIETDNEVLDKGVSREKSDKEIMREIQAIMRQIASSITYLPCLDEPCVFDVLAYTDTDVAVPFTWIESDPKLIANPQMVKLHSFDTKIHKVNTLVSYKNDEWDEQ

SEQ ID NO: 7429 - protein, 207 aa, Triticum aestivum
MASRTASKDIITLKGSAAIVSEFFGYAANSILYNRGVYPEESFGKVKKYGLPMLLTQDKAVKTFLTNLTSQLSEWLEGGKLQRIVLVIMSKATGEVLERWNFNIITDGEVVEKGAVKEKSDKEIMREIQAIMRQVNSCISFLPCLDEPCIFDVLAYTDSDTTVPFTWMESDAKLIENPQMVKLHSFDTKIHKVDTLVSYKVDDLDEQ

SEQ ID NO: 7430 - protein, 207 aa, Taraxacum officinale
MASRTASKDIITLRGSTAIVSEFFGYAANSILYNRGVYPEETFERVKKYGLPLLLSQDEGVKTFISNLHKQLSEWLEAGKLQRIVLVIMSKATNEVLERWNFSIETDGEVVEKGISREKSDKEIMREIQAIMRQIASSITYLPCLDEPCIFDVLAYTDTDVAVPFTWTESDPKLIANPQMVKLHSFDTKIHKVDTLVSYKNDEWDDQ

SEQ ID NO: 7431 - protein, 207 aa, Mimulus guttatus
MASKSATKDIITLRGSAAIVSEFFGYAANSILYNRGVYPEESFARVKKYGLPMLLTQDEGVKSFISNLTSQLSEWLEEGKLQRMVLVIMGKQTGEVFERWNFSIETDGEVVEKGISREKSDKEIMREIQAIMRQIASSITYLPCLEEPCVFDVLAYTDKDCAVPFTWIESDPKLIDNPQMVKLHSFDTKIHKVDTLVSYKNDEWDEP

SEQ ID NO: 7432 - protein, 207 aa, Populus trichocarpa
MASRTVAKDIITLRGSAAIVSEFFGYAANSILYNRGVYPEESFVKVKKYGLPMLLTQDEGVRSFISNLNAQLSEWLEAGKLQRVVLVIMSKATNEVLERWNFSIETDSEVVEQGVSREKSDKEIMREIQAIMRQIASSITYLPCLDESCVFDVLAYTDKDVAVPFTWIESDPKLIANPQMVKLHSFDTKIHKVDTLVSYKNDEWDEQ

SEQ ID NO: 7433 - protein, 207 aa, Carthamus tinctorius
  misc_feature (77)..(77): Xaa can be any naturally occurring amino acid
MASRTASKDIITLRGSTAIVSEFFGYAANSILYNRGVYPEESFGRVKKYGLPLLLSQDDGVKTFIANLNAQLSEWLXAGKLQRIVLVIMSKATNEVLERWNFSIETDGEVVEKGVSREKSDKEIMREIQAIMRQIASSIMYLPCLDEPCIFDVLAYTDTDVAVPFTWTESDPKLIANPQMVKLHSFDTKIHKVDTLVSYKNDEWDEQ

SEQ ID NO: 7434 - protein, 207 aa, Lactuca sativa
MASRTASKDIITLRGSTAIVSEFFGYAANSILYNRGVYPEETFGRVKKYGLPLLLSQDEGVKTFISNLNKQLSEWLEAGKLQRIVLVIMSKATNEVLERWNFSIETDGEVVEKGVSREKSDKEIMREIQAIMRQIASSITYLPCLDEPCIFDVLAYTDTDVAVPFTWTESDPKLIANPQMVKLHSFDTKIHKVDTMVSYKNDEWDDQ

SEQ ID NO: 7435 - protein, 203 aa, Eucalyptus grandis
MASKTVAKDIITLRGSAAIVSEFFGSILYNRGVYPEESFAKVKKYGLPMLLTQDEGVKSFIANLNAQLSEWLEAGKLQRVVLVIMSKATGEVLERWNFSIETDGEVVEKGVSREKSDKEIMREIQAIMRQIASSITYLPCLDEPCVFDVLAYTDKDVAVPFTWIESDPKLIANPQMVKLHSFDTKIHKVDTLVSYKNDEWDEQ

SEQ ID NO: 7436 - protein, 207 aa, Fagopyrum esculentum
MASKTVTKDIITLRGSAAIVSEFFGYAANSILYNRGVYPEESFAKVKKYGLPMLLTQDEGVKTFITNLTAQLSEWLEAGKLQRIVLVIMSKSTGEVLERWNFSIETDQEVVVEKAVTREKSDKEIMREIQAIMRQIASSITYLPCLDEPCVFDVLAYTDQDVSAPLTWIESDPKLIANPQMVKLHSFDTKIHKVDTLVSYKNDDLDD

SEQ ID NO: 7437 - protein, 209 aa, Raphanus sativus
MASKTAAAKDIITLHGSAAIVSEFFCYAANSILYNRAVYPEESFVKVKKYGLPMLLTQDESVKSFLSNLSSQISEWLEAGKLQRVVLVIMSKATGEVLERWNFRIETDSQVVDKGVSREKSDKEIMREIQAIMRQVASSITYLPCLDEPCVFDVLAYTDTDVAVPFTWVESDPKLIANPQMVKLHGFDTKIHKVDTLVSYKNDEWDEEE

SEQ ID NO: 7438 - protein, 209 aa, Raphanus sativus
MASKTAAAKDIITLHGSAAIVSEFFCYAANSILYNRAVYPEESFVKVKKYGLPMLLTQDESVKSFLSNLSSQISEWLEAGKLQRVVLVIMSKASGEVLERWNFRIETDSEVVDKGVSREKSDKEIMREIQAIMRQVASSITYLPCLDEPCVFDVLAYTDTDVAVPFTWVESDPKLIANPQMVKLHGFDTKIHKVDTLVSYKNDEWDEEE

SEQ ID NO: 7439 - protein, 208 aa, Solanum phureja
MASRTVSKDIITLRGSAAIVSEYFGYAANSILYNRGVYPEESFKKVKKYGLTMLLTEDEGVKTFVSNLTAQLAEWLETGKLQRVVLVIMSKASGEVLERWNFSIETDSEVVEKGVSREKSDKEIMREIQAIMRQIASSITYLPCLEEPCVFDVLAYTDTDVAVPFTWIESDPKLIANPQMVKLHSFDTKIHKVDTLVSYKNDDEWDES

SEQ ID NO: 7440 - protein, 220 aa, Gossypium hirsutum
MASRTVAKDIITLRGSAAIVSEFFGYAANSILYNRGVYPEESFAKVKKYGLPMLLTQDEGVKSFITNLTAQLSEWLEAGKLQRVVMVIMSKATNEVLERWNFSIETDSDVFEKGVSREKSDREIMREIQAIMRQIASSITYLPCLDEPCVFDVLAYTDTDVAVPFTWIESDPKLIANPQMVKLHSFDTKIHKVDTLVSYKNDEWTSSRVPEPSLSPTAYM

SEQ ID NO: 7441 - protein, 209 aa, Eutrema halophilum
MASKTAAAKDIITLHGSAAIVSEFFCYAANSILYNRAVYPEESFVKVKKYGLPMLLIEDESVKSFLSNLTSQISEWLEAGKLQRVVLVIMSKATGEVLERWNFRIETDNEVVEKGVSREKSDKEIMREIQAIMRQVASSITYLPCLDEACVFDVLAYTDTDVAVPFTWIESDPKLIANPQMVKLHAFDTKIHKVDTLVSYKNDEWDEEE

SEQ ID NO: 7442 - protein, 208 aa, Solanum lycopersicum
MASRTASKDIITLRGSAAIVSEYFGYAANSILYNRGVYPEESFKKVKKYGLTMLLTEDEGVKTFVSNLTAQLAEWLETGKLQRVVLVIMSKASGEVLERWNFSIETDSEVVQKGVSREKSDKEIMREIQAIMRQIASSITYLPCLEEPCVFDVLAYTDMDVAVPFTWIESDPKLIANPQMVKLHSFDTKIHKVDTLVSYKNDDEWDES

SEQ ID NO: 7443 - protein, 194 aa, Prunus persica
MASRTATKDIITLRGSAAIVSEFFGYSANSILYNRGVYPEESFVKVKKYGLPMLLTQDEGLKSFIANLTAQLSEWLESGKLQRVVLVILSKATNEVLERWNFSIETDNEVVEKGESREKSDKEIMREIQAIMRQIASSITYLPCLEEACVFDVLAYTDKDLAVPFTWVESDPKLIANPQIVKLHSFDTKANSQG

SEQ ID NO: 7444 - protein, 207 aa, Cucurbita pepo
MASKTASKDIITLRGSAAIVSEFFGYAANSILYNRGLYPEESFARVKKYGLPMLLTQDEGVKTFISNLTAQLSEWLEAGKLQRVVLVIMSKANNEVLERWNFRIETDGEVVEQGVSREKSDKEIMREIQAIMRQIASSITYLPCLDEPCVFDVLAYTDKDLAVPFTWIESDPKLIANPQMVKLHSFDTKIHKVDTLVSYKNDDCDDE

SEQ ID NO: 7445 - protein, 207 aa, Amborella trichopoda
MASKTATKDVITLKGSAAIVSEFFGYAANSILYNRGVYPEECFVKVKKYGLPMLLIEDDAVKAFLACLTSQISEWLESGKLQRVVLVIMSKASSEVLERWNFNIETDNEVVEKGVSRAKSDKEIMREIQAIMRQIASSITYLPCLDEPCVFDVLAYTDTDLEIPVTWMESDAKLILNPQMVKLHSFDTKIHKVDTLVSYKNDEWDEQ

SEQ ID NO: 7446 - protein, 119 aa, Ambrosia trifida
MSKATNEVLERWNFSIETDKEVVDKGVSREKSDKEIMREIQAIMRQIASSITYLPCLDEPCIFDVLAYTDMDVAVPFTWTESDPKLIANPQMVKLHSFDTKIHKVDTLVSYKNDEWDEQ

SEQ ID NO: 7447 - protein, 211 aa, Manihot esculenta
MASKTVAKDIITLRGSSAIVSEFFGLVIDDLLFSILYNRGVYPEESFVKVKKYGLPMLLTQDEGVKSFIANLTAQLSEWLEAGKLQRVVLVIMSKATSEVLERWNFSIETDSEVVEKGVSREKSDKEIMREIQAIMRQIASSITYLPCLDEACVFDVLAYTDKDVAVPFTWIESDPKLISNPQMVKLHSFDTKIHKVDTLVSYKNDEWDEE

SEQ ID NO: 7448 - protein, 209 aa, Arabidopsis thaliana
MASKTAAAKDIITLHGSAAIVSEFFCYAANSILYNRAVYPEESFVKVKKYGLPMLLIEDESVKSFMSNLTSQISEWLEAGKLQRVVLVIMSKATGEVLERWNFRIETDNEVVDKGVSREKSDKEIMREIQAIMRQVASSVTYLPCLDETCVFDVLAYTDTDVAVPFTWIESDPKLIANPQMVKLHGFDTKIHKVDTLVSYKNDEWDEEE

SEQ ID NO: 7449 - protein, 208 aa, Beta vulgaris
MASKTVAKDIITLRGSAAIVSEFFGYAANSILYNRGVYPEESFGKVKKYGLPMLLTQDEGVKSFITNLTAQLSEWLESGKLQRVVLVIMSKSTNEVLERWNFSIETDNEVVEKGVSREKSDKEIMREIQAIMRQIASSITYLPCIDEPCVFDVLAYTDKDLAVPFTWIESDPKLINNPQMVKLHCFDTKIHKVDTIVSYKNDEEWDNE

SEQ ID NO: 7450 - protein, 207 aa, Artemisia annua
MASKTSSKDIITLRGSTAIVSEFFGYAANSILYNRGVYPDSSFERVKKYGLPLLLSQDEGVKTFIANLNTQLSEWLEAGKLQRIVLVIMSKATNEVLERWNFSIETDKEVVEKGISREKSDKEIMREIQAIMRQIASSITYLPCLDEPCIFDVLAYADKDVEVPFTWTESDPKLIENPQMVKLHSFDTKIHKVGTLVSYKNDEWDEQ

SEQ ID NO: 7451 - protein, 47 aa, Nicotiana tabacum
TPHAAATATKDIITLRGSAAIVAEFFGYAANSILYNRGVYPEESLRR

SEQ ID NO: 7452 - protein, 201 aa, Cucurbita pepo
MASKTASKDIITLRGSAAIVSEFFGYAANSILYNRGLYPEESFARVKKYGLPMLLTQDEGVKTFISNLTAQLSEWLEAGKLQRVVLVIMSKANNEVLERWNFRIETDGEVVDQGVSREKSDKEIMREIQAIMRQIASSITYLPCLDEPCVFDVLAYTDKDLAVPFTWIESDPKLIANPQMVKLHSFDTKIHKVDTLVSYKN

SEQ ID NO: 7453 - protein, 208 aa, Cucumis melo
MASKTATKDIITLRGSAAIVSEFFGYAANSILYNRGLYPEESFVRVKKYGLPMLLTQDEGVKSFISNLTAQLSEWLEAGKLQRVVLVIMSKSNNEVLERWNFRIETDGEVVEQGVSREKSDKEIMREIQAIMRQIASSITYLPCLDEPCVFNVLAYTDKYLAVPFTWMESDPKLIANPQMVKLHSFDTKIHKVDTLVSYKNDDDGDDE

SEQ ID NO: 7454 - protein, 339 aa, Panicum virgatum
MARVLPLSIEPGETARGKEVVTDTPNSSAGASCAAVDHSEQNTKDDEYARLVTRAQHATSDLSATILPEQPKSRSFIWWMKVLLGCFLLILVGYIFVKWGVPFAFEKVLLPIMQWEASAFGRPVLAVVLVASLALFPVILVPSGPSMWLAGMIFGYCWGFLIIMVGTTIGMVVPYWIGSLFRERLHVWLTKWPQQIALIKLAGEGNWFQQFRVVALFRISPFPYTIFNYAVTVTEIKFNPYLWGSIAGMVPEAFIYIYSGRLIRTLADMKYGNYKMTPVEITYNVISFIIAIVLTVAFTVYAKRALNEIKSSEGICKEVVSSPAGPGAGMKHHQELDVV

SEQ ID NO: 7455 - protein, 197 aa, Sorghum bicolor
MAALGSSITSRGLALHTSVVFHRHHGNPVISTSSHRQRNLTGLSMNSSGMNNAFPIRGTTRIPAVGPGPANPAGGNLPIASMPPWAKWLVGAVIVAIPIYRRFRTLEDKIEKTAEVAIEVIDTVAEATEKVAGEVADAFPGNENLKEAASRIKTVTDAIEEDAEKAEALIEKVDEIKKQVDSIVDPIIDKVVKDKEA

SEQ ID NO: 7456 - protein, 729 aa, Sorghum bicolor
MALLLRPTSPPSPHLRALLRRLLSTGAGPFPSRMLPSPRSTAAVPRLLFGPRVVAAAAAAPRRNGVPVRAFMASTTASEAMHEKRVAAEYTAANVQVLEALDGVRTRPGMYIGSTGPRGLHHLVYEILDNAVDEGQAGHASKIDVVLHDDNSVSVTDNGRGIPTDMHPQTKKSCVETVLTLMHAGGKFGGSKSGYSVSGGLHGVGLSVVNALSEALEVTVWRDGNKYRQSYSRGKPTTPLSSITLTGETSPRQGTSIRFWPDKDIFTTTIDFDFNTISSRIRELAFLNPELTITLTKEEGHTVQHNEYCYAGGLVEYVKWLNTDKKPLHDPIAFRKELDGITVDVSLQWSSDSYSDTVLGYANSIRTIDGGTHIDGLKASLTRTINNFAKKSKTIKDKDITLSGEHVREGMTCVISVKVPSPEFEGQTKTRLGNPEVRRIVEQAVQENLTEYLELHPDVLDSILSKSLNALKASLAAKRARELVRSKSVLKSSSIPGKLADCASTNPEESEIFIVEGDSAGGSAKQGRDRRFQAILPLRGKILNIERRDEAAMYKNEEIQNLILALGLGVKGEDFKKEALRYHKIVILTDADVDGAHIRTLLLTFFFRYQRALFDEGCIYVGVPPLYKVERGKQAHYCYDDADLKEIVNTFPPNASYHIQRFKGLGEMMPVQLWETTMDPERRLLKQLKVEDAAEANVVFSSLMGSRVEYRKQLIQEAASTISMDQLDI

SEQ ID NO: 7457 - protein, 728 aa, Setaria italica
MAPLLRPPPPPPHLRALLRRLLSTGAGPVPSRMLPSLRSTAAAPRFLFGPRVVVAGAAPRRNGVPVRAFMASTAASEAMQEKRVAGEYTAANVQVLEALDGVRTRPGMYIGSTGPRGLHHLVYEILDNAVDEAQAGHASKINVVLHDDNSVSVTDNGRGIPTDIHPQTKKSCVETVLTLMHAGGKFGGSKSGYSVSGGLHGVGLSVVNALSEALEVTVWRDGKEYRQSYSRGKPLTTLNSITLSGETSSRQGTRIRFWPDKDIFTTTISFDFNTISSRIRELAFLNPELTITLTKEEGHTEVQHNEYCYAGGLVEYVKWLNTDKKPLHDPIAYRKELDGITVDVSLQWCSDSYSDTVLGYANSIRTIDGGTHIEGLKASLTRTINNLAKKSKTIKDKDITLSGEHVREGMTCVISVKVPSPEFEGQTKTRLGNPEVRRIVEQSVQENLTEYLELHPDVLDSILSKSLNALKAALAAKRARELVRTKSVLKSSSLPGKLADCASTNPEESEIFIVEGDSAGGSAKQGRDRRFQAILPLRGKILNIERKDEAALYKNEEIQNLILALGLGVKGEDFKKEALRYHKIVILTDADVDGAHIRTLLLTFFFRYQRALFDEGCIYVGVPPLYKVERGKQAHYCYDDADLKKIVNTFPANASYHIQRFKGLGEMMPAQLWETTMDPERRLLKQLKVEDAAEANVVFSSLMGTRVEYRKQLIQNAASMINIDQLDI

SEQ ID NO: 7458 - protein, 727 aa, Panicum virgatum
MAILLRSPPSPPHIRALLLRLLSTGAAAGPLPSRMLPSLSSAAAAPRFLFGPRVAAALRRNGVPVRAFMASTAASEAMQEKRVAGEYTAANVQVLEALDGVRTRPGMYIGNTGPRGLHHLVYEILDNAVDEAQAGHASKINVVLHDDNSVSVTDNGRGIPTDIHPQTKKSCVETVLTLMHAGGKFGGSKSGYSVSGGLHGVGLSVVNALSEALEVTVWREGKEYKQHYSRGKPITTLTSITLSGETSSRQGTRIRFWPDKNIFTTTISFDFNTISSRIRELAFLNPELTITLTKEEGHMEVQHNEYCYAGGLVEYVKWLNTDKKTLHDPIAFRKELDGITVDVSLQWCSDSYSDTVLGYANSIRTIDGGTHIDGLKASLTRTINNLAKKSKSIKDKDITLSGEHVREGMTCIISVKVPSPEFEGQTKTRLGNPEVRRIVEQSVQENLTEYLELHPDVLDSILSKSLNALKAALAAKRARELVRTKSVLKSSSLPGKLADCASTNPEESEIFIVEGDSAGGSAKQGRDRRFQAILPLRGKILNIERRDEAAMYKNEEIQNLILALGLGVKGEDFKKEALRYHKIVILTDADVDGAHIRTLLLTFFFRYQRALFDEGCIYVGVPPLYKVERGKQAHYCYDDADLKEIVNTFPANASYHIQRFKGLGEMMPTQLWETTMDPERRLLKQLKVDDAAEANVVFSSLMGTRVDYRKQLIQNAASSINLDQLDI

SEQ ID NO: 7459 - protein, 729 aa, Oryza sativa
MGPLLRSSPPPRHLRLLLRRLLSTAAGRPSRLLPLPASSSARLLVRPRVAVAAAAAGAPLRRNGVAVRAFMASTAASEAMQEKRVAGEYTAANVQVLEALDGVRTRPGMYIGSTGSRGLHHLVYEILDNAVDEAQAGYATKVDVILHGDNSVSVTDNGRGIPTDIHPQTKKSCVETVLTLMHAGGKFGGSKSGYTVSGGLHGVGLSVVNALSEALEVTVWRDGKEYRQNYSRGKAITMLTSRTLSDESSSRQGTRIRFWPDKHIFTTTMDFDFNTIAGRIRELAFLNPELTIALTKEEDDLQVQHNEYCYAGGLVEYVKWLNTDKKSLHDPIAFRKEMDGITVDVSLQWCSDSYSDTVLGYANSIRTIDGGTHIDGLKTSLTRTINNFAKKSKTLKDKDISLSGEHVREGMTCIIAVKVPNPEFEGQTKTRLGNPEVRRIVEQSVQENLTEYLELHPDVLDSILSKSLNALKAALAAKRARELVRTKSVLKSSSLPGKLADCASSDPEESEIFIVEGDSAGGSAKQGRDRKFQAILPLRGKILNIERRDEAALYKNEEIQNLIVALGLGVKGEDFNKEALRYHKIVILTDADVDGAHIRTLLLTFFFRYQKALFDEGCIYVGVPPLYKVERGKQAHYCYDDADLKELVNTFPTNASYHIQRFKGLGEMMPAQLWETTMDPERRMLKQLKVEDAAEANVVFSSLMGTRVDVRKQLIQNAASMVNLEHLDI

SEQ ID NO: 7460 - protein, 723 aa, Brachypodium distachyon
MALLLRPSPPLPHLRFLLRRLLSTAAPTSRLLPVPSTSARPLFRPRVVAAAAAPRRNGVSVRAFMASTAASEAMQEKPASGEYTAANVQVLEALDGVRKRPGMYIGSTGPRGLHHLVYEILDNAVDEAQAGYATKINVVLHDDNSVSVTDNGRGIPTDIHPQTKKSCVETVLTLMHAGGKFGGSTSSYSVAGGLHGVGLSVVNALSEALDVTVYRDGKEYRQSYSRGKPLTTLSSTTVYGESSTRQGTCIRFWPDKDIFTTTIGFDFNTISSRIRELAFLNPELTITLTKEEDDAEVLHNEYCYAGGLVEYVAWLNTDKKPLHDPIAFRKELDGIIVDVSLQWCSDSYSDTVLGYANSIRTIDGGTHIEGLKTSLTRTVNSFAKNSKAIKDKDISLSGEHVREGMTCIIAVKVPNPEFEGQTKTRLGNPEVRKIVEQSVQENLTEYLELHPDVLDSILSKSLNALKAALAAKRARELVRTKSVLKSSSLPGKLADCASSNPAESEIFIVEGDSAGGSAKQGRDRKFQAILPLRGKILNIERRDEAAMYKNEEIQNLILGLGLGVKGEDFKKEALRYHKIIILTDADVDGAHIRTLLLTFFFRYQRALFDEGCIYVGVPPLYKIERGKQAHYCYDEADLKELVNTFPTNASYNTQRFKGLGEMMPVQLWETTMDPARRLLKQLTVEDAAEANVVFSSLMGSRVDYRKELIQKAAGMVNLEHLDI

SEQ ID NO: 7461 - protein, 721 aa, Secale cereale
MALLLRPSPPPPHLRLLLRRLLSTSPAPSRLLPVPSPSARLLFRPRVVAAAVPGRNGVAVRAFMASTAASDAMQEKRVAGEYTAANVQVLEALDGVRKRPGMYIGSTGPRGLHHLVYEILDNAVDEAQAGYATEINVVLHDDNSVSVTDNGRGIPTDIHPQTKKSCVETVLTLMHAGGKFGGSTSSYSVAGGLHGVGLSVVNALSEALEVTVCRDGKEYRQHYSRGKPLTTLSSTTLPDESSRQGSCIRFWPDKEIFTTTIEFDFSTISSRIREFAFLNPELTITLTKEEQDAPVQHNEYCYAGGLVEYVAWLNTDKKPLHDPIAFRKELDGIIVDVSLQWCSDSYSDTLLGYANSIRTIDGGTHIEGLKTSLTRTINSFAKKSKIMKDKDISLSGEHVREGMTCVISVKVPNPEFEGQTKTRLGNPEVRRIVEQSVQENLTEYLELHPDVLDSILSKSLNALKAALAAKRARELVRTKSVLKSSSLPGKLADCASSNPAESEIFIVEGDSAGGSAKQGRDRKFQAILPLRGKILNIERRDEAAMYKNEEIQNLILGLGLGVKGEDFKKEALRYHKIVILTDADVDGAHIRTLLLTFFFRYQRALFDEGCIYVGVPPLYKVERGKQVHYCYDEADLKELVNTFPTNASYNTQRFKGLGEMMPLQLWETTMDPERRLLKQLTVEDAAEANIVFSSLMGARVEYRKELIQKAASMVNLDHLDI

SEQ ID NO: 7462 - protein, 721 aa, Triticum aestivum
MALLLRPSPPPPHLRLLLRRLLSSAPTPSRLLPVPSPSARHLFRPRVVAAAVPGRNGVAVRAFMASTAASDAMQEKRVAGEYTAANVQVLEALDGVRKRPGMYIGSTGPRGLHHLVYEILDNAVDEAQAGYATEINVVFHDDNSVSVTDNGRGIPTDIHPQTKKSCVETVLTLMHAGGKFGGSTSSYSVAGGLHGVGLSVVNALSEALEVTVCRDGKEYRQHYSRGKPLTTLSSTTLPDESSRQGSCIRFWPDKEIFTTTIEFDFSTISSRIRELAFLNPELTITLTKEEQDAQVQHNEYCYAGGLVEYVAWLNNDKKPLHDPIAFRKELDGIIVDVSLQWCSDSYSDTVLGYANSIRTIDGGTHIEGLKTSLTRTINSFAKKSKIMKDKDISLSGEHVREGMTCIISVKVPNPEFEGQTKTRLGNPEVRRIVEQSVQENLTEYLELHPDVLDSILSKSLNALKAALAAKRARELVRTKSVLKSSSLPGKLADCASSNPAESEIFIVEGDSAGGSAKQGRDRKFQAILPLRGKILNIERRDEAAMYKNEEIQNLILGLGLGVKGEDFKKEALRYHKIVILTDADVDGAHIRTLLLTFFFRYQRALFDEGCIYVGVPPLYKVERGKQVHYCYDEADLKELVNTFPTNASYNTQRFKGLGEMMPLQLWETTMDPERRLLKQLTVEDAAEANVVFSSLMGARVEYRKELIQKAASMVNLDHLDI

SEQ ID NO: 7463 - protein, 658 aa, Triticum aestivum
MASTAASDAMQEKRVAGEYTAANVQVLEALDGVRKRPGMYIGSTGPRGLHHLVVEILDNAVDEAQAGYATEINVVLHDDNSVSVTDNGRGIPTDIHPQTKKSCVETVLTLMHAGGKFGGSTSSYSVAGGLHGVGLSVVNALSEALEVTVCRDGKEYRQHYSRGKPLTTLSSTTLPDESSRQGSCIRFWPDKEIFTTAIEFDFSTISSRIRELAFLNPELTITLTKEEQDAQVQHNEYCYAGGLVEYVAWLNTDKKPLHDPIAFRKELDGIIVDVSLQWCSDSYSDTVLGYANSIRTIDGGTHIEGLKTSLTRTINSFAKKSKIMKDKDISLSGEHVREGMTCIISVKVPNPEFEGQTKTRLGNPEVRRIVEQSVQENLTEYLELHPDVLDSILSKSLNALKAALAAKRARELVRTKSVLKSSSLPGKLADCASSNPAESEIFIVEGDSAGGSAKQGRDRKFQAILPLRGKILNIERRDEAAMYKNEEIQNLILGLGLGVKGEDFKKEALRYHKIVILTDADVDGAHIRTLLLTFFFRYQRALFDEGCIYVGVPPLYKVERGKQVHYCYDEADLKELVNTFPTNASYNTQRFKGLGEMMPLQLWETTMDPERRLLKQLTVEDAAEANVVFSSLMGARVEYRKELIQKAASMVNLDHLDI

SEQ ID NO: 7464 - protein, 429 aa, Pennisetum glaucum
KRVMPRRLHPLAYEILDNAVDEAQAGHASKINVVLHDDNSVSVTDNGRGIPTDIHPQTKKSCVETVLTLMHAGGKFGGSKSGYSVSGGLHGVGLSVVNALSEALEVTVWRDGKEYRQSYSRGKPLTTLNSITLSGETSSLQGTRIRFWPDKDIFTTTISFDFNTISSRIRELAFLNPELTITLTKEEEHTEVQYNEYCYAGGLVEYVKWLNTDKKPLHDPIAYRKELDGITVDVSLQWCSDSYSDTVLGYANSIRTIDGGTHIEGLKASLTRTINNLAKKSKTIKDKDITLSGEHVREGMTCVISVKVPNPEFEGQTKTRLGNPEVRRIVEQSVQENLTEFLELHPDVLDSILSKSLNALKAALAAKRARELVRTKSVLKSSSLPGKLADCASSNPEESEIFIVEGDSAGGSAKQGRDRKFQAIFASKG

SEQ ID NO: 7465 - protein, 587 aa, Saccharum officinarum
MSAAVACAERATNDMLIGPDWAVNIELCDIINMDPGQAKDTLKLLKKRLGSKNSKVQILTLYVLETLSKNCGDIVHQQIVERDILSEMVKIVKKKPDLSVREKILSLIDTWQVAFGGPSGKYRQYHAAYQELRAAGVDFPPREENSVPLFTPPQTQPLRHPHLYPPPGQSYEDAAIQASLQSAPPAPPLSLSEIQSARGIVDVLDEMLNALDHRHPEGVREEVIVDLVGQCRSYQSRVMDLVNSTGDESLLFQALGLNDELQRVVQRHDDIAKGIPPGTGAPVPASANVNQGTAPPRSTAVSFSPLLNVHEDDEPEDEFSVLSRRSARDGAVAQNNLPSAPRNERPSYPSPLLPPPPASKRPVYTEASGIDYLSGDSYKSEKASDDFINPTAPANISTSSNSKPEAYPAPSYGSSRPDSVSDDFINPTAPSFSAPSRPTNEEPIRSSVKQQESLPDDDFINPTALPGFSSSSATKESSEDLPKAPWESQAAAAGALPPPPARYGQRQQYFEQNVYSGGSNGGGYDGLLTQTENLSLNPRSSENEKSASRPTASRQAKPEDSLFKDLVDFAKTKPSSPSKPANSRRTR

SEQ ID NO: 7466 - protein, 582 aa, Sorghum bicolor
MSAAVACAERATNDMLIGPDWAVNIELCDIINMDPGQAKDTLKLLKKRLGSKNSKVQILTLYVLETLSKNCGDIVHQQIVERDILSEMVKIVKKKPDLNVREKILSLIDTWQVAFGGPSGKYKQYHVAYQELRAAGVDFPPREENSVPLFTPPQTQPLRHPHLYPPPGQSYEDAAIQASLQSAPPAPPLSLSEIQSARGIVDVLDEMLNALDHRHPEGVREEVIVDLVGQCRSYQSRVMDLVNSTGDESLLFQALGLNDELQRVVQRHDDIAKGIPPGTGAPVPASANVNQGTAPPRSTAVSFSPLLNVHEDDEPEDEFSVLSRRSARDGAVPQNNLPSATRNERPYPSPLLPPPPASKRPVYSEASSIDYLSGDSYKSEKVPDDFINPTAPSNISTSSHSKPEVYPPPSYGSRPDSVSDDFINPTAPSFSAPSRPTNEEPTHSSVKRQESLPDDDFINPTALPGFSSSSASKESSEDLPKAPWESQAAAAGSLPPPPARYGQRQQYFEQNVYSGGSNGGGYDGLMTQTENLSLNPRSSESASRPTASRQAKPEDSLFKDLVDFAKTKPSSPSKPANSRRTR

SEQ ID NO: 7467 - protein, 583 aa, Setaria italica
MSAAVACAERATNDMLIGPDWAVNIELCDIINMDPGQAKDTIKLLKKRLGSKNSKVQILTLYVLETLSKNCGDVVHQLIVERDILSEMVKIVKKKPDLNVREKILSLIDTWQVAFGGPSGRYPQYHAAYQELRAAGVDFPPREENSVPLFTPPQTQPLRQPHLYPPPGQSYEDAAIEASLQSAPSVPALSLSEIQSARGIVDVLDEMLNALDHRHPEGVREEVIIDLVGQCRSYQSRVMDLVNSTGDESLLFQALGLNDELQRVVQRHDDIAKGIPPGTGATAPASANTNQGTAPPRSTAVSFSPLLNVHEDDEPEDEFSVLSRRSARDGTVAQSNQPSAPRNERPYPSPLLPPPPASKRPVYTEASNIDYLSGDSYKSEKVSDDFINPTAPANISTSSHLKTEAYPPPSYGSRSESVPDDFVNPTAPSFSAPSRPTSEEPTRTSVKQQESLPDDDFINPTALPSFSSSSATKGYEDSREDIPKAPWEPQAAAGSLPPPPARYGQRQQYFEQNVYSGGSNGGGYDGLVTQTENLSLNQNEKSTSRPTASRQAKPEDSLFKDLVDFAKTKPSSPSKPANSRRTR

SEQ ID NO: 7468 - protein, 583 aa, Pennisetum glaucum
MSAAVACAERATNDMLIGPDWAVNIELCDIINMDPGQAKDTIKLLKKRLGSKNSKVQILTLYVLETLSKNCGDVVHQLIVERDILSEMVKIVKKKPDLTVREKVLSLIDTWQVAFGGSSGRYPQYHAAYQELRAAGVDFPPREENSVPLFTPPQTQPLRQPHLYPPPGQSYEDAAIEASLQSAPSVPALSLSEIQSARGIVDVLDEMLNALDHRHPEGVREEVIIDLVGQCRSYQSRVMDLVNSTGDESLLFQALGLNDELQRVVQRHDDIAKGIPPGTGATAPASANTNQGTAPPRSTAVSFSPLLNVHDDDEPEDEFSVLSRRSARDGTVAQSNQPSAPRNERPYPSPLLPPPPASKRPVYTEASNIDYLSGDSYKSEKVSDDFINPTAPANISTSSHSKTEAYPPPSYGSKSESVPDDFVNPTAPSFSAPSRPTSEEPTRTTVKRQESLPDDDFINPTALPGFPSSSATRGYEDSKEDIPKAPWEPQAAAGSLPPPPARYGQRQQYFEQTVYSGGSNGGGYDGLVTQAENLSLNQNEKSSSRPTASRQAKPEDSLFKDLVDFAKTKPSSPSKPANSRRTR

SEQ ID NO: 7469 - protein, 584 aa, Panicum virgatum
MSAAVACAERATNEMLIGPDWAVNIELCDIINMDPGQAKDTLKLLKKRLGSKNSKVQILTLYVLETLSKNCGDVVHQLIVERDILSEMVKIVKKKPDLNVREKILSLIDTWQVAFGGSSGRYPQYHAAYQELRAAGVDFPPREENSVPLFTPPKTQPLRHPHLYPPPGQSYEDAAIEASLQSAPSVPALSLSEIQSARGIVDVLDEMLNALDHKHPEGVREEVIVDLVGQCRSYQSRVMDLVNSTGDESLLFQALGLNDELQRVVQRHDDIAKGVPPGTGATAPASANVNQGTAPPRSTGVSFSPLLNVHEDDEPEDEFSVLSRRSARDGTAAQSNPPSAPRSERPYTSPLLPPPPASKMPVYREASNIDYLSGDSYKSEKVSDDFINPTAPANISTSSHSKAEAYPPPSYGSRTDSVSDDFINPTAPSFSAPSHPKSEEPTRSSAKQQESLPDDDFINPTALPGFSSPATKGYEDSREDVPKAPWEPQAAAGSLPPPPARYGQRQQYFEQNVYSGGSNGGGYDGLVTQTENLSLNQNEKSSASSRPAASRQTKPEDSLFKDLVDFAKAKPSSPSKPANSRRTR

SEQ ID NO: 7470 - protein, 582 aa, Zea mays
MSAAVACAEKATNDMLIGPDWAINIELCDIINIDPGEAKDTLKLLKKRLGSENSKVQILTLYVLETLSKNCGDIVHQQIVERDILSEMIKIVKKKPDLNVREKILSLIDTWQVVFGGPSGKYRQYHAAYEELRAAGVDFPPREENSLPLFTPPQTQPLRHSHLYPPPGQSYEDAAIQASLQSAPPAPALSLSEIQSARGIVDVLDEMLNALDHRHPEGVREEVIVDLVGQCRSYQSRVMDLVNSTGDESLLFQALGLNDELQRVVQRHDDIAKGILPPGTGAPVPASANVNQGTTPPRPTAVSFSPLLNVHEDDEPEDEFVVLFRRPARDGTVARNNLPYARRNERPYRSPLLPPPPASKRPVYTEASSIDYLSGGSYKSSEKVPDDFINPTAPANVTTSPHSKPEAYPPPSYSSRPDSVSDDFINPTAPSFSAPSRPTDEEPTRSPVKRQESIPDDDFINPTALPGFSSSSATKEFSEDLPRAPWEAQAAAAGSLPPPPARHGQRQQYLEQNVYSGGSNGGGYDELLTRTENLSLNPEKNASRPTASCQAKPEDSLFKDLVDFAKTKPSSPSKSANSRRTR

SEQ ID NO: 7471 - protein, 585 aa, Panicum virgatum
MSAAVACAERATNDMLIGPDWAVNIELCDIINMDPGQAKDTLKLLKKRLGSKNSKVQILTLYVLETLSKNCGDVVHQLIVERDILSEMVKIVKKKPDLNVREKILSLIDTWQVAFGGPSGRYPQYHAAYQELRAAGVDFPPREENSVPLFTPPQTQPLRHPHLYPPPGQSYEDAAIEASLQSAPSVPALSLSEIQSARGIVDVLDEMLNALDHRHPEGVREEVIVDLVGQCRSYQSRVMDLVNSTGDESLLFQALGLNDELQRVVQRHDDIAKGVPPGTGATAPASANVNQGTAPPRSTGVSFSPLLNVHEDDEPEDEFSVLSRRSARDGTAAQSNLPSAPRSERQYTSPILPPPPASKRPVYTEASNIDYLSGDSYKSEKVSDDFINPTAPANISTSSHSKTEAYPPPSYGSKTDSVSDDFINPIAPSFSAPAHPKSEEPTRSSAKQQESLPDDDFINPTALPGFSPPATKGYEDPREDVPKAPWEPQAAAGSLPPPPAKYGQRQQYFEQSVYSGGSNGGGSYDRLVTQTENLSLNQNEKSSTSSRPAASRQTKPEDSLFKDLVDFAKAKPSAPSKPANSRRTR

SEQ ID NO: 7472 - protein, 585 aa, Panicum virgatum
MSAAVACAERATNEMLIGPDWAVNIELCDIINMDPGQAKDTLKLLKKRLGSKNSKVQILTLYVLETLSKNCGDVVHQLIVERDILSEMVKIVKKKPDLNVREKILSLIDTWQVAFGGSSGRYPQYHAAYQELRAAGVDFPPREENSVPLFTPPKTQPLRHPHLYPPPGQSYEDAAIEASLQSAPSVPALSLSEIQSARGIVDVLDEMLNALDHRHPEGVREEVIVDLVGQCRSYQSRVMDLVNSTGDESLLFQALGLNDELQRVVQRHDDIAKGVPPGTGATAPASANVNQGTAPPRSTGVSFSPLLNVHEDDEPEDEFSVLSRRSARDGTAAQSNLPSAPRSERQYTSPILPPPPASKRPVYTEASNIDYLSGDSYKSEKVSDDFINPTAPANISTSSHSKTEAYPPPSYGSKTDSVSDDFINPIAPSFSAPAHPKSEEPTRSSAKQQESLPDDDFINPTALPGFSPPATKGYEDPREDVPKAPWEPQAAAGSLPPPPAKYGQRQQYFEQSVYSGGSNGGGSYDRLVTQTENLSLNQNEKSSTSSRPAASRQTKPEDSLFKDLVDFAKAKPSAPSKPANSRRTR

SEQ ID NO: 7473 - protein, 579 aa, Hordeum vulgare
MSAAVACAERATSDMLIGPDWAVNIELCDIINMDPGQAKDALKLLKKRLGNKNSKVQILALYVLETLSKNCGDIVYQQIIERDILSEMVKIVKKKPDLNVREKILSLIDTWQVAFGGPSGRYPQYHTAYQELRAAGVDFPPREENTVPLFTPPQTQPLRQPHLYPPGQSYEDVAIQASLQSSTPAAPPLSLSEIQSARGIVDVLDEMLNALDHRHPEGVREEVIVDLVGQCRSYHARVMDLVSDTGDESLLFQALGLNDELQRVLQRHDDIAKGVPPNIPVPVAGNVNQGAAPPRPAGVSFSPLLNVHHEDDEPEDEFSVLSRRSARDAAAAQGNMSSVPRNERPYPSPLLPPPPSTKRPVYTEASSVDYLSGDSYKSEKVPDDFVNPTAPANISAPSYSKTETDHEPKYDSRSEYVPDDFINPTAAPSFSMPSRPTSEPNNSSVNKLESLPDDDFINPTALPGFSSSSTSEDLPKAPWEAQAPVSLPPPPARHGQRQQFFEQQHGFPGGNNEGGYDEMLTQTGSLSLNQRNTENGKSASVSTASRQPKHEDALFKDLVDFAKKNPSSPSKPANSRRTR

SEQ ID NO: 7474 - protein, 579 aa, Brachypodium distachyon
MSAAVACAERATSDMLIGPDWAVNIELCDIINMDPGQAKDTLKLLKKRLGNKNSKVQILALYVLETLSKNCGDVVYQQIIERDILSEMVKIVKKKPDLNVREKILSLIDTWQVAFGGPSGRYPQYHTAYQELRTAGVDFPPREENTVPLFTPPQTQPLRQPHLFPPGQSYEDVAIQASLQSSAPAAAALSLSEIQSARGIVDVLDEMLNALDHRHPEGVREEVIVDLVGQCRSYHARVMDLVSDTGDESLLFQALGLNDELQRVLQRHDDIAKGLPPNIPVPVAGNVNQGAPPPRPAGASFSPLLNVHHEDDEPEDDFSVLSRRSARDGTAAQGNLSSVARNERPYPSPLLPPPPSTKRPVYTESSSVDYLSGDSYKSEKVPDDFVNPTAPANISAPSYSKAETNRQPSYDNRSESVSDDFINPTAVHSFSMPSRPVSEPNSSSVNQHESLPDDDFINPTALPGFSSSSTSEDLPKAPWEAQAPVSLPPPPARYGQRQQFFEQNHVFPGGNNGGGYDELLTQTGNLSLNQRNTEHEKSASASTAPRQPKPEDSLFKDLVDFAKKNPSSPTKPANSRRTR

SEQ ID NO: 7475 - protein, 576 aa, Triticum aestivum
MSAAVVCAERATSDMLIGPDWAVNIELCDIINMDPGQAKDALKLLKKRLGNKNSKVQILALYVLETLSKNCGDIVYQQIIERDILSEMVKIVKKKPDLNVREKILSLIDTWQVAFGGPSGRYPQYHTAYQELRAAGVDFPPREENTVPLFTPPQTQPLRQPHLYPPGQSYEDVAIQASLQSSTPAAPPLSLSEIQSARGIVDVLDEMLNALDHRHPEGVREEVIVDLVGQCRSYHARVMDLVSDTGDESLLFQALGLNDELQRVLQRHDDIAKGVPPNIPVPVAGNVNQGSAPARPAGVSFAPLLNVHHEDDEPEDEFSVLSRRSARDGAAAQGNMSSVPRNERPYPSPLLPPPPSTKRPVYTEASSVDYLSGDSYKSEKVPDDFVNPTAPANMSAPSHSKTETDQVPNYDSRSENVPDDFINPTAAPSFSMPSRPTSEPSVNKLESLPDDDFINPTALPGFSSSSTSEDLPKAPWEAQAPVSLPPPPARYGQRQQFFEQQHGFPGENNEGGYDEMLTRTGSLSLNQRNTENGKSASVSTASRQPKPEDALFKDLVDFAKKNPSSPSKPANSRRTR

SEQ ID NO: 7476 - protein, 576 aa, Triticum aestivum
MSAAVACAERATSDMLIGPDWAVNIELCDIINMDPGQAKDALKLLKKRLGNKNSKVQILALYVLETLSKNCGDIVYQQIIERDILSEMVKIVKKKPDLNVREKILSLIDTWQVAFGGPSGRYPQYHTAYQELRAAGVDFPPREENTVPLFTPPQTQPLRQPHLYPPGQSYEDVAIQASLQSSTPAAPPLSLSEIQSARGIVDVLDEMLNALDHRHPEGVREEVIVDLVGQCRSYHARVMDLVSDTGDESLLFQALGLNDELQRVLQRYDDIAKGVPPNIPVPVAGNINQGTAPPRPAGASFAPLLNVHHEDDEPEDEFSVLSRRSARDGAAAQGNMSSVPRNERPYPSPLLPPPPSTKRPVYTEASSVDYLSGDSYKSEKVPDDFVNPTAPANMSAPSHSKTETDQVPNYDSRSENVPDDFINPTAAPSFSMPSRPTSEPSVNKLESLPDDDFINPTALPGFSSSSTSEDLPKAPWEAQAPVSLPPPPARYGQRQQFFEQQHGFPGENNEGGYDEMLTRTGSLSLNQRNTENGKSASVSTASRQPKPEDALFKDLVDFAKKNPSSPSKPANSRRTR

SEQ ID NO: 7477 - protein, 576 aa, Triticum aestivum
MSAAVSCAERATSDMLIGPDWAVNIELCDIINMDPGQAKDALKLLKKRLGNKNSKVQILALYVLETLSKNCGDIVYQQIIERDILSEMVKIVKKKPDLNVREKILSLIDTWQVAFGGPSGRYPQYHTAYQELRAAGVDFPPREENTVPLFTPPQTQPLRQPHLYPPGQSYEDVAIQASLQSSTPAAPPLSLSEIQSARGIVDVLDEMLNALDHRHPEGVREEVIVDLVGQCRSYHARVMDLVSDTGDESLLFQALGLNDELQRVLQRHDDIAKGVSPNIPVPVAGNINQGTAPPRPAGASFAPLLNVHHEDDEPEDEFSVLSRRSARDGAAAQGNMSSVPRNERPYPSPLLPPPPLTKRPVYTEASSVDYLSGESYKSEKVPDDFVNPTAPANMSAPSHSKTETDQVPNYDSRSENVPDDFINPTAAPSFSMPSRPTSEPSVNKLESLPDDDFINPTALPGFSSSSTSEDLPKAPWEAQAPVSLPPPPARYGQRQQFFEQQHGFPGENNEGGYDEMLTRTESLSLNQRNTENGKSASVSTASRQPKPEDALFKDLVDFAKKNPSSPSKPANSRRTR

SEQ ID NO: 7478 - protein, 576 aa, Triticum aestivum
MSAAVSCAERATSDMLIGPDWAVNIELCDIINMDPGQAKDALKLLKKRLGNKNSKVQILALYVLETLSKNCGDIVYQQIIERDILSEMVKIVKKKPDLNVREKILSLIDTWQVAFGGPSGRYPQYHTAYQELRAAGVDFPPREENTVPLFTPPQTQPLRQPHLYPPGQSYEDVAIQASLQSSTPAAPPLSLSEIQSARGIVDVLDEMLNALDHRHPEGVREEVIVDLVGQCRSYHARVMDLVSDTGDESLLFQALGLNDELQRVLQRHDDIAKGVPPNIPVPVAGNINQGTAPPRPAGASFAPLLNVHHEDDEPEDEFSVLSRRSARDGAAAQGNMSSVPRNERPYPSPLLPPPPLTKRPVYTEASSVDYLSGESYKSEKVPDDFVNPTAPANMSAPSHSKTETDQVPNYDSRSENVPDDFINPTAAPSFSMPSRPMSEPSVNKLESLPDDDFINPTALPGFSSSSTSEDLPKAPWEAQAPVSLPPPPARYGQRQQFFEQQHGFPGENNEGGYDEMLTRTGSLSLNQRNTENGKSASVSTASRQPKPEDALFKDLVDFAKKNPSSPSKPANSRRTR

SEQ ID NO: 7479 - protein, 325 aa, Oryza sativa
MEVVVARQPKAKKQINLFYCSECEELALKVAASSDTIHLQSINWRSFDDGFPNLFINNAHDIRGQHVAFLASFSSPSVIFEQISVIFALPKLFIASFTLVLPFFPTGSFERVEEEGDVATAFTLARILSMIPKSRGGPTSVVIYDIHALQERFYFGDDVLPCFETGIPLLLQRLRQLPDADNITIAFPDDGAWKRFHKLLLNFPMVVCAKVREGDKRIVRIKEGNPEGRHVVIVDDLVQSGGTLRECQKVLAAHGAAKVSAYVTHAVFPKQSYERFTHTNSAGSADKFAYFWITDSCPQTVKAINQQPPFEVLSLAGSIADALQI

SEQ ID NO: 7480 - protein, 312 aa, Elaeis guineensis
PIHLFYCAECEELARKVAEQSDAIQLQSISWRSFDDGFPNLFIKNAHDIRGQHVAFLASFSSPGVIFEQISAIFALPKLFIASFTLVLPFFPTGSFERVEEEGDVATAFTMARILSMIPKSRGGPTSVVIYDIHALQERFYFGDDVLPCFESGIPLLLQRLRQLPDADNVTIAFPDDGAWKRFHKQLLNFPMVVCAKVREGDKRIVRIKEGNPEGRHVVIVDDLVQSGGTLIECQKVLATHGAAKVSAYVTHGVFPKQSWERFLQNGSEGSPNNFTYFWITDSCPLTVKTIANSAPFEVLSLAGSIADALQI

SEQ ID NO: 7481 - protein, 319 aa, Musa acuminata
MAMRTKKQVNLFYCSESEELARKVADQSDAIQLRTISWRNFDDGFPNLFINNAHDIRGQHVAFLASFSSPGVIFEQISAIFALPKLFIASFTLVLPFFPTGSFERMEEEGDVATAFTMARILSMIPKSRGGPTSIVIYDIHALQERFYFGDDVLPCFETGIPLLLQRLRKLPDADNVTIAFPDDGAWKRFHKQLMHFPMIVCAKVREGDKRIVQIKEGNPAGRHVVIVDDLVQSGGTLIECQKVLTAHGAGKVSAYVTHGVFPKRSWERFVHIKAERSDHRFANFWITDSCPLTVKAIANEAPFEVLSLAGSIADALQV

SEQ ID NO: 7482 - protein, 305 aa, Phalaenopsis aphrodite
AEAEELARKVAEQSDSIQLRSIAWRSFDDGFPNLFINDAHDIRGQHVAFLASFSSPAVIFEQISAIFALPKLFIASFTLVLPFFPTGSFERMEEEGDVATAFTMARILSMIPKSRGGPTSVVIYDIHALQERFYFGDDVLPCFETGIPLLLLRLRQLPDADNITIAFPDDGAWKRFHKQLQHFPMVVCAKVREGDKRIVRIKEGNPNGRHVVIVDDLVQSGGTLIECQKVLASNGAAKVSAYVTHGVFPKQSWQRFVQNNSNDLSNWFTYFWITDSCPLTVKAIGGKPPFEVLSLASSIADALQI

SEQ ID NO: 7483 - protein, 321 aa, Papaver somniferum
MEKCKQKKVLLFYCVESEDLARKVAASQSDSIQLQSINWRSFDDGFPNLFINNAQDIRGQHVAFLASFSSPAVIFEQLSVIFALPRLFVASFTLVLPFFPTGSFERMEEEGDVATAFTMARILSNIPISRGGPTSLVIYDIHALQERFYFGDHVLPCFETGIPLLKQRLDQLPDADNIVVAFPDDGAWKRFYKQLQHYPMVVCTKVREGDKRIVRLKEGNPAGRHVVIVDDLVQSGGTLIECQKVLAAHGATKVSAYVTHGVFPKRSWERFTSCNEKEESERAFSYFWITDSCSHTVKAIGDRAPFEVLSLAGSIADALQI

SEQ ID NO: 7484 - protein, 119 aa, Zea mays
MHDFCFTIPYGFAVLAGGVLGYLRRGSTASLAGGAGAGALLLLAGFVSLKAFEKRRNSYVALALETLCALALTFVMGQRFLETSKIMPAGVVAGLSAVMSAFYLFKIASGGNHIPPKKE

SEQ ID NO: 7485 - protein, 119 aa, Panicum virgatum
MHDFCFTIPYGFAVLAGGVLGYLRRGSTASLAGGAGAGALLLLAGFVSLKAFEKRRNSYLALALETLCAFALTYVMGQRYLETSKIMPAGVVAGLSAVMSAFYLFKIATGGNHIPPKKE

SEQ ID NO: 7486 - protein, 119 aa, Cynodon dactylon
MHDFCFTIPYGFAVLAGGLLGYLRRGSTASLAGGAGAGALLLLAGFVSLKAFEKRRNSYVALAIETLCALALTYVMGQRFLETSKIMPAGVVAGLSALMSAFYLFKIATGGNHIPPKKE

SEQ ID NO: 7487 - protein, 119 aa, Pennisetum glaucum
MHDFCFTIPYGFAVLAGGVLGYLRRGSTASLAGGAGAGALLLLAGFVSLKAFEKRRNSYLALALETLCAFTLTYVMGQRYLETSKIMPAGVVAGLSAVMSAFYLFKIATGGNHIPPKKE

SEQ ID NO: 7488 - protein, 119 aa, Saccharum officinarum
MHDFCFTIPYGFAVLAGGVLGYLRRGSTASLVGGAGAGALLLLAGFVSLKAFEKRRNSYVALALQTICALALTYVMGQRFLETSKIMPAGVVAGLSAVMSTFYLFKIATGGNHIPPKKE

SEQ ID NO: 7489 - protein, 119 aa, Setaria italica
MHDFCFTIPYGFAVLAGGVLGYLRRGSTASLAGGAGAGALLLLAGFVSLKAFEKRRNSYLALALETLCAFALTYVMGQRYLETSKVMPAGVVAGLSALMSAFYLFKIATGGNHIPPKKE

SEQ ID NO: 7490 - protein, 119 aa, Oryza sativa
MHDFCFTIPYGFAVLAGGVLGYARRGSTASLAGGAGAGALLLLAGFVSLKTFEKRRNSYLALALETLCALALTYVMGQRYLETSKIMPAGVVAGLSALMSAFYLFKIATGGNHIPPKKE

SEQ ID NO: 7491 - protein, 119 aa, Sorghum bicolor
MHDFCFTIPYGFAVLAGGVMGYLRRGSTASLAGGAGAGAILLLAGFVSLKAFEKRRNSYVALALQTLCALALTYVMGQRYLETSKIMPAGVVAGLSAVMSVFYLFKIATGGNHIPPKKE

SEQ ID NO: 7492 - protein, 119 aa, Hordeum vulgare
MHDFCFTIPYGFAVLAGGLLGYLRRGSTASLAGGAGVGGLLLLAGFVSLKAFEKRRNSYLALALETLCALALTFVMGQRYLETSKIMPAGVVAGLSALMSAFYLFKIATGGNHFPPKKE

SEQ ID NO: 7493 - protein, 119 aa, Triticum aestivum
MHDFCFTIPYGFAVLAGGLLGYLRRGSTASLAGGAGVGGLLLLAGFVSLKAFEKRRNSYLALALETLCALALTFVMGQRYLETSKIMPAGVVAGLSALMSAFYLFKIATGGNHFSPKKE

SEQ ID NO: 7494 - protein, 119 aa, Brachypodium distachyon
MHDFCFTIPYGFAVLAGGLIGYLRRGSTASLAGGAGVGGLLLLAGFVSLKAFEKRRNSWLALALETLCALALTYVMGQRYLETSKIMPAGVVAGLSALMSAFYLFKIATGGNHISPKKE

SEQ ID NO: 7495 - protein, 119 aa, Pseudoroegneria spicata
MHDFCFTIPYGFAVLAGGLLGYLRRGSTASLAGGAGVGGLLLLAGFVSLKAFEKRRNSYLALALETLCALALTFVMGQRYLETSKIMPAGVVAGLSALMSLFYLFKIATGGNHFSPKKE

SEQ ID NO: 7496 - protein, 119 aa, Secale cereale
MHDFCFTIPYGFAVLAGGLLGYFRRGSTASLAGGAGVGGLLLLAGFVSLKAFEKRRNSYLALALETLCALALTFVMGQRYLETSKIMPAGVVAGLSALMSAFYLFKIATGGNHFSPKKE

SEQ ID NO: 7497 - protein, 119 aa, Triticum aestivum
MHDFCFTIPYGFAVLAGGLLGYLRRGSTASLAGGAGVGGLLLLAGFVSLKAFEKRRNSYLALALETLCALALTFVMGQRYLETSKIMPAGVVAGLSVLMSAFYLFKIATGGNHFSPKKE

SEQ ID NO: 7498 - protein, 119 aa, Avena sativa
MHDFCFTIPYGFAVLAGGLLGYLRRGSTASLAGGAGVGGLLLLAGFVSLKAFEKRRNSYLALALETLCAVALTFVMGQRYLETSKIMPAGVVAGLSAVMSLFYVFKIANGGNHFSPKKE

SEQ ID NO: 7499 - protein, 658 aa, Sorghum bicolor
MAETLNVSPDDANGSAAVQTEPSSHEDAAIEDMESFLVEVDEVKDKFHVFGVVNKAIIKGILSDVQQEAASQIALKDAEIASLNQKLQQLGNGSLSLSEGRDKRHDEFYSLRQQLDSISKSLLNSEWGLSGSQHNFEDENASKQQDKEKPSRNGVAKTIGPGESKEVVFGDPKLLDHMDKAALISHFNKSMNEMKRQHDSVLHERTEEIFKLKREILKKDGSNPFHLRNNKELEQTRKKMEEVISKLDVLLLENKRNPVRIKSNTIPGQQDKNNVLDSEIQQLESGASNNEEDDCSIPTHSSHFASREADHELNIVRLESDVEDARIAATFREEIERIIIKEFISEINVELHGFEIEGDMKQEVCSIIHNEAVARAMSNIDSLLSKYEEKKSHAEEESLHKQNIEKLKLIVDSFTEVVSEKEKFISQIGLEAMQIRVESMCRELVLLRDKMAKQDSYLSEKNREFGVIMGRLEQARQHVQHNDVTLVELNGRLRTISDSKKDLEKQNQALHNVIEEKEKMLTLAVSKDNYMRKFMENVVKSIRDFEILMMDQQAVVANKVQHIESRFCFLKEQCKHLAKEGNLLRKKALRYKEISEARGSNLQKAELEVDLLGDEVEALTNLLAKIYTALDHYSPVLQHYTGVMETLNMIKKHISMTK

SEQ ID NO: 7500 - protein, 222 aa, Sorghum bicolor
MFARPVLAALLLPAFLLSAAGAADSKDNPADQLVALINSNRTASKASAVSDNQGLGCIALQYIRAYEGHCDQVDDKKPMESSFTDTFAPTCGVQATTLSKITGRLVGCQSKYATPAEAFNILVNDAKGLQILHSKNHTEVGAAVSGTDGGGPYFWCVLFSDGKPTTSFKVDGEVPKAAIHPGCFSGNNDDCMGATNGAISTNAGASRLVAALPFAVACAFAL

SEQ ID NO: 7501 - protein, 524 aa, Sorghum bicolor
MAEVKPEEISHPPMEQLQGFEYCIDSNPPWGEAIILGFQHYILALGTAVMIPAVLVPMMGGDDGDRVRVVQTLLFVTGINTLLQSLFGTRLPTVIGGSYAFVIPIMAIIQEPSLSGIADGHQRFLETMKAIQGALIVSSSIQIILGYSQLWGIFSRFFSPVGMTPVVALLGFGLFERGFPVVGRCVEIGLPMLILFVVLSQYLKNIQIKEIPILERFSLFICIALVWAYAQILTSGGAYKNSSEVTQNNCRTDRANLISSAPWIKIPYPLQWGAPTFNAGQSFGMVSAVLVSLVESTASYKAAARLASATPPPAHILSRGIGWQGIGILLDGLFGTGTGSTVSVENVGLLGSTRIGSRRVIQISAGFMIFFSILGKFGALFASIPFTIFAAVYCVLFGLVAAVGLSFLQFTNMNSMRNLFIVGVSIFLGLSVPEYFFRYTMAAHRGPAHTKAGWFNDYINTIFSSPPTVGLIVAVFLDNTLEMKDAGKDRGMPWWLRFRAFKGDSRNEEFYSLPFNLNRFFPPA

SEQ ID NO: 7502 - protein, 524 aa, Setaria italica
MAEAKPEEISHPPMEQLQGFEYCIDSNPPWGEAIILAFQHYILALGTAVMIPAVLVPMMGGDDGDRVRVVQTLLFVTGINTLLQSLFGTRLPTVIGGSYAFVIPIVAIIQDSSLAAIPDGHERFLETMRAIQGALIVSSSIQIILGYSQLWGIFSRFFSPVGMAPVVALLGFGLFERGFPVVGRCVEVGLPMLILFVVLSQYLKNIQIKDIPILERFSLFICIALVWAYAQILTSGGAYKNSTEVTQINCRTDRANLISSAPWIKIPYPLQWGAPTFNAGQSFGMVSAVLVSLVESTASYKAAARLASATPPPAHILSRGIGWQGIGILLDGLFGTGTGSTVSVENVGLLGSTRIGSRRVIQISAGFMIFFSMLGKFGALFASIPFTIFAAVYCVLFGLVAAVGLSFLQFTNMNSMRNLFIVGVSIFLGLSVPEYFFRYTMAAQRGPAHTKAGWFNDYINTIFSSPPTVGLIVAVFLDNTLETKDAGNDRGLPWWVRFRSFKGDSRNEEFYSLPFNLNRFFPPA

SEQ ID NO: 7503 - protein, 524 aa, Panicum virgatum
MAEAKPEEISHPPMEQLQGFEYCIDSNPPWGEAIILAFQHYILALGTAVMIPAVLVPMMGGDDGDRVRVVQTLLFVTGINTLLQSLFGTRLPTVIGGSYAFVIPIVAIIQDSSLAPIPDGHERFLETMRAIQGALIVSSSIQIILGYSQLWGIFSRFFSPVGMAPVVALLGFGLFERGFPVVGRCVEVGLPMLILFVVLSQYLKNVQIKDIPILERFSLFICIALVWAYAQILTSGGAYKNSTEVTQINCRTDRANLISSAPWIKIPYPLQWGAPTFNAGQSFGMVSAVLVSLIESTASYKAAARLASATPPPAHILSRGIGWQGIGILLDGLFGTGTGSTVSVENVGLLGSTRIGSRRVIQISAGFMIFFSMLGKFGALFASIPFTIFAAVYCVLFGLVAAVGLSFLQFTNMNSMRNLFIVGVSIFLGLSVPEYFFRYTMAAQRGPAHTKAGWFNDYINTIFSSPPTVGLIVAVFLDNTLETKGAANDRGLPWWARFRSFKGDSRNEEFYSLPFNLNRFFPPA

SEQ ID NO: 7504 - protein, 524 aa, Brachypodium distachyon
MAEVKPEEISHPAMEQLQGFEYCIDSNPPWGEAIILGFQHYILALGTAVMIPAVLVPMMGGTDGDRVRVVQTLLFVTGINTLLQSLFGTRLPTVIGGSYAFVVPIMAIVQDSSLAGIPDDHERFLQSMRAIQGALIVSSSIQIILGYSQLWGIFSRFFSPLGMAPVVALLGFGLFERGFPVVGRCVEVGLPMLILFVVLSQYLKNIQIRDIPILERFSLFICIALVWAYAQILTSGGAYKHSSEVTQNNCRTDRANLISSAPWIKIPYPLQWGAPTFSAGQSFGMVSAVLISLIESTASYSAAARLASATPPPAHILSRGIGWQGIGILLSGLFGTGTGSTVSVENVGLLGSTRIGSRRVIQISAGFMIFFSMLGKFGALFASIPFTIFAAVYCVLFGLVAAVGLSFLQFTNMNSMRNLFIVGVSIFLGLSVPEYFFRYSMAAQRGPAHTKAGWFNDYINAIFSSPPTVGLIVAVFLDNTLEVKDAGKDRGMPWWVQFRSFKGDTRNEEFYSLPFNLNRFFPPS

SEQ ID NO: 7505 - protein, 524 aa, Oryza sativa
MAEVKPEEISYPPMEQLQGFEYCIDSNPPWGEAIILGFQHYILALGTAVMIPAVLVPMMGGSDGDRVRVVQTLLFVTGINTLLQSLFGTRLPTVIGGSYAFVVPIMAIIQDSSLAAIPDDHERFLQTMRAIQGALIVSSSIQIILGYSQLWGIFSRFFSPLGMAPVVALLGFGLFERGFPVVGRCVEVGLPMLILFVVLSQYLKNVQIRDIPILERFSLFICIALVWAYAQILTAGGAYKHSPEVTQINCRTDRANLISSAPWIKIPFPLQWGAPTFSAGQSFGMVSAVLVSLVESTASYKAAARLASATPPPAHILSRGIGWQGIGILLDGLFGTGTGSTVSVENVGLLGSTRIGSRRVIQISAGFMIFFSMLGKFGALFASIPFTIFAAVYCVLFGLVAAVGLSFLQFTNMNSMRNLFIVGVSIFLGLSVPEYFFRYSMAAQRGPAHTKAGWFNDYINTIFSSPPTVGLIVAVFLDNTLEVKNAAKDRGMPWWVPFRSFKGDARSEEFYSLPFNLNRFFPPS

SEQ ID NO: 7506 - protein, 524 aa, Triticum aestivum
MSEVKPEEISHPAMEQLQGFEYCIDSNPPWGEAIILGFQHYILALGTAVMIPAVLVPMMGGSDGDRVRVVQTLLFVTGINTLLQSLFGTRLPTVIGGSYAFVIPVMAIVQDSSLAAIPDDHERFLQSMRAIQGALIVSSSIQIILGYSQLWGIFSRFFSPLGMAPVVALLGFGLFERGFPVVGRCVEVGLPMLILFVVLSQYLKNVQIREIPILERFSLFICIALVWAYAQILTSGGAYNHSTEVTQINCRTDRANLISSAPWIKIPYPLQWGAPTFSAGQSFGMVSAVLVSLIESTASYSAAARLASATPPPAHILSRGIGWQGIGILLCGLFGTGTGSTVSVENVGLLGSTRIGSRRVIQICAGFMIFFSMLGKFGALFASIPFTIFAAVYCVLFGLVAAVGLSFLQFTNMNSMRNLFIVGVSIFLGLSVPEYFFRYSMAAQRGPAHTKAGWFNDYINTIFSSPPTVGLMVAVFLDNTLEVKDAGRDRGMPWWVPFRSFKGDSRNEEFYSLPFNLNRFFPPS

SEQ ID NO: 7507 - protein, 524 aa, Secale cereale
MSEVKPEEISHPAMEQLQGFEYCIDSNPPWGEAIILGFQHYILALGTAVMIPAVLVPMMGGNDGDRVRVVQTLLFVTGINTLLQSLFGTRLPTVIGGSYAFVVPVMAIVQDSSLAAIPDDHERFLQSMRAIQGALIVSSSIQIILGYSQLWGIFSRFFSPLGMAPVVALLGFGLFERGFPVVGRCVEVGLPMLILFVVLSQYLKNVQIREIPILERFSLFICIALVWAYAQILTSGGAYNHSTEVTQINCRTDRANLISSAPWIKIPYPLQWGAPTFSAGQSFGMVSAVLVSLIESTASYSAAARLASATPPPAHILSRGIGWQGIGILLCGLFGTGTGSTVSVENVGLLGSTRIGSRRVIQICAGFMIFFSMLGKFGALFASIPFTIFAAVYCVLFGLVAAVGLSFLQFTNMNSMRNLFIVGVSIFLGLSVPEYFFRYSMAAQRGPAHTKAGWFNDYINTIFSSPPTVGLMVAVFLDNTLEVKDAGRDRGMPWWVPFRSFKGDSRNEEFYSLPFNLNRFFPPS

SEQ ID NO: 7508 - protein, 524 aa, Triticum aestivum
MSEVKPEEISHPAMEQLQGFEYCIDSNPPWGEAIILGFQHYILALGTAVMIPAVLVPMMGGNDGDRVRVVQTLLFVTGINTLLQSLFGTRLPTVIGGSYAFVIPVMAIVQDSSLAAISDDHERFLQSMRAIQGALIVSSSIQIILGYSQLWGIFSRFFSPLGMAPVVALLGFGLFERGFPVVGRCVEVGLPMLILFVVLSQYLKNVQIREIPILERFSLFICIALVWAYAQILTSGGAYNHSTEVTQINCRTDRANLISSAPWIKIPYPLQWGAPTFSAGQSFGMVSAVLVSLIESTASYSAAARLASATPPPAHILSRGIGWQGIGILLCGLFGTGTGSTVSVENVGLLGSTRIGSRRVIQICAGFMIFFSMLGKFGALFASIPFTIFAAVYCVLFGLVAAVGLSFLQFTNMNSMRNLFIVGVSIFLGLSVPEYFFRYSMAAQRGPAHTKAGWFNDYINTIFSSPPTVGLMVAVFLDNTLEVKDAGRDRGMPWWVPFRSFKGDSRNEEFYSLPFNLNRFFPPS

SEQ ID NO: 7509 - protein, 524 aa, Hordeum vulgare
MSEVKPEEISHPAMEQLQGFEYCIDSNPPWGEAIILGFQHYILALGTAVMIPAVLVPMMGGSDGDRVRVVQTLLFVTGINTLLQSLFGTRLPTVIGGSYAFVVPVMAIVQDSSLAAIPDDHERFLQSMRAIQGALIVSSSIQIILGYSQLWGIFSRFFSPLGMAPVVALLGFGLFERGFPVVGRCVEVGLPMLILFVVLSQYLKNVQIREIPILERFSLFICIALVWAYAQILTSGGAYNHSTEITQINCRTDRANLISSAPWIKIPYPLQWGAPTFSAGQSFGMVSAVLVSLIESTASYSAASRLASATPPPAHILSRGIGWQGIGILLCGLFGTGTGSTVSVENVGLLGSTRIGSRRVIQICAGFMIFFSMLGKFGALFASIPFTIFAAVYCVLFGLVAAVGLSFLQFTNMNSMRNLFIVGVSIFLGLSVPEYFFRYSMAAQRGPAHTKAGWFNDYINTIFSSPPTVGLMVAVFLDNTLEVKDAGRDRGMPWWVPFRSFKGDSRNEEFYSLPFNLNRFFPPS

SEQ ID NO: 7510 - protein, 468 aa, Panicum virgatum
EWCCCSQGDRVRVVQTLLFVTGINTLLQSLFGTRLPTVIGGSYAFVIPIVAIIQDSSLAAIPDGHERFLETMRAIQGALIVSSSIQIILGYSQLWGIFSRFFSPVGMAPVVALLGFGLFERGFPVVGRCVEVGLPMLILFVVLSQYLKNVQIKDIPILERFSLFICIALVWAYAQILTSGGAYKNSTEVTQINCRTDRANLISSAPWLKIPYPLQWGAPTFNAGQSFGMVSAVLVSLIESTASYKAAARLASATPPPAHILSRGIGWQGIGILLDGLFGTGTGSTVSVENVGLLGSTRIGSRRVIQICAGFMIFFSMLGKFGALFASIPFTIFAAVYCVLFGLVAAVGLSFLQFTNMNSMRNLFIVGVSIFLGLSVPEYFFRYTMAAQRGPAHTKAGWFNDYINTIFSSPPTVGLMVAVFLDNTLETKDAGKDRGLPWWVRFRSFKGDSRNEEFYSLPFNLNRFFPPA

SEQ ID NO: 7511 - protein, 524 aa, Musa acuminata
MAEIKPEEITHPPMDQLQGFEYCIDSNPSWGEAIVLGFQHYILALGTAVMIPTLLVPLMGGSNDDKVRVVQTLLFVTGVNTLLQTLFGTRLPTVVGGSYAFVVPIISIIHDSSLTRIVDDHERFLQTMRAIQGALIVSSSIQIILGYSQLWGIFSRFFSPLGMVPVVSLVGFGLFDKGFPVVGRCVEIGIPMLILFIASSQYLKHLHVRRLPVLERFSLLITITIIWVYAHLLTVGGAYKYRPERTQFNCRTDRANLISSAPWIKIPYPLQWGAPTFDAGHSFGMMAAVFVSLIESTGTYKAAARLASATPPPAHVLSRGIGWQGIGILLDGLFGTVTGSTVSVENVGLLGSTRVGSRRVIQISAGFMIFFSILGKFGALFASIPFTIFAAVYCVLFGVVAAVGLSLLQFTNMNSMRNLFIVGVSIFLGLSVPEYFFRYTMSAQHGPAHTKASWFNDYMNTIFSSPPTVALIVAVFLDNTLDFKDTGKDRGMPWWARFRTFNGDSRSEEFYTLPFNLDRFFPPS

SEQ ID NO: 7512 - protein, 524 aa, Musa acuminata
MAEVKPEEITHPPMDQLHGLEYCIDSNPSWGEAIALGFQHYILALGTAVMIPTLLVHLMGGTDDDKVKVVQTLLFVSGINTLLQTLFGTRLPIVIGGSYAFVVPIISIIHDSSLAQITDDHERFLQTMRAIQGALIVSSSIQIILGYSQLWGICSRFFSPLGMVPVVSLVGFGLFDRGFPVVGRCVEIGIPMLILFIASSQYLKHLHIRRWPILERFSLLITIVIIWIYAYLLTVGGAYKHRPERTQVNCRTDRANLISSAPWIKIPYPLQWGAPTFNAGHSFGMMAAVLVSLIESTGAFKAAARLASATPPPAHVLSRGIGWQGIGILLDGLFGTASGSTVSVENVGLLGSTRVGSRRVTQISACFMIFFSIMGKFGAFFASIPFTIFAAVYCVLFGLVAAVGLSLLQFTNMNSMRNLFIVGVSIFLGLSVPQYFFRYTLSAQHGPAHTNAGWFNDYINTIFSSPPTVALIVAVFLDNTLDFEDAAADRGMPWWTRFRTFKGDSRNEEFYTLPFNLNRFFAPS

SEQ ID NO: 7513 - protein, 107 aa, Elaeis guineensis
MTDFKPEEISHPPMDQLQGFEYCIDSNPSWGEAIALGFQHYILALGTAVMIPTLLVPLMGGSDDDKVRVVQTLLFVTGINTLLQTLFGLAFQLWLVVLMHSWSRSSP

SEQ ID NO: 7514 - protein, 524 aa, Phalaenopsis aphrodite
MSDFKPEEISHPPMDQLQGFEYCIDSNPSWGEAIALGFQHYILALGTAVMIPTFLVPLMGGSDDDKVRVVQTLLFVGGINTLIQTLFGTRLPTIIGGSYAFLIPTISIIHDSSFSQIANDHERFLQTMRAIQGALIVSSSIQIILGYSQLWGICTRFFSPVGMVPVVSLVGFGLFYRGFPVVGRCVEIGVPMLILFVALSQYLKHLNVRRLPVLERFALLISIAILWLYAHILTVSGAYKYRPAKTQFNCRTDRANLISSASWIKIPYPLQWGAPTFDAGHAFGMMAAVFVSLVESTGAYKAAARLASATPPPAHVLSRGIGWQGIGILLDGLFGTVSGSTVSVENVGLLGSTRVGSRRVIQISAGFMIFFSILGKFGALFASIPFTIFAALYCVLFGLVAAVGLSFLQFTNMNSMRNLFIVGLSMFLGLSIPEYFFSYTESANHGPAHTKAEWFNDYINTIFSSPATVALIISVFLDNTLDFKETGKDRGMPWWVRFRTFKGDSRNEEFYTLPFNLNRFFPPS

SEQ ID NO: 7515 - protein, 525 aa, Musa acuminata
MAEVKPEEIITHPPMDQLQGFEYCIDSNPSWGEAIALGFQHYVLALGTAVMIPTFLVPLMGGSDDDKVRVVQTLLFVTGINTLIQTLFGTRLPTVIGGSYAFMVPIISIIHDSSLTQITDDHQRFLQTMRAIQGALIVSSCIQIILGYSQLWGICSRFFSPLGMVPVVSLVGFGLFDRGFPVVGRCVEIGVPMLILFVASSQYLKHLHVRGLPILERFSLLITITIIWVYAHLLTVSGAYKHHPERTQVNCRTDRANLISSAPWIKIPYPLQWGAPTFDAGHSFGMMAAVFASLIESTGAYKAAARLASATPPPAHVLSRGIGWQGIGILLDGLFGTVTGSTVSVENLGLLGSTRVGSRRVIQISAGFMIFFSIMGKFGALFASIPFVIFAAVYCVLFGIVAAVGLSLLQFTNMNSMRNLFITGVSIFLGLSVPQYFFKYTSSAQRGPAHTNAEWFNDYINTIFSSPPTVALIVAVFLDNTLDVSGTAGDRGMAWWARFRKFQGDSRNEEFYTLPFNLNRFFPPS

SEQ ID NO: 7516 - protein, 524 aa, Aristolochia fimbriata
MAAPKPEEISHQPMDQLQGFEYCIDSNPSWGEAIALGFQHYILALGTSVMIPSLLVPVMGGTDDDKVRVVQTLLFVGGINTLLQTLFGTRLPTVIGGSYAFVVPIMSIIRDSSLMRISDPHTRFLQSMRAIQGALIVSSSVQIILGYSQLWGICSRFFSPLGMVPVIALVGFGLFDRGFPVVGKCVEIGVPMLILFVAFSQYLKRFQARNLPILERFALLLAVTIIWAYAHLLTASGAYRHRPERTQNNCRTDRANLISSAPWIKIPYPLQWGAPTFDAGHAFGMMAAVLVSLIESTGAYKAASRLASATPPPAHVLSRGIGWQGIGILLDGLFGTGTGSTVSVENVGLLGSTRVGSRRVIQISAGFMIFFSILGKFGALFASIPFTIFAAVYCILFGLVASVGLSFLQFTNMNSMRNLFITGVSLFLGLSIPQYFYEYTASAGHGPAHTGAGWFNDFLNTIFFSPPTVALIVAVFLDNTLDYKDTALDRGMPWWARFRTFKGDSRNEEFYTLPFNLNRFFPPS

SEQ ID NO: 7517 - protein, 525 aa, Musa acuminata
MAEVKPEEIVTHPPMDQLQGFEYCIDSNPSWGEAISLGFQNYILALGAAVMIPTLLVPLMGGSDDDKVRVVQTLLFVTGINTLLQTLFGTRLPTIVGGSYAFVVPIISIIHDSSLTRITDDHERFLQTMRAIQGALIVSSCIQIVLGYSQLWSIFSRFFSPLGMVPVVSLVGFGLFDRGFPVVGRCVEIGVPMLILFIAASQYLKHLHVRRLPVLERFSLLLTITIIWVYAHLLTVGGAYKHRPERTQINCRTDRADLISSAPWIKIPYPLQWGAPTFDAGHSFGMMAAVLVSMIESTGAYNAAARLASATPPPAYVLSRGIGWQGIGVLLDGLFGTATGSTVSVENVGLLGSTRVGSRRVIQISAGFMIFFSILGKFGALFASIPFTIFAAVYCVLFGIVAAVGLSLLQFTNMNSMRNLFITGVSIFLGLSIPQYFFRYTASARHGPAHTKAEWFNDYINTIFSSPPTVALIVAVFLDNTLDFKDTAGDRGMPWWARFRKFKGDGRNEEFYTLPFNLNRFFPPR

SEQ ID NO: 7518 - protein, 525 aa, Oryza sativa
MAEVKPEDMVHHPPMDQLQGFEYCIDSNPSWGEAIALGFQHYILSLGTAVMIPTMLVPLMGGNDHDKARVVQTLLFVTGIKTLLQTLFGTRLPTIIGGSYAFVVPILSIIRDPSLAQIADGHTRFVQTMRAIQGSLIVSSSIQIILGYSQLWAICSRFFSPLGMVPVVALVGLGLFERGFPVIGRCVEIGLPMLILFVALSQYLKHVNVRHVPVLERFSLLICVALVWVYAHILTASGAYKHTALLTQFSCRTDRANLISSALWISIPFPLQWGAPTFSANHAFGMMAAVVVSLIETTGAFMAAARLASATPPPAYVLSRGIGWQGIGTLLDGLFGTGTGSTVSVENVGLLGSTRVGSRRVIQISAGFMIFFSMLGKFGALFASIPFPIFAAIYCVMFGIVAAVGLSFLQFTNMNSMRNLFIVGVSLFLGLSIPEYFSRYTTSAQQGPAHTKAGWFNDYINSVFSSPPTVALIMAVLLDNTLDVREAARDRGMPWWARFRTFRGDSRNEEFYTLPFNLNRFFPPS

SEQ ID NO: 7519 - protein, 524 aa, Sesamum indicum
MAAPKPEEISHPPMDQLQGLEYCIDSNPSWGEAIALGFQHYILALGTAVMIPSFLVPLMGGTDDDKVRVVQTLLFVGGINTLLQTLFGTRLPTVIGGSWAFMVPIISIIHDSSLQRIPDPHMRFLNTMRAIQGALIVASSVQIILGYSQLWAICSRFFSPLGMVPVISLVGFGLFDRGFPVVGRCVEIGIPMFILFVAFSQYLKHFQTKQIPVLERFALLISVTVIWAYAHLLTASGAYKHHPELTQRNCRTDKANLISSAPWIKIPYPLQWGAPTFDAGHAFGMMSAVLVSLIESTGAYKAASRLASATPPPAHVLSRGIGWQGIGILLDGMFGTATGSTVSVENIGLLGSTRVGSRRVIQISAGFMIFFSILGKFGALFASIPFTIFAALYCVMFGLVASVGLSFLQFTNMNSMRNLFITGVSLFLGLSIPEYFREYTAAALHGPAHTKAGWFNDFLNTIFLSSPTVALMVAVFLDNTLDYKDSARDRGMPWWAKFRTFKGDSRNEEFYTLPFNLNRFFPPS

SEQ ID NO: 7520 - protein, 524 aa, Cucumis sativus
MEAPKPEEITHPPMDQLQGLEYCIDSNPSWGEAIALGFQHYILALGTAVMIPSFLVPLMGGDDGDKVRVVQTLLFVEGINTLLQTLFGTRLPTVIGGSYAFMVPIISIIHDSSLSRIEDPHLRFLNTMRAVQGALIVSSSIQIILGYSQLWAICSRFFSPLGMVPVIALVGFGLFDRGFPVVGRCVEIGVPMLILFIAFSQYLKGFHTRQLPILERFALLITVTVIWAYAHLLTASGAYKHRPELTQMNCRTDRANLISSAPWIKIPYPLQWGAPTFNAGHAFGMMAAVLVSLVESTGAFKAASRLASATPPPAHVLSRGIGWQGIGILLSGLFGTLSGSTVSIENVGLLGSTRVGSRRVIQISAGFMIFFSILGKFGALFASIPFTIFAAVYCVLFGLVASVGLSFLQFTNMNSMRNLFITGVALYLGLSVPDYFREYTAKAFHGPAHTNAGWFNDFLNTIFFSPPTVALIVAVFLDNTLDYKDSARDRGMPWWVKFRTFKGDSRNEEFYTLPFNLNRFFPPS

SEQ ID NO: 7521 - protein, 524 aa, Mimulus guttatus
MAAVKPEEISHAPMDQLQGLEYCIDSNPSWGEAIALGFQHYILALGTAVMIPSFLVPLMGGSDDDKVRVVQTLLFVGGINTVLQTLFGTRLPTVIGGSWAFLVPIISIIHDPSLERIIDPHQRFLSTMRAIQGALIVASSVQIILGYSQLWAICSRFFSPLGMVPVISLVGFGLFDRGFPVVGRCVEIGIPMFILFVAFSQYLKHFQTKQIPVLERFALVISVTVIWAYAHLLTASGAYKHHPELTQRNCRTDKANLISSAPWIKIPYPLQWGAPTFDAGHAFGMMAAVLVSLIESTGAYKAASRLASATPPPAHVLSRGIGWQGIGILLDGLFGTGTGSTVSVENIGLLGTTRVGSRRVIQIAAGFMIFFSILGKFGALFASIPFTIFAAVYCVMFGLVASVGLSFLQFTNMNSMRNLFITGVSLFLGLSIPEYFREYTAAALHGPSHTKAGWFNDFLNTIFLSSPTVGLLVAVFLDNTLEYKDSAVDRGMPWWAKFRAFKGDSRNEEFYTLPFNLNRFFPPS

SEQ ID NO: 7522 - protein, 524 aa, Citrullus lanatus
MEAPKPEEISHPPMDQLQGLEYCIDSNPSWGEAIALGFQHYILALGTAVMIPSFLVPLMGGDDGDKVRVVQTLLFVEGINTLLQTLFGTRLPTVIGGSYAFMVPIISIIHDSSLSRIEDPHLRFLNTMRAVQGALIVSSSIQIILGYSQLWAICSRFFSPLGMVPVIALVGFGLFDRGFPVVGRCVEIGVPMLILFIAFSQYLKGFHTRQLPILERFALLITVTVIWAYAHLLTASGAYKHRPELTQINCRTDRANLISSAPWIKIPYPLQWGAPTFNAGHAFGMMAAVLVSLIESTGAFKAASRLASATPPPAHVLSRGIGWQGIGILLSGLFGTLSGSTVSIENVGLLGSTRVGSRRVIQISAGFMIFFSILGKFGALFASIPFTIFAAVYCVLFGLVASVGLSFLQFTNMNSMRNLFITGVALYLGLSVPDYFREYTAKAFHGPAHTNAGWFNDFLNTIFFSPPTVALIVAVFLDNTLDYKDSARDRGMPWWVKFRTFKGDARNEEFYTLPFNLNRFFPPS

SEQ ID NO: 7523 - protein, 585 aa, Sorghum bicolor
MRHVLLSRFLLRRQQGGGMPTAHHHHLLRALSSAPSPVSSDAELRKYAGYALLLVGCGAATYYSFPLPADALHKKAVPFRYAPLPEDLHAVSNWSGTHEVHARVLLQPDSLPALEGALAAAHKERRKLRPLGSGLSPNGIALSRAGMVNLALMDKVLDVDAKKKTVTVQAGIRVAELVDTLREHGLTLQNFASIREQQVGGFTQVGAHGTGATLPPVDEQVISMKLVTPAKGTIELSREKDPELFYLARCGLGGLGVVAEVTLQCVERHQLVEHTFVSNADEVKKNHKKWLSENKHIKYLWIPYTDTVVVVQCNPPSKWRTPKLGSKYGNDEALQHVRDLYRESLKKYRTEAESNDPDIDTLSFTELRDKLLALDPLDKDHVMKINKAEAEYWKKSEGYRMGWSDEILGFDCGGQQWVSENCFPAGTLATPSMKDLDYIDKLLRLIEKEEIPAPGPIEQRWTARSKSPMSPASSSEEEDIFSWVGIIMYLPTSDARQRKEITEEFFNYRSLAQSLWDDYSAYEHWAKIEVPKDKDELAEVQARLRKRFPVDAYNKARLELDPHKVLSNAKLEKLFPVLEPVHQTK

SEQ ID NO: 7524 - protein, 580 aa, Setaria italica
MRHLLLSRLLLRRGSSPSSHHHLPLLRALSSAPSPVSSDADLRKYAGYALLLLGCGAATYYSFPFPADALHKKAVPFKYAPLPEDLHAVSNWSATHEVHTRVLLQPDSLPALEDALATAHKERRKLRPLGSGLSPNGIGLSRAGMVSLGLMDKVLDVDVKKKTVTVQAGIRVAELVDALREHGLTLQNFASIREQQVGGFIQVGAHGTGARLPPVDEQVISMKLVTPAKGTIELSREKDPELFYLARCGLGGLGVVAEVTLQCVERHQLVEHTFVSNADEVKKNHKKWLSENKHIKYLWIPYTDTVVVVRCNPPSKWKTPKLTSKYGKDEALQHVRNLYRESLKKYRTETESNDPEIDTLSFTELRDKLLALDPLDKDHVVKVNKAEAEYWKKSEGYRMGWSDEILGFDCGGQQWVSENCFPTGTLAKPSTKDLDYIEKLLQLIEKEDIPAPAPIEQRWTAHSKSPMSPASSSEEDDVFSWVGIIMYLPTSDARQRKEITEEFFNYRSLAQTLWDDYSAYEHWAKIEVPKDKDELAELQARLRKRFPVDAYNKARMELDPNKVLSNAKIEKLFPALEPVK

SEQ ID NO: 7525 - protein, 362 aa, Panicum virgatum
MKLVTPAKGTIELSKEKDPELFYLARCGLGGLGVVAEVTLQCVERHQLVEHTFVSNADEVKKNHKKWLSENKHIKYLWIPYTDTVVVVQCNPPSKWRTPKLTSKYGKDEALQHVRSLYRESLKKYRTETESNDPEIDTLSFTELRDKLLSLDPLDKDHVMKVNKAEAEYWRKSEGYRMGWSDEILGFDCGGQQWVSENCFPTGTVAKPSMKDLDYIEKLLQLIEKEDIPAPAPIEQRWTAHSKSPMSPASSSEEDDVFSWVGIIMYLPTSDARQRKEITEEFFNYRSLAQSLWDGYSAYEHWAKIEIPKDKDELAELQARLRKRFPVDAYNKARMELDPNKVLSNTKLEKLFPVLESVHQAK

SEQ ID NO: 7526 - protein, 582 aa, Setaria italica
MRHLLLSRLLLRRGSSPSSHQHHHHLPFLCALSSAPSPVSSDADLRKYAGYALLLLGCGAATYYSFPLPADALHKKAVPFKYAPLPEDLHAVSNWSATHEVHARVLLQPDSLPALEDALATAHKERRKLRPLGSGLSPNGIGLSRAGMVSLALMDKVLDVDVKKKTVTVQAGIRVAELVDALREHGLTLQNFASIREQQVGGFIQVGAHGTGARLPPVDEQVISMKLVTPAKGTIELSREKDPELFYLARCGLGGLGVVAEVTLQCVERHQLVEHTFVSNADEVKKNHKKWLSENKHIKYLWIPYTDTVVVVRCNPPSKWKTPKLTSKYGKDEALQHVRNLYRESLKKYKTETESNDPEIDTLSFTELRDKLLALDPLDKDHVVKVNKAEAEYWKKSEGYRMGWSDEILGFDCGGQQWVSENCFPTGTLAKPSTKDLDYIEKLLQLIEKEDIPAPAPIEQRWTARSKSPMSPASSSEEDVFSWVGIIMYLPTSDARQRKEITEEFFNYRSLAQTLWDDYSAYEHWAKIEVPKDRDELAELQARLRKRFPVDAYNKARMELDPNKVLSNAKLEKLFPALEPVK

SEQ ID NO: 7527 - protein, 439 aa, Panicum virgatum
MVSLALMDKVLDVDAKKKTVTVQAGIRVAELVDALREHGLTLQNFASIREQQVGGFIQVGAHGTGARLPPVDEQVISMKLVTPAKGTIELSKEKDPELFYLARCGLGGLGVVVEVTLQCVERHQLVEHTFVSNADEVKKNHKKWLSENKHIKYLWIPYTDTVVVVQCNPPSKWRTPKLTSKYGKDEALQHVRSLYRESLKKYRTETESNDPEIDTLSFTELRDRLLSLDPLDKDHVMKVNKAEAEYWRKSEGYRMGWSDEILGFDCGGQQWVSENCFPTGTVAKPSMKDLDYIEKLLQLIEKEDIPAPAPIEQRWTAHSKSPMSPASSSEEDDVFSWVGIIMYLPTSDARQRKEITEEFFNYRSLAQSLWDGYSAYEHWAKIEIPKDKDELAELQARLRKRFPVDAYNKARMELDPNKVLSNTKLEKLFPVLESVHQAK

SEQ ID NO: 7528 - protein, 583 aa, Oryza sativa
MRRLLLAGILRRASSSPSSHHHLHLVRALSASSPLPASDADLRKYAGYALLLLGCGAATYYSFPLPPDALHKKAVPFKYAPLPDDLHAVSNWSATHEVHTRVLLQPDSLPALHDALAAAHGECRKLRPLGSGLSPNGLALSRAGMVNLALMDKVLGVDAKKKTVTVQAGIRVAELVDALREHGLTLQNFASIREQQVGGIIQVGAHGTGARLPPIDEQVISMKLVTPAKGTIELSREKDPDLFYLARCGLGGLGVVAEVTLQCVERHQLIEHTFVSNADEVKKNHKKWLSENKHIKYLWIPYTDTVVVVQCNPPSRWRTPKFTSKYGKDEAIQHVRDLYHESLKKYRTKAESNDPEVDQLSFTELRDRLLTLDPLDKDHVIRINKAEAEYWKKSEGYRMGWSDEILGFDCGGQQWVSETCFPAGTLAKPNMKDLDYIEELLQLIEKEDIPAPAPIEQRWTACSRSPMSPASSSQEDDIFSWVGIIMYLPTSDARQRKEITEEFFNYRSKTQTNLWDGYSAYEHWAKIEVPKDKDELAELQARLRKRFPVDAYNKARMELDPNKVLSNAKLEKLFPVTEVQHEK

SEQ ID NO: 7529 - protein, 583 aa, Oryza sativa
MRRLLLAGILRRASSSPSSHHHLHLVRALSASSPLPASDADLRKYAGYALLLLGCGAATYYSFPLPPDALHKKAVPFKYAPLPDDLHAVSNWSATHEVHTRVLLQPDSLPVLHDALAAAHGERRKLRPLGSGLSPNGLALSRAGMVNLALMDKVLDVDAKKKTVTVQAGIRVAELVDTLREHGLTLQNFASIREQQVGGIIQVGAHGTGARLPPIDEQVISMKLVTPAKGTIELSREKDPDLFYLARCGLGGLGVVAEVTLQCVERHQLIEHTFVSSADEVKKNHKKWLSENKHIKYLWIPYTDTVVVVQCNPPSRWRTPKFTSKYGKDEAIQHVRDLYRESLKKYRTKAESNDPEVDQLSFTELRDRLLALDPLDKDHVIRINKAEAEYWKKSEGYRMGWSDEILGFDCGGQQWVSETCFPAGTLAKPNMKDLDYIEELLQLIEKEDIPAPAPIEQRWTACSRSPMSPASSSQEDDIFSWVGIIMYLPTSDARQRKEITEEFFNYRSKTQTNLWDGYSAYEHWAKIEVPKDKDELTELLARLRKRFPVDAYNKARMELDPNKVLSNAKLEKLFPVTEVQHVK

SEQ ID NO: 7530 - protein, 584 aa, Brachypodium distachyon
MRHLLIPRFLRRASSLTHYHSHLQLLRPLSSSSPLPASESDLRKYAGYALLVLGCGAATYYSFPFPPDALHKKAVPFKYAPLPDDLHTVSNWSGTHEVHTRVLLQPDSLPDLEEALAAAHKEQRRLRPLGSGLSPNGLALSRAGMVNLALMDKVLDVDVKKKTVTVQAGIRVAELVDALREHGLTLQNFASIREQQVGGIIQVGAHGTGAGLPPIDEQVISMKLVTPAKGTIELSREKDPDLFYLARCGLGGLGVVAEVTLQCVERHQLVEHTFVSNADEIKKNHKKWLSENKHIKYLWIPYTDTVVVVKCNPPSRWKTPKLTSKYGKDEAIQHVRDLYREALKKYRTEAESNDPAIDQLSFTELRDQLLALDPLDKDHVIRINKAEAEYWKKSEGYHMGWSDEILGFDCGGQQWVSETCFPTGTLAKPSMKDLDYMEELLQLIEKEDIPAPAPIEQRWTARSRSPMSPASSSEEDDIFSWVGIIMYLPTSDPRQRKDITEEFFNYRSLAQTSLWNDYSAYEHWAKIEIPKDKDELAELQARLRKRFPVNAYNKARMELDPNKVLSSARLEKLFPATGTVQSAK

SEQ ID NO: 7531 - protein, 584 aa, Triticum aestivum
MRHLLLSRLLRRASSPSQPHHNLQLIRAFSSSSPLPASDTDLRKYAGYALLVLGCGAATYYSFPFPPDALHKKAVPFKYAPLPDDLHTVSNWSGTHEVHTRVLLQPDSIPALEDALATAHRERRRLRPLGSGLSPNGLGLSRAGMVNLALMDKVLDVDVKKKTVTVQAGIRVAELVDALREHGLTLQNFASIREQQVGGIIQVGAHGTGARLPPIDEQVISMKLVTPAKGTIELSREKDPDLFYLARCGLGGLGVVAEVTLQCVERHQLVEHTFVSNADEIKKNHQKWLSENKHIKYLWIPYTDTVVVVQCNPPSRWKTPKLASKYGKDEALQHVRDLYRESLKKYRTEADSKDPAIDQLSFTELRDQLLALDPLDKDHVIRINKAEAEYWKKSEGYRMGWSDEILGFDCGGQQWVSETCFPTGTLAKPNMKDLYYMEELLQLIEKEDIPAPAPIEQRWTARSRSPMSPASSSEEDDIFSWVGIIMYLPTSDPRQRKDITEEFFNYRSLTQTSLWDDYSAYEHWAKIEVPKDKDELAQLQARLRKRFPVDAYNKARMELDPNKVLSSAKLEKFFPGMQTVQHAR

SEQ ID NO: 7532 - protein, 584 aa, Hordeum vulgare
MRHLLLSRLLRRASSPSQPHHNLQLIRALSSSSPLPASDTDLRKYAGYALLVLGCGAATYYSFPFPPDALHKKAVPFKYAPLPDDLHTVSNWSGTHEVHTRVLLQPDSIPALEDALATAHRERRRLRPLGSGLSPNGLALSRAGMVNLALMDKVLDVDVKKKTVTVQAGIRVAELVDALREHGLTLQNFASIREQQVGGIIQVGAHGTGARLPPIDEQVISMKLVTPAKGTIELSREKDPDLFYLARCGLGGLGVVAEVTLQCVERHQLVEYTFVSNADEIKKNHQKWLSENKHIKYLWIPYTDTVVVVQCNPPSRWKTPKLTSKYGKDEALQHVRDLYRESLKKYRTEADSKDPAIDQLSFTELRDQLLALDPLDKDHVIRINKAEAEYWKKSEGYRMGWSDEILGFDCGGQQWVSETCFPTGTLAKPNMKDLYYMEELLQLIKKEDIPAPAPIEQRWTARSRSPMSPASSSEEDDIFSWVGIIMYLPTSNPRQRKDITEEFFNYRSLTQTSLWDDYSAYEHWAKIEVPKDKDELAELQARLRKRFPIDVYNKARMELDPNKVLSSAKLEKLFPGMQTVQHAK

SEQ ID NO: 7533 - protein, 582 aa, Secale cereale
RHLLLSRLLRRASSPSQPHHNLQLIRALSSSPLPASDTDLRKYAGYALLVLGCGAATYYSFPFSPDALHKKAVPFKYAPLPDDLHTVSNWSGTHEVHTRVLLQPDSIPALEDALATAHRERRRLRPLGSGLSPNGLGLSRAGMVNLALMDKVLDVDVKKKTVTVQAGIRVAELVDALREHGLTLQNFASIREQQVGGIIQVGAHGTGARLPPIDEQVISMKLVTPAKGTVELSREKDPDLFYLARCGLGGLGVVAEVTLQCVERHQLVEHTFVSNADEIKKNHQKWLSENKHIKYLWIPYTDTVVVVQCNPPSRWKTPKLISKYGKDEALHHVRVLYRESLKKYRTEAESKDPAIDLLSFTELRDQLLALDPLDKDHVIRINKAEAEYWKKSEGYRMGWSDEILGFDCGGQQWVSETCFPTGTLAKPNMKDLHYMEELLQLIEKEDIPAPAPIEQRWTAHSRSPMSPASSSEEDDIFSWVGIIMYLPTSDPRQRKDITEEFFNYKSLTQTSLWDDYSAYEHWAKIEVPKDKDELAKLQARLRKRFPVDAYNKARMELDPNKVLSSAKLEKLFPGMQTVQHAK

SEQ ID NO: 7534 - protein, 584 aa, Triticum aestivum
MRHLLLSRLLRRASSPSQPHHNLQLIRALSSSSPLPASDTDLRKYAGYALLVLGCGAATYYSFPFPPDALHKKAVPFKYAPLPDDLHTVSNWSGTHEVHTRVLLQPDSIPALEDALATAHRERRRLRPLGSGLSPNGLGLSRAGMVNLALMDKVLDVDVKKKTVTVQAGIRVAELVDALSKHGLTLQNFASIREQQVGGIIQVGAHGTGARLPPIDEQVISMKLVTPAKGTIELSREKNPDLFDLARCGLGGLGVVAEVTLQCVERHQLVEHTFVSNADEIKKNHQKWLSENKHIKYLWIPYTDTVVVVQCNPPSRWKTPKLASKYVKDEALQHVRDLYRESLKKYRTEADSKDPAIDQLSFTELRDQLLALDPLDKDHVIRINKAEAEYWKKSEGYRMCWSDEILGFDCGGQQWVSETCFPTGTLAKPNMKDLYYMEELLQLIEEEDIPAPAPIEQRWTAHSRSPMSPASSSEEDDIFSWVGIIMYLPTSDPRQRKDITEEFFNYRSLTQTSLWDDYSAYEHWAKIEVPKDKDELAQLQARLRKRFPVDAYNKARMELDPNKVLSSAKLEKFFPGMQTVQHAR

SEQ ID NO: 7535 - protein, 532 aa, Panicum virgatum
AAPPPTTTTTSPSSAPSPVSSDADLRKYAGYALLLLGCGAATYYSFPFPADALHKKAIPFKYAPLPEDLHAVSNWSATHEVHTRVLLQRDSLPALEDALATAHRERRKLRPLGSGLSPNGLALSRAGMVSLALMDKVLDVDVKKKTVGAHGTGARLPPVDEQVISMKLVTPAKGTIELSKEKDPELFYLARCGLGGLGVVAEVTLQCVERHQLVQHTFVSNADEVKKTTIYLYTWKWLSENKHIKYLWIPYTDTVVVVQCNPPSKWRTPKLTSKYGKDEALHHVRNLYRESLKKYRTETESNDPEIDTLSFTELRDKLLALDPLDKHHVMKVNKAEAEYWKKSEGYRMGWSDEILGFDCGGQQWVSENCFPTGTIANPSMKDLDYIEKLLRLIEKEDIPAPAPIEQRWTAHSKSPMSPASSSEEDDVFSWVGIIMYLPTSDARQRKEITEEFFNYRSLVQSLWDDYSAYEHWAKIEVPKDKDELAELQARLWKRFPVDAYNKARMELDPNKVLSNAKFEKMFPVLEPVHQAK

SEQ ID NO: 7536 - protein, 302 aa, Setaria italica
MDRGQNGRDPFAGFGGFGPQRSLISGFFGGRDPFDDPFFTQPFGGRTMGGPGMFGPSPFGPMGGPFGDMRNDGFIEQAPPRSNVRRPVITELDEEGENAEHGNEQSNQDSYVQEPDDTSDGMEGGQVQLRRELNRANSGGQPQARTFTYQSSSVTYGGINGAYYTASKTRRSGSDGITVEESKEADTTTKQATHRISRGIHDKGHSLTRKLNSDGKVDTTQTLHNLNEDELAGFEESWKGNAGHPLPGWNQNAGAPNSDNSGNRSSSGRDRRSAWGWALPGTEQGRDPRRNGKPKSRVIPIS

SEQ ID NO: 7537 - protein, 310 aa, Panicum virgatum
MDRGQNGRDDFFGGRDPFAGFGDFGPQRSLISGFFGGRDPFDDPFFTQPFGGRMMGGPGMFGPSLFGQMGGSFGDMRNDGFIEQAPPRSNGRRPVITELDEEGGENAEHGNAQANQDSYVQEPDVASDGMEGGQVQPWRDLNRANSGGQSQAHTFTYQSSSVTYGGINGAYYTASKTRRTGSDGITVEESKEADTTTKEATHRISRGIHDKGHSLTRKLKSDGKVDTTQILHNLNEDELAGFEESWKGNAGHHLPGWNQNAGPPNSDNSGNRSSSGRDRRSAWGWALPGTEQGRDPRRNGKPKSRVIPIS

SEQ ID NO: 7538 - protein, 310 aa, Panicum virgatum
MDRGQNGRDDFFGGRDPFAGFGGFGPQRSLISGFFGGRDPFDDPFFTQPFGGRMMGGPGMFGPSLFGQMGGSFGDMRNDGFIEQAPPRSNGRRPVITELDEEGGENAEHGNAQANQDSYVQEPDVASDGMEGGQVQPRRDLNRANSGGQSQAHTFTYQSSSVTYGGINGAYYTASKTRRTGSDGITVEESKEADTTTKEATHRISRGIHDKGHSLTRKLKSDGKVDTTQILHNLNEDELAGFEESWKGNAGHHLPGWNQNAGPPNSDNSGNRSSSGRDRRSAWGWALPGTEQGRDPRRNGKPKSRVIPIS

SEQ ID NO: 7539 - protein, 321 aa, Sorghum bicolor
MDRGQNRRDDVFRGRDPFAGFGSHRSLISGFFGGRDPFDDPFFTRPFGGQMMGGMFGPSPFGGQMMGEHDMFGPSPFGPMGGPFGDRGNHGFIDQAPPRGNSRRPVITEVDEDEGENAEHGNEQPNQDSYVQGPDDGSDGTEGGQVQLRRDLNRANSGGQPQARTFTYQSSSVTYGGINGAYYTASKTRRTGSDGITVEESKEADTTTKEATHRISRGIHDKGHSLTRKLNSDGKVDTTQTLHNLNEDELAGFEESWKGNAGHYLPGWNQNAGVPNSDNSGNRSSNGRDRRSAWGWALPGTEQGRDPRRNGKPKSRVIPIS

SEQ ID NO: 7540 - protein, 312 aa, Panicum virgatum
MERRQNGRDDFFGGRDPFAGFGGFGPQRSLISGFFGGRDPFDDPFFTQPFGGRMMGGPGMFGPSLFGPMGGPFGDMRNDGFIEQAPPRSNGRRPVITELDEEGGENAEHGDEQANQDSYVQVQEPDDASGGMEGGQVQLRRDLNRANSGGQSQARTFTYQSSSVTYGGINGAYYTASKTRRTGSDGITVEESKEADTTTKEATHRISRGIHDKGHSLTRKLKSDGKVDTAQILHNLNEDELAGFEESWKGNAGHHLPSWNQNAGAPNSDNSGNRSSSGRDRRSAWGWALPETEQGRDPRRNGKPKSRVIPIC

SEQ ID NO: 7541 - protein, 309 aa, Pennisetum glaucum
MDRGQNGRDDFFGGRDPFAGFGGFGPQRSLISGFFGGRDPFDDPFFTQPFGGRMMGGPGMFGPSPFGPMGGPFGGMNDRFIDQAPPPRSNSRRPVITELDEEGENTEHGNEQSNQDSYVQEPDDANDGMEGDQVQLRRDPNKANSGGQPQDRTFTYQSSSVTYGGINGAYYTASKTRRSGSDGITVEESKEADTTTKQATHRISRGIHDKGHSLTRKLNSDGKVDTTQTLHNLNEDELAGFEESWKGNAGHYLPGWNQNAGAPNSDISGNRSSSGRDRRSAWGWALPGTEQGRDSRRNGKPKSRVIPIS

SEQ ID NO: 7542 - protein, 82 aa, Setaria italica
MELGDKAVGFLLTLTSLSIFTYYTFWVIILPFVDSDHFVHKYFLPQEYAILIPVIAGVVLLSFLSVFVGLVMLKSKKKKKTN

SEQ ID NO: 7543 - protein, 82 aa, Sorghum bicolor
MELGDKVVGFLLTLTSLSIFTYYTFWVIILPFVDSDHFVHKYFLPQEYAILIPVLAGVVLLSFLSVFVGLVMLKSKKKKKTT

SEQ ID NO: 7544 - protein, 60 aa, Saccharum officinarum
MRFDTSAGRRSSPFILERLCGSCDAQVKEKEEDYLIGFAIYTAVLFTYCDEIHEFGVSNC

SEQ ID NO: 7545 - protein, 82 aa, Panicum virgatum
MELGDKAVGFLLTLTSLSIFTYYTFWVIILPFVDSDHFVHKYFLPQEYAILIPVIAGVVLLSFLSIFVGLVMLKSKKKKKTT

SEQ ID NO: 7546 - protein, 81 aa, Panicum virgatum
MELGDKAVGFLLTLTSLSIFTYYTFWVIILPFVDSDHFVHKYFLPQEYEILIPVIAGVVLLCFLSIFVGLVMLKSKKKKTT

SEQ ID NO: 7547 - protein, 82 aa, Panicum virgatum
MELGDKAVGFLLTLTSLSIFTYYTFWVIILPFVDSDHFVHKYFLPQEYAILIPVIAGMVLLSFLSIFVGLVMLKSKKKKKTT

SEQ ID NO: 7548 - protein, 82 aa, Oryza sativa
MELGDKAVGFILTLTSLSIFTYYTFWVIILPFVDSDHFVHKYFLPQEYAILIPVLAGVILLSFLSVFMGLVMLKSKKKKKTT

SEQ ID NO: 7549 - protein, 82 aa, Panicum virgatum
  misc_feature (17)..(17): Xaa can be any naturally occurring amino acid
MELGDKAVGFLLTLTSXSIFTYYTFWVIILPFVDSDHFVHKYFLPQEYAILIPVIAGVVLLSFLSIFVGLVMLKSKKKKKTT

SEQ ID NO: 7550 - protein, 82 aa, Panicum virgatum
MELGDKAVGCLLTLTSLSIFTYYTFWVIILPFVGSDHFVHKYFLPQEYAILIPVIAGVVLLSFLIIFVGLVMLKSKKKKKTT

SEQ ID NO: 7551 - protein, 82 aa, Oryza sativa
MELGDKAVGFILTLTSLSIFTYYTFWVIILPFVDSDHFAHKYFLPQEYAILIPVLVGVIVLSFLSVFVGLVMLKSKKKKKTT

SEQ ID NO: 7552 - protein, 81 aa, Avena sativa
MEMGDKAVGLVLTMTSLSIFTYYTFWVIILPFVDDDHFVHKYFLPQEYAIFIPVFAGVVLLSFLSIFVGLVMLKSKKKKTA

SEQ ID NO: 7553 - protein, 82 aa, Brachypodium distachyon
MELGDKAIGLVLTMTSLSIFTYYTFWVIILPFVDDDHFVHEYFLPQEYAIFIPVLAGVVLLSFLSIFVGLVMLNSKKKKKAA

SEQ ID NO: 7554 - protein, 80 aa, Eucalyptus grandis
MELADRAVGFLLTLVSLSIFTYYTFWVIILPFVDSDHFVHQYFLPQEYAILIPVFAGVVLLCFLCVFIGLVMLKPKKKKA

SEQ ID NO: 7555 - protein, 81 aa, Triticum aestivum
MEMGDKAVGLVLTMTSLSIFTYYTFWVIILPFVDDDHFVHQYFLPQEYAIFIPVFAGVVLLSFLSIFIGLVMLKSKKKKAA

SEQ ID NO: 7556 - protein, 82 aa, Hordeum vulgare
MEMGDKAVGLVLTMTSLSIFTYYTFWVIILPFVDDDHFVHQYFLPQEYAIFIPVFAGVVLLSFLSIFIGLVMLKSKKKKKAA

SEQ ID NO: 7557 - protein, 100 aa, Cynodon dactylon
MELGDKAVGFLLTLTSLSIFTYYTFWVIILRSLRPQVLPATRVCYFDTSFCRCTTTYFPECLCGFCHAQVEEKKEDHLIMFIMASNSLLTLMKSMRLETM

SEQ ID NO: 7558 - protein, 69 aa, Sorghum bicolor
MELGDKLVGFLLTLTSLSIITYYTLWVIILPFVDRDHFVHKYFLPQKYANLISVLAGVVLVSFLSVWVL

SEQ ID NO: 7559 - protein, 80 aa, Bupleurum chinense
MELADRAVGFLLSFTSLSIFTYYTFWVIILPFVHSDHFVHKYFLPQEYAILIPVFAGVTLLCFLCVFIGLVMLKSKKKKA

SEQ ID NO: 7560 - protein, 80 aa, Carica papaya
MELADRAVGFLLCLISLSVFTYYTFWVIILPFVDTDHFIHNYFLPQEYAILIPVFAGVVLLSFLSVFIGLVMLQSKKKKA

SEQ ID NO: 7561 - protein, 80 aa, Citrullus lanatus
MELADKTVGFLLSLTSLSIFTYYTFWVIILPFVDSDHFIHNYFLPQEYAILIPVFAGVVLLSLLGIFVGMVMLKSKKKKA

SEQ ID NO: 7562 - protein, 81 aa, Triticum aestivum
MEMGDKAVGLVLTMTSLSIFTYYTFWVIILPFVDDDHFVHQYFLPQEYAIFIPVFAGVVLLSFLSIFIGLVMMKSKKKKAA

SEQ ID NO: 7563 - protein, 82 aa, Secale cereale
MEMGDKAVGLVLTMTSLSIFTYYTFWVIIVPFVDDDHFVHQYFLPQEYAIFIPVFAGVVLLSFLSIFIGLVMLKSKKKKKAA

SEQ ID NO: 7564 - protein, 80 aa, Nicotiana benthamiana
MELADRAVGLLLTLTSLSIFTYYTFWVIILPLVDSDHFVHKYFLPQEYAILIPVSAGVALICLLSVFIGYVMLKSKKKKA

SEQ ID NO: 7565 - protein, 80 aa, Fagus grandifolia
MELADKAVGFLLSFISLSIFTYYTFWVIILPFVDSDHFIYNYFLPQEYAILIPVFAGVVLLCFLSVFIGFVMLKSKKKKA

SEQ ID NO: 7566 - protein, 80 aa, Bupleurum chinense
MELADRAVGFLLSFISLSIFTYYTFWVIILPFVHSDHFVHKYFLPQEYAILIPVFAGVTLLCFLCVFIGLVMLKSKKKKA

SEQ ID NO: 7567 - protein, 80 aa, Vigna unguiculata
MELADRAVGFLLSVTSLSIFTYYTFWVIILPFVDDDHFVHKYFLPQEYAILIPVSAGVTLLCFLSIFVGVVMLKSKRKKA

SEQ ID NO: 7568 - protein, 80 aa, Cucurbita pepo
MELADKTVGFLLSLTSLSIFTYYTFWVIILPFVDSDHFIHNYFLPQEYAILIPVFAGVVLLCLLAIFVGIVMLKSKKKKA

SEQ ID NO: 7569 - protein, 80 aa, Cucumis melo
MELADKTVGFLLSLTSLSIFTYYTFWVVILPFVDSDHFVHNYFLPQEYAILIPVFAGVVLLCLLGIFVGTVMLKSKKKKA

SEQ ID NO: 7570 - protein, 80 aa, Lippia dulcis
MELADRAVGLLLSIISLTIFTYYTFWVIILPFVDSDHFVHKYFLPQEYAILIPVYAVVALISFLSVFIGYVMLKSKKKKA

SEQ ID NO: 7571 - protein, 80 aa, Populus trichocarpa
MELADRAVGFLLSLTSISIFTYYTFWVIILPFVDSDHFVHQYFLPQEYAILVPVFAGMVLLCFLCVFVGFVMLKSKKKKA

SEQ ID NO: 7572 - protein, 82 aa, Secale cereale
MEMGDKAVGLVLTMTSLSIFTYYTFWVIIVPFVDDDHFVHQYFLPQEYAIFIPVFAGVVLLSFLSIFIGLVMLKSKKKQKAA

SEQ ID NO: 7573 - protein, 80 aa, Unknown
  Sequence found in Organisms: Nicotiana benthamiana, Nicotiana tabacum
MELADRAVGLLLTLTSLSIFTYYTFWVIILPLVDSDHFVHKYFLPQEYAILIPVYAGVALICLLSVFIGYIMLKSKKKKA

SEQ ID NO: 7574 - protein, 80 aa, Cucumis sativus
MELADKTVGFLLSLTSLSIFTYYTFWVVILPFVDSDHFIHNYFLPQEYAILIPVFAGVVLLCLLGIFVGTVMLKSKKKKA

SEQ ID NO: 7575 - protein, 80 aa, Carpinus betulus
MEIADRAVGFLLSLISLSIFTYYTFWVIILPFVDGDHFIHKYFLPQEYAILIPVCAGVVLLCFLCVFIGSVMLKSKKKKA

SEQ ID NO: 7576 - protein, 80 aa, Arachis hypogaea
MELADRAVGFLLTFLSLSIFTYYTFWVIILPFVDGDHFVHKYFLPQEYAILIPVSAGVAILCFLCIFIGLVMLKSKKKKA

SEQ ID NO: 7577 - protein, 80 aa, Cajanus cajan
MDLADRAVGFLLSFISLSIFTYYTFWVIILPFVDDDHFVHKYFLPQEYAILIPVSAGVALLCFLSIFVGFVMLKSKKKKA

SEQ ID NO: 7578 - protein, 80 aa, Primula obconica
MELADRAVGLLLTIISLSIFTYYTLWVIILPFVDSDHFIHQYFLPQEYAILIPVFAGVTLLCFLSVFVGLVMVKSKKKKA

SEQ ID NO: 7579 - protein, 80 aa, Solanum phureja
MELADRAVGLILTLTSLSIFTYYTFWVIILPLVDSDHFVHKYFLPQEYAILIPVYAAVALICFLSVFIGYVMLKSKKKKA

SEQ ID NO: 7580 - protein, 80 aa, Camellia sinensis
MELADKAVGFLLSVVSLVMFTYYTFWVIILPFVDDEHFIHKYFLPQEFAILIPVLAGVALLCFLSVFVGFVMLKSKKKAA

SEQ ID NO: 7581 - protein, 149 aa, Sorghum bicolor
MAKPQLLLCFLVAAAATLLVATAKKSGDVTELQIGVKYKPESCSIQAHKGDKVKVHYRGKLTDGTVFDSSYERGDPIEFDLGTGQVIKGWDQGLLGMCVGEKRKLKIPSKLGYGPQGSPPTIPGGATLIFDTELVAVNGEPANQSDNEL

SEQ ID NO: 7582 - protein, 149 aa, Saccharum officinarum
MAKPQFLLCFLLAAAAPLLVATAKKSGDVTELQIGVKHKPESCSIQAHKGDKVKVHYRGKLTDGTVFDSSYERGDPIEFDLGTGQVIKGWDQGLLGMCVGEKRKLKIPSKLGYGPQGSPPTIPGGATLIFDTELVAVNGEPANQSDSEL

SEQ ID NO: 7583 - protein, 151 aa, Panicum virgatum
MAKPQVLLCLLVAAAALLLVAAAKKSGDVTELQIGVKYKPESCSIQAHKGDRVKVHYRGKLTDGTVFDSSYERGDPIEFELGTGQVIKGWDQGLLGMCVGEKRKLKIPSKLGYGPQGSPPTIPGGATLIFDTELVAVNGEPSSKSDESSEL

SEQ ID NO: 7584 - protein, 151 aa, Panicum virgatum
MAKPQVLLCLLIAAAALLLVAAAKKSGDVTELQIGVKYKPESCSIQAHKGDRVKVHYRGKLTDGTVFDSSYERGDPIEFELGTGQVIKGWDQGLLGMCVGEKRKLKIPSKLGYGPQGSPPTIPGGATLIFDTELVAVNGEPSSKSDEDSEL

SEQ ID NO: 7585 - protein, 83 aa, Triticum aestivum
PQLLLCFLLAASAPLIVATAKKSGDVSELQIGVKYKPESCSIQAHKGDKVKVHYRGKLTDGTVFDSSYERGDPIEFELGHWDK

SEQ ID NO: 7586 - protein, 150 aa, Setaria italica
MAKPQLLLCLLVAAAALLLVAVAKKSGDVTELQIGVKFKPETCSIQAHKGDRVKVHYRGKLTDGTVFDSSYERGDPIEFELGSGQVIKGWDQGLLGMCVGEKRKLKIPSKLGYGPQGSPPTIPGGATLIFDTELVAVNGEPASKSDDSEL

SEQ ID NO: 7587 - protein, 85 aa, Avena sativa
MAKPQLLLCLLVAAAALLLVASAKTAADVSELQIGVKFKPESCSIQAHKGDRVKFTTVENLLMGQFLILAMKGATQLNLSWALVK

SEQ ID NO: 7588 - protein, 151 aa, Pennisetum glaucum
MAKPQLLLCLVVAAAALLLVAAAAKKSGDVTELQIGVKFKPETCSIQAHKGDRVKVHYRGKLTDGTVFDSSFERGDPIEFELGTGQVIKGWDQGLLGMCVGEKRKLKIPAKLGYGPQGSPPTIPGGATLIFDTELVAVNGEPASKSDDSEL

SEQ ID NO: 7589 - protein, 152 aa, Triticum aestivum
MAKPRLLLCLLVAAAALLLVASAKKSGDVSALQIGVKYKPESCSISAHKGDRVKVHYRGTLTDGTVFDSSFERGDPIEFELGTGQVIKGWDQGILGMCIGEKRKLKIPSKLGYGDQGSPPTIPGGATLIFDTELVAVNGEPSSKSDEDDADL

SEQ ID NO: 7590 - protein, 154 aa, Avena sativa
MAKPQLLLCLLVAAAALLLVASAKKAADVSELQIGVKFKPESCSISAHKGDRVKVHYRGKLTDGTVFDSSYERGDPIEFELGTGQVIKGWDQGILGMCVGEKRKLKIPSKLGYGESGSPPTIPGGATLIFDTELVAVNGEPASKSDEGDVGSEL

SEQ ID NO: 7591 - protein, 154 aa, Avena sativa
MAKPQLLLCLLVAAAALLLVASAKKAADVSELQIGVKFKPESCSIQAHKGDRVKVHYRGKLTDGTVFDSSYERGDPIEFELGTGQVIKGWDQGILGMCVGEKRKLKIPSKLGYGESGSPPTIPGGATLIFDTELVSVNGEPAGKSDEGDVGSEL

SEQ ID NO: 7592 - protein, 152 aa, Triticum aestivum
MAKPRLLLCLLVAAAALLLVASAKKSGDVSALQIGVKYKPESCSISAHKGDRVKVHYRGTLTDGTVFDSSFERGDPIEFELGTGQVIKGWDQGILGMCIGEKRKLKIPSKLGYGDQGSPPTIPGGATLIFDTELVAVNGEPSSKSEEDDADL

SEQ ID NO: 7593 - protein, 151 aa, Brachypodium distachyon
MAKPQLLLCLLVAAAALLLVASAKKSADVTELQIGVKHKPKSCSIQAHKGDRVKVHYRGKLTDGTVFDSSYERGDPIEFELGTGQVIKGWDQGILGMCVGEKRKLKIPSKLGYGDGGSPPTIPGGATLIFDTELVSVNSEPATKSDDEDEL

SEQ ID NO: 7594 - protein, 154 aa, Hordeum vulgare
MAKPGLLLCLLVVAAALLLVASAKKSGDVSALQIGVKYKPESCSISAHKGDRVKVHYRGTLTDGTVFDSSYERGDPIEFELGTGQVIKGWDQGILGMCIGEKRKLKIPSKLGYGDQGSPPTIPGGATLIFDTELVAVNGEPSSKSDEDVADSDL

SEQ ID NO: 7595 - protein, 154 aa, Pseudoroegneria spicata
MAKQRLLLCLLVAAAALLLVASAKKSGDVSALQIGVKYKPESCSISAHKGDRVKVHYRGTLTDGTVFDSSYERGDPIEFELGTGQVIKGWDQGILGMCIGEKRKLKIPSKLGYGDQGSPPTIPGGATLIFDTELVAVNGEPSSKSDEDDADSDL

SEQ ID NO: 7596 - protein, 154 aa, Secale cereale
MAKPRLLLCLLVAAAALLLVASAKKSGDVSALQIGVKYKPASCSISAHKGDRVKVHYRGTLTDGTVFDSSYERGDPIEFELGTGQVIKGWDQGILGMCIGEKRKLKIPSKLGYGDQGSPPTIPGGATLIFDTELVAVNGEPSSKSDEDDADSDL

SEQ ID NO: 7597 - protein, 154 aa, Secale cereale
MAKPRLLLWLLVAAAALLLVASAKKSGDVSALQIGVKYKPASCSISAHKGDRVKVHYRGTLTDGTVFDSSYERGDPIEFELGTGQVIKGWDQGILGMCIGEKRKLKIPSKLGYGDQGSPPTIPGGATLIFDTELVAVNGEPSSKSDEDDADSDL

SEQ ID NO: 7598 - protein, 154 aa, Oryza sativa
MAKPQLLLVVAAAALLLVVAASAKKSGDVTELQIGVKHKPESCSIQAHKGDRVKVHYRGKLTDGTDFDSSYERGDPIEFELGTGQVIKGWDQGILGMCVGEKRKLKIPSKLGYGAQGSPPTIPGGATLIFDTELVAVNGEPASKSDEDDDDSEL

SEQ ID NO: 7599 - protein, 150 aa, Secale cereale
RLLLCLLVAAAALLLVASAKKSGDVSALQIGVKYKPASCSISAHKGDRVKVHYRGTLTDGTVFDSSYERGDPIEFELGTGQVIKGWDQGILGMCIGEKRKLKIPSKLGYGDQGSPPTIPGGATLIFDTELVAVNGEPSSKSDEDDADSDL

SEQ ID NO: 7600 - protein, 509 aa, Saccharum officinarum
MDGSTRGGGHSEALRNYNLGRTLGIGTFGKVKIAEHKLTGHRVAIKIINCRQMRNMEMEEKAKREIKILKLFIHPHIIRLYEVIYTPTDIYVVMEYCKYGELFDYIVEKGRLLEDEARRIFQQIISGVEYCHRNMVVHRDLKPENLLLDSKYNVKLADFGLSNVMHDGHFLKTSCGSPNYAAPEVISGKLYAGPEVDVWSCGVILYALLCGTLPFDDENIPNLFKKIKGGIYTLPSHLSALARDLIPRMLVVEPMKRITIREIREHQWFQTRLPRYLAVPPPDTTQQAKMIDEDTLRDVVNMGFNKNHVCESLCSRLQNEATVAYYLLLDNRFRATSGYLGADYQESMDRNLNQLASSESSSSGTRNYVPGSSDPHSSGLRPHYPVERKWALGLQSRAHPREIMIEVLKALQELNVSWKKNGHYNMKCRWLPGFPEVHDMLDASNSFLGDSTIMDNDDANGRLPAVIKFEFQLYKTKDDKYLLDMQRVTGPQLLFLDFCAAFLTKLRVL

SEQ ID NO: 7601 - protein, 509 aa, Sorghum bicolor
MDGSTRGGGHSEALRNYNLGRTLGIGTFGKVKIAEHKLTGHRVAIKIINCRQMKNMEMEEKAKREIKILKLFIHPHIIRLYEVIYTPTDIYVVMEYCKYGELFDYIVEKGRLQEDEARRIFQQIISGVEYCHRNMVVHRDLKPENLLLDSKYNVKLADFGLSNVMHDGHFLKTSCGSPNYAAPEVISGKQYAGPEVDVWSCGVILYALLCGTLPFDDENIPNLFKKIKGGIYTLPSHLSALARDLIPRMLVVEPMKRITIREIRDHQWFQTRLPRYLAVPPPDTTQQAKMIDEDTLRDVVNMGFNKNHVCESLCSRLQNEATVAYYLLLDNRFRATSGYLGADYQESMDRNLNQMASSESSSSGTRNYVPGSSDPHSSGLRPHYPVERKWALGLQSRAHPREIMIEVLKALQELNVSWKKNGHYNMKCRWLPGFPEVHDMLDASNSFLGDSTIMDNDDANGRLPAVIKFEFQLYKTKEDKYLLDMQRVTGPQLLFLDFCAAFLTKLRVL

SEQ ID NO: 7602 - protein, 509 aa, Setaria italica
MDGSARGGGHSDALRNYNLGRTLGIGTFGKVKIAEHKLTGHRVAIKIINCRQMKNMEMEEKAKREIKILKLFIHPHIIRLYEVIYTPTDIYVVMEYCKYGELFDYIVEKGRLQEDEARRIFQQIISGVEYCHRNMVVHRDLKPENLLLDSKYNVKLADFGLSNVMHDGHFLKTSCGSPNYAAPEVISGKLYAGPEVDVWSCGVILYALLCGTLPFDDENIPNLFKKIKGGIYTLPSHLSALARDLIPRMLVVEPMKRITIREIREHQWFQNRLPRYLAVPPPDTTQQAKMIDEDTLRDVVNMGFNKDHVCESLCSRLQNEATVAYYLLLDNRFKATSGYLGADYQESMDRNLNQLASSESTSSGVRNYVPGSTDPHSNGLRTHYPVERKWALGLQSRAHPREIMIEVLKALQELNVSWKKNGHYNMKCRWCPEFSEAHDMLDSSNSFLGDSTIMDNDDANGRLPAVIKFEIQLYKTRDEKYLLDMQRVTGPQLLFLDFCAAFLTKLRVL

SEQ ID NO: 7603 - protein, 509 aa, Panicum virgatum
MDGSTKGGGHSDALRNYTLGRTLGIGTFGKVKIAEHKLTGHRVAIKIINCRQMRNMEMEEKAKREIKILKLFIHPHIIRLYEVIYAPMDIYVVMEYCKYGELFDYIVEKGRLQEDEARRIFQQIISGVEYCHRNMVVHRDLKPENLLLDSKYNVKLADFGLSNVMHDGHFLKTSCGSPNYAAPEVISGRLYAGPEVDVWSCGVILYALLCGTLPFDDENIPNLFKKIKGGIYTLPSHLSALARDLIPRMLVVEPMKRITIREIREHQWFQFRLPRYLAVPPPDTAQQAKMIDEDTLRDVVNMGFNKDDVCESLCSRLQNEATVAYYLLLDNRFRATSGYLGADYQESMDRNLNQLALSESTSSGARNYVPGSSDPHSSGLRTHYPVERKWALGLQSRAHPREIMIEVLKALQELNVSWKKNGHYNMKCRWCPGFSQVHDMLDASNSFLGDSTIMDNDDANGKLPAVIKFEIQLYKTRDEKYLLDMQKVTGPQLLFLDFCAAFLTKLRVL

SEQ ID NO: 7604 - protein, 509 aa, Pennisetum glaucum
MDGSARGAGHSDALINYNLGRTLGIGTFGKVKIAEHKLTGHRVAIKIINCRQMETMEMEEKAKREIKILKLFIHPHIIRLYEVIYTRTDIYVVMEYCKYGELFDYIVEKGRLQENEARRIFQQIISGVEYCHRNMVVHRDLKPENLLLDSKYNVKLADFGLSNVMHDGHFLKTSCGSPNYAAPEVISGKLYAGPEVDVWSCGVILYALLCGTLPFDDENIPNLFKKIKGGIYTLPSHLSALARDLIPRMLVVEPMKRITIREIREHQWFQNRLPRYLAVPPPDTTQQAKMIDEDTLRDVVNMGFNKDHVCESLCSRLQNEATVAYYLLLDNRFKATSGYLGADYQESMERNLNQLPSSESTSSGARNYVPGSTDPHSNGLRTHYPVERKWALGLQSRAHPREIMIEVLKALQELNVSWKKNGHYNMKCRWCPEFSEAHDMLDSSNSFLGDSTIMDNDDANGRLPAVIKFEIQLYKTRDEKYLLDMQRVTGPQLLYLDFCAAFLTKLRVL

SEQ ID NO: 7605 - protein, 244 aa, Panicum virgatum
MDGNTRGGGQSDALRNYTLGRTLGIGTFGKVKIAEHKLTGHRVAIKIINCRQMRNMEMEEKAKREIKILKLFIHPHIIRLYEVIYTPMDIFVVMEYCKYGELFDYIVEKGRLQEEEARRIFQQIISGVEYCHRNMVVHRDLKPENLLLDSKYNVKLADFGLSNVMHDGHFLKTSCGSPNYAAPEVISGRLYAGPEVDVWSCGVILYALLCGTLPFDDEIFPTCSKRSREVSTLFRVIYLLWPGI

SEQ ID NO: 7606 - protein, 509 aa, Panicum virgatum
MDGNTRGGGQSDALRNYTLGRTLGIGTFGKVKIAEHKLTGHRVAIKIINCRQMRNMEMEEKAKREIKILKLFIHPHIIRLYEVIYTPMDIFVVMEYCKYGELFDYIVEKGRLQEEEARRIFQQIISGVEYCHRNMVVHRDLKPENLLLDSKYNVKLADFGLSNVMHDGHFLKTSCGSPNYAAPEVISGRLYAGPEVDVWSCGVILYALLCGTLPFDDENIPNLFKKIKGGIYTLPSHLSALARDLIPRMLVVEPMKRITIREIREHPWFQFRLPRYLAVPPPDTAQQAKMIDEDTLRDVVNLGFKKDDVCESLCSRLQNEATVAYYLLLDNRFRATSGYLGADYQESMDRNLNQPALSESTSSGTRNHVPGSSDPHSSGLWTHYPVERKWALGLQSRAHPREIMIEVLKALQELNVSWKKNGHYNMKCRWCPGFSEVDDMLDASNSFLGDSTIMDNDDANGKLPAVIKFEIQLYKTRDEKYLLDMQRVTGPQLLFLDFCAAFLTKLRVL

SEQ ID NO: 7607 - protein, 508 aa, Oryza sativa
MDGNAKGGGHSEALKNYNLGRTLGIGSFGKVKIAEHKLTGHRVAIKILNRRQMRNMEMEEKAKREIKILRLFIHPHIIRLYEVIYTPTDIYVVMEYCKFGELFDYIVEKGRLQEDEARRIFQQIISGVEYCHRNMVVHRDLKPENLLLDSKYNVKLADFGLSNVMHDGHFLKTSCGSPNYAAPEVISGKLYAGPEVDVWSCGVILYALLCGTLPFDDENIPNLFKKIKGGIYTLPSHLSALARDLIPRMLVVDPMKRITIREIREHQWFQIRLPRYLAVPPPDTAQQAKMIDEDTLQDVVNLGYGKDHVCESLRNRLQNEATVAYYLLLDNRFRATSGYLGADYQESLERNFNRFASSESASSNTRHYLPGSSDPHASGLRPHYPVERKWALGLQSRAQPREIMIEVLKALQDLNVSWKKNGQYNMKCRWSVGTQATDMLDVNNSFVDDSIIMDNGDVNGRLPAVIKFEIQLYKTRDEKYLLDMQRVTGPQLLFLDFCADFLTKLRVL

SEQ ID NO: 7608 - protein, 507 aa, Avena sativa
MDGNTRGGGHSDALKNYNLGRTLGIGTFGKVKIAEHKHTGHKVAIKILNRRQMRTMEMEEKAKREIKILRLFIHPHIIRLYEVIYTPTDIFVVMEYCKYGELFDCIVEKGRLQEDEARRIFQQIISGVEYCHRNMVVHRDLKPENLLLDSKYNVKLADFGLSNVMHDGHFLKTSCGSPNYAAPEVISGKLYAGPEVDVWSCGVILYALLCGTLPFDDDNIPNLFKKIKGGIYILPSHLSALARDLIPRMLVVDPMKRITIREIREHPWFQNHLPRYLAVPPPDTAQQAKMIDEDTLQDVVNLGYDKDHVCESLCNRLQNEATVAYYLLLDNRFRATSGYLGAEHQSMDRSYNQVASSESASSSTRNYLPGSNDSHGSGLRPYYPVERKWALGLQSRAHPREIMIEVLKALQELNVSWKKNGHYNMKCRWCPGFPQVSDMLDANHSFVDDSTIMDNGEANGLPVVIKFEIQLYKTRDDKYLLDMQRVTGPQLLFLDFCAAFLTNLRVL

SEQ ID NO: 7609 - protein, 509 aa, Brachypodium distachyon
MDGNARGGGHSEALKNYNLGRTLGIGTFGKVKIAEHKHTGHKVAIKILNRRQMRTMEMEEKAKREIKILRLFIHPHIIRLYEVIYTPTDIFVVMEYCKYGELFDCIVEKGRLQEDEARRIFQQIISGVEYCHRNMVVHRDLKPENLLLDSKYNVKLADFGLSNVMHDGHFLKTSCGSPNYAAPEVISGKLYAGPEVDVWSCGVILYALLCGSLPFDDDNIPNLFKKIKGGIYILPSHLSALARDLIPRMLVVDPMKRITIPEIREHNWFQNRLPRYLAVPPPDTAQQAKMIDEDTLQDVVNLGYEKDHVCESLCNRLQNEATVAYYLLLDNRFRATSGYLGADYQESMDRSFNQFTSSEPASSSTRNYLPGSSDSQGSGLRPYYPVERKWALGLQSRAHPREIMIEVLKALQELNVCWKKNGHYNMKCRWCPGFPQVSDMVDANHSFADDSTIMDNVNVNGRLPAVVKFEIQLYKTRDDKYLLDMQRVTGPQLLFLDFCAAFLTNLRVL

SEQ ID NO: 7610 - protein, 509 aa, Oryza sativa
MEGNARGGGHSEALKNYNLGRTLGIGSFGKVKIAEHKLTGHRVAIKILNRRQMRNMEMEEKAKREIKILRLFIHPHIIRLYEVIYTPTDIYVVMEYCKFGELFDYIVEKGRLQEDEARRIFQQIISGVEYCHRNMVVHRDLKPENLLLDSKYNVKLADFGLSNVMHDGHFLKTSCGSPNYAAPEVISGKLYAGPEVDVWSCGVILYALLCGTLPFDDENIPNLFKKIKGGIYTLPSHLSALARDLIPRMLVVDPMKRITIREIREHQWFQIRLPRYLAVPPPDTAQQAKMIDEDTLQDVVNLGYEKDHVCESLRNRLQNEATVAYYLLLDNRFRATSGYLGADYQESLERNLNRFASSESASSNTRHYLPGSSDPHASGLRPHYPVERKWALGLQSRAQPREIMIEVLKALEDLNVCWKKNGQYNMKCRWSVGYPQATDMLDVNHSFVDDSIIMDNGDVNGRLPAVIKFEIQLYKSRDEKYLLDMQRVTGPQLLFLDFCAAFLTKLRVL

SEQ ID NO: 7611 - protein, 509 aa, Hordeum vulgare
MDGNTRGGGHSEALKNYNLGRTLGIGTFGKVRIAEHKHTGHKVAIKILNRRQMRTMNMEEKAKREIKILRLFIHPHIIRLYEVIYTPTDIFVVMEYCKYGELFDCIVEKGRLQEDEARRIFQQIISGVEYCHRNMVVHRDLKPENLLLDSKYNVKLADFGLSNVMHDGHFLKTSCGSPNYAAPEVISGKLYAGPEVDVWSCGVILYALLCGTLPFDDDNIPNLFKKIKGGIYILPSHLSALARDLIPRMLVVDPMKRITIREIREHPWFQNRLPRYLAVPPPDTAQQAKMIDEDTLKDIVNLGYDKDHVCESLCNRLQNEATVAYYLLLDNRFRATSGYLGADYQQSMGRSLNQFTSSESASPSTRQYLPGTNDSQGSGLRPYYPVERKWALGLQSRAHPREIMIEVLKALQELNVSWKKNGHYNMKCRWCPGFPQVSDMLDANHSFVDDSTIMDNGDANGRLPAVIKFEIQLYKTKDDKYLLDMQRLTGPQLLFLDFCAAFLTNLRVL

SEQ ID NO: 7612 - protein, 509 aa, Triticum aestivum
MEGNTRGGGHSEALKNYNVGRTLGIGTFGKVRIAEHKHTGHKVAIKILNRRQMRTMEMEEKAKREIKILRLFIHPHIIRLYEVIYTPTDIFVVMEYCKYGELFDCIVEKGRLQEDEARRIFQQIISGVEYCHRNMVAHRDLKPENLLLDSKYNVKLADFGLSNVMHDGHFLKTSCGSPNYAAPEVISGKLYAGPEVDVWSCGVILYALLCGTLPFDDDNIPKLFKKIKGGIYILPSHLSALARDLIPRMLVVDPMKRITIREIREHPWFQNRLPRYLAVPPPDTAQQAKMIDEDTLKEIVNLGYDKDHVCESLCNRLQNEATVAYYLLLDNRFRATSGYLGADYLQSMGRSFNQFTSSESASPSTRQYLPASNDSQGSGLRPYYPVERKWALGLQSRAQPREIMIEVLKALQELNVCWKKNGHYNMKCRWCPGFPQVSDMLDANHSFVDDSTIMDNGDANGRLPAVIKFEIQLYKTKDDKYLLDMQRVTGPQLLFLDFCAAFLTNLRVL

SEQ ID NO: 7613 - protein, 509 aa, Triticum aestivum
MEGNTRGGGHSDALKNYNVGRTLGIGTFGKVRIAEHKHTGHKVAIKILNRRQMRTMEMEEKAKREIKILRLFIHPHIIRLYEVIYTPTDIFVVMEYCKYGELFDCIVEKGRLQEDEARRIFQQIISGVEYCHRNMVAHRDLKPENLLLDSKYNVKLADFGLSNVMHDGHFLKTSCGSPNYAAPEVISGKLYAGPEVDVWSCGVILYALLCGTLPFDDDNIPKLFKKIKGGIYILPSHLSALARDLIPRMLVVDPMKRITIREIREHPWFQNRLPRYLAVPPPDTAQQAKMIDEDTLKEIVNLGYDKDHVCESLCNRLQNEATVAYYLLLDNRFRATSGYLGADYLQSMGRSFNQFTSSESASPSTRQYLPASNDSQGSGLRPYYPVERKWALGLQSRAQPREIMIEVLKALQELNVCWKKNGHYNMKCRWCPGFPQVSDMLDANHSFVDDSTIMDNGDANGRLPAVIKFEIQLYKTKDDKYLLDMQRVTGPQLLFLDFCAAFLTNLRVL

SEQ ID NO: 7614 - protein, 507 aa, Secale cereale
MDGNTRGGGHSEALKNYNLGRTLGIGTFGKVRIAEHKHTGHKVAIKILNRRQMRTMEMEEKAKREIKILRLFIHPHIIRLYEVIYTPTDIFVVMEYCKYGELFDCIVEKGRLQEDEARRIFQQIISGVEYCHRNMVAHRDLKPENLLLDSKYNVKLADFGLSNVMHDGHFLKTSCGSPNYAAPEVISGKLYAGPEVDVWSCGVILYALLCGTLPFDDDNIPNLFKKIKGGIYILPSHLSALARDLIPRMLVVDPMKRITIREIREHPWFQNRLPRYLAVPPPDTAQQAKMIDEDTLKDIVKLGYDKDHVCESLCNRLQNEATVAYYLLLDNRFRATSGYLGADYQQSMGRSFNQFTSPASPSTRQYLPGSNDSQGSGLRPYYPVERKWALGLQSRAQPREIMIEVLKALQELNVCWKKNGHYNMKCRWCPGFPQVSDMLDVNHSFVDDSTITDNSDANGRLPAMIKFEIQLYKTKDDKYLLDMQRVTGPQLLFLDLCAAFLTNLRVL

SEQ ID NO: 7615 - protein, 1175 aa, Sorghum bicolor
MHIKEVTLEGFKSYAGRTVVSGFDPLFNAITGLNGSGKSNILDSICFVLGITDLRQVRAASLQELVYKQGQAGVTKATVSIVFDNSDRSRSPLGYEDSPEITVTRQIVVGGRNKYLINGHLAQPSRVQTLFHSVQLNVNNPHFLIMQGRITKVLNMKPPEILSMLEEAAGTRMYEMKKESALKTLEKKQNKVDEINKLLDVEILPALEKLRKERCQYMKWANGNAELDRLKRFCIAYEFVQAERVRDGALSDVKQIRAKIDELDENTETIKADIQEMDNNISTLAAEKEAKEGGEMKLLSDKVDKLSHVLIKETSVMNNQEETLKSEEKGAEKILTNIEDIKKSILERDAAVKNVEIEASDMKRRAEELTKELDEKEKEYQGVLAGKSSASEKKCLEDQLRDAKAAVGDAESGLKQLATKIKHSEKELKEKKALLVSKRDEAIAAENELKTRTKDLDGIKASMGSINYDEGQMEALQKDRSMELEIGQKLKDRVRKLSGELANVHFSYRDPERNFDRSKVKGVVARLIRIKDSSTATALEVAAGGRLYNVVVDTEETGKQLLKNGDLRSRVTIIPLNKIQTYTIPDRVQQAARRLVGPDNVTLALELVGYGEEVKNAVAYVFGSTFVCRNMDAAKEVAFNREVSSTSVTLEGDTYQPSGLLTGGSKGGRGNLLRKLDELAKAEADLSDHEKRLSVIEQQIGALLPLQKRYTELKSQFELKSYDLSLFQSRVEQNEHHKLGELVKKIEQELQESTQELTEKEVQHERCVSTVSELETTIKTYGTEREGRLKALEKRIKSIKSEMQSMSKQLKAYESDRERLIMEKDAVANELATLEEQLTTSKAQITSLSETLEKQKDKVTSIKQDYDQAESELNVGRSKLKECDSQINRMAKEQQKLQQKLSDSNVERKKMENEVKRMEIEQKDCSSIVDKLLEKYSWIVTEKQLFGKSGTDYDFHSCEPHKAREELENLQAQQSSLEKRVNKKVMAMFEKAEDEYNDLMSKKNIIENDKAKIKNVIEELDEKKKETLKVTWLKVNKDFGSIFSTLLPGTMAKLDPPEGGTFLDGLEVRVAFGTVWKQSLSELSGGQRSLLALSLILALLLFKPAPLYILDEVDAALDLSHTQNIGRMIKAHFPHSQFIVVSLKEGMFNNANVIFRTKFVDGVSTVTRTVPSKQR

SEQ ID NO: 7616 - protein, 1175 aa, Panicum virgatum
MHIKEVTLEGFKSYAGRTVVSGFDPLFNAITGLNGSGKSNILDSICFVLGITDLRQVRAASLQELVYKQGQAGVTKATVSIVFDNSDRSRSPLGYEDSPEITVTRQIVVGGRNKYLINGHLAQPSRVQTLFHSVQLNVNNPHFLIMQGRITKVLNMKPPEILSMLEEAAGTRMYEMKKESALKTLEKKQNKVDEINKLLDAEILPALEKLRKERCQYMKWANGNAELDRLKRFCISYEFVQAERVRDGALNDVKKIRAKILELDENTEKLKADIQEMYKNISTLAAEKEAKLGGEMKVLSEKVDKLSHALIKETSVMNNQEETLKSEEEGAEKILKNIEDIKRSMIERDAAVKDLEDGASDMKRKAEDLTKKLDENEKEYQGVLAGKSNANEKKCLEDQLRDAKAAVGDAESGLKQLNTKISHSEKELKEKKALLVSKRDEATAAENELKARTKDLEAIKTSMGSINYDEGQMEALQKDRSTELEMVQNLKDRVRKLSGELANVHFSYRDPERNFDRSKVKGVVARLIRIKNSSAATALEVAAGGRLFNVVVDTEETGKKLLKNGDLQSRVTIIPLNKIQTYTIPDRVQQAARRLVGPDNVTLALELVGYGEEVKNAVSYVFGSTFVCRNSEAAKEVAFNREVASTSVTLEGDTYQPSGLLTGGSKGGRGNLLRKLDELAKAEADLSNHEKRLSVIEQQIGALLPLQKRYTELKSQFELKSYDLSLFHKRVEQNEHHKLGELVKKIEQEIQESKQELTEKQVQYEKCVSMVSELEQTIRTYGTEREGRLKALEKTIKSLKSEMQSMSKQLKAHESERERLIMEKDAVVNELANLEEQLSTSKAQITSQSETLEKQKDKVASIKQDYDQAEGELNVGRSKLNECDSQINHMAKEQQKLQQQLSDSNVERKKMENEVKRMEIEQKDCSSIVDKLVEKYSWISTEKQLFGKSGTDYDFESCEPHKAREELENLQAQQSSLEKRVNKKVMAMFEKAEDEYNDLMSKKNIIENDKAKIKKVIEELDEKKKETLKVTWLKVNKDFGSIFSTLLPGTMAKLDPPEGGTFLDGLEVRVAFGTVWKQSLSELSGGQRSLLALSLILALLLFKPAPLYILDEVDAALDLSHTQNIGRMIKAHFPHSQFIVVSLKEGMFNNANVIFRTKFVDGVSTVTRTVPSKQR

SEQ ID NO: 7617 - protein, 866 aa, Panicum virgatum
MHIKEVTLEGFKSYAGRTVVSGFDPLFNAITGLNGSGKSNILDSICFVLGITDLRQVRAASLQELVYKQGQAGVTKATVSIVFDNSDRSRSPLGYEDSPEITVTRQIVVGGRNKYLINGHLAQPSRVQTLFHSVQLNVNNPHFLIMQGRITKVLNMKPPEILSMLEEAAGTRMYEMKKESALKTLEKKQNKVDEINKLLDVEILPALEKLRKERCQYMKWANGNAELDRLKRFCIAYEFVQAERVRDGALNDVKQIRAKILELDENTEKLKADIQEMDKNISTLAAEKEAKLGGEMKALSEKVDKLSHVLIKETSVMNNQEETLKSEEKGAEKILKNIEDIKRSMIERDAAVKDLEDGASDMKMKAEDLTKKLDENEKEYQGVLAGKSNANEKKCLEDQLRDAKAAVGEAESGLKQLNTKISHSEKELKEKKALLVSKRDEATAAENELKARTKDLEAIKTSMGSINYDEGQMEVLQKDRSTELEMVRNLKDRVRKLSGELANVHFSYRDPERNFDRSKVKGVVARLIRIKDSSAATALEVAAGGRLFNVVVDTEDTGKKLLKNGDLQSRVTIIPLNKIQTYTIPDRVQQAARRLVGPDNVTLALELVGYGEEVKNAVSYVFGSTFVCRNSEAAKEVAFNREVGSTSVTLEGDTYQPSGLLTGGSKGARGNLLRKLDELAKAEADLSNHEKRLSVIEQQIGALLPLQKRYTELKSQFELKSYDLSLFHKRVEQNEHHKLGELVKKIEQDLQESKQELTEKQVQYEKCVSTVSELEQTIRTYGTEREGRLKALEKTIKSLKSEMQSMSKQLKAHESERERLIMEKDAVANELANLEEQLSTSNAQITSLSETLEKTKGQGYFHKARL

SEQ ID NO: 7618 - protein, 1175 aa, Setaria italica
MHIKEVTLEGFKSYAGRTVVSGFDPLFNAITGLNGSGKSNILDSICFVLGITDLRQVRAASLQELVYKQGQAGVTKATVSVVFDNSDRSRSPLGYEDSSEITVTRQIVVGGRNKYLINGHLAQPSRVQTLFHSVQLNVNNPHFLIMQGRITKVLNMKPPEILSMLEEAAGTRMYEMKKESALKTLEKKQNKVDEINKLLDVEILPALEKLRKERCQYMKWANGNAELDRLKRFCIAYEFVQAERVRDGALNDVKQIRARILELDENTEKLKADIQEMDKNISTLAAEKEAKLGGEMKALSDKVDKLSHALIKETSVMNNQEETLKSEEKGVEKILKNIEDIKRSMIERDAAVKDVEDGASDMKRKAEDLTRKLDENEKEYQGVLAGKSNANEKKCLEDQLRDAKAAVGDAESGLKQLTTKISHSEKELKEKKALLVSKRDEATAAENELKERTKDLEAIKTSMGSFNYNEAQMEALQKDHSTESEIIQNLKDCIRNLSGELANLHFSYRDPERDFDRSKVKGVVARLIRIKDSSAATALEVTAGGRLFNVVVDTEDTGKKLLKNGDLRKRVTIIPLNKIQTYMIPDRVQQAARRLVGPDNVTLALELVGYGEEVKNAVAYVFGSTFVCRNTEAAKEVAFNREVGSTSVTLEGDTYQPSGLLTGGSKGGRGDLLRKLDKLAKAETDLSDHQKKLSVIEQQIGALLPLQERYTKLKSQFELKSYDLSLFQKRVEQNEHHKLGELVKKIEQELQESKQELTEKQVQYEKCVSMVSELEQTIRTYGTEREGRLKALEKMIKSLKSEMQSMSKQLKAYESERERLIMEKDAVANELATLEEQLSTSKAQITSLSETLEKQRDKVTAIKQEYDQAEGELNVGRSKLKECDSQINRMAKEQQKLQQKLSDSNVERKKMENEVKRMEIEQKDCSSVVDKLVEKYSWIATEKQLFGKSGTDYDFESCEPHKAREELENLQAQQSSLEKRVNKKVMAMFEKAEDEYNDLMSKKNIIENDKAKIKKVIEELDEKKKETLKVTWLKVNKDFGSIFSTLLPGTMAKLDPPEGGTFLDGLEVRVAFGTVWKQSLSELSGGQRSLLALSLILALLLFKPAPLYILDEVDAALDLSHTQNIGRMIKAHFPHSQFIVVSLKEGMFNNANVIFRTKFVDGVSTVTRTVPSKQK

SEQ ID NO: 7619 - protein, 1175 aa, Oryza sativa
MHIKEICLEGFKSYAGRTVVSGFDPLFNAITGLNGSGKSNILDSICFVLGITDLRQVRAASLQELVYKQGQAGVTKATVSIVFDNSDRSRSPLGYEDSPEITVTRQIVVGGRNKYLINGHLAQPSRVQTLFHSVQLNVNNPHFLIMQGRITKVLNMKPPEILSMLEEAAGTRMYEMKKEAALKTLEKKQNKVDEINKLLDEEILPALEKLRKERCQYMKWANGNADLDRLKRFCIAYEFVQAERVRDGALNDVKQIRAKIVELDESTEKLKSEIQEMDKNISNLAAEKEAKLGGEMKTLSEKVDKLSHALIKETSVMNNQEETIKSEEKGAEKILKNIEDIKRSIIERDTAVKNAEDGAADMKKRADDLTKELDESEKEYQGVLAGKSNANEKKCLEDQLRDAKAAVGEAESGLKQLTTKISHSEKELKDKKAQLVSKRDEATAAENELKAREKDLETVKASMQSVNYEEGQMEALQKDRSIELDAVQKLKDKIRALSGELANVHFNYRDPVKNFDRSKVKGVVARLIKIKDSSTATALEVAAGGRLYNVVVDTETTGKQLLQNGDLKRRVTIIPLNKIQTGTIPERVRQAARRLVGAENVTLALELVGYVEEVKNAMTYVFGSTFVCRNMESAKEVAFNREVGSTSVTLEGDIFQPSGLLTGGSRRGGGDLLRQLHELAKAEADLANHEKRLSVIEQKIVVLLPLQKKFTELKSQFELKSYDLSLFQNRVEQNEHHKLGELVKKLEQELQESKQELKAKQAQYEKSVSTVSELEKTIKTYGSEREGRLKALERKIKSLKSELQSMSKQLKAHESERERLIMEKDAVANELAMLEEQLTTSKAQIAAMTETLNRHQTKVASIKQDYDQAESELNIGRSKLKECDSQINSMAKEQQKLQQQLSDSNVERKKMENEVKRMEIEQKDCSSKVDKLVEKYSWIATEKQLFGKSGTDYDFVSCEPHKAREELENLQAQQSSLEKRVNKKVMAMFEKAEDEYNDLMSKKNIIENDKSKIKTVIEELDEKKKETLKVTWLKVNKDFGSIFSTLLPGTMAKLDPPEGGTFLDGLEVRVAFGTVWKQSLSELSGGQRSLLALSLILALLLFKPAPLYILDEVDAALDLSHTQNIGRMIKAHFPHSQFIVVSLKEGMFNNANVIFRTKFVDGVSTVTRTVPSKQR

SEQ ID NO: 7620 - protein, 1175 aa, Brachypodium distachyon
MHIKEVCLEGFKSYAGRTVVPGFDPLFNAITGLNGSGKSNILDSICFVLGITDLRQVRAASLQELVYKQGQAGVTKATVSIVFDNSDRSRSPLGYEDSAEITVTRQIVVGGRNKYLINGHLAQPSRVQTLFHSVQLNVNNPHFLIMQGRITKVLNMKPPEILSMLEEAAGTRMYEMKKESALKTLEKKQNKVHEINKLLDDEILPALEKLRKERCQYMKWANGNAELDRLKRFCIAYEFVQAEGVRDGAVSGVKQIRGKIVELDESTEKLKAQINEMDKNISTLAAEKEAKLGGEMKVLSEKVDKLSHALVKETSAMDNQEETLRSEEKAAEKILKNIEDIKRSIIERDAAVKNAEDGASDMKKRAEDLTKELDESEREYQGVLAGKSSANEKKCLEDQLRDARGAVGEAESGLKQLTTKISLSEKELKEKKAQMVSKRDEATAAEKELKARTKDLEAIKASMGSIDYEEGQMEALQKDRSTELDVVQKLKDKVRALSGELANVHFSYRDPVRSFDRSKVKGVVARLIKIKDSTTATALEVAAGGRLYNVVVDSETTGKQLLQNGDLKRRVTIIPLNKIKAGTIPDRVQQAARRMVGAENVTLALELVGYSEEVKNAMAYVFGSTFVCRNMDAAKEIAFNREVGSTSVTLEGDIFQPSGLLTGGSRRGGGDLLRQLHELAKAEADLSDHEDRLSVIEQKIAVLLPLQKKYAELKSQFELKSYDLSLFQNRVEQNEHHKLGELVKKLEQELQESRTELTEKKVQYEKCVSTVSELEKTIKTYGTEREGMLKALEGKIKSLKSEMQSMSKQLKAHESERERLIMEKDAVANELAILEDQLVTSKAQITALSEAWATNKSKVASIKLDYDQAESELNTERSKLKDCDSQINCIAKEQQKLQQLLSDSNVERKKMENEVKRMEIEQKDCSLKVDKLVEKYSWITTEKQLFGRSGTDYDFASCEPHKAREEFEQLQAQQSGLEKRVNKKVMAMFEKAEDEYNDLISKKNIIENDKAKIKKVIEELDEKKKETLKVTWLKVNKDFGSIFSTLLPGTMAKLDPPEGGTFLDGLEVRVAFGTVWKQSLSELSGGQRSLLALSLILALLLFKPAPLYILDEVDAALDLSHTQNIGRMIKAHFPQSQFIVVSLKEGMFNNANVIFRTKFVDGVSAVTRTVPSKQR

SEQ ID NO: 7621 - protein, 1175 aa, Hordeum vulgare
MHIKEVCLEGFKSYAGRTVVPGFDPLFNAITGLNGSGKSNILDSICFVLGITDLRAVRAASLQELVYKQGQAGVTKATVSIVFDNSDRARSPLGYEDSAEITVTRQIVVGGRNKYLINGHLAQPSRVQTLFHSVQLNVNNPHFLIMQGRITKVLNMKPPEILSMLEEAAGTRMYEMKKESALKTLEKKQNKVEEINKLLDDEILPALEKLRKERCQYMKWANGNTELDRLKRFCIAYEFVQAERVRESALSDVKQIQGKIVELDESTEKLKADIDEMDKNIATLTAEKEAKLGGELKVLSEKVDKLSHALIKETSLMDNQEETLRSEEKAADKILKNIEDIKRSIVERDAAVKNAEDGASDMSKRAEDLTKEIDESEKEYQGVLAGKSSANEKKCLVDQLRDAKAAVGEAESGVKRLTTKISHSEKELKEKKAQMKSKRDEATAAEKELKARTKDLEAIKASMGSINYEEGQMETLQKDRSTEVEVVQKLKYKVRALSGELGNVNFSYQDPVKNFDRSKVKGVVAQLVKIKDSSTATALEVAAGGRLYNVVVDTETTGKQLLQNGGLNRRVTIIPLNKIHTGTIPDRVQQAARRMVGAENVTLALELVGYDEEVKNAMAYVFGSTFVCRNMEAAKEIAFNREVGSTSVTLEGDIFQPSGLLTGGSRRGGGDLLRKLHELAKAEADLSDHEDMLSVIEQKIAVLLPLHKKYAELKSQFELKSYDLSLFQSRVEQNEHHKLGELVKKLEQELQESKEELKEKQVEHKKCVSTVSDLEKTIKTYGSEREGRLKALEKKIKSLKSEMQAMSDQLKAYQSERERLIMEKDAVANELATLEEQLITSKAQITALSETWGTHKSKVAGTKLEYDQAESELNIGRSKLKECDSQINSISKEQQKLQQLLGDSNVERKKMENEVKRMEIEQKDCSSRVDKLMEKYSWIATEKQLFGKSGTDYDFASCEPHKAREELDNLQTQQSGLEKRVNKKVMAMFEKAEDEYNDLISKKNIIENDKSKIKKVIEELDEKKKETLKVTWLKVNKDFGSIFGTLLPGTMAKLDPPEGGTFLDGLEVRVAFGTVWKQSLSELSGGQRSLLALSLILALLLFKPAPLYILDEVDAALDLSHTQNIGRMIKAHFPQSQFIVVSLKEGMFNNANVIFRTKFVDGVSTVTRTVPSKQK

SEQ ID NO: 7622 - protein, 1175 aa, Hordeum vulgare
MHIKEVCLEGFKSYAGRTVVPGFDPLFNAITGLNGSGKSNILDSICFVLGITDLRAVRAASLQELVYKQGQAGVTKATVSIVFDNSDRARSPLGYEDSAEITVTRQIVVGGRNKYLINGHLAQPSRVQTLFHSVQLNVNNPHFLIMQGRITKVLNMKPPEILSMLEEAAGTRMYEMKKESALKTLEKKQNKVEEINKLLDDEILPALEKLRKERCQYMKWANDNTELDRLKRFCIAYEFVQAERVRESALSDVKQIQGKIVELDESTEKLKADIDEMDKNIATLTAEKEAKLGGELKVLSEKVDKLSHALIKETSLMDNQEETLRSEEKAADKILKNIEDIKRSIVERDAAVKNAEDGASDMSKRAEDLTKEIDESEKEYQGVLAGKSSANEKKCLVDQLRDAKAAVGEAESGVKRLTTKISHSEKELKEKKAQMKSKRDEATAAEKELKARTKDLEAIKASMGSINYEEGQMETLQKDRSTEVEVVQKLKYKVRALSGELGNINFSYQDPVKNFDRSKVKGVVAQLVKIKDSSTATALEVAAGGRLYNVVVDTETTGKQLLQNGGLNRRVTIIPLNKIHTGTIPDRVQQAARRMVGAENVTLALELVGYDEEVKNAMAYVFGSTFVCRNMEAAKEIAFNREVGSTSVTLEGDIFQPSGLLTGGSRRGGGDLLRKLHELAKAEADLSDHEDMLSVIEQKIAVLLPLHKKYAELKSQFELKSYDLSLFQSRVEQNEHHKLGELVKKLEQELQESKEELKEKQVEHKKCVSTVSDLEKTIKTYGSEREGRLKALEKKIKSLKSEMQAMSDQLKAYQSERERLIMEKDAVANELATLEEQLITSKAQITALSETWGTHKSKVAGTKLEYDQAESELNIGRSKLKECDSQINSISKEQQKLQQLLGDSNVERKKMENEVKRMEIEQKDCSSRVDKLMEKYSWIATEKQLFGKSGTDYDFASCEPHKAREELDNLQAQQSGLEKRVNKKVMAMFEKAEDEYNDLISKKNIIENDKSKIKKVIEELDEKKKETLKVTWLKVNKDFGSIFGTLLPGTMAKLDPPEGGTFLDGLEVRVAFGTVWKQSLSELSGGQRSLLALSLILALLLFKPAPLYILDEVDAALDLSHTQNIGRMIKAHFPQSQFIVVSLKEGMFNNANVIFRTKFVDGVSTVTRTVPSKQK

SEQ ID NO: 7623 - protein, 135 aa, Zea mays
MSEYKNVVGGRLKLKGKALDVKEGGVKKKKKKHQLEESSQIEHDELHKGGNSGLPADHNNELIEAGKVGDEERNLHPDYDHLTPAERRYIDQKQKIDMQKLAKVANKSHRDRIQDFNQYLANLSEHYDIPKVGPG

SEQ ID NO: 7624 - protein, 136 aa, Saccharum officinarum
MSEYQNVVGGRLKLKGKALDVKEGGVKKKKKKKYQREESSQIGHDELHKGGSSELPTDPNNELIEADKIGDEEGNPHPDYDHLTPAERRYMEQKQKIDMQKLAKVANKSHRDRIQDFNQYLANLSEHYDIPKVGPG

SEQ ID NO: 7625 - protein, 136 aa, Sorghum bicolor
MSEYQNVVGGRLKLKGKALDVKEGGVKKKKKKKHQLEESSQIEHDELQKGRNSDLPTDPNNELVEADKMGDEEGNPHPDYDHLTPAERRYMEQKQKIDMHKMAKVANKSHRDRIQDFNQYLANLSEHYDIPKVGPG

SEQ ID NO: 7626 - protein, 137 aa, Sorghum bicolor
MSEYQNVVGGRLKLKGKALDVKEGAVKKKKKKKYQREESSQSGHEHNELHKGGSSELPTDPNNELIEADKIGDEGNPHPDYDHLTPAERRYIEQKQKIDMQKLAKVANKSHRDRIQDFNQYLANLSEHYDIPKVGPG

SEQ ID NO: 7627 - protein, 136 aa, Setaria italica
MSEYQNVVGGRLKLKGKALDVKEGGVKKKKKKKQHREESSQIGHDELHEGGSSELPTDPNNELTEADKLGEEEGNPHPDYDHLTPAERRYMEQKQKIDMQKLAKVSNKSHRDRIQDFNQYLANLSEHYDIPKVGPG

SEQ ID NO: 7628 - protein, 136 aa, Panicum virgatum
MSEYQNVVGGRLKLKGKALDVKEGGVKKKKKKKQHREESSQIGHDELNEGGNSELPTDPNSELTEADKMGEEEGNPHPDYDHLTPAERRYMEQKQKIDMQKLAKVANKSHRDRIQDFNQYLANLSEHYDIPKVGPG

SEQ ID NO: 7629 - protein, 136 aa, Pennisetum glaucum
MSEYQNVVGGRLKLKGKALDVKEGGVKKKKKKKQHREESSQIGHGELHEGGSSELPTDTNNELTEADKLGEEEENPHPDYDHLTPAERRYMEQKQKIDMQKLAKVSNKSHRDRIQDFNQYLANLSEHYDIPKVGPG

SEQ ID NO: 7630 - protein, 136 aa, Cynodon dactylon
MSEYQNVVGGRLKLKGKALDVKEGGVKKKKKKKQHREESSQIGRDELHEGGSSELPPDPNSELTEADKMGEEEGNPHPDYDHLTPAERRYMEQKQKIDQQKLAKVANKSHRDRIQDFNQYLANLSEHYDIPKVGPG

SEQ ID NO: 7631 - protein, 136 aa, Eragrostis curvula
MSEYQNVVGGKLKLKGKALDVKEGGVKKKKKKKQNREESSQIGHDELHEGGSSELPTDPNNELIEADKMAEEERERHPDYDHLTPAERRYMEQKQKIDMQKLAKVANKSHRDRIQDFNQYLANLSEHYDIPKVGPG

SEQ ID NO: 7632 - protein, 136 aa, Panicum virgatum
MSEYQNVVGGRLKLKGKALDVKEGGVKKKKTKKQHREESSQIGHDELNEGGNSELPTDPNSELTEADKMGEEEGNPHPDYDHLTPAERRYMEQKQKIDMQKMAKVANKSHRDRIQDFNQYLANLSEHYDIPKVGPG

SEQ ID NO: 7633 - protein, 135 aa, Panicum virgatum
MSEYQNVVGGRLKLKGKALDVKEGGIKKKKKKQHREESSQIGRDELQEGGSSELTTDPNSELIEADKMGEEEGNPHPDYDHLTPAERRYMEQKQKIDMQKLAKVANKSHRDRIQDFNQYLANLSEHYDIPKVGPG

SEQ ID NO: 7634 - protein, 136 aa, Panicum virgatum
MSEYQNVVVGGRLKLKGKALDVKEGGIKKKKKKQHREESSQIGRDELQEGGSSELTADPNSELIEADKMGEEEGNPHPDYDHLTPAERRYMEQKQKIDMQKLAKVANKSHRDRIQDFNQYLANLSEHYDIPKVGPG

SEQ ID NO: 7635 - protein, 135 aa, Setaria italica
MSEYQNVVGGRLKLKGKTLDIKEGGVKKKKKQQHREESSQIGHDGLHEGGISELPTNHNNELTEGEKTGEEEGNPHPDYDHLTPAERRYMEQKQKIDMQKMAKVANKSHRDRIQDFNQYLANLSEHYDIPKVGPG

SEQ ID NO: 7636 - protein, 134 aa, Zea mays
MLEYQNAIGGRLKLKGKALDVKDGGVKKKKKKYQREESSQIAHDELHKGGRSESPIDPNNERIESDKTGDEGNPHPDYGHLTPAERRYMEQKQKIDMQKMAKVANKSHRDRIQDFNQYLANLSEHYDIPKVGPG

SEQ ID NO: 7637 - protein, 141 aa, Eragrostis curvula
  misc_feature (5)..(5): Xaa can be any naturally occurring amino acid
  misc_feature (31)..(31): Xaa can be any naturally occurring amino acid
  misc_feature (69)..(69): Xaa can be any naturally occurring amino acid
  misc_feature (121)..(121): Xaa can be any naturally occurring amino acid
  misc_feature (127)..(127): Xaa can be any naturally occurring amino acid
MSEYXNVVGGRLKLKGKALDVKEGGVKKKKXKKQNREESSQIGHDELHEGGSSELPTDPNNELIEADKXAEEEREQEERERHPDYDHLTPAERRYMEQKQKIDMQKLAKVANKSHRDRIQXFNQYLXNLSEHYDIPKVGPG

SEQ ID NO: 7638 - protein, 135 aa, Oryza sativa
MSEYQNVVGGRLKLKGKALDVKEGGVKKKKKKKQHREESSEAGHGELHQGGSSEVPADPNDELTEADKMGEEGNLQGDYDHLTPAERRYMEQKQKIDMHKLAKVANKSHRDRIQDFNQYLANLSEHYDIPKVGPG

SEQ ID NO: 7639 - protein, 135 aa, Secale cereale
MSEYQNVVGGRLKLKGKPLDVKEGGVKKKNKKKHRREESSQGEHGELREGGSSELPGDPDNEFSEAGKLGEEGSAQADYDHLTPAERRYIEQKQKIDVHKLAKVADKSHRDRIQDFNQYLANLSEHYDIPKVGPG

SEQ ID NO: 7640 - protein, 132 aa, Avena sativa
MSEYQNVVGGRLKLKGKPLDVKEGGVKKKKKKHRREESSQVEHGQQYEGGSSELPGDPELSEAGKMGEEGDVQPDYDHLTPAERRYIEQKQKIDVHKLAKVADKSHRDRIQDFNQYLANLSEHYDIPKVGPG

SEQ ID NO: 7641 - protein, 135 aa, Unknown
  Sequence found in Organisms: Pseudoroegneria spicata, Triticum aestivum
MSEYQNVVGGRLKLKGKPLDVKEGGVKKKNKKKHRREESSQGEHGELREGGSSELPGDPDNEFSEADKLGEEGSAQADYDHLTPAERRYIEQKQKIDVHKLAKVADKSHRDRIQDFNQYLANLSEHYDIPKVGPG

SEQ ID NO: 7642 - protein, 135 aa, Triticum aestivum
MSEYKNVVGGKLKLKGKPLDVKEGGVKKKNKKKHRREESSQGEHSELREGGSSELPGDPDNEFSEADKLGEEGSAQADYDHLTPAERRYIEQKQKIDVHKLAKVADKSHRDRIQDFNQYLANLSEHYDIPKVGPG

SEQ ID NO: 7643 - protein, 135 aa, Triticum aestivum
MSEYKNVVGGKLKLKGKPLDVKEGGVKKKNKKKHRREESSQGEHGELREGGSSELPGDPDNEFSEADKLGEEGSAQADYDHLTPAERRYIEQKQKIDVHKLAKVADKSHRDRIQDFNQYLANLSEHYDIPKVGPG

SEQ ID NO: 7644 - protein, 132 aa, Avena sativa
MSEYQNVVGGRLKLKGKPLDVKEGGVKKKKKKHRREESSQVEHGQQYEGGSSELPGDPELSEAGKMGEEGDAQADYDHLTPAERRYIEQKQKIDVHKLAKVADKSHRDRIQDFNQYLANLSEHYDIPKVGPG

SEQ ID NO: 7645 - protein, 142 aa, Unknown
  Sequence found in Organisms: Fagus grandifolia, Theobroma cacao, Ricinus communis, Castanea mollissima, Euphorbia peplus, Heritiera littoralis, Humulus lupulus, Quercus alba, Carica papaya, Prunus persica, Prunus mume, Euphorbia esula, Fragaria vesca
MIRFILLQNRQGKTRLAKYYVPLEDSEKHKVEYEVHRLVVNRDPKFTNFVEFRTHKVIYRRYAGLFFSLCVDITDNELAYLECIHLFVEILDHFFSNVCELDLVFNFHKVYLILDEFILAGELQETSKKAIIERMGELEKLE

SEQ ID NO: 7646 - protein, 408 aa, Malus domestica
MLLASIPVKIFEKTISGMYLGEIVRRVLVKMAEADALFGESVLEKLSTPFLLRTPYLCAMQQDASDDLQAVGSILYNVAGVESSLSARKIVVDVCDTIVKRGGRLAGAGIVGILQKMEEDSKDLIFGKRTVVAMDGGLYENYPQYRRYLQEAVAELLGTEISKNVVIEHSKDGSGIGAALLAAANSQIQINRWILMLTKTINGDKSPLPKLSTPFFIFLFLLPPRDPLELRDDIAQRNHKRKGKLVAFVPKFRCSAVVNFSSFASTMIRFILLQNRQGKTRLAKYYVPLEDSEKHKVEYEVHRLVVNRDPKFTNFVEFRTHKVIYRRYAGLFFSLCVDITDNELAYLECIHLFVEILDHFFSNVCELDLVFNFHKVYLILDEFILAGELQETSKKAIIERMGELEKLE

SEQ ID NO: 7647 - protein, 142 aa, Beta vulgaris
MIRFILLQNRQGKTRLAKYYVPLEDSEKHKVEYEVHRLVVNRDPKFTNFVEFRTHKVIYRRYAGLFFSMCVDITDNELAYLECIHLFVEILDHFFSNVCELDLVFNFHKVYLILDEFILAGELQETSKKAIIERMGELEKLE

SEQ ID NO: 7648 - protein, 81 aa, Manihot esculenta
LLFFDFDFGRSDSYSCKTGKERLVLPNTMFLSRIPRSTKSNTRFIGWWLTEIPSSRILLSSEHTRSSTGDMLDYFSQFALT

SEQ ID NO: 7649 - protein, 142 aa, Panicum virgatum
MIRFILLQNRQGKTRLAKYYVPLEDSEKHKVEYEVHRLVVNRDPKFTNFVEFRTHKVIYRRYAGLFFSICVDITDNELAYLECIHLFVEILDHFFSNVCELDLVFNFHKVYLILDEFILAGELQETSKKAIIERMGELEKLD

SEQ ID NO: 7650 - protein, 142 aa, Unknown
  Sequence found in Organisms: Hordeum vulgare, Brachypodium distachyon, Festuca arundinacea, Leymus cinereus x Leymus triticoides, Lolium multiflorum, Avena sativa, Secale cereale, Triticum aestivum
MIRFILLQNRQGKTRLAKYYVPLEDSEKHKVEYEVHRLVVNRDPKFTNFVEFRTHKVIYRRYAGLFFSICVDITDNELVYLECIHLFVEILDHFFSNVCELDLVFNFHKVYLILDEFILAGELQETSKKAIIERMGELEKLD

SEQ ID NO: 7651 - protein, 142 aa, Unknown
  Sequence found in Organisms: Cannabis sativa, Euonymus alatus
MIRFILLQNRQGKTRLAKYYVPLEDSEKHKVEYEVHRLVVNRDPKFTNFVEFRTHKVIYRRYAGLFFSLCVDITDNELAYLECIHLFVEILDHFFSNVCELDLVFNFHKVYLILDEFILAGELQETSKKAIIERMGELEKLD

SEQ ID NO: 7652 - protein, 142 aa, Unknown
  Sequence found in Organisms: Cicer arietinum, Medicago truncatula, Arachis hypogaea, Trigonella foenum-graecum
MIRFILLQNRQGKTRLAKYYVPLEDSEKHKVEYEVHRLVVNRDPKYTNFVEFRTHKVIYRRYAGLFFSLCVDITDNELAYLECIHLFVEILDHFFSNVCELDLVFNFHKVYLILDEFILAGELQETSKKAIIERMGELEKLE

SEQ ID NO: 7653 - protein, 142 aa, Unknown
  Sequence found in Organisms: Citrus clementina, Citrus sinensis
MIRFILLQNRQGKTRLAKYYVPLEDSEKHKVEYEVHRLVVNRDPKFTNFVEFRTHKVIYRRYAGLFFSLCVDITDNELAYLECIHLFVEILDHFFSNVCELDLVFNFHKVYLILDEFILAGELQETSKRAIIERMGELEKLE

SEQ ID NO: 7654 - protein, 142 aa, Unknown
  Sequence found in Organisms: Gossypium hirsutum, Gossypium raimondii
MIRFVLLQNRQGKTRLAKYYVPLEDSEKHKVEYEVHRLVVNRDPKFTNFVEFRTHKVIYRRYAGLFFSLCVDITDNELAYLECIHLFVEILDHFFSNVCELDLVFNFHKVYLILDEFILAGELQETSKKAIIERMGELEKLE

SEQ ID NO: 7655 - protein, 142 aa, Unknown
  Sequence found in Organisms: Cucumis sativus, Cucurbita pepo, Cucumis melo, Citrullus lanatus
MIRFILLQNRQGKTRLAKYYVPLEESEKHKVEYEVHRLVVNRDPKFTNFVEFRTHKVIYRRYAGLFFSLCVDITDNELAYLECIHLFVEILDHFFSNVCELDLVFNFHKVYLILDEFILAGELQETSKKAIIERMGELEKLE

SEQ ID NO: 7656 - protein, 142 aa, Euonymus alatus
MIRFILLQNRQGKTRLAKYYVPLEDSEKHKVEYEVHRLVVNRDPKFTNFVEFRTHKVIYRRYAGLFFSLCVDITDNELAYLESIHLFVEILDHFFSNVCELDLVFNFHKVYLILDEFILAGELQETSKKAIIERMGELEKLE

SEQ ID NO: 7657 - protein, 142 aa, Zea mays
MIRFILLQNRQGKTRLAKYYVALEDSEKHKVEYEVHRLVVNRDPKFTNFVEFRTHKVIYRRYAGLFFSICVDITDNELAYLECIHLFVEILDHFFSNVCELDLVFNFHKVYLILDEFILAGELQETSKRAIIERMGELEKLE

SEQ ID NO: 7658 - protein, 142 aa, Pennisetum glaucum
MIRFILLQNRQGKTRLAKYYVPLEDSEKHKVEYEVHRLVVNRDPKFTNFVEFRTHKVIYRRYAGLFFSMCVDITDNELAYLECIHLFVEILDHFFSNVCELDLVFNFHKVYLILDEFILAGELQETSKKAIIERMGELDKLE

SEQ ID NO: 7659 - protein, 142 aa, Unknown
  Sequence found in Organisms: Oryza sativa, Sorghum bicolor
MIRFILLQNRQGKTRLAKYYVPLEDSEKHKVEYEVHRLVVNRDPKFTNFVEFRTHKVIYRRYAGLFFSMCVDITDNELAYLECIHLFVEILDHFFSNVCELDLVFNFHKVYLILDEFILAGELQETSKRAIIERMGELEKLE

SEQ ID NO: 7660 - protein, 142 aa, Silene vulgaris
MIRFILLQNRQGKTRLAKYYVPLEDSEKHKVEFEVHRLVVNRDPKFTNFVEFRTHKVIYRRYAGLFFSMCVDITDNELAYLECIHLFVEILDHFFSNVCELDLVFNFHKVYLILDEFILAGELQETSKKAIIERMGELEKLE

SEQ ID NO: 7661 - protein, 142 aa, Glycine max
MIRFILLQNRQGKTRLAKYYVPLEDSEKHKVEYEVHRLVVNRDPKYTNFVEFRTHKIIYRRYAGLFFSICVDITDNELAYLECIHLFVEILDHFFSNVCELDLVFNFHKVYLILDEFILAGELQETSKKAIIERMGELEKLE

SEQ ID NO: 7662 - protein, 88 aa, Hevea brasiliensis
FLFAIETEILIFLSFGRSDSYFCRTGKARLVLPNTMFLSRIPRNTKSNTRFIGWWLTEIPSSRILLSSEHTRSSTGGMLDYFSHCVLI

SEQ ID NO: 7663 - protein, 142 aa, Unknown
  Sequence found in Organisms: Glycine max, Phaseolus coccineus, Vigna unguiculata, Lotus japonicus, Cajanus cajan
MIRFILLQNRQGKTRLAKYYVPLEDSEKHKVEYEVHRLVVNRDPKYTNFVEFRTHKIIYRRYAGLFFSLCVDITDNELAYLECIHLFVEILDHFFSNVCELDLVFNFHKVYLILDEFILAGELQETSKKAIIERMGELEKLE

SEQ ID NO: 7664 - protein, 142 aa, Brachypodium distachyon
MIRFILLQNRQGKTRLAKYYVPLEDSEKHKVEGEVHRLVVNRDPKFTNFVEFRTHKVIYRRYAGLFFAICVDITDNELAYLECIHLFVEILDHFFSNVCELDLVFNFHKVYLILDEFILAGELQETSKKAIIERMGELEKLD

SEQ ID NO: 7665 - protein, 142 aa, Unknown
  Sequence found in Organisms: Cleome gynandra, Cleome spinosa
MIRFILLQNRQGKTRLAKYYVPLEDSEKHKVEYEVHRLVVNRDPKFTNFVEFRTHKVIYRRYAGLFFSLCVDITDNELAYLECIHLFVEILDHFFSNVCELDLVFNFHKVYLILDEFILAGELQETSKRAIIERMAELEKLE

SEQ ID NO: 7666 - protein, 142 aa, Cyamopsis tetragonoloba
MIRFILLQNRQGKTRLAKYYVPLEDSEKHKVEYEVHRLVVNRDPKHTNFVEFRTHKIIYRRYAGLFFSLCVDITDNELAYLECIHLFVEILDHFFSNVCELDLVFNFHKVYLILDEFILAGELQETSKKAIIERMGELEKLE

SEQ ID NO: 7667 - protein, 142 aa, Cynodon dactylon
MIRFILLQNRQGKTRLAKYYVPLEDSEKHKVEYEVHRLVVNRDPKFTNFVEFRTHKVIYRRYAGLFFSMCVDITDNELAYLECIHSFVEILDHFFSNVCELDLVFNFHKVYLILDEFILAGELQETSKRAIIERMGELEKLE

SEQ ID NO: 7668 - protein, 142 aa, Setaria italica
MIRFILLQNRQGKTRLAKYYVPLEDSEKHKVEYDVHRLVVNRDPKFTNFVEFRTHKVIYRRYAGLFFSMCVDITDNELAYLECIHLFVEILDHFFSNVCELDLVFNFHKVYLILDEFILAGELQETSKRAIIERMGELEKLE

SEQ ID NO: 7669 - protein, 142 aa, Eragrostis curvula
MIRFLLLQNRQGKTRLAKYYVPLEDSEKHKVEYEVHQLVVNRDPKFTNFVEFRTHKVIYRRYAGLFFSICVDITDNELAYLECIHLFVEILDHFFSYVCELDLVFNFHKVYLILDEFILAGELQETSKKAIIERMGELEKLE

SEQ ID NO: 7670 - protein, 142 aa, Tropaeolum majus
MIRFILLQNRQGKTRLAKYYVPLEDSEKHKVEYEVHRLVVNRDPKFTNFVEFRTHKVIYRRYAGLFFSLCVDITDNELAYLECIHLFVEILDHFFSNVCELDLVFNFHKVYLILDEFILAGELQETSKKAIIERMGELDKLD

SEQ ID NO: 7671 - protein, 142 aa, Avena sativa
MIRFILLQNRQGKTRLAKYYVPLEDSEKHKVEYEVHRLVVNRDPKFTNFVEFRTHKVIYRRYAGLFFAICVDITDNELAYLESIHLFVEILDHFFSNVCELDLVFNFHKVYLILDEFILAGELQETSKKAIIERMGELEKLD

SEQ ID NO: 7672 - protein, 142 aa, Elaeis guineensis
MIRFILLQNRQGKTRLAKYYVPLEDSEKHKVEYEVHRLVVNRDPKFTNFVEFRTHKIIYRRYAGLFFSMCVDITDNELAYLECIHLFVEILDHFFSNVCELDLVFNFHKVYLILDEFILAGELQETSKKAIIERMGELEKQE

SEQ ID NO: 7673 - protein, 142 aa, Populus trichocarpa
MIRFILLQNRQGKTRLAKYYVPLEDSEKHKVEYEVHRLVVNRDPKFTNFVEFRTHKVIYRRYAGLFFALCVDITDNELAYLECIHLFVEILDHFFSNVCELDLVFNFHKVYLILDEFILAGELQETSKRAIIERMGELEKLE

SEQ ID NO: 7674 - protein, 142 aa, Populus trichocarpa
MIRFILLQNRQGKTRLAKYYVPLEDSEKHKVEYEVHRLVVNRDAKFTNFVEFRTHKVIYRRYAGLFFSLCVDITDNELAYLECIHLFVEILDHFFSNVCELDLVFNFHKVYLILDEFILAGELQETSKRAIIERMGELEKLE

SEQ ID NO: 7675 - protein, 142 aa, Papaver somniferum
MIRFILLQNRQGKTRLAKYYVPLEESEKHKVEYEVHRLVVNRDPKFTNFVEFRTHKVIYRRYAGLFFSTCVDITDNELAYLECIHLFVEILDHFFSNVCELDLVFNFHKVYLILDEFILAGELQETSKKAIIERMGELEKQE

SEQ ID NO: 7676 - protein, 142 aa, Rhizophora mangle
MIRFIVLQNRQGKTRLAKYYVPLEDSEKHKVEYEVHRLVVNRDPKFTNFVEFRTHKIIYRRYAGLFFSLCVDITDNELAYLECIHLFVEILDHFFSNVCELDLVFNFHKVYLILDEFILAGELQETSKKAIIERMGELEKLE

SEQ ID NO: 7677 - protein, 142 aa, Saccharum officinarum
MIRFILLQNRQGKTRLAKYYVPLEDSEKHKVEYEVHRLVVNRDPKFTNFVEFRTHKVIYRRYAGLFFSMCVDITDNELAYLECIHLFVEILDHFFSNVCELDLVFNFHKVFLILDEFILAGELQETSKRAIIERMGELEKLE

SEQ ID NO: 7678 - protein, 142 aa, Panicum virgatum
  misc_feature (137)..(137): Xaa can be any naturally occurring amino acid
MIRFILLQNRQGKTRLAKYYVPLEDSEKHKVEYEVHRLVVNRDPKFTNFVEFRTHKVIYRRYAGLFFSICMDITDNELAYLECIHLFVEILDHFFSNVCELDLVFNFHKVYLILDEFILAGELQETSKRAIIERMGXLEKLE

SEQ ID NO: 7679 - protein, 142 aa, Tripterygium wilfordii
MIRFILLQNRQGKTRLAKYYVPLEDSEKHKVEYEVHRLVVNRDSKFTNFVEFRTHKVIYRRYAGLFFSLCVDITDNELAYLESIHLFVEILDHFFSNVCELDLVFNFHKVYLILDEFILAGELQETSKKAIIERMGELEKLE

SEQ ID NO: 7680 - protein, 142 aa, Allium cepa
MIRFILLQNRQGKTRLAKYYVPLEESEKHKVEYEVHRLVVNRDPKFTNFVEFRTHKVIYRRYAGLFFSTCVDITDNELAYLECIHLFVEILDHFFSNVCELDLVFNFHKVYLILDEFILAGELQETSKRAIIERMGELEKQE

SEQ ID NO: 7681 - protein, 142 aa, Unknown
  Sequence found in Organisms: Aristolochia fimbriata, Zostera marina
MIRFILLQNRQGKTRLAKYYVPFEESEKHKVEYEVHRLVVNRDPKFTNFVEFRTHKVIYRRYAGLFFSMCVDITDNELAYLECIHLFVEILDHFFSNVCELDLVFNFHKVYLILDEFILAGELQETSKKAIIERMGELEKQE

SEQ ID NO: 7682 - protein, 142 aa, Acacia harpophylla
MIRFILLQNRQGKTRLTKYYVPLEESEKHKVEYEVHRLVVNRDPKFTNFVEFRTHKVIYRRYAGLFFSLCVDITDNELAYLECIHLFVEILDHFFSNVCELDLVFNFHKVYLILDEFILAGELQETSKRAIIERMGELEKLE

SEQ ID NO: 7683 - protein, 142 aa, Unknown
  Sequence found in Organisms: Coffea canephora, Panax ginseng, Plantago ovata, Tabernaemontana elegans
MIRFILLQNRQGKTRLAKYYIPLEESEKHKVEYEVHRLVVNRDPKFTNFVEFRTHKVIYRRYAGLFFSLCVDITDNELAYLECIHLFVEILDHFFSNVCELDLVFNFHKVYLILDEFILAGELQETSKKAIIERMGELEKQE

SEQ ID NO: 7684 - protein, 142 aa, Eschscholzia californica
MIRFILLQNRQGKTRLAKYYVPLEESEKHKVEYEVHRLVVNRDPKFTNFVEFRTNKVIYRRYAGLFFSMCVDITDNELAYLECIHLFVEILDHFFSNVCELDLVFNFHKVYLILDEFILAGELQETSKKAIIERMGELEKQE

SEQ ID NO: 7685 - protein, 142 aa, Eucalyptus grandis
MIRFILLQNRQGKTRLAKYYVPLEDSEKHKVEYEVHRLVVNRDPKFTNFVEFRTHKVIYRRYAGLFFSLCVDITDNELAYLECIHLFVEILDHFFSNVCELDLVFNFHKVYLILDEFILAGEIQETSKRAIIERLGELEKLE

SEQ ID NO: 7686 - protein, 142 aa, Fagopyrum esculentum
MIRFILLQNRQGKTRLAKYYIPLEDSEKHKVEYEIHRLVVNRDPKFTNFVEFRTHKVIYRRYAGLFFSMCVDITDNELAYLECIHLFVEILDHFFSNVCELDLVFNFHKVYLILDEFILAGELQETSKRAIIERMGELEKLE

SEQ ID NO: 7687 - protein, 142 aa, Linum usitatissimum
MIRFILLQNRQGKTRLAKYYVPLEDTEKHRVEYEVHRLVVNRDPKFTNFVEFRTHKVIYRRYAGLFFSLCVDITDNELAYLECIHLFVEILDHFFSNVCELDLVFNFHKVYLILDEFILAGELQETSKRAIIERMGELEKLE

SEQ ID NO: 7688 - protein, 142 aa, Zingiber officinale
MIRFILLQNRQGKTRLAKYYVPLEDSEKHKVEYEVHRLVVNRDPKFTNFVEFRTHKVIYRRYAGLFFSLCVDITDNELAYLECIHLFVEILDHFFSNVCELDLVFNFHKVYLILDEFILAGEIQETSKRAIIERMGELEKQE

SEQ ID NO: 7689 - protein, 142 aa, Mimulus guttatus
MIRFILLQNRQGKTRLAKYYVPLEESEKHKVEYEVHRLVVNRDPKFTNFVEFRTHKVIYRRYAGLFFSLCVDITDNELVYLECIHLFVEILDHFFSNVCELDLVFNFHKVYLILDEFILAGELQETSKKAIIERMGELEKQE

SEQ ID NO: 7690 - protein, 142 aa, Phalaenopsis aphrodite
MIRFILLQNRQGKTRLAKYYVPLEESEKHKVEYEVHRLVVNRDPKFTNFVEFRTHKVIYRRYAGLFFSMCVDITDNELAYLECIHLFVEILDHFFSNVCELDLVFNFNKVYLILDEFILAGELQETSKKAIIERMGELEKQE

SEQ ID NO: 7691 - protein, 142 aa, Valeriana officinalis
MIRFILLQNRQGKTRLAKYYVPLEESEKHKVEYEVHRLVVNRDPKFTNFVEFRTHKVIYRRYAGLFFSLCVDITDNELAYLESIHLFVEILDHFFSNVCELDLVFNFHKVYLILDEFILAGELQETSKKAIIERMGELEKQE

SEQ ID NO: 7692 - protein, 142 aa, Unknown
  Sequence found in Organisms: Brassica napus, Brassica juncea, Brassica oleracea, Brassica rapa
MIRFILLQNRQGKTRLAKYYVPLEESEKHKVEYEVHRLVVNRDSKFTNFVEFRTHKVIYRRYAGLFFSLCVDITDNELAYLECIHLFVEILDHFFSNVCELDLVFNFHKVYLILDEFILAGELQETSKRAIIERMSELEKLE

SEQ ID NO: 7693 - protein, 142 aa, Unknown
  Sequence found in Organisms: Olea europaea, Lippia dulcis, Utricularia gibba
MIRFILLQNRQGKTRLAKYYIPLEESEKHKVEYEVHRLVVNRDPKFTNFVEFRTHKVIYRRYAGLFFSLCVDITDNELAYLESIHLFVEILDHFFSNVCELDLVFNFHKVYLILDEFILAGELQETSKKAIIERMGELEKQE

SEQ ID NO: 7694 - protein, 142 aa, Unknown
  Sequence found in Organisms: Ambrosia trifida, Flaveria ramosissima, Guizotia abyssinica, Helianthus annuus
MIRFILLQNRQGKTRLAKYYIPLEESEKHKVEYEVHRLVVNRDPKFTNFVEFRTHKVIYRRYAGLFFSLCVDITDNELAYLECIHLFVEILDHFFSNVCELDLVFNFHKVYLILDEFILAGELQETSKRAIIERMGELEKQE

SEQ ID NO: 7695 - protein, 142 aa, Amorphophallus konjac
MIRFILLQNRQGKTRLAKYYVALEDSEKHRVEYEVHRLVVNRDPKFTNFVEFRTHKIIYRRYAGLFFSMCVDITDNELAYLECIHLFVEILDHFFSNVCELDLVFNFHKVYLILDEFILAGELQETSKKAIIDRMGELEKLE

SEQ ID NO: 7696 - protein, 142 aa, Amsonia hubrichtii
MIRFILLQNRQGKTRLAKYYIPLEESEKHKVEYEVHRLVVNRDPKFTNFVEFRNHKVIYRRYAGLFFSLCVDITDNELAYLECIHLFVEILDHFFSNVCELDLVFNFHKVYLILDEFILAGELQETSKKAIIERMGELEKQE

SEQ ID NO: 7697 - protein, 142 aa, Unknown
  Sequence found in Organisms: Brassica napus, Brassica juncea, Brassica rapa, Raphanus sativus
MIRFILLQNRQGKTRLAKYYVPLEESEKHKVEYEVHRLVVNRDAKFTNFVEFRTHKVIYRRYAGLFFSVCVDITDNELAYLECIHLFVEILDHFFSNVCELDLVFNFHKVYLILDEFILAGELQETSKRAIIERMSELEKLE

SEQ ID NO: 7698 - protein, 142 aa, Musa acuminata
MIRFILLQNRQGKTRLAKYYVPLEDSEKHKVEYEVHRLVVNRDPKYTNFVEFRTHKVIYRRYAGLFFSMCVDITDNELAYLECIHLFVEILDHFFSNVCELDLVFNFHKVYLILDEFILAGEIQETSKRAIIERMGELEKQE

SEQ ID NO: 7699 - protein, 142 aa, Vitis vinifera
MIRFILLQNRQGKTRLAKYYVPFEESEKHKVEYEVHRLVVNRDPKHTNFVEFRTHKVIYRRYAGLFFSLCVDITDNELAYLECIHLFVEILDHFFSNVCELDLVFNFHKVYLILDEFILAGELQETSKKAIIERMGELEKQE

SEQ ID NO: 7700 - protein, 142 aa, Unknown
  Sequence found in Organisms: Lippia dulcis, Salvia sclarea
MIRFILLQNRQGKTRLAKYYIPLEESEKHKVEYEVHRLVVNRDPKFTNFVEFRTHKVIYRRYAGLFFSLCVDITDNELAYLESIHLFVEILDHFFSNVCELDLVFNFHKVYLILDEFILAGELQETSKKAIIERMGELEKLD

SEQ ID NO: 7701 - protein, 142 aa, Papaver somniferum
MIRFILLQNRQGKTRLAKYYVPLEESEKHKVEYEVHRLVVNRDPKYTNFVEFRTNKVIYRRYAGLFFSMCVDITDNELAYLECIHLFVEILDHFFSNVCELDLVFNFHKVYLILDEFILAGELQETSKKAIIERMGELEKQE

SEQ ID NO: 7702 - protein, 142 aa, Sarracenia psittacina
MIRFILLQNRQGKTRLAEYYIPLEESEKHKVEYEVHRLVVNRDPKFTNFVEFRTHKVIYRRYAGLFFSLCVDITDNELAYLECIHLFVEILDHFFSNVCELDLVFNFHKVYLILDEFILAGELQETSKRAIIERMGELEKLE

SEQ ID NO: 7703 - protein, 142 aa, Vinca minor
MIRFILLQNRQGKTRLAKYYIPLEESEKHKVEYEVHRLIVNRDPKFTNFVEFRTHKVIYRRYAGLFFSLCVDITDNELAYLECIHLFVEILDHFFSNVCELDLVFNFHKVYLILDEFILAGELQETSKKAIIERMGELEKQE

SEQ ID NO: 7704 - protein, 142 aa, Mimulus guttatus
MIRFIILQNRQGKTRLAKYYVPLEESEKHKVEYEVHRLVVNRDPKFTNFVEFRTHKVIYRRYAGLFFSLCVDITDNELAYLESIHLFVEILDHFFSNVCELDLVFNFHKVYLILDEFILAGELQETSKKAIIERMGELEKQE

SEQ ID NO: 7705 - protein, 142 aa, Brassica juncea
MIRFILLQNRQGKTRLAKYYVPLEESEKHKVEYEVHRLVVNRDSKFTNFVEFRTHKVIYRRYAGLFFSLCVDITDNELAYLECIHLFVEILDHFFSNVCELDLVFNFHKVYLILDEFILAGELQETSKRAIIERMSELEKLQ

SEQ ID NO: 7706 - protein, 142 aa, Unknown
  Sequence found in Organisms: Artemisia annua, Centaurea maculosa, Cichorium intybus, Cirsium arvense, Cynara scolymus, Lactuca sativa, Carthamus tinctorius, Tragopogon dubius
MIRFILLQNRQGKTRLAKYYIPLEESEKHKVEYEVHRLVVNRDPKFTNFVEFRTHKVIYRRYAGLFFSLCVDITDNELAYLEGIHLFVEILDHFFSNVCELDLVFNFHKVYLILDEFILAGEFQETSKKAIIERMGELEKQE

SEQ ID NO: 7707 - protein, 142 aa, Unknown
  Sequence found in Organisms: Solanum lycopersicum, Solanum melongena, Nicotiana benthamiana, Capsicum annuum, Solanum phureja, Nicotiana tabacum
MIRFILLQNRQGKTRLAKYYIPLEESEKHKVEYEVHRLVVNRDPKFTNFVEFRTHKVIYRRYAGLFFSLCVDITDNELAYLESIHLFVEILDHFFSNVCELDLVFNFHKVYLILDEFILAGELQETSKRAIIERMGELEKQE

SEQ ID NO: 7708 - protein, 142 aa, Olea europaea
MIRFILLQNRQGKTRLAKYYIPLEESEKHKVEYEVHRLVVNRDPKFTNFVEFRTHKVIYRRYAGLFFSLCVDMTDNELAYLESIHLFVEILDHFFSNVCELDLVFNFHKVYLILDEFILAGELQETSKKAIIERMGELEKQE

SEQ ID NO: 7709 - protein, 142 aa, Amborella trichopoda
MIRFILLQNRQGKTRLAKYYIPLEESEKHKVEYEVHRLVVNRDPKFTNFVEFRTHKVIYRRYAGLFFSMCVDITDNELAYLECIHLFVEILDHFFSNVCELDLVFNFHKVYLILDEFILAGELQETSKRAIIERMGELERQE

SEQ ID NO: 7710 - protein, 142 aa, Ceratodon purpureus
MIRFILLQNRQGKTRLAKYYIPLEDSEKHKLEYEVHRLVVNRDPKFTNFVEFRTHKVIYRRYAGLFFSMCVDITDNELAYLESIHLFVEILDHFFSNVCELDLVFNFHKVYLILDEFILAGELQETSKKAIIERMGELEKQD

SEQ ID NO: 7711 - protein, 142 aa, Fraxinus spp
MIRFIILQNRQGKTRLAKYYIPLEESEKHRVEYEVHRLVVNRDPKFTNFVEFRTHKVIYRRYAGLFFSLCVDITDNELAYLESIHLFVEILDHFFSNVCELDLVFNFHKVYLILDEFILAGELQETSKKAIIERMGELEKLE

SEQ ID NO: 7712 - protein, 142 aa, Gerbera hybrid cultivar
MIRFILLQNRQGKTRLAKYYMPLEESEKHKVEYEVHRLVVNRDPKFTNFVEFRTHKVIYRRYAGLFFSLCVDITDNELAYLEGIHLFVEILDHFFSNVCELDLVFNFHKVYLILDEFILAGEFQETSKKAIIERMGELEKQE

SEQ ID NO: 7713 - protein, 142 aa, Unknown
  Sequence found in Organisms: Ipomoea batatas, Ipomoea nil
MIRFILLQNRQGKTRLAKYYIPLEESEKHKVEYEVHRLVVNRDPKFTNFVEFRTYKIIYRRYAGLFFSLCVDITDNELAYLECIHLFVEILDHFFSNVCELDLVFNFHKVYLILDEFILAGELQETSKKAIIERMGELEKQE

SEQ ID NO: 7714 - protein, 142 aa, Actinidia deliciosa
  misc_feature (55)..(55): Xaa can be any naturally occurring amino acid
MIRFILLQNRQGKTRLAKYYIPLEESEKHKVEYEVHRLVVNRDPKFTNFVEFRTXKVIYRRYAGLFFSLCVDITDNELAYLESIHLFVEILDHFFSNVCELDLVFNFHKVYLILDEFILAGELQETSKRAIIERMGELEKLE

SEQ ID NO: 7715 - protein, 142 aa, Marchantia polymorpha
MIRFILLQNRQGKTRLAKYYVPLEDSEKHKLEYEVHRLVVNRDPKFTNFVEFRTHKVIYRRYAGLFFSMCVDITDNELAYLESIHLFVEILDHFFSNVCELDLVFNFHKVYLILDEFILAGELQETSKKAIIERMSELERQE

SEQ ID NO: 7716 - protein, 142 aa, Orobanche aegyptiaca
MIRFMLLQNRQGKTRLAKYYIPLEESEKHKVEYEVHRLVVNRDPKFTNFVEFRTHKVIYRRYAGLFFSFCVDMTDNELAYLECIHLFVEILDHFFSNVCELDLVFNFHKVYLILDEFILAGELQETSKKAIIERMGELEKQE

SEQ ID NO: 7717 - protein, 142 aa, Physcomitrella patens
MIRFILLQNRQGKTRLAKYYIPLEDSEKHKLEYEVHRLVVNRDPKFTNFVEFRTHKVIYRRYAGLFFSLCVDITDNELAYLESIHLFVEILDHFFSNVCELDLVFNFHKVYLILDEFILAGELQETSKKAIIERMGELEKQD

SEQ ID NO: 7718 - protein, 142 aa, Raphanus sativus
MIRFILLQNRQGKTRLAKYYVPLEESEKHKVEYEVHRLVVNRDSKFTNFVEFRTHKVIYRRYAGLFFSLCVDITDNELAYLECIHLFVEILDHFFSNVCELDLVFNFHKVYLILDEFILAGELQETSKRAIIERMSELEKLD

SEQ ID NO: 7719 - protein, 142 aa, Triphysaria pusilla
MIRFMLLQNRQGKTRLAKYYIPLEESEKHKVEFEVHRLVVNRDPKFTNFVEFRTHKVIYRRYAGLFFSFCVDITDNELAYLESIHLFVEILDHFFSNVCELDLVFNFHKVYLILDEFILAGELQETSKKAIIERMGELEKLE

SEQ ID NO: 7720 - protein, 87 aa, Allium cepa
MIRFILLQNRQGKTRLAKYYVPLEESEKHKVEYEVHRLVVNRDPKFTNFVEFRTHKVIYRRYAGPFSPCVLTSLIMSWHIWSASIYL

SEQ ID NO: 7721 - protein, 147 aa, Manihot esculenta
FDFVWQIRFILLQNRQGKTRLAKYYVPLEDSEKHKVEYEVHRLVVNRDPKFTNFVEFRTHKVIYRRYAGLFFSLCVDITDNELAYLECIHLFVEILDHFFSNVCELDLVFNFHKVYLILDEFILAGELQETSKKAIIERMGELEKLE

SEQ ID NO: 7722 - protein, 142 aa, Musa acuminata
MIRFILLQNRQGKTRLAKYYIPLEESEKHKVEYEVHRLVVNRDPKYTNFVEFRTHKVIYRRYAGLFFSMCVDITDNELAYLECIHLFVEILDHFFSNVCELDLVFNFHKVYLILDEFILAGEIQETSKRAIIERMGELEKQE

SEQ ID NO: 7723 - protein, 141 aa, Nicotiana benthamiana
IRFILLQNRQGKTRLAKYYIPLEESEKHKVEYEVHRLVVNRDPKFTNFVEFRTHKVIYRRYAGLFFSLCVDITDNELAYLESIHLFVEILDHFFSNVCELDLVFNFHKVYLILDEFILAGELQETSKRAIIERMGELEKQE

SEQ ID NO: 7724 - protein, 142 aa, Unknown
  Sequence found in Organisms: Arabidopsis thaliana, Arabidopsis lyrata
MIRFILLQNRQGKTRLAKYYVPLEESEKHKVEYEVHRLVVNRDAKFTNFVEFRTHKVIYRRYAGLFFSVCVDITDNELAYLESIHLFVEILDHFFSNVCELDLVFNFHKVYLILDEFILAGELQETSKRAIIERMSELEKLQ

SEQ ID NO: 7725 - protein, 142 aa, Cryptomeria japonica
MIRFILLQNRQGKTRLAKYYIPLEESEKHKLEYEVHRLVVNRDPKFTNFVEFRTHKVIYRRYAGLFFSMCVDITDNELAYLESIHLFVEILDHFFSNVCELDLVFNFHKVYLILDEFILAGELQETSKKAIIERMGELERQE

SEQ ID NO: 7726 - protein, 143 aa, Physcomitrella patens
MIRFILLQNRQGKTRLAKYYIPLEDSEKHKLEYEVVHRLVVNRDPKFTNFVEFRTHKVIYRRYAGLFFSMCVDITDNELAYLESIHLFVEILDHFFSNVCELDLVFNFHKVYLILDEFILAGELQETSKKAIIERMGELEKQD

SEQ ID NO: 7727 - protein, 142 aa, Raphanus sativus
MIRFILLQNRQGKTRLAKYYVPLEESEKHKVEYEVHRLVVNRDSKFTNFVEFRTHKVIYRRYAGLFFSLCFDITDNELAYLECIHLFVEILDHFFSNVCELDLVFNFHKVYLILDEFILAGELQETSKRAIIERMSELEKLD

SEQ ID NO: 7728 - protein, 142 aa, Valeriana officinalis
MIRFLLLQNRQGKTRLAKYYIPLEESEKHKVEYEVHRLVVNRDPKFTNFVEFRTHKVIYRRYAGLFFSLCVDITDNELAYLESIHLFVEILDHFFSNVCELDLVFNFHKVYLILDEFILAGELQETSKKAIIERLGELEKLD

SEQ ID NO: 7729 - protein, 174 aa, Primula obconica
AITAKIGCSLSLSLISFPNSISKSFFLPNCVITIRFILLQNRQGKTRLAKYYIPLEESEKHKVEYEVHRLVVNRDPKFTNFVEFRTHKVIYRRYAGLFFSLCVDITDNELAYLESIHLFVEILDHFFSNVCELDLVFNFHKVYLILDEFILAGELQETSKRAIIERMGELEKLD

SEQ ID NO: 7730 - protein, 72 aa, Sarracenia psittacina
MIRFILLQNRQGKTRLAKYYIPLEESEKHKVEYEVHRLVVNRDPKFTNFVEFRTHKVIYRRYAGIFFHCVSI

SEQ ID NO: 7731 - protein, 142 aa, Gnetum gnemon
MIRFILLQNRQGKTRLAKYYIPLEDSEKHKLEYEVHRLVVNRDPKFTNFVEFRTHKVIYRRYAGLFFSMCVDITDNELAYLESIHLFVEILDHFFSNVCELDLVFNFQKVYLILDEFILAGELQETSKKAIIERMTELERQE

SEQ ID NO: 7732 - protein, 142 aa, Unknown
  Sequence found in Organisms: Pinus pinaster, Pinus taeda, Pseudotsuga menziesii, Picea glauca
MIRFILLQNRQGKTRLAKYYIPLEESEKHKLEYEVHRLVVNRDPKFTNFVEFRTHKVIYRRYAGLFFSMCVDITDNELAYLESIHLFVEILDHFFSNVCELDLVFNFHKVYLILDEFILAGELQETSKKAIIERMTELERQE

SEQ ID NO: 7733 - protein, 142 aa, Petunia hybrida
MIRFIVLQNRQGKTRLAKYYIPLEESEKHKVEFEVHRLVVNRDPKFTNFVEFRTHKIIYRRYAGLFFSLCVDITDNELAYLESIHLFVEILDHFFSNVCELDLVFNFHKVYLILDEFILAGELQETSKKAIIERMGELEKQE

SEQ ID NO: 7734 - protein, 142 aa, Selaginella moellendorffii
MIRFILLQNRQGKTRLAKYYVPLEDSEKQKLQYEVHRLVVNRDPKFTNFVEFRTHKVIYRRYAGLFFSMCVDITDNELAYLESIHLFVEILDHFFSNVCELDLVFNFHKVYLILDEFILAGELQETSKKAIIERMAELERQE

SEQ ID NO: 7735 - protein, 143 aa, Triticum aestivum
MIRFILLQNRQGKTRLAKYYVPLEDSEKHKVEYEVHRLVVNRDPKFTNFVEFRTHKVIYRRYAGLFFSICVDITDNDLVYLECIHLFVEILDHFFSNVCELDLVFNFHKVYLILDEFILAGELQETSKKAIIERMGVPACMGR

SEQ ID NO: 7736 - protein, 142 aa, Abies balsamea
MIRFILLQNRQGKTRLAKYYIPLEESEKHKLEYEVHRLVVNRDPKFTNFVEFRTHKVIYRRYAGTFFSMCVDITDNELAYLESIHLFVEILDHFFSNVCELDLVFNFHKVYLILDEFILAGELQETSKKAIIERMTELERQE

SEQ ID NO: 7737 - protein, 142 aa, Podocarpus macrophillus
MIRFILLQNRQGKTRLAKYYIPLEESEKHKLEYEVHRLVVNRDPKFTNFVEFRTHKVIYRRYAGLFFSMCVDITDNELAYLESIHLFVEILDHFFSNVCELDLVFNFHKVYLILDEFILAGELQETSKKAIIERMAELERQD

SEQ ID NO: 7738 - protein, 142 aa, Pteridium aquilinum
MIRFILLQNRQGKTRLAKYYIPLEDSEKHKLEYEVHRLVVNRDPKFTNFVEFRTNKVIYRRYAGLFFSMCVDITDNELVYLESIHLFVEILDHFFSNVCELDLVFNFHKVYLILDEFILAGELQETSKKAIIERMAELERQE

SEQ ID NO: 7739 - protein, 142 aa, Sarracenia psittacina
MIRFILLQNRQGKTRLAKYYIPLEESEKHKVEYEVHRLIVNRDPKFTNFVEFRMHKIIYRRYAGLFFSICVDITDNELAYLECIHLFVEILDHFFSNVCELDLVFNFHKVYLILDEFILAGELQETSKRVVIERMGELEKQE

SEQ ID NO: 7740 - protein, 142 aa, Selaginella moellendorffii
MIRFILLQNRQGKTRLAKYYVPLEDSEKQKLQYEVHRLVVNRDPKFTNFVEFRTHKVIYRRYAGLFFSMCVDITDNELAYLESIYLFVEILDHFFSNVCELDLVFNFHKVYLILDEFILAGELQETSKKAIIERMAELERQE

SEQ ID NO: 7741 - protein, 105 aa, Platanus occidentalis
MIRFILLQNRQGKTRLAKYYVPLEESEKHKVEYEVHRLVVNRDPKFTNFVEFRTHKIIYRRYAGLFFSMCVDITDNELAYLECIHLLWRYWIISSVMCASWIWCI

SEQ ID NO: 7742 - protein, 142 aa, Nicotiana benthamiana
MIRSIVLQNRQGKTRLAKYYIPLEESEKHKVEHEVHRLVVNRDPKFTNFVEFRTHKIIYRRYAGLFFSLCVDITDNELAYLESIHLFVEILDHFFSNICELDLVSNFHKVYLILDEFILAGELQETSKKAIIERIGELEKQE

SEQ ID NO: 7743 - protein, 136 aa, Arnica chamissonis
LQNRQGKTRLAKYYIPLEESEKHKVEYEVHRLVVNRDPKFTNFVEFRTHKVIYRRYAGLFFSLCVDMTDNELAYLECIHLFVEILDHFFSNVCELDLVFNFHKVYLILDEFILAGELQETSKRAIIERMGELEKQE

SEQ ID NO: 7744 - protein, 147 aa, Momordica charantia
MIRFILLQNRQGKTRLAKYYVPLEESEKHKVEYEVHRLVVNRDPKFTNFVEFRTHKVIYRRYAGLFFSLCVDITDNELAYLECIHLFVEILDHFFSNVCELDLVFNFHKVYLILDEFILAGELQETSKKAIIERMGSWKSWSEDSAC

SEQ ID NO: 7745 - protein, 147 aa, Eutrema halophilum
PLLCFQIRFILLQNRQGKTRLAKYYVPLEESEKHKVEYEVHRLVVNRDSKFTNFVEFRTHKVIYRRYAGLFFSVCVDITDNELAYLESIHLFVEILDHFFSNVCELDLVFNFHKVYLILDEFILAGELQETSKRAIIERMSELEKLD

SEQ ID NO: 7746 - protein, 149 aa, Eutrema halophilum
SISYPLFQIRFILLQNRQGKTRLAKYYVPLEESEKHKVEYEVHRLVVNRDSKFTNFVEFRTHKVIYRRYAGLFFSLCVDITDNELAYLECIHLFVEILDHFFSNVCELDLVFNFHKVYLILDEFILAGELQETSKRAIIERMSELEKLD

SEQ ID NO: 7747 - protein, 134 aa, Persea americana
MIRFILLQNRQGKTRLAKYYVALEESEKHKVEYEVHRLVVNRDPKFTNFVEFRTHKIIYRRYAGLFFSMCVDITDNELAYLECIHLFVEILDHFFSNVCELDLVFNFQKVYLILDEFILAGELQETSKKAIIDR

SEQ ID NO: 7748 - protein, 130 aa, Arachis hypogaea
MIRFILLQNRQGKTRLAKYYVPLEDSEKHKVEYEVHRLVVNRDPKYTNFVEFRTHKVIYRRYAGLFFSLCVDITDNELAYLECIHLFVEILDHFFSNVYLILDEFILAGELQETSKKAIIERMGELEKLE

SEQ ID NO: 7749 - protein, 102 aa, Triticum aestivum
MIRFILLQNRQGKTRLAKYYVPLEDSEKHKVEYEVHRLVVNRDPKFTNFVEFRTHKVIYRRYAGLFFSICVDITDNELAYLECIHLFVEILAISLAMFVSSI

SEQ ID NO: 7750 - protein, 135 aa, Sequoia sempervirens
SKQTRKDPSGQVLYSTGRIRKHKLEYEVHRLVVNGDPKFTNFVEFRTHKVIYRRYAGLFFSMCVDITDNELAYLESIHLFVEILDHFFSNVCELDLVFNFHKVYLILDEFILAGELQETSKKAIIERMGELERQE

SEQ ID NO: 7751 - protein, 131 aa, Vitis vinifera
MIRFIILQNRQGKTRLAKYYVPLEESEKHKVEYEVHRLVVNRDPKFTNFVEFRTHKVIYRRYAGLFFSLCVDMTDNELAYLECIHLFVEILDHFFSNVCELDLVFNFHKVYLILDEFILAGELQETSKKEK

SEQ ID NO: 7752 - protein, 130 aa, Curcuma longa
MIRFILLQNRQGKTRLAKYYVPLEDSEKHKVEYEVHRLVVNRDPKFTNFVEFRTHKVIYRRYAGLFFSLCVDITDNELAYLECIHLFVEILDHFFSNVCELDLVFNFHKVYLILDEFILAGEIQETARGR

SEQ ID NO: 7753 - protein, 134 aa, Adiantum capillus-veneris
MIRFILLQNRQGKTRLAKYYIPLEDSEKHKLEYEVHRLVVNRDPKFTNFVEFRTHKVIYRRYAGLFFSMCVDITDNELVYLESIHLFVEILDHFFSNVCELDLVFNFHKVYLILDEFILAGELQETSKKLYYSF

SEQ ID NO: 7754 - protein, 126 aa, Festuca arundinacea
ARGYVPLEDSEKHKVEYEVHRLVVNRDPKFTNFVEFRTHKVIYRRYAGLFFAICVDITDNELAYLECIHLFVEILDHFFSNVCELDLVFNFHKVYLILDEFILAGELQETSKKAIIERMGELEKLD

SEQ ID NO: 7755 - protein, 149 aa, Cephalotaxus harringtonia
VYRLLWHHDPVHITQNRQGKTRLAKYYIPLEESEKHKLEYEVHRLVVNRDPKFTNFVEFRTHKVIYRRYAGLFFSMCVDITDNELAYLESIHLFVEILDHFFSNVCELDLVFNFHKVYLILDEFILAGELQETSKKAIIERMGELERQE

SEQ ID NO: 7756 - protein, 140 aa, Brassica napus
MILFILLQNRQGKTRLANYYVPLEESEKHKVEYEVHRLVVNRDSKFTNFVEFRTHKVIYRRYAGLFFSLCVDITDNELAYLECIYLFVEILDNFFSNVCELNLVFNFHKVYLILDEFILAGELQETSKRRSLRGCQNWRS

SEQ ID NO: 7757 - protein, 149 aa, Catharanthus roseus
MIRFILLQNRQGKTRLAKYYIPLEESEKHKVEYEVHRLVVNRDPKFTNFVEFRTHKVIYRRYAGLFFSLCVDITDNELAYLECIHLFVEILDHFFSNVCELDLVFNFHKVYLILDEFILAGELQETKQEGYYRKDGRIGKAGVEIKFGS

SEQ ID NO: 7758 - protein, 123 aa, Lippia dulcis
MIRFILLQNRQGKTRLAKYYIPLEESELHKVEYEVHRLVVNRDPKFTNFVEFRTHKVIYRRYAGLFFSLCVDITDNELAYLESIHLFVEILDHFFTNVCELDLVFNFHKVYLILDEFILAGEL

SEQ ID NO: 7759 - protein, 285 aa, Sorghum bicolor
MGRKGRKARVSRDADADGSEDERAAAAAPAATAGKSLYEILGVEKTASQQEIKKAYHKLALRLHPDKNPGDEEANEKFQQLQKVISILGDAEKRALYDETGITDDDALVGAAADNLQEYFRTMYKKVTEADIEEFEAKYRGSDSEKKDLKELYTKYKGNMNRLFCSMICSEPKLDSHRFKDIIDEAIAEGELKSTKAYEKWAKKISEMEPPTNPLERRVKKKKNSENDLILAISQRRAERKNQFNSILSNIMSKCDSKASSSEPTEEEFERARQRLESKRAKRRK

SEQ ID NO: 7760 - protein, 281 aa, Saccharum officinarum
MGRKARVSRDADADADGSEDERAAPAATVGKSLYEILGVEKTASQQEIKKAYHKLALRLHPDKNPGDEEAKEKFQQLQKVISILGDAEKRALYDETGITDDDALVGAAADNLQEYFRTMYKKVTEADIEEFEAKYRGSDSEKKDLKELYTKYKGNMNRLFCSMICSEPKLDSHRFKDIIDEAIAEGELKSTKAYEKWAKKISEMEPPTNPLERRVKKKNSEENDLILAISQRRAERKNQFNSILSNIMSKCDSKASSSEPTEEEFEQARQRLESKMAKRRK

SEQ ID NO: 7761 - protein, 284 aa, Panicum virgatum
MGRKGRKARVSRDADADGSEEEGAAAPAATGSRSLYEILGVEKTASQQEIKKAYYKLALRLHPDKNPGDEEAKEKFQQLQKVISILGDAEKRVLYDETGIADDDALVGEAADNLQEYFRTMYKKVTEADIEEFEAKYRGSDSEKKDLKDLYTKYKGNMNRLFCSMICSEPKLDSHRFKDIIDEAIAEGELKSTKAYEKWAKKISEMEPPTNPLERRVKKKRKTEENDLVLAISQRRMERKNQFNSILSSIMSKCDPKASSSEPTEEEFEQARQRLESKRAKKRK

SEQ ID NO: 7762 - protein, 286 aa, Zea mays
MGRNRKGRKARVSHDADADADADGSEDERATTAGRSLYEILGVEKTASQQEIKKAYHKLALRLHPDKNPGDEEAKEKFQQLQKVISILGDVEKRALYDETGITDDDALVGEAANNLQEYFRTMYKKVTEADIEEFEAKYRGSDSEKTDLKELYTKYKGNMNRLFCAMICSEPKLDSHRFKDIIDEAIGEGELKSTKVYEKWAKKISGMEPPTNPLERRVKKRKNSEENDLILAISQRRAERKKQFNSILSNIMSKCDSKASSSEPTEEEFEQAQQRLESRRAKRRK

SEQ ID NO: 7763 - protein, 286 aa, Panicum virgatum
MGCKGRKARVSRDADADADGSEEEGAAAPAATGSKSLYEILGVEKTASQQEIKKAYYKLALRLHPDKNPGDEEAKEKFQQLQKVISILGDAEKRALYDETGIADDDALVGEAADNLQEYFRTMYKKVTEADIEEFEAKYRGSDSEKKDLKDLYTKYKGNMNRLFCSMICSEPKLDSHRFKDIIDEAIAEGELKSTKAYEKWAKKISEMEPPTNPLERRVKKKRKTEENNLVLAISQRRMERKNQFNSILSSIMSKCDPKASSSEPTEEEFEQARQRLESKRAKKRK

SEQ ID NO: 7764 - protein, 289 aa, Setaria italica
MGRKGRRARVSRDADADADGSDEERGAAAAAPAATGSKTLYEILGVEKTASQQEIKKAYYKLALRLHPDKNPGDEEAKEKFQQLQKVISILGDAEKRALYDETGIADDDALVGAAADNLQEYFRTMYKKVTEADIEEFEAKYRGSDSEKKDLKDLYTKYKGNMNRLFCSMICSEPKLDSHRFKDIVDEAIAEGELKSTKAYEKWAKKISEMEPPTNPLERRVKKKRKSEENDLILAISQRRAERKNQFDSILSSIMSKCDPNASSSEPTEEEFEQARQRLEGKRAKKRK

SEQ ID NO: 7765 - protein, 274 aa, Panicum virgatum
SRDADADGSEEEWAAAPAATGSKSLYEILGVEKTASQQEIKKAYYKLALRLHPDKNPGDEEAKEKFQQLQKVISILGDAEKRALYDETGIADDDELVGEAADNLQEYFRTMYKKVTEADIEEFEAKYRGSDSEKKDLKELYTKYKGNMNRLFCSMICSEPKLDSHRFKDIIDEAIAEGELKLTKAYEKWAKKISEMEPPTNPLERRIKKKKKTEENDLILAISQRRVERKNQFNSNISSIMSKCDPKASSSEPTEEEFEQARQRLESKRAKKRK

SEQ ID NO: 7766 - protein, 282 aa, Oryza sativa
MGRKRRARVSRDGDGEEEEEPAPVAAESKSLYEILGVERTASQQEIKKAYHKLALRLHPDKNPGDEEAKEKFQQLQKVISILGDEEKRALYDETGIADDDALVGEAADNLQEYFRAVYKKVTEADIEEFEAKYRGSDSEKKDLKDLYTKFKGNMNRLFCSMICSDPKLDSHRFKDIIDEAIAEGELKSTKAYDKWAKKISEIEPPTNPLERRVKKNKKKSEENDLILAISQRRAQRKDRFDSVLSSIMSKCDPKGSSSSEPTEEEFEQARQRLEKKRSKNRK

SEQ ID NO: 7767 - protein, 284 aa, Brachypodium distachyon
MGRKRKARVSDDCDGADMNGEEAAAGPADAQSKSLYEILGVERTASQQEIKKAYHKLALRLHPDKNPGDEEANEKFQQLQKVISILGDEEKRALYDETGITDDDALVGEAADNLQEFFRTLYKKFTEADIEDFEAKYRGSDSEKKDLKDLYTKFKGKMNRLFCSMICSDAKLDSHRFKDIIDQAIAGGELKSTKSYEKWAKKISEIEPPTNPLKRRVKKKKSEESDLILAISQRRAERKDRFDSVLSSIMSKCDSKASSSSEPTEEEFERARQRLEKKRAKGRK

SEQ ID NO: 7768 - protein, 261 aa, Pennisetum glaucum
STAPAATGSKSLYEILGVEKTASQQDIKKAYYKLALRLHPDKNPGDEEAKEKFQQLQKVISILGDAEKRALYDETGIADDDALVGASADNLQEYFRTMYKKVTEADIEEFEAKYRGSDSEKKDLKDLYTKYKGNMNRLFCSMICSEPKLDSHRFKDIIDEAIAEGELKSTKAYEKWAKKISEMEPPTNPLERRVKKKKNSEENDLILAISQRRAERKTQFNSILSSIMSKCDPKASSSEPTEEEFEQARQRLESRRAKKRK

SEQ ID NO: 7769 - protein, 282 aa, Secale cereale
MGRKRRARVSSDSDGDDGEMNGQEPADAQSKSLYEILGVESTASQQEIKKAYHKLALRLHPDKNPGDEEANEKFQQLQKVISILGDQEKRALYDETGITDDDALVGEAADNLQAYFRTVYRKVTEADIEEFEAKYRGSESEKKDLKELYTKFKGNMNRLFCSMICSDAKLDSHRFKDIIDQAIAEGELKSTKVYAKWAKKISEIEPPTNPLERRVKKKKSQESDLILAISQRREQRKERFDSVLSSIMSKCDDSKASSSEPTEEEFERARQRLEKKRTKGRK

SEQ ID NO: 7770 - protein, 285 aa, Triticum aestivum
MGRKRRARVSSDSDGDDVEMNGQEPAAAADAQSKSLYEILGVESTASQQEIKKAYHKLALRLHPDKNPGDEEANEKFQQLQKVISILGDQEKRALYDETGITDDDALVGEAADNLQAYFRTVYRKVTEADIEEFEAKYRGSDSEKKDLKELYTKFKGNMNRLFCSMICSDAKLDSHRFKDIIDQAIAEGELKSTKVYAKWAKKISEIEPPTNPLERRVKKKKSQESDLILAISQRREQRKERFDSVLSSIMSKCDDNKAGSSEPTEEEFERARQRLEKKRAKGRK

SEQ ID NO: 7771 - protein, 285 aa, Triticum aestivum
MGRKRRARVSSDSDGDDVEMNGQEPAAAADAQSKSLYEILGVESTASQQEIKKAYHKLALRLHPDKNPGDEEANEKFQQLQKVISILGDQEKRALYDETGITDDDALVGEAADNLQAYFRTVYRKVTEADIEEFEAKYRGSDSEKKDLKELYTKFKGNMNRLFCSMICSDAKLDSHRFKDIIDQAIAEGELKSTKVYAKWAKKISEIEPPTNPLERRVKKKKSQESDLILAISQRREQRKERFDSVLSSIMSKCDDNKAGSSEPTEEEFERARQRLEKKRTKGRK

SEQ ID NO: 7772 - protein, 342 aa, Sorghum bicolor
MSSQGGFGTGSPKSFRYPRGGGDFDLESGSPRKGRKPKNPHLETSIVMRIRYFYEAHPVAVALLLLSFGLSVLILLSVYETRFRTMRSGGAWSSDGGEYPFPKLRNLVMVAGHSIYTSSRCGETESENSWFLEPYQKHPGQAATFLAHIKEGVGIVARDEGALLLFSGGETRRDAGPRSEAQSYWAIAESKGWFGNDESVRSRALTEEHARDSFENLLFSVCRFRELTGRYPQNITVVSYDFKEERFAQLHRTALGFPEGRFFFTGTPATPSAREAALKGEAAVRSQFLEDPYGCLGSLHVKRLKRDPFHRTIPYPDGCPELKGLFSYCGPVPYSGHLPWTE

SEQ ID NO: 7773 - protein, 341 aa, Setaria italica
MSSSQGFGPGSPKSFRYPRGVDFDLESGVSRKGRKPKNPHLEASIVMRIRYFYEAHPVAVALILLSFGLSVLILLSVYETRFRTMRSGGAWSSEVGEYPFPNLRNLVMVAGHSIYTSASCGKTDREDSWFLEPYQKHPGQAATFLAHIKEGVDIAARDEGALLLFSGGETRKDAGPRSEAQSYWAIAESKGWFGNDESVRSRALTEEHARDSFENLLFSVCRFRELTGRYPQNITVVSYDFKEERFAQLHRTALGFPEGRFFFTGTPATPAAREAALKGEAAVRAQFLEDPYGCLGSLHVKRLKRDPFHRTIPYPDGCPELKGLFSYCGPVPFSGHLPWTE

SEQ ID NO: 7774 - protein, 341 aa, Pennisetum glaucum
MSSSQGFGPGSPKSFRYPRGVDLDLESGVPRKGRKLKNPHLEASIVMRIRYFYEAHPVAVALILLSFGLSVLILLSVYETRFRTMRSGAAWSSEVGEYPFPNLRNLVMVAGHSIYTSSSCGKTDREDSWFLEPYQKHPGQAATFLAHIKEGVDIASRDEGALLLFSGGETRKDAGPRSEAQSYWAIAESKGWFGSDETVRSRALTEEHARDSFENLLFSVCRFKELTGRYPQNITVVSYDFKEERFAQLHRTALGFPEGRFFFSGTPATPAARDAALKGEAAVRAQFLEDPYGCLGSLHVKRLKRDPFHRTIPYPDGCPELKSLFSYCGPVPFSGHLPWTE

SEQ ID NO: 7775 - protein, 341 aa, Leymus cinereus x Leymus triticoides
MSSQGFGPGSPKSFRYPRADYDLESGIPRKGRKPKTSHLDAPAPLSSALMKIRYFYEAHPVAVALILLSFGLSVLILLSVYETRFRTMRSGSNEVGAYPFPDLRNLVMVAGHSIYTSASCGKIDREDSWFLEPYQKHPGQAATFLAHIKEGVEIAARDQGALLLFSGGETRKDAGPRSEAQSYWAIAESKGWFGNDDSVRSRALTEEHARDSFENLLFSVCRFRELTGTYPQNITVVSYDFKEERFAQLHRSALGFPEERFFFSGTPATATAKEAALKGEASVRSQFQEDPYGCVGSLRVKRLKRDPFHRTIPYPNGCPELKGLFSYCGMVPYSGNLPWTQ

SEQ ID NO: 7776 - protein, 341 aa, Brachypodium distachyon
MSSQGFGPGSPKSFRYPRADYDLESGIARKGRKPKNQHLDSPGALSSVLMKIRIFYEAHPVAVALILLSFGLSVLILLSVYETRFRAMRSGINEVGSYPFPDLRNLVMVAGHSIYTSASCGKLDREDSWFLEPYQKHPGQAATFLAHIKEGVDIAARDQGALLLFSGGETRKDAGPRSEAQSYWAIAESKGWFGNDESVRSRALTEEHARDSFENLLFSICRFRELTGTYPQNITVVSYDFKEERFAQLHRSALGFPEGRFFFTGTPATPTAREAAVKGEASVRSQFQEDPYGCLGSLHVKRLKRDPFHRTIPYPDGCPELKSLFSYCGPVPYSGNLPWDQ

SEQ ID NO: 7777 - protein, 341 aa, Oryza sativa
MNSQGFGPGGSPKSFRYPRADFDLESGIARKGLRKPKNHDAPGLLTSTLMKIRYFYEAHPVAVAFILLSFGLSVLILLSVYETRFRMMRGSSGEVGEYPLPELRNLVMVAGHSIYTSESCGKIDREDSWFLEPYQKHPGQAATFLAHIKEGVGIAARDEKALLLFSGGETRKDAGPRSEAQSYWTIADSKGWFGNDESVRRRALTEEHARDSFENLLFSVCRFRELTGSYPQNITVVSYDFKEERFAQLHRSALGFPEGRFFFLGTPATLTARESAVKGEAAVRSQFQEDPYGCLGSLHMKRLKRDPFHRAIPYPNGCPELKGLFSYCGLVPYPGQLPWTQ

SEQ ID NO: 7778 - protein, 341 aa, Hordeum vulgare
MSSQGFGPGSPKSFRYPRADYDLESGIPRKGRKPKASHLDAPAPLSSALMKIRFFYEAHPVAVALILLSFGLSVLILLSVYETRFRTMRSGGDGVGAHPLPGLRNLVMVAGHSIYTSASCGKIDREDSWFLEPYQKHPGQASTFLAHIKEGVEIAARDQGALLLFSGGETRKDAGPRSEAQSYWAIAESEGWFGNDDSVRSRALTEEHARDSFENLLFSVCRFRELTGTYPQNITVVSYDFKEERFAQLHRSALGFPEERFFFSGTPATATAKEAALKGEASVRSQFQEDPYGCVGSLRVKRLKRDPFHRTIPYPNGCPELKGLFSYCGMVPYSGNLPWTQ

SEQ ID NO: 7779 - protein, 341 aa, Triticum aestivum
MSSQGFGPGSPKSFRYPRADYDLESGIPRKGRKPKASHLDAPAPLSSALMRIRFFYEAHPVAVALILLSFGLSVLILLSVYETRFRTMRSGGNEVGAHPLPGLRNLVMVAGHSIYTSASCGKTDREDSWFLEPYQKHPGQAATFLAHIKEGVEIAGRDQGALLLFSGGETRKDAGPRSEAQSYWAIAESEGWFGNDDSVRNRALTEEHARDSFENLLFSVCRFRELTGTYPQNITVVSYDFKEERFAQLHRSALGFPEERFFFSGTPATATAKEAALKGEASVRSQFQEDPYGCVGSLRVKRLKRDPFHRTIPYPNGCPELKGLFSYCGMVPYSGNLPWTQ

SEQ ID NO: 7780 - protein, 293 aa, Panicum virgatum
MRLRHFYEAHPVAVAASLLAAGLAALVLLSVHEARSRAARPGGAWAGEEYPLPSLRNLVMVAGHSVYTSATCGGTDREESWFLEPYQRHPGQAATFVAHIKEGVDIAARDDGALLLFSGGETRKDAGPRSEAQSYWAIAESKGWFGNDESVRSRALTEEHARDSFENLLFSVCRFRELTGRYPQNITVVSYDFKEERFAQLHRTALGFPEGRFFFSGTPATPAAREAALKGEAAVRAQFLEDPYGCLGSLHVKRLKRDPFHRTIPYPEGCPELKSLFSYCGAVPFPGLLPWAE

SEQ ID NO: 7781 - protein, 341 aa, Triticum aestivum
MSSQGFGPGSPKSFRYPRADYDLESGIPRKGRKPKASHLDAPAPLSSALMRIRFFYEAHPVAVALILLSFGLSVLILLSVYETRFRTMRSGGNEVGAHPLPGLRNLVMVAGHSIYTSASCGKTDREDSWFLEPYQKHPGQAATFLAHIKEGVEIAGRDQGALLLFSGGETRKDAGPRSEAQSYWAIAESEGWFGNDDSVRNRALTEEHARDSFENLLFSVCRFRELTGTYPQNITVVSYDFKEERFAQLHRSALGFPEERFFFSGTPATATAKEAALKGEASVRSQFQEDPYGCVGPLRVKRLKRDPFHRTIPYPNGCPELKGLFSYCGMVPYSGNLPWTQ

SEQ ID NO: 7782 - protein, 341 aa, Secale cereale
MSSQGFGPGSPKSFRYPRADYDLESGIPRKGRKPKASHLDAPAPLSSALMKIRFFYEAHPVAVALILLSFGLSVLILLSVYETRFRTMRSGDLEVGAHPLPGLRNLVMVAGHSIYTSASCGKTDREDSWFLEPYQKHPGQAATFLAHIKEGVEVAARDQDALLLFSGGETRKDAGPRSEAQSYWAIAESEGWFGNDDSVRNRALTEEHARDSFENLLFSVCRFRELTGTYPQNITVVSYDFKEERFAQLHRSALGFPEERFFFSGTPATATAKEAALKGEASVRSQFQEDPYGCAGSLRVKRLKRDPFHRTIPYPNGCPELKGLFSYCGMVPYSGNLPWTQ

SEQ ID NO: 7783 - protein, 346 aa, Triticum aestivum
MSSQGFGPGSPKSFRYPRADYDLESGIPRKGRKPKASHLDAPAPLGSALMKIRFFYEAHPVAVALILLSFGLSVLILLSVYETRFRTMRSGGNEVGAHPLPGLRNLVMVAGHSIYTSASCGKIDREDSWFLEPYQKHPGQAATFLAHIKEGVEIAARDEGALLLFSGGETRKDAGPRSEAQSYWAIAESEGWFGNDDSVRNRALTEEHARDSFENLLFSICRFRELTGTYPQNITVVSYDFKEERFAQLHRSALGFPEERFFFSGTPATATAKEAALKGEASVRSQFQEDPYGCVGSLRVKRLKRDPFHRTIPYPNGCPELKGLFSYCGMVPYSGNLPWTQYRKKA

SEQ ID NO: 7784 - protein, 83 aa, Triticum aestivum
SSEQRETSSPPSHPAAAVSTVANKPPHPGMEMKKIACAVLVAASATVALAAEAPAPSPTSGSSAVAPAIVGAAVASFFAYYIH

SEQ ID NO: 7785 - protein, 54 aa, Eragrostis curvula
MEMKKIACAVLVAASATVALAAEAPAPAPTSGSSAVAPAVLGAAVASFFAYYLQ

SEQ ID NO: 7786 - protein, 54 aa, Eragrostis curvula
MEMKKIACAVLIAASATVALAAEGPAPAPTSGSSAVAPALLGAAVASFFAYYLQ

SEQ ID NO: 7787 - protein, 57 aa, Pennisetum glaucum
MEMKKIACAVLVAASATVALAADAPAPAPTSGSSAVAPALGAALGAAVASFFAYYIQ

SEQ ID NO: 7788 - protein, 57 aa, Sorghum bicolor
MEMKKIACAVLFAASATVALAAEAPAPAPTSGSSAVAPAVGAALGAAVASFFAYYIQ

SEQ ID NO: 7789 - protein, 57 aa, Saccharum officinarum
MEMKKIACAVLVAASATVALAAEAPAPAPTSGSYAVAPAVGAALGAAVASFFAYYIQ

SEQ ID NO: 7790 - protein, 57 aa, Panicum virgatum
MEMKKIACAVLVAASATVALAADAPAPAPTSGSSAVAPAVGAALGAAVASFFAYYIQ

SEQ ID NO: 7791 - protein, 96 aa, Setaria italica
PGKQAISKAQRQAKKSSSSQARRSSSCRSPPFRRFAEEGMEMKKIACAVLVAASATVALAADAPAPAPTSGSSAVAPALGAALGAAVASFFAYYIQ

SEQ ID NO: 7792 - protein, 342 aa, Zea mays
MATTAFAAARFFPAHLDSSPRIAPHRVGPTANLSFSPLSANSSSLRRLHSPCPSGPGGRLPPPPRSYGGAGGSGDAANSGGGEGRRGGILGLLLAGWAARVAADPQFPFKVLMEELVGVTACVLGDMASRPNFGLNELDFVFSTLVVGSILNFVLMYLLAPTAGVAAAASSAASALPSHMFEPGAYSLGSRVATIMSKGATFAVVGFAAGLTGTAISNGLIAMRKRMDPAFETPNKPPPTLLNAATWALHMGVSSNLRYQTLNGIEYLLGKVAPAPVFKVSVVALRCMNNVLGGMSFVLLARLTGAQKSDKPATVAEEKERLIAVGNAAADAINEARHGEGK

SEQ ID NO: 7793 - protein, 344 aa, Panicum virgatum
MASTAFAAAKFLPAHLDSSPRIAPHRAGPTANLSFAPLSSSPSSAASLLRLRSPSPSGPGGRLPPPPRSYGGGGSGDAADSGGGDGRRGGILGVFLAGWAARVAADPQFPFKVLMEELVGVTACVLGDMASRPNFGLNELDFVFSTLVVGSILNFVLMYLLAPTAGVAAAASSAASALPSHMFEPGAYSLGSRVATLVSKGATFAMVGFAAGLAGTALSNGLIAMRKRMDPEFETPNKPPPTLLNAATWAIHMGVSSNLRYQTLNGVEYLLGKVAPAPVFKVSVVALRCVNNVLGGMSFVLLARLTGSQRSDKPATAAEEKERLIAVGNAAADAISEAKDAEGK

SEQ ID NO: 7794 - protein, 340 aa, Setaria italica
MASTAFAAAKFLPAHLDSSPRIAPYRAVPTANLSFTPLSSSASLLRLRSPSPSGPGGRLPPPPPPRSYGGGGSGDAADSGGGDGDGRRGGILGVFLAGWAARVAADPQFPFKLLMEELVGVTACVLGDMASRPNFGLNELDFVFSTLVVGSILNFVLMYLLAPTAAASSAASALPSHMFEAGAYTLGSRVATLMSKGATFAMVGFAAGLAGTAISNGLIAMRKRMDPAFETPNKAPPTLLNAATWALHMGVSSNLRYQTLNGIEYLLGKVAPVPVFKVSVLALRCMNNVLGGMSFVLLARLTGAQRSDKPATVAEEKETLIAVSNAAADAISEAKEGEGK

SEQ ID NO: 7795 - protein, 344 aa, Panicum virgatum
MASTAFAATKFLPAHLDSSPRIAPHRAGPTANLSFAPLSPSSSSAASLLRLRSPSPSGPGGRLPPPPRSYGGGGSGDAADSGGGNGRRGGILGVFLAGWAARVAADPQFPFKVLMEEIVGVTACVLGDMASRPNFGLNELDFVFSTLVVGSILNFVLMYLLAPTAGVAAAASSAAAALPSHMFEPGAYSLGSRVATLVSKGATFAMVGFAAGLAGTALSNGLIAMRKRMDPEFETPNKPPPTLLNAATWAIHMGVSSNLRYQTLNGVEYLLGKVAPAPVFKVSIVALRCINNVLGGMSFVLLARLTGSQRSDKPATAAEEKERLIAVGNAAADAISEAKDAEGK

SEQ ID NO: 7796 - protein, 344 aa, Panicum virgatum
MASTAFAATKFLPAHLDSSPRIAPHRAGPTANLSFAPLSPSSSSAASLLRLRSPSPSGPGGRLPPPPRSYGGGGSGDAADSGGGDGRRGGILGVFLAGWAARVAADPQFPFKVLMEEIVGVTACVLGDMASRPNFGLNELDFVFSTLVVGSILNFVLMYLLAPTAGVAAAASSAAAALPSHMFEPGAYSLGSRVATLVSKGATFAMVGFAAGLAGTALSNGLIAMRKRMDPEFETPNKPPPTLLNAATWAIHMGVSSNLRYQTLNGVEYLLGKVAPAPVFKVSIVALRCINNVLGGMSFVLLARLTGSQRSDKPATAAEEKERLIAVGNAAADAISEAKDAEGK

SEQ ID NO: 7797 - protein, 344 aa, Setaria italica
MASTALGAAKFLHLDSSPRIAPQRAIPTANLSFSPLSASSSSSSSPSLLRLRSPSPSGPGGRLPPPPPPRSYGGGGSGDAADSGAGDGDGSRGGILGVFLAGWAARVAADPQFPFKVLMEEVVGVTACVLGDMASRPNFGLNELDLVFSTIVVGSIVNFVIMYLLAPTAAASSVASALPNYMFEPGAYTLGSRVATLLSKGATFTMVGFAAGLAGTALSNGLIAMRKRMDPSFETPNKAPPTLLNAATWGLHMGGSSNLRYQTLNGIEYVLGKVAPAPVFKASVVALRCINNVLGGMSFVLLARLTGAQKSDKPATVAEEKETLIAVGNAAADAISEAKEGEGK

SEQ ID NO: 7798 - protein, 341 aa, Brachypodium distachyon
MASTAFAAAKFLPSAHLDSSPRLSQLRAAPTANLSFSPLPTSSSSSLLTLRSPCPSGPGGKLPPPPRSYGGGGGSGDAADSGGDGGRGGILGMFLAGWAARVAADPQFPFKVLMEELVGVTACVLGDMSSRPNFGLNELDFVFSTLVVGSILNFVLMYLLAPTAGVSAAVSALPSHMFEAGPYSVGSRVATLVSKGATFAAVGFGAGLLGTAISNGLISLRKRMDPAFETPNKPPPTMLNAATWALHMGISSNLRYQTLNGFEYLLGKAAPAPVFKVSVIALRCMNNVLGGMSFVMLARLTGAQKSDKPATSVSEAKERLIAEGDAIAANVGAEGRDVEGK

SEQ ID NO: 7799 - protein, 692 aa, Saccharum officinarum
MDLDMDDYIDPYEEAEAEAAAAQDDDSDDPDEDDSDAESDYEEKSFGLLKSGKHRVRNPDGTFRCPFCPGKKKQGYKIKDLLQHADGIGVSSKHRRHGRERANHRAFARFVRTDPDFAEDLVGITGIQGAITTTPADKNGSANGDGKAQANGDTAGSSSVAAKVGPPQEVERFAWPWACVLAAGAGFNPEEFADRVAMFSLVEVVPLFVDEMEVTETFAIVRFTNDWSGFNDALTLENHFGVNKLGKKEFETRDSGLGSVVGDGAEGEVKVYGWVARAEDYDATSVVGRFLRKHTVLKTIDEVSKTELEKSGEMVAILASQIEEKNRYLQDLETKKNATELSISRLEEDNRKLHEAYNEEMRNLHRRARENALRIFQENENLRIDLENKRRELNLRAKELEKMSAENANDRKTLDDEKQKAKYDNSELELASIEQQRADADVLKLLADQEREKEDVLARMLQLEKELHEKQQLELEVERLNGTLQVMKHLEGDDDGGDIHEKMEKLSVRFEREKKRLEDLSGDLVRKERESNDELQEARKELIKGLEEELDGQTAIGIKRMGELNEKPFLNACKRKYGKGEYQIKAAELVTNWQEELKKPSWHPFKMVEVNGENKEILVDDDAKLKHLWIEYGDDVCNAVKTALMEINEYNPSGRYVVPELWNFRKGRKATMKEVLKYLFSQIDTTTKRRRG

SEQ ID NO: 7800 - protein, 693 aa, Sorghum bicolor
MDFDMDDYIDPYEEAEAEAAAGEDDDSDDPDEDDSDAESDYEEKSFGLLKSGKHRVRNPDGTFRCPFCPGKKKQGYKIKDLLQHADGIGVSSKHRRHGRERANHRAFARFVRTDPDFAEDLVGITGIQGAITTTPADKNGGSANGDGKAKANGDTAGSSSVAAKVGPPQEVERFAWPWACVLAAGAGFNPEEFADRVAVFSLVEVVPLFVDEMEVTETFAIVRFTNDWSGFNDALTLENHFGVNKLGKKEFETRDSGLGSVEGDGGKGEVKVYGWVARAEDYDATSVVGRFLRKHTVLKTIDEVSKTELEKSGEMVAILASQIEEKNRYLQDLETKKNATELSISRLEDDNRKLHEAYNEEMRNLHRRARENAMRIFQENENLRIDLENKRRELNLRAKELEKMSAENANDRKTLDDEKQKAKYDNSELELASIEQQRADADVLKLLADQEREKEEVLARMLQLEKELHEKQQLELEVERLNGTLQVMKHLEGDDDGGDIHEKMEKLSVRFEHEKKRLEDLSGDLVRKERESNDELQVARKELIKGLEEELDGQTAIGIKRMGELDEKPFLNACKRKYGKGEYQIKAAELVTNWQEELKKPSWHPFKMVEVNGENKEILVDDDAKLKHLWIEYGDDVCNAVKTALMEINEYNPSGRYVVPELWNFRKGRKATMKEVLKYLFSQMDTTTKRRRG

SEQ ID NO: 7801 - protein, 691 aa, Zea mays
MDLDLDDYVDPYEEAEAEAAAAEDGSDDPDEDDSDAESDYEEESFGLLKSGKHRVRNPDGTFRCPFCPGKKKQGYKIKDLLQHADGIGVSSKHRRHGRERANHRAFARFVRTEPSFAEDLVGITGIQGAIKPTPANRDGSTNGDGKAKANVDTAGSSSVAAKVGLPREVERFSWPWACVLAAGAGFNTEDFAGRVAMFSSVEVVPLFVDEVEVAETFAVVRFTNDWSGFSDALTLENHFSINKLGKKEFEMRDNGIGSVEGDGGEGEVKVYGWVARAEDYDSPSVVGRFLRKHTVLKTIDEVSKTELEKSGEMVAILASKIEEKNRHLQDLETKKNATELSISRLEEDNRKLHEAYNEEMRNLHRRARENALRIFQENENLRIDLESKKRELNLRAKELDKISTENANDRKTLDNEKQKAKYDNSELELASIEQQRADADVLKLLADQEREKEDVLARMLQLEKELHEKQQLELEVERLNGTLQVMKHLEGDDDGGDIHEKMEKLSERFEREKKRLEDLSGDLVRKERESNDELQEARKELIKGLEEELNGRTAIGIKRMGELDEKPFQNACKTKYGKDEYEIKAAELVTSWQDELKKPSWHPFKMVEVNGENKEILDDDDTKLKFLWIEYGDDVCNAVKTALMEINEYNPSGRYVVPELWNFRKGRKATVKEVLKYLFSQMDTTTKRRRG

SEQ ID NO: 7802 - protein, 699 aa, Setaria italica
MDLDMDDYIDPYEEAEAEAAAEAAGLADPKSEDSDDDSEDDSDAESDYEEQSFRLLTSGKHRVRNPDGTFRCPFCPGKKKQGYKIKDLLQHADGIGVSSKHCRHGRERASHRAFARFVRTDPSFAEDLVGITGILGAIKPAPANANGSGSATAEAKANVGPTGSSSAPAENVGPPREVERYAWPWACVLAAGAGFNAEEFAGRVAMFSFVEVVPLFIDEIEGMETFAIVRFTNDWSGFNDALTLENHFSVNKLGKKEFETRNSGLGAAEGEGGEGEVKVYGWVAREGDYNGGTVVGRFLRKRTILKTIDEVSKTELEKSGEMVARLASQIEEKNRYLQDLETKKNATELSISRLEEDNRKLHEAYNEEMRNLHRRARENALRIFQENDNLRQELENKRRELNSRAKQLEKLSAENANDWKTLDDEKQKAKDDNSELELASIEQQRADFDVLKLLDDQKREKEDVFARMLQLEKELHEKQQLELEVARLNGTLQVMKHLEGDDDGDIHEKMEKLSERLEREKKRLEDLSGDLVRKERESNDELQQARKELIMGLEDELNGRAAIGIKRMGELDEKPFQNACRRKFGNDDYQVKAAELITNWQEELKKPSWHPFKVVQVNGEDKEVLDDDDAKLKFLWIEYGDDVCNAVKTALMEINEYNPSGRYVVPELWNFRKGRKATTKEVLKYLFGQMETTTKRRRG

SEQ ID NO: 7803 - protein, 580 aa, Sorghum bicolor
MADEAKAKGNAAFAAGRFEEAVQHFSDAIVLAPDNHVLYSNRSAAYASLGRYAEALGDAERTVALKPDWAKGYSRLGAAHLGLGDAPKAVEAYEKGLALEPSNEALKSGLAQARQAASAPRRPVGSGADAVGKMFQGPELWTKVAADPTTRGYLDQPDFVQMLREVQRNPSSLNSYLSDQRMVQVLTLMLGIKLQNQSNGAPEPAAAQSNPPPPKQQPEAQARELEPEPGPEPEPMEVTEEEKERKERKASAQKEKEAGNAAYKRKDFDTAIQHYTKAMELDDEDISYITNRAAVYLEMGKYDECIKDCDKAVERGRELHADFKMISRALTRKGTALAKLAKSSQDYDAAIETFQKALTEHRNPDTLKKLNDAERAKKELEQQEYYDPRIADEEREKGNEFFKQQKYPEAVKHYTEALRRNPKDPRVYSNRAACYTKLGALPEGLKDAEKCIELDSTFSKGYTRKGAIQFFMKEYDKALETYQAGLKHDPKNQELLDGVRRCVEQINKASRGELSEEELKERQNKAMQDPEIQNILTDPIMRQVLTDLQENPRAAQAHLKNPGVMQKIQKLVSAGIVQMK

SEQ ID NO: 7804 - protein, 578 aa, Setaria italica
MADEAKAKGNAAFSAGRFDEAARHFGDAIALAPDNHVLYSNRSAAYASLGRYSEALADAERTVALRPDWAKGYSRLGAARLGLGDAPGAVEAYEKGLALDPSNEALKSGLAQARQAASAARRPGGSGADALGKVFQGPELWSKIAADPTTRGYLDQPDFVQMLREVQRNPSSLNTYLSDQRMVQVLTLMLNINIQHKSNGASEPASAQSAPQTPKQQPEAKAREPEPEPEPEPMEVTEEEKERKERKAAAQKEKEAGNAAYKKKDFDTAIQHYTKAMELDDEDISYITNRAAVYLEMGKYDECIKDCDKAVERGRELHADFKMISRALTRKGTALAKLAKSSKDYDVAIETFQKALTEHRNPDTLKKLNEAERAKKELEQQEYYDPKIADEEREKGNEFFKQQKYPEAVKHYTEALRRNPKDPRVYSNRAACYTKLGALPEGLKDAEKCIELDPTFSKGYTRKGAIQFFMKEYDKALETYQAGLKHDPKNQELLDGVRRCVEQINKASRGELSEEELKERQNKAMQDPEIQNILTDPIMRQVLTDLQENPRAAQAHLKNPGVMQKIQKLVSAGIVQMK

SEQ ID NO: 7805 - protein, 345 aa, Panicum virgatum
MADEAKAKGNAAFAAGRFEEAARHFGDAIALAPDNHVLYSNRSAAHASLGRYSEALADAERTVALRPDWAKGYSRLGAAHLGLGDAPAAVEAYEKGLALDPSNEALRSGLAQARQAAATRRPGASGGDALGKVFQGPELWTKIAADPTTRAYLDQPDFVQMLREVQRNPGSLNTYLSDPRMVQVLTLMLNIKLQPQSNGASEPAAAPQTPKQQPEAKAREPEPEPEPEPMEVIEEEKERKERKAAAQKEKEAGNAAYKKKDFDNAIQHYTKAMELDDEDISYITNRAAVYLEMGKYDECIKDCDKAVERGRELHADFKMISRALTRKGTALAKTCEDIQRLRCCH

SEQ ID NO: 7806 - protein, 574 aa, Oryza sativa
MADEAKAKGNAAFSAGRFEEAAAHFTDAIALAPDNHVLYSNRSAAYASLHRYPEALADAERTVALRPDWAKGCSRLGAARLGLGDAAGAVAAYEKGLALEPSNGALKDGLAHARQARRPAPASGAGAIGKVFQGPELWSRMAADPTTRPYLDQPDFMRMLRDVQRNPSSLNNYLSDPRMVQVLSLMLNLRLPNNDAPPRPPAQSTPPPPPQQQQHQPETKAREPEPEPEPMEVTEEEKERKERKAAAQEEKEAGNAAYKKDFETAIQHYTKAMELDDEDVSYLTNRAAVYLEMGKYDECINDCDKAVERGRELHADFKIISRALTRKGTALAKIAKCFKDYDVAIETYQKALTEHRNPDTLKKLNDAEIAKKELEQQEYYDPKIADEEREKGNEFFKQQKYPEAVKHYSEALRRNPKDPRVYSNRAACYTKLGAMPEGLKDAEKCIELDPTFSKGYTRKGAIQFFMKEYDKALETYQAGLKHDPNNQELLDGVRRCVQRINKASRGELSQEELQERQNKAMQDPEIQNILKDPIMQQVLTDFQENPKAAQAHLKNPGVMQKIQKLVSAGIVQMK

SEQ ID NO: 7807 - protein, 576 aa, Triticum aestivum
MAADEAKAKGNAAFSAGRFEEAAGHFGDAVALAPDNHVLFSNRSAAYASLHRYKEALADAERTVALRPDWAKGYSRLGAARLGSGDAAGAVEAYEKGLALDPSNAALKDGLAQARSALPRRPASGADAIGKIFQGADLWSKIAADPTTRAYLDQPDFMQMLRDLQRNPGNLNNYLSDPRMMQVLSLMLNIKVQNQNNDASEPAPAPTPAKSSPPPPQKQPETKPREPEPEPVEMTDEEKERKERKAAAQKEKEAGNAAYKKKDFETAIQHYTKAMELDDEDISYLTNRAAVYLEMGQYDDCIKDCDTAVERGRELRADFKMVSRALTRKGTALAKLAKSSKDYDVAIETFQKALTEHRNPDTLKRLNDAERAKKELEQQEYYDPKIADEEREKGNEFFKQQKYPEAVKHYTEALRRNPKDPKVYSNRAACYTKLGAMPEGLKDAEKCIELDPTFSKGYTRKGAIQFFMKEYDKAMETYQEGLKHDPSNQELLDGVKRCIQQINKANRGELTPEELKERQGKAMQDPEIQNILTDPVMRQVLIDFQENPRAAQEHLKNPGVKQKIQKLVSAGIVQMK

SEQ ID NO: 7808 - protein, 588 aa, Brachypodium distachyon
MADEAKAKGNAAFSAGRFEEAAGHFGDAIALAPDNHVLYSNRSAAYASLHRYKEALADAERTVALKPDWAKGYSRLGAAHLGLRDAGKAVEAYEKGLALEPSNTALKDGLAQARLALPRPRPPGFGADTIGKVFQGPDVWSKIAADPTTRAYLEQPDFMQMLRDVQRNPGSLGNYLSDPRMMQVLTLMLNIRPQNENQYNEASEPAASQSASPPPQQQQQHKPETRSREPEPETKSKDPEPEPMEMTEEEKERKERKVAAQKEKEAGNAAYKKKDFETAIEHYTKAMELDDEDISYLTNRAAVYLEMAKYDECIKDCDMAVERGRELRADFKMISRALTRKGTALAKLAKCSKDYNVAIESFQKALTEHRNPDTLKRLNDAERAKKELEQQEYYDPKIADEEREKGNEFFKQQKYPEAVKHYTEALRRNPQDPRVYSNRAACYTKLGAMPEGLKDAEKCIELDPTFSKGYTRKGAIQFFMKEYDKAMETYQVGLKHDPSNQELLDGVKRCIQQINKANRGELTPEELKERQDKAMHDPEIQNILTDPVMRQVLIDFQENPRSAQDHLKNPGVKQKIMKLVSAGIVQMK

SEQ ID NO: 7809 - protein, 576 aa, Secale cereale
MAADEAKAKGNAAFSAGRFEEAAGHFGDAIALAPDNHVLFSNRSAAYASLHRYKEALADAERTVALKPDWAKGYSRLGAARLGSGDAAGAVEAYEKGLALDPSNAALKDGLAQARLALPRRPASGADAIGKIFQGPDLWSKIAADPTTRAYLDQPDFMQMLRDLQRNPGNLNNYLSDPRMMQVLSLMLNVKVQNKNNEASEPAPAPTPAKSSSPPPQKQPETKPREPEPEPVEMTDEEKERKERKAAAQKEKEAGNAAYKKKDFETAIQHYTKAMELDDEDISYLTNRAAVYLEMGQYDDCIKDCDTAVERGRELRADFKMVSRALTRKGTALAKLAKSSKDYDVAIETFQKALTEHRNPDTLKRLNDAERAKKELEQQEYYDPKLADEEREKGNEFFKQQKYPEAVKHYTEALRRNPKDPKVYSNRAACYTKLGAMPEGLKDAEKCIELDPTFSKGYTRKGAIQFFMKEYDKAMETYQEGLKHDPSNQELLDGVKRCIQQINKANRGELTPEELKERQGKAMQDPEIQNILTDPVMRQVLIDFQENPREAQEHLKNPGVKQKILKLVSAGIVQMK

SEQ ID NO: 7810 - protein, 579 aa, Panicum virgatum
MADEAKAKGNAAFSAGRFEEAARHFSDAIALAPGNHVLYSNRSAALASLHRYSDALADAQKTVELKPDWAKGYSRLGAAHLGLGDAASAVAAYEKGLALDPTNEGLKAGLEDARKAAAAPPRRGPSGPDAIGQMFQGPELWSKIAADPTTRAYLDQPDFMQMLREVQRNPSSLNMYLSDPRMMQVLSLMLNIKIQRPEASEPSQSTPPPPPQQQQTTPPETKAREVEPEPEPEPMDLTDEEKERKERKAAAQKEKEAGNAAYKKKDFETAIQHYTKALELDDEDISYLTNRAAVYIEMGKYDECIKDCDQAVERGRELRADFKMISRALTRKGTALVKLAKSSKDFDIAIETFQKALTEHRNPDTLKKLNEAEKAKKELEQQEYYDPKLADEEREKGNEFFKQQKYPEAIKHYTEALRRNPKDPRVYSNRAACYTKLGAMPEGLKDAEKCLELDPTFSKGYTRKGAIQFFMKEYDKAMETYQAGLKHDPNNQELLDGVRRCIEQINKANRGEISQDELQERQNKAMQDPEIQNILTDPIMRQVLIDFQENPRAAQEHLKNPGVLQKIQKLVSAGIVQMR

SEQ ID NO: 7811 - protein, 579 aa, Panicum virgatum
MADEAKAKGNAAFSAGRFEEAARHFSDAIALAPGNHVLYSNRSAALASLHRYSDALADAQKTVELKPDWAKGYSRLGAAHLGLGDAASAVAAYEKGLALDPTNEGLKAGLEDARKAAAAPPRRGPSGPDAIGQMFQGPELWSKIAADPTTRAYLDQPDFMQMLREVQRNPSSLNMYLSDPRMMQVLSLMLNIKIQRPEASEPSQSTPPPPQQQQQTTPPETKAREVEPEPEPEPMDLTDEEKERKERKAAAQKEKEAGNAAYKKKDFETAIQHYTKALELDDEDISYLTNRAAVYIEMGKYDECIKDCDQAVERGRELRADFKMISRALTRKGTALVKLAKSSKDFDIAIETFQKALTEHRNPDTLKKLNEAEKAKKELEQQEYYDPKLADEEREKGNEFFKQQKYPEAIKHYTEALRRNPKDPRVYSNRAACYTKLGAMPEGLKDAEKCLELDPTFSKGYTRKGAIQFFMKEYDKAMETYQAGLKHDPNNQELLDGVRRCIEQINKANRGEISQDELQERQNKAMQDPEIQNILTDPIMRQVLIDFQENPRAAQEHLKNPGVLQKIQKLVSAGIVQMR

SEQ ID NO: 7812 - protein, 580 aa, Hordeum vulgare
MAADEAKARGNAAFSAGRFEEAAGHFGDAIALAPDNHVLFSNRSAAYASLGRYKEALADADRTVALRPDWAKGYSRLGAARLGLGDAAGAVEAYEKGLALEPSNAALKDGLAQARSALPRRPASGADAIGNIFQSPDLWSKIAADPSTRAYLDQPDFMQMLRDLQRNPGNLNNYLSDPRMLQVFSLMLNVKVQNQNNGASEPKSPAPAPFKSSPPPPQQQQKQPEAKPREPEPEPVEMTDEEKERKERKAAAQKEKEAGNAAYKKKDFETAIQHYTKAMELDDEDISYLTNRAAVYLEMGQYDDCIKDCDTAVERGRELRADFKMVSRALTRKGTALAKLAKSSKDYDVAIETFQKALTEHRNPDTLKRLNDAERAKKELEQQEYYDPKLADEEREKGNEFFKQQKYPEAIKHYTEALRRNPKDPKVYSNRAACYTKLGAMPEGLKDAEKCIELDPTFSKGYTRKGAIQFFMKEYDKAMETYQEGLKHDPSNQELLDGVKRCIQQINKANRGELTPEELKERQGKAMQDPEIQNILTDPVMRQVLIDFQENPKAAQEHLKNPGVKQKIQKLVSAGIVQMK

SEQ ID NO: 7813 - protein, 580 aa, Panicum virgatum
MADEAKAKGNAAFSAGRYEEAARHFSDAIALAPGNHVLYSNRSAALASLHRYSDALADAQKTVELKPDWAKGYSRLGAAHLGLGDAASAVAAYEKGLALDPTNEGLKAGLEDAKKAAAAPPRRGPSGPDAIGQMFQGPELWTKIAADPTTRAYLDQPDFMQMLREVQRNPSSLNMYLSDPRMMQVLSLMLNIKIQRPEASEPSQSTPPPPPQQQQQTPPPETKAREVEPEPEPEPMDLTDEEKERKERKAAAQKEKEAGNAAYKKKDFETAIQHYTKALELDDEDISYLTNRAAVYIEMGKYDECIKDCDKAVERGRELRADFKMISRALTRKGTALVKLAKSSKDFDIAIETFQKALTEHRNPDTLKKLNEAEKAKKELEQQEYYDPKLADEEREKGNEFFKQQKYPEAIKHYTEALRRNPKDPRVYSNRAACYTKLGAMPEGLKDAEKCLELDPTFAKGYTRKGAIQFFMKEYDKAMETYQAGLKHDPNNQELLDGVRRCIEQINKANRGEISQDELQERQNKAMQDPEIQNILTDPIMRQVLIDFQENPRAAQEHLKNPGVMQKIQKLISAGIVQMR

SEQ ID NO: 7814 - protein, 578 aa, Oryza sativa
MADEAKAKGNAAFSAGRYEEAARHFTDAIALAPGNHVLYSNRSAALASVHRYSEALADAEKTVELKPDWAKGYSRLGAAHLGLGDAASAVAAYEKGLALDPTNEGLKAGLADAKKAAAAPPRRPPPSGVDGIGQMFQGPELWTKIASDPTTRAYLEQPDFMQMLRDVQRNPSSLNMYLSDPRMMQVLGLMLNIKIQRPEASESSQPSSSPPSQPQEQPEAKAREVEPEPEPEPMEVTDEEKERKERKSSAQKEKEAGNAAYKKKDFETAIQHYTKAMELDDEDISYLTNRAAVYIEMGKYDECIKDCDKAVERGRELRADFKMISRALTRKGTALAKLAKTSKDYDIAIETFQKALTEHRNPDTLKKLNEAERAKKELEQQEYYDPKLADEEREKGNQLFKEQKYPDAVKHYTEAIRRNPKDPKVYSNRAACYTKLGAMPEGLKDAEKCIELDPTFSKGYTRKGAIQFFMKEYDKAMETYQAGLKHDPNNPELLDGVKRCIEQINKANRGDLTQEEIQERQNKAMQDPEIQNILTDPIMRQVLVDLQENPRASQEHLKNPGVMQKIQKLVSAGIVQMR

SEQ ID NO: 7815 - protein, 580 aa, Setaria italica
MADEAKAKGNAAFSAGRFEEAARHFSDAIALAPGNHVLYSNRSAALASLHRYSDALADAQKTVELKPDWAKGYSRLGAAHLGLGDAASAVAAYEKGLALDPSNGGLKAGLEDAKKAAAAPPRRGPSGPDAIGQMFQGPELWSKIAADPTTRAYLEQPDFMQMLREVQRNPSSLNMYLSDPRMMQVLSLMLNIKIQRPEASEPSQSTPPPEQHQQQQAPPPETKAREVEPEPEPEPMDLTDEEKERKERKAAAQKEKEAGNAAYKKKDFETAIQHYTKALELDDEDISYLTNRAAVYIEMGKYDECIKDCDKAVERGRELRADFKMISRALTRKGTALVKLAKSSKDFDVAIETFQKALTEHRNPDTLKKLNEAERAKKELEQQEYYDPKLADEEREKGNEFFKEQKYPEAIKHYTEALRRNPKDPKAYSNRAACYTKLGAMPEGLKDAEKCLELDPTFTKGYTRKGAIQFFMKEYDKAMETYQAGLKLDPNNQELLDGVRRCVEQINKANRGEISQDELQERQNKAMQDPEIQNILTDPIMRQVLIDFQENPRAAQEHLKNPGVMQKIQKLVSAGIVQMR

SEQ ID NO: 7816 - protein, 298 aa, Saccharum officinarum
MAPPRRALLALAALLLLSLSLAAAAFQSDELLLNDDDEFEGVGARPSAPSPPAAPAVSSSRRRSADAPLPGAGESNAVQFTLEHDLGGGKGFVPAGTFSARLKTFAHGTQTLTKLRFTRNDLTEDDKVAFKKLLQEDGFYTIRLPSNVLDTTKKHNVVSSIKARCIPRDSLDEHIVIHMDGVNILAVNYGSVGGCQYPRPMKLPSKWTFSSYTILKTAEQAPRTPSFADQLIEADNGLGEVMKPPEKSFWAKYWMYIIPLGLIVMNAVTAAANIPEEAAGQGQPGAQRAPAAAAGRRR

SEQ ID NO: 7817 - protein, 298 aa, Sorghum bicolor
MAPPCRSLLALAALLLLSLSLAAAAFQSDELLLNDDDEFEGVGARPSVPSPPAAPAISSSRRRSADAPLPGAGESNAVQFTLEHDLGDGKGFVPAGTFSARLKTFAHGTQTLTKLRFTRNDLNEDDKVAFKKLLQEDGFYTIRLPSNVLDTTKKHNVASSIKARCIPRDSLDEHIVIHMDGVNILAVNYGSVGGCQYPRPMKLPSKWTFSSYTILKTAEQAPRTPSFADQLIEADNGLGEVMKPPEKSFWAKYWMYIIPLGLIVMNAVTAAANIPEEAAGQGQPGAQRAPAAAAGRRR

SEQ ID NO: 7818 - protein, 299 aa, Panicum virgatum
MAPPRRALLALAALLLLSLSLTAAAFQSDELLLNDDEEFEGVGARPASPSPSPPAAPAVSSSRRRSADAASAGAGESNAVQFALEHDLGAGKGFVPAGTFSARLKTSAHGTQTLTKLRFTRNELTEDEKDAFKKLLQEDGFYTIRLPSNVLDSTRKNNVVSSIKARCIPRDSLDEHIVIHMDGVNVLAVNYGSVGGCQYPRPMKFPSKWTFSSYTILKTAEQAPRTPSFVDQLLEADNGLGEVIKPPERSFWAKYWMYIIPLGLIVMNAVTAAANIPEEQAAGQGQPGARAPAAAARRR

SEQ ID NO: 7819 - protein, 298 aa, Setaria italica
MAPPRRALLALAALLLFSLYLTAAAFQSDELVLNDDEEFEGVGARPSSPSQPAAPAVPSSRRRSADAASAAVGESNALQFTLEHDLGVGKGFTPAGTFSARLKTSAHGTQTLTKLRFMRNELTEDDKDAFKKLLQEDGFYTIRLPSNVLDPTRKDNVVSSIKARCIPRDSLDEHVVIHMDGVNILAVNYGSVGGCQYPRQMKFPSKWTFSSYTILKTAEQAPRTPSFVDQMLEADNGLGEVMKPPEKSFWAKYWMYIIPLGLIVMNAVTAAANIPEEQAAGQGQPGAQRASAAAARRR

SEQ ID NO: 7820 - protein, 298 aa, Pennisetum glaucum
MAPPRRALLALAALLLFSLYLTSTAFQSDELVLNDDEEFEGVGARPSAPSPPVAPAVSSSRRRSADSASPGAGEPNALQFTLEHNLGGGKGFTPAGIFSARLKTSAHGTQTLTKLRFTRNELTEDDKDAFKKLLQEDGFYTIRLPSNVLDPTRKDNVVSSIKARCIPRDSLDEHIVIHMDGVNILAVNYGSVGGCQYPRPMKFPSKWTFNSYTILKTAEQAPRTPSFVDQLLEADDGLGEVMKPPEKSFWAKYWMYIIPLGLIVINAVTAAANIPEEQAAGQGQPGGQRAPAAAARRR

SEQ ID NO: 7821 - protein, 333 aa, Sorghum bicolor
MITTAHSRQQHHAFEKSPGNNHMKSIDRKLQQAMNQAASKYMQRIYPLGIQRSSSNLTLSSLSLSQNSNDSSISSSNSSWEPKVPLLYGGTFSPWGEVMVSREMRREDDDKVSDHDVEGGEEDFDCSEPGSLHRCSWITKNSDEAYIQFHDECWGVPVYSDNRLFELLSLSGMLIDHNWTEILKRRDMYREAFADFDPSEVARMDEDDVAEISGNRELRLAECRVRCIVENAKCIQKVAREFGSFSGYMWGHVNHRPVVGKYRHHKYIPFRTPKSEAVSKDLVRRGFRLVGPVIVYSFMQAAGMAIDHLVDCFRFHDCVRLAERSWGITNVAA

SEQ ID NO: 7822 - protein, 331 aa, Panicum virgatum
MLTTAHSRQHHHAFEKSPSSHMKNLDRKLQQAMSNATSKYMQRIYPLGIQRSSSNLTLSSLSLSQNSNDSSLSSSNSSWEPKVPLLYGGTFSPWGDVLVSLEMRREEDDKASDHDVEGGEDFDCSEPGSLHRCSWITKNSDEAYVQFHDECWGVPVYSDNRLFELLSLSGMLIDHNWTEILKRRDMYREVFADFDPSTVAKMDEDAVAEISGNKELRLAESRVRCIVENAKCIQKVAKEFGSFSGYMWGHVNHRPVVGKYRHHKYIPFRTPKSEAVSKDLVRRGFRLVGPVIVYSFMQAAGMAIDHLVDCFRFPECVRLAERSWGITNIAA

SEQ ID NO: 7823 - protein, 331 aa, Panicum virgatum
MLTTAHSRQHHHAFEKSPSSHMKNLDRKLQQAMSNATSKYMQRIYPLGIQRSSSNLTLSSLSLSQNSNDSSLSSSNSSWEPKVPLLYGGTFSPWGDVLVSLEMRREEDDKASDHDVEGGEDFDCSEPGSLHRCSWITKNSDEAYVQFHDECWGVPVYSDNRLFELLSLSGMLIDYNWTEILKRRDMYREVFADFDPSTVAKMDEDAVAEISGNKELKLAESRVRCIVENAKCIQKVAKEFGSFSGYMWGHVNHRPVVGKYRHHKYIPFRTPKSEAVSKDLVRRGFRLVGPVIVYSFMQAAGMAIDHLVDCFRFPECVRLAERSWGITNIAA

SEQ ID NO: 7824 - protein, 332 aa, Panicum virgatum
MLTTAHSRQHHHAFEKSPSSHVKNLDRKLQQAMNNATSKYMQRIYPLGIQRSSSNLTLSSLSLSQNSNDSSLSSSNSSWEPKVPLLYGGTFSPWGDVLVSLEMRREDDDKASDHDVEGGEEDFDCSEPGSLHRCSWITKNSDEAYVQFHDECWGVPVYSDNRLFELLSLSGMLIDHNWTEILKRRDMYREVFADFDPSTVAKMDEDAIAEISGNKELKLAEARVRCIVENAKCIQKVAKEFGSFSGYMWGHVNHRPVVGKYRHHKYIPFRTPKSEAVSKDLVRRGFRLVGPVIVYSFMQAAGMAIDHLVDCFRFPECVRLAERSWGITNIAA

SEQ ID NO: 7825 - protein, 332 aa, Panicum virgatum
MLTTAHSRQHHHAFEKSPSSHVKNLDRKLQQAMNNATSKYMQRIYPLGIQRSSSNLTLSSLSLSQNSNDSSLSSSNSSWEPKVPLLYGGTFSPWGDVLVSLEMRREDDDKASDHDVEGGEDDFDCSEPGSLHRCSWITKNSDEAYVQFHDECWGVPVYSDNRLFELLSLSGMLIDHNWTEILKRRDMYREVFADFDPSTVAKMDEDAIAEISGNKELKLAEARVRCIVENAKCIQKVAKEFGSFSGYMWGHVNHRPVVGKYRHHKYIPFRTPKSEAVSKDLVRRGFRLVGPVIVYSFMQAAGMAIDHLVDCFRFPECVRLAERSWGITNIAA

SEQ ID NO: 7826 - protein, 331 aa, Pennisetum glaucum
MLTTAHSRQHHAFERSPSSHTKNLDRKLQQAMNNAASKYMQRIYPLGIQRSSSNLTLSSLSLSQNSNDSSLSSSNSSWEPKVPLLYGGTFSPWGEVMVSLEMRREDDDKASDHDVEGGEEDFDCSEPGSMHRCSWITKNSDEAYVQFHDESWGVPVYSDDRLFELLSLSGMLIDHNWTEILKRRDMYREVFADFDPSTVAKMDEDAIAEISGNKELKLAECRVRCVVENAKCIQKVAKEFGSFSGYMWGHVNHRPVVGKYRHHKYIPFRTPKSEAVSKDLVRRGFRLVGPVIVYSFMQAAGMAIDHLVDCFRFPECVRLAERSWGITNVAA

SEQ ID NO: 7827 - protein, 330 aa, Eragrostis curvula
MLTTAHSRQHHAFEKSPSHMKNLDRKLQEAMSHAAGSKYMQRIYPLGIQRSSSNLTLSSLSLSQNSNDSSLSSSNSSWEPKVPLLYGGTFSPWGDVLVSLERRREDDKVSDHDVEGGEEEFDCSEPGSLHRCSWITKNSDEAYVEFHDECWGVPVYNDNRLFELLALSGMLIDHNWTEILKRREMYRKVFADFDPSVVAKMDENDIVEISGDKELKLAECRVRCIVENAKCIQKVAKEFGSFSGYMWGHVNHRPVVGKYKHHKYIPFRTPKSEAVSKDLVRRGFRLVGPVIVYSFMQAAGMVIDHLVDCFRFPECVHLAERSWGITNVAA

SEQ ID NO: 7828 - protein, 339 aa, Oryza sativa
MLTTSSHSRHHHAFERSPNHSMMKNIADRNKHDLLQSAMNHAASKYMQRIYPLGIQRSSSNLTLSSLSLSQNSNDSSLSSSNSSWEPKVPLLYGGTFSPWGDVLVSLERRREEDDDKVSDHDVEGGEEDFDCSEPGSLHRCSWITKNSDEAYVQFHDECWGVPVYNDNRLFELLALSGMLIDHNWTEILKRRDMYREAFADFDPSTVAKMDENDVAEISGNKELKLAECRVRCIIENAKCIQKVAKEFGSFSGYIWGHVNHRPTVGRYKHHKYIPFRTPKSEAVSKDLVRRGFRLVGPVIVYSFMQASGIVIDHLVDCFRFPECLHLADRSWGITNVAA

SEQ ID NO: 7829 - protein, 606 aa, Sorghum bicolor
MAKLGCFPALLPGKRKKTRKIADANKASGNECPKVKPVEFTDATLGIGGCVESVALVPRDVKVVPVEDRNKEAHQLVSVKGSDLSGFDFHFHEANKSNLRSDSDVALDTAVEGAVADPSSPKLKRSCSNIETKRPGSRAAPEMPARSRSYGDLGNLITGLAMETTATPHSAPDPEASPASVKTSRTADRVMLKKRSSSQVLPSRSRKLWWRLFLWSHRNLHKPRSPRTAHQAACSPGRHGGYTSDTFEEGPAADRKDKKVMVDDSPPPSVPNQWVAFCAENSIHDRISAWVSSIESEPPFHIAEEDDNYDGEDDEEHGGECASERPRHLELGEPSSGKGGHGKSKRSAAADEVVQANTIVQSLNAFSSVAHISGMGLKVMPMIAPFSTLRAVNLSSNFIVHISPGSLPKGLHSLDLSRNKIANVEGLRELTKLRVLNLSYNRISRIGHGLSNCTAIRELYLAGNKISDVEGLHRLLKLAVLDLSFNKITTAKALGQLVANYHSLLALNLVGNPVQANVGDDALRRAVTGLLPSLAYLNKQPVKPQRSAREVATDSIARAALGGSCSRSSRKKTSRRLTQSPRSSSLTRGRGGGGASPTPRNPSRRR

SEQ ID NO: 7830 - protein, 58 aa, Sorghum bicolor
MDKANKLSAGAGEKTAKNRSHGSTALFVAVDYAFLLAFAGFLAYLVGSRILPSAAGSA

SEQ ID NO: 7831 - protein, 58 aa, Zea mays
MDKDNRLRARAGEKASKSRSHGSTALFVAVDYAFLLAFAGFLAYLVGSRILPSAVSFV

SEQ ID NO: 7832 - protein, 90 aa, Cynodon dactylon
PGVTVGPDPNHAADASPISSVPLRRSGGGEREMDAAKKLSARAGEKVTKNRSHGSTALFVAVDYAFLLGFAGFLAYLVSSRILPSVATAV

SEQ ID NO: 7833 - protein, 101 aa, Sorghum bicolor
MAAASFPPASSSGGWDFTCNLEVDYGSEENASIVYKTLAVDKELQPDKVKREMTLSGSKLAVHFAAVEARFLRASFSAFVDLMGLVTKLVEEYGVAMEEHS

SEQ ID NO: 7834 - protein, 101 aa, Panicum virgatum
MAAASVPPASSSGGWDFTCNFEVDYESEEHASIVYKTLAVDKELQPDKVKREMTLSGSKLAVHFAAVEARFLRSSFSAFVDLMGLVTKLVEEYGVAKEGHS

SEQ ID NO: 7835 - protein, 101 aa, Setaria italica
MAAASFPPASSSGGWDFTCNFEVDYGSEEQASIIYKTLAVDKELQPDKVKREMTLSGSKLAVHFAAVEARFLRASFSAFVDLMGLVTKLVEEYGVAKEGHS

SEQ ID NO: 7836 - protein, 407 aa, Panicum virgatum
MAAQALPFLRWSRSAASLRARSSTTAAPHRLFSTLRRPAACCEAGSKVMLKGMDYSELENWVQAQGFRPGQSMMLWKCLYGNNVWAHCHDELAGLNKDFRKMITEHADLKALTVKDILTASDGTRKILFSLEDGPVIETVIIPCARGRTTVCVSSQVGCAMNCQFCFTGRMGLRKHLSTAEIVEQAVFARRLFSDEFGAITNVVFMGMGEPFHNIDNVIKASAIMVDDQGLHFSPRKVTVSTSGLVPQLKRFLRESNCSLAVSLNATTDEVRNWIMPINRKYNLNMLLGTLREELCLRKNYRVLFEYVMLSGVNDSMDDAKRLIELVQGIPCKINLISFNPHSGSQFKPTPDEKIIEFRNVLIQGGLIVFVRLSRGDDQMAACGQLGEPGDYQLPLLRVPEKFQVAL

SEQ ID NO: 7837 - protein, 407 aa, Brachypodium distachyon
MAAPPLGPLLRWGASSLRVHSASPPTRRLFSALRRPSAVVRCEPGSRVMLKGMDYPELEKWVQSQGFRPGQAMMLWKCLYGNNVWAHCHDELAGLNKDLRKMICELADLKALTVKDIITASDGTRKILFSLENASVIETVVIPNARGRTTVCVSSQVGCAMNCQFCFTGRMGLRKHLSTAEIVEQAVFARKLFSDEFGSITNVVFMGMGEPLHNVDNVIKASAIMVDEQGLQFSPRKVTVSTSGLVPQIKRFLHESKCDLAVSLNATTDEVRNWIMPINRKYNLNLLLGTLREELRLRRKSIVLFEYVMLAEVNDSMDDAKRLTELVHGISCKINLISFNPHSGSQFKPTPDEKIIEFRNILIQSGLTVMVRLSRGDDQMAACGQLGEPGDYQLPLLRVPDKFQVAL

SEQ ID NO: 7838 - protein, 413 aa, Secale cereale
QNHTKPTIPMAALPLLRWGASSLHAHSSPPPPRRLFSALRRPPAAARYEPGSRVMLKGMDYPELEKWVQSQGFRPGQAMMLWKCLYGNNVWAHCHDELAGLNKDLRKMISDHADLKALTVKDIITASDGTRKILFSLEDASVIETVVIPSARGRTTVCVSSQVGCAMNCQFCFTGRMGLRKHLSTAEIVEQAVFARKLFSDEFGSVTNVVFMGMGEPLHNVDNVIKASSIMVDEQGLQFSPRKVTVSTSGLVPEIKRFLSESNCDLAVSLNATTDEVRNWIMPINRKYNLSTLLGTLREELRLRPKSIVLFEYVMLAGVNDSVDDAKRLTELVRGIPCKINLISFNPHSGSQFKPTPDEKIIEFRNTLIQSGLTVMVRLSRGDDQMAACGQLGEPGDYQLPLLRVPEKFQAAL

SEQ ID NO: 7839 - protein, 402 aa, Triticum aestivum
ALPLLRWGASSLHAHFSPTPPRRLFSALRQPPAAGRYEPGSRVMLKGMDYPELEKWVQSQGFRPGQAMMLWKCLYGNNVWAHCHDELAGLNKDLRKMISDHADLKALTVKDIITASDGTRKILFSLEDASVIETVVIPSARGRTTVCVSSQVGCAMNCQFCFTGRMGLRKHLSTAEIVEQAVFARKLFSDEFGSITNVVFMGMGEPLHNVDNVIKASSIMVDEQGLQFSPRKVTVSTSGLVPEIKRFLNESNCDLAVSLNATTDEVRNWIMPINRRYNLSTLLGTLREELRLRPKSIVLFEYVMLAGVNDSTDDAKRLMELVHGIPCKINLISFNPHSGSQFKPTPDESIIEFRNMLIQSGLTVMVRLSRGDDQMAACGQLGAPGDYQLPLLRVPEKFQVAL

SEQ ID NO: 7840 - protein, 117 aa, Panicum virgatum
  misc_feature (8)..(8): Xaa can be any naturally occurring amino acid
  misc_feature (29)..(29): Xaa can be any naturally occurring amino acid
SQTRQPKXPMAAQALPFLRWSRSAASLRXRSSTTAAPHRLFSTLRRPAACCEAGSKVMLKGMDYSELENWVQAQGFRPGQSMMLWKCLYGNNVWAHCHDELADMCHLMYCQMLTEWM

SEQ ID NO: 7841 - protein, 530 aa, Sorghum bicolor
MGIQVAAVVTPPPCSSPSSSPSSTSPASPSSSAIATSPRHAVLGVRLARSQSSLAGCNAGLIGRRRGGQHAIRRALSASIDSVGSDGGDDEEFLRRIQELAAGQHPGGAGGWPASVERSASSVGLPLSLRMLKRRKQQQQQLEQGRWDERLIDCAGESARAAVGRAFSSMVLIIRELQSFTLQMRESLLYEDLQGVLARVHAEMHASFVWLFQHIFAGTPALMVSLMLLLANFTVYSMGDSVAAAATFRPPSSVVEMVDTTQQPEQSHSHSQQQRFDTPALKTFSTGRTASVGGNGDGGGKVRPVAGATGDGQSDESSYRQSGAVVPQDVSQSQATPLGAGAGSGSEASVSESDSMAVEEAAQQQTVQDELVIWKRISDEATRMQASVRAEELMDPEILEQLVAPVEAPKPDVAYSSEHVATAQRYEQAVSEEPNSSLLLANFAQFLYQVQGDLDRAEHFFKRAVRAEPADAEALGRYAAFLWQARNDLAAAEETYQEAIAADPGNAHHAAAYAHFLWNTGGEDTCYPLD

SEQ ID NO: 7842 - protein, 516 aa, Zea mays
MGIQVAAVVTPPPCSSPSSSPASPSSSAIATSPRHAVLGARLARSQSSLACWNAGLGRRRGGQHAIRRALSASIDSVGSGGGEDEEFLRRIQELAAGQHPGAGGCGWPASVERSASSVGLPLSLRMLKRRKQQQQLEQGRWNERLIDCAGESARAAVGRAFSSMVLIIRELQSFTLQMREAVVYEDLQGVLARVHAEMHASFVWLFQHIFSGTPALMVSLMLLLANFTVYSMGDSVAAAASLVPPPQAAVEMVDIQQQPEQQQSHSQQRFDTPALKTFSTGRTASVGGNGDGGGKVRPVAGATGDGQSDESSHRQNGAVVLPQDVSQSQATPLASVSDSMAVEDAQAQQTVHDDELAIWKRISDEAARMQASVRAEELMDPETLEQLVAPVEAPKPDTVHYSPEHVATAQRYEQALSEEPNSSLLLANFAQFLYQVQGDLDRAEHFFKRAVRAEPADAEALGRYAAFLWQARDDLAAAEETYQEAIAADPGNAHHAAAYAHFLWNTGGEDTCYPLD

SEQ ID NO: 7843 - protein, 514 aa, Setaria italica
MGIQVAAVVTPPPCSSSPSSSSPASPSSSAITTSLRHAAPGVRLARSQSSLAGWSAGLAPRRAGQHAIRRTLSASIDSVGSDGGDDEEFLRRIQELAAGQHPGAGGCGWPASVERSASSVGLPLSLRMLKRRKQQQQQLEQGRRDERLVDRAGESARAAVGRAFASMVLIIRELQSFTLQMREALFYEDLQGVLARVHAEMHASFVWLFQHIFSGTPALMVSLMLLLANFTVYSMGDSVATAATIPPPQAAVAAVEMVDTQQPEQSHSSQQRFDPAALKTFSIGRTASVGGNGDGGGKVRPVAGSTGDGQSDESSYRQSGTVLPQDASQQATPLGAGSEASVSDSMAVEDVQDELVIWKRISDEATRMQASARAEELMDPEILEQLVAPVEAPKLDVEYSAEHAATAQRYEQAVSEEPSNSLLLANFAQFLYQVQGDHDRAEHFFKRAVRAEPADAEAMGRYAAFLWQARNDLAAAEETYQEAIAADPGNAHHAAAYAHFLWNTGGEDTCYPLD

SEQ ID NO: 7844 - protein, 132 aa, Saccharum officinarum
MGNAMNKDKVHDKETHGTSTDITEKTSVEKVKGPDLLERAKEEIEALAGAVHTKMEHHSSPHEKKEESHKEDKEGSLHNIKTHTNETHGTSADINENTPVDKVKGPNVFERAKEEIEAIVEAIHPKSGSDSK

SEQ ID NO: 7845 - protein, 132 aa, Sorghum bicolor
MGNSTNKDKVHDKETHGTSSNITEETSVEKVKAPDLLERAKEEIEALAGAVHTKMEHHSSPHEKKGESHKEDKEGSLHNIKTHTNETHGTSDDINENTPVDKVKGPNVFERAKEEIEAIVEAIHPKSGSDSK

SEQ ID NO: 7846 - protein, 131 aa, Setaria italica
MGNAMNKDKVHDKETHGTSSDINENTSVDKVKGPNLLERAKEEIEALAGAVHTKMEHHSSPLEKDESHKEDKEGSLQKIKTHTNETHGTSADISENTPVDKVKGPNVFERAKEEIEAIAEAIHPKKGSGSN

SEQ ID NO: 7847 - protein, 127 aa, Pennisetum glaucum
MGNAMNKDKVHDKETHGTSSDINENTSVDKVKGPNLLERAKEEIEALAGSVHTNMEHHSSPHEKKDDKEGSLQKIKTHTNETHGTSADINENTPVDKVKGPNVFERAKEEIEAIAEAIHPKKGSDSK

SEQ ID NO: 7848 - protein, 132 aa, Panicum virgatum
MGNAMNKDKVHGKETHGTSSDINENTSVDEVKGPNLLERAKEEIEALAGAVHTKMEHQSSPHEKEDESHKKDKEGSLQEIKTHTNETHGTSTDISENTPVDKVKGPNVFERAKEEIEAIAEAIHPKKGPDSK

SEQ ID NO: 7849 - protein, 749 aa, Sorghum bicolor
MRRSGRACSVLASLLLLLWLGVAAAQKASSWKTLSGKAPAIVAKGGFSGLFPDSSEYAYQFALVASSPDTILYCDVRLTKDEIGICLPDIRMDNCTNIPDFYAQGQKSYLVNGVPTSGWFSVDYNGTELGQVTLKQSINSRTPRFDSSFFALLAVEDVQSKFKPPGIWLNVQHDSFYSQFNLSMRNYIISVSKRVVANYISSPEVSFLTSILGRISNKTKLVFRFLDESTLEPSMNQTYGSMMKNLTFVKTFASGILVPKSYIWPNSPDNYLQPYTSVVDDAHKAGLEIYAADFANDFLLSYNHSYDPLAEYLSFIDNDVFSVDGVLTDFPVTASEAIGCFTNLNKSNTDHGKPLIISHNGASGDYPGCTDLAYQKAVDDGADVIDCPVQVTKDGIPICLSSIDLMTDTTIARSQFISQTATIKDIQIAPGVFSFNLTWDDIVKNLKPKISTPWTNFKLDRNPRYRNAGKFVRLSDFLEFTKDKDLSGIMISVEHAAFLAGELGFDMVDKVIKALDDAGYHEQTAQKVMIQSADSSVLEKFKEQTKYDLVYMINKEVGDAAPSSLADIKKFASAVSVDTSSVFPETHYFTVYETNLVQTLQSAGLSVYVYTLMNEFPSQPYDFFSDATAQINAYVKGALVDGLITDFPATARRYKVNSCMNMGNNTPNFMAPVHPGDLMQSISRSAQPPALAPIPPLTESDVAQPPLPPARSNSSTVPTQSPASRTHACAAHIPVLVTLAILCTWRSLV

SEQ ID NO: 7850 - protein, 748 aa, Setaria italica
EMRACHVCSVLAQLMLLWLGVAAAQKATSWKTLSGKAPAIVAKGGFSGLFPDSSPDAYGFVQYSSSPDTVLYCDVRLTKDEVGLCLPDIKMDNCTNIADIYAQGQKSYLVNGVPTSGWFSVDYNNTELGQVSLIQSIASRSPRFDSNFYPPLAVEDVRSKFKPPGIWLNVQHDRFYSQFNLSMRNYIISVSKRVVVNYISSPEVSFLTSVLGRVSKKTKLVFRYLDESTLEPSMNQTYGSMLKNLTFVKTFASGILVPKSYIWPTSADNYLQPHTSVVNDAHKAGLEIYAADFANDFMISYNYSYDPLAECLTFIDNGVFSVDGVLTDFPVTPSEAIGCFTNLNKSNTDHGKPLIISHNGASGDYPGCTDLAYQKAVDDGADVIDCPVQVTKDGVLVCMSSVNLMDDTTVARSQFASQTAVIKEIQSARGVFTFNLTWDDIVKNLRPIISTPLSTYRMDRNPRYRNAGKFMRLSDFLDFTKNKDLSGIMISIEHATFVAEELGFDMVDTVIKALGDAGYNNQTTQKVMIQSTNSSVLEKFKQQTKYDLVYMINEEVRDATPSSLVDIKKFASAVSVDTSSVFPEPHHFTMYKTNLVQTLQTAGLSVYVYTLMNEFVSQPYDFFADATVQINAYVKGAGVDGLITDFPATARRYKVNSCMNMGNSAPIFMAPPRAGDLMQIISKLAQPPALAPMPLLTDSDVAEPPLPPARSNSSTAPTHSGATRMHAHATHIPVLVTLAVLFAWCSLV

SEQ ID NO: 7851 - protein, 670 aa, Sorghum bicolor
MDLLRHPFKGVVTDIKGRATWYKHDWVAGVHSGFRILAPTMYIFFASALPVIAFGAQLSTATNGILTTVETLASTAICGIIHSILGGQPLLIVGVAEPTIIMYTYLYNFAKNQQALGEKLYLAWAGWVCIWTAIMLFLLAMFNASNVISRFTRVAGELFGMLITVLFLQEAIKGMISEFSVPEDADSSSPIYQFQWLYVNGLLGVIFSIGLLYTALRTRRARSWLYGIRRLRSFIADYGVPLMVIVWTALSYTLPGKLPSGVPRRLFSPLPWESSSQGHWTIARDLFSVPPAYILAAILPALMVAGLYFFDHSVASQLAQQKEYNLKKPSAYHYDILVLGIMVLLCGLLGIPPSNGVLPQSPMHTKSLAVLKRQLLSKKMVDTAKDSIGRSATTLEIYGKMEEIFIEMDSEQNTGSVDKELKNFKDAVLQEGNEEGKLAREFDPRKHIEAHLPVRVNEQRLSNLLQSILVGGCVGAMPVIRMIPTSVLWGYFAYMAIDSLPGNQFWERIQLLFVAESRLYKVLEGPHASFVESVVPKTITIFTIFQLVYLLICFGITWIPIAGILFPVPFFLMILIRQYLLPKFFDPIVLRELDAAEYEELDGIALEHNLEDEVSEVASCPSRPDAEILDELTTNRGEVKHRTSSLREERPIQVTMSTHMVATNAVQPSL

SEQ ID NO: 7852 - protein, 663 aa, Panicum virgatum
MDLLRSPFRGVIADVKGRAAWYRHDWVAGLHSGFRILAPTMYIFFASALPVIAFGEQLSTATNGRLTTVETLASTAICGIVHSILGGQPLLIVGVAEPTIIMYTYLYNFAKKQQGLGEQLYLAWTGWVCIWTAIMLFLLAMFNASNVISRFTRVAGELFGMLITILFLQEAIKGIIGEFSVPEDTDSSSPIHQFQWLYVNGLLGVIFSIGLLYTALRTRRARSWLYGVGCLRSFIADYGVPLMVIVWTALSYTLPSKVPSGVPRRLLSPLPWESSSLGHWTIVEDLISVPPEYIFGAIVPALMVAGLYFFDHSVASQLAQQKEYNLKKPSAYHYDIFVLGVMVLLCGLIGIPPSNGVLPQSPMHTRSLAVLKRQLLSKKMVDTTKESIGKSATSLEIYGKMQEVFIKMDSEQNADSVDKELKNFKDAVLQEGDEEGKLAREFDPRKHIEAHLPVRVNEQRLSNLLQSILVGGCVGAMPVIRMVPTSVLWGYFAYMAIDSLPGNQFWERIQLLFITESRRYKVLEGPHASFVESVPPKTIAIFTIFQLLYLLICFGITWIPIAGILFPVPFFLMILIRQYLLPKFFDPILLRELDAAEYEELDGVPHEHTLEDEVSEVGSCISRPDAEILDELTTNRGELKHRTSSLREERPVQVPSNAVQPSL

SEQ ID NO: 7853 - protein, 663 aa, Panicum virgatum
MDMLRSPFRGVIADVKGRAAWYRHDWVAGLHSGFRILAPTMYIFFASALPVIAFGEQLSTATNGRLTTVETLASTAICGIIHSILGGQPLLIVGVAEPTIIMYTYLYNFAKKQQGLGEQLYLAWTGWVCIWTAIMLFLLAMFNASNVISRFTRIAGELFGMLITILFLQEAIKGIISEFSVPEDADSSSPIHQFQWLYVNGLLGVIFSIGLLYTALRTRRARSWLYGVGCLRSFIADYGVPLMVIVWTALSYTLPSKVPSGVPRRLLSPLPWESSSLGHWTIVEDLISVPPAYIFAAIVPALMVAGLYFFDHSVASQLAQQKEYNLKKPSTYHYDIFVLGVMVLLCGLIGIPPSNGVLPQSPMHTRSLAVLKRQLLSKKMVDTAKESIGKSATSLEIYGKMQEVFIKMDSEQNADSVDKELKNFKDAVLQEGDEEGKLAREFDPQKHIEAHLPVRVNEQRLSNLLQSILVGGCVGAMPVIRMVPTSVLWGYFAYMAIDSLPGNQFWERIQLLFIAESRRYKVLEDPHASFVESVPPKIIVIFTIFQLVYLLICFGITWIPIAGILFPVPFFLMILIRQYLLPKFFDPILLRELDAAEYEELDGVPHEHTLEDEVSEVGSCISRPDAEILDELTTNRGELKHRTSSLREETPVQVPSNAIQPSL

SEQ ID NO: 7854 - protein, 673 aa, Setaria italica
MDLLRNPFKGVIADIKGRAAWYRHDWVAGLRSGFRILAPTMYIFFASALPVIAFGEQLSTATNGILTTVETLASTAICGIIHSILGGQPLLIVGVAEPTIIMYTYLYNFAKKQQGLGEQLYLAWAGWVCIWTAIMLFLLAMFNASNVISRFTRVAGELFGMLITVLFLQEAIKGIINEFSVPEDADSSSPIYQFQWLYVNGLLGVIFSIGLLFTALRTRRARSWLYGVGWLRSFIADYGVPLMVIVWTALSYTLPSKVPSGVPRRLFSPLPWESSSLGHWTIVKDLFSVPPAYIFAAILPALMVAGLYFFDHSVASQLAQQNEYNLKKPSAYHYDILVLGIMVLLCGLIGIPPSNGVLPQSPMHTRSLAILKRQLLSKKMVDTAKESIGKSATSLEIYGKMQEVFIEMDSEQNTDSVDKELKNFKDAVLQEGDEEGKLAGEFDPRKHIEAHLPVRVNEQRLSNLLQSILVGGCVGAMPVIRMIPTSVLWGYFAYMAIDSLPGNQFWERMQLLFIAESRHYKVLEGPHASFVESVPPRTITIFTVFQLVYLLICFGITWIPIAGILFPVPFFLMILIRQYLLPKFFDPIVLRELDAAEYEELDGVPHEHTLEDEVSEAGSCISRRDAEILDELTTNRGELKHRTSSLREERSVQVNNGHADGTTIGVTRGLEMI

SEQ ID NO: 7855 - protein, 663 aa, Panicum virgatum
MDLLRSPFRGVIADVKGRAAWYRHDWVAGLRSGFRILAPTMYIFFASALPVIAFGEQLSTATNGRLTTVETLASTAICGIIHSIVGGQPLLIVGIAEPTIIMYTYLYNFAKKQQGLGEQLYLAWTGWVCIWTAIMLFLLAMFNASNVISRFTRVAGELFGMLITVLFLQEAIKGIISEFNVPEDADSSSPIHQFPWLYVNGLLGVIFSIGLLYTALRTRRARSWLYGVGCLRSFIADYGVPLMVIVWTALSYTLPSKVLSGVPRRLLSPLPWESSSLGHWTIVEDMISVPPAYIFAAIVPALMVAGLYFFDHSVASQLAQQKEYNLKKPSAYHYDIFVLGIMVLLCGLIGIPPSNGVLPQSPMHTRSLAVLKRQLLSKKMVDTAKKSIGKSATSLEIYGKMQEVFIEMDSEQNADSVDKELKNFKDAVLQEGDEEGKLAREFDPRKHIEAHLPIRVNEQRLSNLLQSILIGGCVGAMPVIRMVPTSVLWGYFAYMAIDSLPGNQFWERIQLLFIAESRRYKVLEGPHASFVESVPPKTIAIFTIFQLVYLLICFGITWIPIAGILFPMPFFLMILIRQYLLPKFFDPILLRELDAAEYEELDGVPHEHTLEDEVSEVGSCISRPDAEILDELTTNRGELKHRTSSLREERPVQVPSNAVQPSL

SEQ ID NO: 7856 - protein, 666 aa, Brachypodium distachyon
MDLLRNPFKGVVADVKGRASWYKDDWVAGLRAGFRILAPTMYIFFASALPVIAFGEQLSRETNGMLSTVETLASTAICGVIHSILGGQPLLIVGVAEPTIIMYTYLYNFAKEEAGLGEQLYLAWAGWVCIWTAIMLFFLAMFNASNVISRFTRVAGELFGMLITVLFLQQAIKGIVSEFSLPKAAEIVDRSSLIYDFQWIYVNGLLGVIFSIGLLYTALKSRRARSWLYGIGCLRSFIADYGVPLMVIVWTALSYTLPSKVPSGVPRRLFSPLPWESSSLGHWTVAKDLFSVPPAFIFAAIVPALMVAGLYFFDHSVASQLAQQKEFNLKKPSAYHYDILVLGFMVLLCGLIGIPPSNGVLPQSPMHTRSLAVLKGQLMRNKMLQTAKEGMTNRASSLEIYGKMQEVFIQMDREKNTDSVDKELKSLKDAVLREGDEEGKLAGEFDPRKHIEAHLPVRVNEQRLSNLLQSLLVGGCVGAMPVIKMIPTSVLWGYFAYMAIDSLPGNQFWERIKLLFIGSTRRYKVLEGPHASFVESVPSKTISVFTIFQLVYLLICFGTTWIPIAGILFPVPFFLMILIRQHLLPKFFDPNHLRELDAAEYEELEGVQNEHTLEEDGSISGSCDSRNDAEILDELTTNRGELKHRSVSHREERHLQVHSNAVQPSV

SEQ ID NO: 7857 - protein, 672 aa, Oryza sativa
MDLLRTPFKGVVADIEGRVAWYKHDWVAGFRSGFRILAPTMYIFFASALPVIAFGAQLSRETNGILTTVETLASTALCGIIHSILGGQPLLIVGVAEPTIIMYTYLYNFAKNQQALGERLYLAWAGWVCIWTALMLFLLAMFNASNVISRFTRVAGELFGMLITVLFLQQAIKGIIEEFKVPRDADHSSPIYQFQWLYVNGLLGVIFSIGLLYTALRSRRARSWVYGQGWLRGFIADYGVPLMVIVWTAFSYTLPKDVPSGVPRRLFSPLPWESSSLQHWTVAKDLFSVPPAYIFAAILPALMVAGLYFFDHSVASQLAQQKEFNLKKPSAYHYDILVLGFMVLLCGLIGIPPSNGVLPQSPMHTRSLAVLKGQLLRKKMVQTANEGLMNRASSLEIYGKIQGVFIEMDCEKNTDSVDKELKSLKDAILQEVDKEGTLAEEFDPIKHIEAHLPVRVNEQRLSNLLQSLLVGACVGAMPVIKMIPTSVLWGYFAYMAIDSLPGNQFWERLRLIFIPSSRRYKVLEGPHASFMESVPSKTITVFTIFQLVYLLICFGITWIPIAGILFPLPFFLMILIRQHVLPKFFEPNDLRELDAAEYEELEGVHHDHTLEDGESDSGSCGSRDDAEIFDELTTNRGELKHRTSSHREERHLQVHSNAIQPRCGDTENLSEC

SEQ ID NO: 7858 - protein, 666 aa, Triticum aestivum
MDLLGNPFKGVVADAPGRASWYKDDWVAGLRTGFRILAPTMYIFFASALPVISFGEQLSNETDGILSTVETLASTAICGIIHAILGGQPLLIVGVAEPTIIMYTYLYKFAKKQPDLGEQLYLAWAGWVCIWTAIMLFLLAMFNASNVISRFTRVAGELFGMLITVLFLQQAIKGIVSEFSMPKDDEISDPSSPIYQFQWIYVNGLLGVIFSIGLLYTALKTRRARSWLYGIGWLRSFIADYGVPLMVIVWTAFSFTLPSKVPSGVPRRLFSPLPWESISLRHWTVAKDLFSVPPTYIFAAIVPALMVAGLYFFDHSVASQLAQQKEFNLKKPSAYHYDILVLGFMVLLCGLLGIPPSNGVLPQSPMHTRSLAVLKGQLLRKKMLQTAKEGMSNRASSLEIYGKMQEVFIQMDSNQNANSVDKDLKSLKDAVLWEGDEEGKLAGEFDPSKYIEAHLPVRVNEQRLSNLLQSLLVGGCVGAMPVIKMIPTSVLWGYFAYMAIDSLPGNQFWERLQLLCIGASRRYKVLEGPHASFVESVPSRTISAFTVFQFVYLLICFGITWIPVAGILFPLPFFIMILIRQHLLPKFFEPNDLRELDAAEYEELEGVPHEQILEEDGSNSGSCDSRDDSEILDELTTNRGELKHRSVSHPEERHLQVHSNAVQPSV

SEQ ID NO: 7859 - protein, 666 aa, Hordeum vulgare
MDLLRNPFKGVVADVKGRAPWYKDDWLAGLRAGFGILAPTMYIFFASALPVIAFGEQLSNETNGILSTVETLASTAICGIIHAILGGQPMMIVGVAEPTIIMYTYLYNFAKKQPGLGERLYLAWAGWVCIWTAIMLFLLAMFNASNVISRFTRVAGELFGMLITVLFLQEAIKGIVGEFSMPKDAEIFDRSSPIYQFQWIYVNGLLGVIFSIGLLYSALKTRRARSWLYGIGWLRSFIADYGVPLMVIVWTAFSYALPSGVPSGVPRRLFSPLPWESSSLGHWTVAKDLFSVPPAYIFAAIVPALMVAGLYFFDHSVASQLAQQQEFNLKKPSAYHYDILVLGFMVLLCGLIGIPPANGVLPQSPMHTRSLAVLKGQLMRKRMLRTAKEGMSNRASSLEIYGKMHEVFIEMDNKQDADSVDKDLKSLKDAVLREGDEDGKLAGEFDPRKHIEAHLPVRVNEQRLSNLLQSLLVGGCVGAMPVIKMIPTSVLWGYFAYMAIDSLPGNQFWERIQLLFVGASRRYKVLEGPHASFVESVSSRTIYVFTIFQIVYFLICFGTTWIPIAGILFPLPFFLMILIRQYLLPKFFEPNDLRELDAAEYDELEGVQHEHTLEEDGSISGSCDGRIDAEILDELTTHRGELKHRVVSHREERHLQVHSNAVQPSV

SEQ ID NO: 7860 - protein, 672 aa, Oryza sativa
MELLKIPFKGVVADIEGRAAWYKHDWLEGFHSGFRILAPTMYIFFASALPVIAFGTQLSRETNGILTTVETLASTAICGIIHSILGGQPLLIVGVAEPTIIMYTYLYNFAKNQQALGERLYLAWAGWVCIWTAIMLFLLAMFNASNVISRFTRVAGELFGMLITVLFLQQAIKGIIEEFKVPGGVDHSSPIYRFQWLYVNGLLGVIFSIGLLYTALRSRRARSWVYGQGWLRGFISDYGVPLMVIVWTALSYALPKDVPSGVPRRLFSPLPWESSSLHHWTIAKDLFSVPPAYIFAAILPALMIAGLYFFDHSVASQLAQQKEFNLKKPSAYHYDILVLGFMVLLCGLIGIPPSNGVLPQSPMHTRSLAVLKGQLLRKKMVQTANEGLMNRASSLEIYGKMQGVFIEMDCEKNTDSVDKELKSLKDAMLQEGDKEGTLAEEFDPIKHIEAHLPVRVNEQRLSNLLQSLLVGACVGAMPVIKMIPTSVLWGYFAYMAIDSLPGNQFWERIRLIFIPSSRRYKVLEGPHASFMESVPSKTITVFTIFQLVYLLICFGITWIPIAGILFPLPFFLMILIRQHVLPKFFEPNDLRELDAAEYEELEGVHHDHTLEDGASDSESCGSRDDAEILDELTTNRGELKHRTFNHREERHPQAHTKAVQPRCGDTENWSEC

SEQ ID NO: 7861 - protein, 666 aa, Secale cereale
MDLLMNPFKGVVTDVKGRAPWYKDDWVAGLRTGFRILAPTMYIFFASALPVISFGEQLSNETDGILSTVETLASTAICGIIHAILGGQPLLIVGVAEPTIIMYTYLYKFAKKQPDLGEGLYLAWAGWVCIWTAIMLFLLAMFNASNVISRFTRVAGELFGMLITVLFLQQAIKGIVSEFSMPKDDEISDPSSPIYQFQWIYVNGLLGVIFSIGLLYTALKTRRARSWLFGIGWLRSFIADYGVPLMVIVWTAFSFALPSKVPSGVPRRLFSPLPWESISLRHWTVAKDLFSVPPTYIFAAIVPALMVAGLYFFDHSVASQLAQQKEFNLKKPSAYHYDILVLGFMVLLCGLLGIPPSNGVLPQSPMHTRSLAVLKGQLLRKKMLQTAKEGMSNRASSLEIYGKMQEVFIQMDSNQNANSVDKDLKSLKDAVLRDGDEEGKLAGEFDPSKYIEAHLPVRVNEQRLSNLLQSLLVGGCVGAMPVIKMIPTSVLWGYFAYMAIDSLPGNQFWERLQLLCIGASRRYKVLEGPHASFVESVPSRTISAFTVFQFVYLLICFGITWIPVAGILFPLPFFIMILIRQHLLPKFFEPNDLRELDAAEYEELEGVPHEQTLEEDGSNSGSCDSRDDSEILDELTTNRGELKHRTVSHPEERHLQVHSNAVQPSV

SEQ ID NO: 7862 - protein, 666 aa, Hordeum vulgare
MDLLGNPFKGVVADVKGRASWYKDDWVAGLRTGFRILAPTMYIFFASALPVISFGEQLSNETDGIVSTVETLASTAICGIIHSILGGQPLLIVGVAEPTIIMYTYLYKFAKKQPDLGERLYLAWAGWVCIWTAIMLFLLAMFNASNVISRFTRVAGELFGMLITVLFLQQAIKGIVSEFSVPKDDEISDPSSPIYQFQWIYVNGLLGVIFSIGLLYTALKTRRARSWLYGVGWLRSFIADYGVPLMVIVWTALSFTLPSKVPSGVPRRLFSPLPWESISLRHWTVAKDLFSVPPTYIFAAIVPALMVAGLYFFDHSVASQLAQQKEFNLKKASAYHYDILVLGFMVLLCGLLGIPPSNGVLPQSPMHTRSLAVLKGQLLRRKMLQTAKEGMSNRASSLEIYGKMQEVFIQMDSNQNANSVDKDLKSLKDAVLREGDEEGKLAGEFDPSKHIEAHLPVRVNEQRLSNLLQSLLVGGCVGAMPAIKMIPTSVLWGYFAYMAIDSLPGNQFWERLQLLCIGASRRYKVLEGPHASFVEAVPSRTISAFTVFQFVYLLICFGITWIPVAGILFPLPFFIMILIRQHLLPKFFEPNDLRELDAAEYEELEGVPHEQTLEEDGSNSGSHDSIDDAEMLDELTTNRGELKHRSASHPEERHLQVHSNAVQPSV

SEQ ID NO: 7863 - protein, 666 aa, Triticum aestivum
MDLLGNPFKGVVADVQGRASWYKDDWVAGLRTGFRILAPTMYIFFASALPVISFGEQLSNETDGILSTVETLASTAICGIIHSILGGQPLLIVGVAEPTIIMYTYLYKFARKQPDLGEQLYLAWAGWVCIWTSIMLFLLAMFNASNVISRFTRVAGELFGMLITVLFLQQAIKGIVSEFSMPKDDEISDPSSPIYQFQWIYVNGLLGVIFSIGLLYTALKTRRARSWLYGIGWLRSFIADYGVPLMVIVWTAFSFALPSKVPSGVPRRLFSPLPWESISLRHWTVAKDLFSVPPTYIFAAIVPALMVAGLYFFDHSVASQLAQQKEFNLKKPSAYHYDILVLGFMVLLCGLLGIPPSNGVLPQSPMHTRSLAVLKGQLLRKKMLQTAKEGMSNRASSLEIYGKMQEVFIQMDSNMNANSVDKDLKSLKDAVLREGDEEGKLAGEFDPSKYIEAHLPVRVNEQRLSNLLQSLLVGGCVGAMPVIKMIPTSVLWGYFAYMAIDSLPGNQFWERLQLLCIGASRRYKVLEGPHASFVESVPSRTISAFTVFQFVYLLICFGITWIPVAGILFPLPFFIMILIRQHLLPKFFEPNDLRELDAAEYEELEGVPHEQILEEDGSNSGSCDSRDDSEILDELTTNRGELKHRTVSHPEERHLQVHSNAVQPSV

SEQ ID NO: 7864 - protein, 667 aa, Triticum aestivum
MDLLRSPVKGVVADVKGRAPWYKDDWLAGLRAGFGILAPTMYIFFASALPVIAFGEQLSNKTNGILSTVETLASTAICGIIHAILGGQPMMIVGVAEPTIIMYTYLYNFAKKQPGLGERLYLAWAGWVCIWTAIMLFLLAMFNASNVISRFTRVAGELFGMLITVLFLQEAIKGIVSEFSMPKDAEISDRSSATYQFQWIYVNGLLGVIFSIGLLYSALKTRRARSWLYGIGWIRSFIADYGVPLMVIVWTAFSHALPSGVPSGVPRRLFSPLPWESSSLGHWTVAKDLFSVPPVYIFAAIVPALMVAGLYFFDHSVASQLAQQQEFNLKKPSAYHYDILVLGFMVLLCGLIGIPPANGVLPQSPMHTRSLAVLKGQLMRKKMLQTAKEGMSNRASSLEIYGKMHEVFIEMDNKQDADSVDNDLKSLKDAVLREGDEDGKLAREFDPRKHIEAHLPVRVNEQRLSNLLQSLLVGGCVAAMPVIKMIPTSVLWGYFAYMAIDSLPGNQFWERIQFLCIGASRRYKVLEGPHASFMESVSRRTIYVFTIFQIVYFLLCFGTTWIPIAGILFPLPFFLMILIRQYLLPKFFEPNDLRELDAAEYEELEGVQHEHTLLEEDGSFSGSCDSRIDAEILDELTTHRGELKHRIVSHREERHLQVHSNAVQPSV

SEQ ID NO: 7865 - protein, 115 aa, Triticum aestivum
MDLLRSPFKGVVADVQGRAPWYKDDWLAGLRAGFGILAPTMYIFFASALPVIAFGEQLSNETNGILSTVETLASTAICGIIHAILGGQPMMIVGVAEPTIIMYTYLYNFARSSQV

SEQ ID NO: 7866 - protein, 277 aa, Setaria italica
MEVASSSSASPSAPPPPASSKPALRLNPAAVLLRRLPTPTPTTATPVTASASPERPGGAANPLVAFLSSLIPWREQRPPKKQPDHPAATASASASAAAARRAAKAAAEEEAEARQLVGCAVPLFRPYVAQLPWHGGARAWLSKLFPRYGHYCGPNWSSGKETGSVLWDRRPVDHLDFCCYCHDMAYDTHDQAQLLRADLAFLRCLESSRQTPARDGIAAAAIYRAMCIFGLKTILIPYRTNLVRLQTGPNYADFFADFLKRVASSSGRPTGGEKQRL

SEQ ID NO: 7867 - protein, 435 aa, Sorghum bicolor
MASEKHFKYVILGGGVAAGYAAREFAKQGVKPGELAIISKEAVAPYERPALSKGYLFPQNAARLPGFYVCVGSGGERLLPEWYSEKGIELILSTEIVKADLSTKTLTSAAGANFTYEILLIATGSSVIKLTDFGTPGADSNNILYLREIDDADKLVAAIQAKKGGKAVVVGGGYIGLELSAALKINDFDVTMVFPEPWCMPRLFTADIAAFYEAYYTNKGVKVLKGTLAVGFDADANGDVTAVKLKDGTVLEADIVVVGVGGRPLTTLFKGQVAEEKGGIKTDAFFETSVPGVYAIGDVATFPLKMYNELRRVEHVDHSRKSAEQAVKAIKGKESGEPVPEYDYLPYFYSRSFDLGWQFYGDNVGETILFGDSDPTSSKPKFGSYWIKDGKVLGAFLEGGSPDENKAIAKVAKTQPPVANLEELKKEGLQFASKI

SEQ ID NO: 7868 - protein, 435 aa, Saccharum officinarum
MASEKHFKYVILGGGVAAGYAAREFAKQGVKPGELAIISKEAVAPYERPALSKGYLFPQNAARLPGFYVCVGSGGERLLPEWYSEKGIELILSTEIVKADLSTKTLTSAAGANFTYEILLIATGSSVIKLTDFGTPGADFNNILYLREIDDADKLVAAIQAKKGGKAVVVGGGYIGLELSAALKINDFDVTMVFPEPWCMPRLFTADIAAFYEAYYTNKGVKILKGTLAVGFDADANGDVTAVKLKDGTVLEADIVVVGVGGRPLTTLFKGQVAEEKGGIKTDAFFETSVPGVYAIGDVATFPLKMYNELRRVEHVDHSRKSAEQAVKAIKGKESGEPVPEYDYLPYFYSRSFDLGWQFYGDNVGETILFGDSDPTSSKPKFGSYWIKDGKVLGAFLEGGSPDENKAIAKVAKTQPPVANLEELKKEGLQFASKI

SEQ ID NO: 7869 - protein, 435 aa, Cenchrus ciliaris
MASGKHFKYVILGGGVAAGYAAREFAKQGVQPGELAIISKEAVAPYERPALSKGYLFPQNAARLPGFHVCVGSGGERQLPEWYSEKGIELILSTEIVKADLSTKTLTSAAGATFTYEILLIATGSSVIKLTDFGTQGADSNNILYLREIDDADKLVAAIQAKKGGKAVVVGGGYIGLELSAALKINDFDVTMVFPEPWCMPRLFTADIAAFYEAYYTNKGVKVLKGTLAAGFDANANGDVTAVKLKDGTVLEADIVVVGVGARPLTTLFKGQVAEEKGGIKTDAFFETSVPGVYAIGDVATFPLKMYNELRRVEHVDHSRKSAEQAVKAIKGKESGESVPEYDYLPYFYSRSFDLGWQFYGDNVGETILFGDSDPTSSKPKFGSYWIKDGKVFGAFLEGGSPDENKAIAKVAKTQPPVTNIEELKKEGLQFASKI

SEQ ID NO: 7870 - protein, 435 aa, Pennisetum glaucum
MASGKHFKYVILGGGVAAGYAAREFAKQGVKPGELAIISKEAVAPYERPALSKGYLFPQNAARLPGFHVCVGSGGERQLPEWYSEKGIELILSTEIVKADLSTKTLTSAAGATFTYEILIIATGSSVIKLTDFGTQGADSNNILYLREIDDADKLVAAIQAKKGGKAVVVGGGYIGLELSAALKINDFDVTMVFPEPWCMPRLFTADIAAFYEAYYTNKGVKVLKGTLAVGFDANANGDVTAVKLKDGKVLEADIVVVGVGGRPLTTLFKGQVAEEKGGIKTDAFFETSVPGVYAIGDVATFPLKMYNELRRVEHVDHSRKSAEQAVKAIKGKESGESVPEYDYLPYFYSRSFDLGWQFYGDNVGETILFGDSDPTSSKPKFGSYWIKDGKVFGAFLEGGSPDENNAIAKVAKTQPPVASIEELKKEGLQFASKI

SEQ ID NO: 7871 - protein, 435 aa, Panicum virgatum
MASGKHFKYVILGGGVAAGYAAREFAKQGVQPGELAIISKEAVAPYERPALSKGYLFPQNAARLPGFYVCVGSGGERLLPEWYSEKGIELILSTEIVKADLSTKTLTSAAGATFTYDVLLIATGSSVIKLTDFGTQGADSNNILYLREIDDADKLVAAIQAKKGGKAVVVGGGYIGLELSAALKLNDYDVTMVFPEPWCMPRLFTADIAAFYEAYYTNKGVKILKGTLAVGFDANANGDVTAVKLKDGTVLEADIVVVGVGGRPLTTLFKGQVAEEKGGIKTDAFFETSVPGVYAIGDVATFPLKMYNELRRVEHVDHARKSAEQAVKAIKGKESGESVPEYDYLPYFYSRSFDLGWQFYGDNVGETILFGDSDPTSSKPKFGSYWIKDGKVLGAFLEGGSPDENKAIAKVAKTQPAVASVEELKKEGLQFASKI

SEQ ID NO: 7872 - protein, 435 aa, Setaria italica
MASGKHFKYVILGGGVAAGYAAREFAKQGVKPGELAVISKEAVAPYERPALSKGYLFPQNAARLPGFHVCVGSGGERQLPEWYTEKGIELILSTEIVKADLSTKTLTSAAGATFTYEILLIATGSSVIKLTDFGTQGADSNNILYLREIDDADKLVAAIQAKKGGKAVVIGGGYIGLEISAALKINDFDVTMVFPEPWCMPRLFTADIAAFYEAYYTNKGVKILKGTLAVGFDANANGDVTAVKLKDGTVLEADIVVVGVGARPLTTLFKGQVAEEKGGIKTDAFFETSVPGVYAIGDVATFPLKMYNELRRVEHVDHSRKSAEQAVKAIKGKESGESVPEYDYLPYFYSRSFDLGWQFYGDNVGETILFGDSDPASSKPKFGSYWIKDGKVLGAFLEGGSPDENKAIAKVAKTQPPVASIEELKKEGLQFASKI

SEQ ID NO: 7873 - protein, 434 aa, Panicum virgatum
MASGKHFKYVILGGGVAAGYAAREFAKQGVQPGELAIISKEAVAPYERPALSKGYLFPQNAARLPGFHVCVGSGGERLLPEWYSEKGIELILSTEIVKADLSTKTLTSAAGATFTYDILLIATGSSVIKLTDFGTQGADSNNILYLREIDDADKLVAAIQAKKGGKAVVVGGGYIGLELSAALKINDYDVTMVFPEPWCMPRLFTADIAAFYEAYYTNKGVKVLKGTLAVGFDANANGDVTAVKLKDGTVLEADIVVVGVGGRPLTTLFKGQVAEEKGGIKTDAFFETSVPGVYAIGDVATFPLKMYNELRRVEHVDHARKSAEQAVKAIKGKESGESVPEYDYLPYFYSRSFDLGWQFYGDNVGETILFGDSDPASSKPKFGSYWIKDGKVLGAFLEGGSPDENKAIAKVAKTQPAVSSVEELKEGLQFASKI

SEQ ID NO: 7874 - protein, 433 aa, Panicum virgatum
MSGKHFKYVILGGGVAAGYAAREFAKQGVQPGELAIISKEAVAPYERPALSKGYLFPQNAARLPGFHVCVGSGGERLLPEWYSEKGIELILSTEIVKADLSTKTLTSAAGATFTYDILLIATGSSVIKLTDFGTQGADSNNILYLREIDDADKLVAAIQANKGGKAVVVGGGYIGLELSAALKINDYDVTMVFPEPWCMPRLFTADIAAFYEAYYTNKGVKVLKGTLAVGFDANANGDVTAVKLKDGTVLEADIVVVGVGGRPLTTLFKGQVAEEKGGIKTDAFFETSVPGVYAIGDVATFPLKMYNELRRVEHVDHARKSAEQAVKAIKGKESGESVPEYDYLPYFYSRSFDLGWQFYGDNVGETILFGDSDPASSKPKFGSYWIKDGKVLGAFLEGGSPDENKAIAKVAKTQPAVSSVEELKEGLQFASKI

SEQ ID NO: 7875 - protein, 435 aa, Oryza sativa
MASEKHFKYVILGGGVAAGYAAREFAKQGVKPGELAIISKEAVAPYERPALSKGYLFPQNAARLPGFHVCVGSGGERLLPEWYSEKGIELILSTEIVKADLASKTLTSAVGATFTYEILIIATGSSVIKLSDFGTQGADSNNILYLREVDDADKLVAAIQAKKGGKAVIVGGGYIGLELSAALKINDFDVTMVFPEPWCMPRLFTADIAAFYESYYTNKGVKIVKGTVAVGFDADANGDVTAVNLKNGSVLEADIVVVGVGGRPLTTLFKGQVAEEKGGIKTDAFFETSVPGVYAVGDVATFPMKMYNELRRVEHVDHARKSAEQAVKAIKGKESGESVVEYDYLPYFYSRSFDLGWQFYGDNVGDTILFGDSDPTSAKPKFGSYWIKDGKVLGAFLEGGSPDENKAIAKVAKTQPPVANIEELKKEGLQFASKI

SEQ ID NO: 7876 - protein, 435 aa, Brachypodium distachyon
MASEKHFKYVIVGGGVSAGYAAREFAKQGVQPGDLAIISKEAVAPYERPALSKAYLFPQNPARLPGFHVCVGSGGERLLPEWYSEKGIELILGTEIIKADLASKTLTSAAGATFTYEILLIATGSSVIKLSDFGTQGADSNNILYLREVDDADKLYAAIQAKKGGKAVVVGGGYIGLELSAVLKMNDLDVTMVYPEPWCMPRLFTADIAAFYESYYANKGVKIVKGTVAVGFDADANGDVTAVKLKDGRVLEADIVVVGVGGRPLTTLFKGQVAEEKGGIKTDASFETSVPGVYAVGDVATFPMKIYNDVRRVEHVDHARKSAEQAVKAIKGKESGEAVPEYDYLPYFYSRSFDLSWQFYGDNVGETVLFGDSDPSSAKPKFGSYWIKDGKVLGAFLEGGSPDENNAIAKVARAQPPVSSVEELKKEGLQFASKI

SEQ ID NO: 7877 - protein, 435 aa, Avena sativa
MATEKHFKYVVLGGGVSGGYAAREFVKQGVQPGELAIISKEAVAPYERPALSKAYLFPQNPARLPGFHVCVGSGGERLLPEWYSEKGIELILSTEIVKADLATKTLTSAAGATFTYEILVIATGSSVIKLSDFGTPGADSNNILYLREIDDADKLHAAIQAKKGGKAVVVGGGYIGLELSAVLKMNNLDVTMVFPEPWCMPRLFTAKIAAFYESYYTNKGVKIVKGTVAVGFDANANGDVTAVQLNDGSVLEADIVVVGVGGRPLTTLFKGQVAEEKGGIKTDASFETSIPGVYAVGDVATFPMKIYNDVRRVEHVDHSRKSAEQAVKAIKGKEAGEAVPEYEYLPYFYSRSFDLSWQFYGDNVGETVLFGDSDPSSAKPKFGSYWIKDGKVLGVFLEGGSADENSAIAKVAKAQPAAGSLEELKKEGLQFASRI

SEQ ID NO: 7878 - protein, 435 aa, Triticum aestivum
MASGKHFKYVVLGGGVSGGYAAREFAKQGVQPGELAIISKEAVAPYERPALSKAYLFPQNPARLPGFHVCVGSGGERLLPEWYSEKGIELILSTEIVKADLASKTLTSAAGATFTYEILLIATGSSVIKLSDFGTQGADSNNILYLREIDDADNLYAAIQAKKGGKAVVVGGGYIGLELSAVLKMNDLDVTMVFPEPWCMPRLFTAEIAAFYESYYTNKGVKIVKGTVAIGFDADANGDVTAVKLKDGSVLEADIVVVGVGGRPLTTLFKGQVAEEKGGIKTDAFFETSVPGVYAVGDVATFPMKIYNDERRVEHVDHSRKSAEQAVKAIKGKEAGSAVEEYDYLPYFYSRSFDLSWQFYGDNVGDAILFGDADPSSAKPKFGSYWVKDGKCVGAFLEGGSPDENAAIAKLARAQPPAASPDELKAAGLQFASKI

SEQ ID NO: 7879 - protein, 435 aa, Triticum aestivum
MASGKHFKYVVLGGGVSGGYAAREFAKQGVQPGELAIISKEAVAPYERPALSKAYLFPRNPARLPGFHVCVGSGGERLLPEWYSEKGIELILSTEIVKADLASKTLTSAAGATFTYEILLIATGSSVIKLSDFGTQGADSNNILYLREIDDADNLYAAIQAKKGGKAVVVGGGYIGLELSAVLKMNDLDVTMVFPEPWCMPRLFTAEIAAFYESYYTNKGVKIVKGTVAIGFDADANGDVTAVKLKDGSVLEADIVVVGVGGRPLTTLFKGQVAEEKGGIKTDAFFETSVPGVYAVGDVATFPMKIYNDERRVEHVDHSRKSAEQAVKAIKGKEAGSAVEEYDYLPYFYSRSFDLSWQFYGDNVGDAILFGDADPSSAKPKFGSYWVKDGKCVGAFLEGGSPDENAAIAKLARAQPPAASPDELKAAGLQFASKI

SEQ ID NO: 7880 - protein, 435 aa, Leymus cinereus x Leymus triticoides
MASGKHFKYIVLGGGVSGGYAAREFAKQGVQPGELAIISKEAVAPYERPALSKAYLFPQNPARLPGFHVCVGSGGERLLPEWYSEKGIELILSTEIVKADLASKSLTSAAGATFTYEILLIATGSSVIKLSDFGTQGADSNNILYLREVDDADKLYAAIQAKKGGKAVVVGGGYIGLELSAVLKMNNLDVTMVFPEPWCMPRLFTADIAAFYESYYTNKGVKIVKGTVAVGFDADANGDVTAVKLKDGSVLEADIVVVGVGGRPLTTLFKGQVAEEKGGIKTDAFFETSVPGVYAVGDVATFPMKIYNDVRRVEHVDHSRKSAEQAVKAIKGKEAGSTVAEYDYLPYFYSRSFDLSWQFYGDNVGDAILFGDADPSSAKPKFGSYWVKDGKLVGAFLEGGSPDENGAIAKLARAQPPATSPEELKAAGLQFASKI

SEQ ID NO: 7881 - protein, 435 aa, Avena sativa
MATEKHFKYVVLGGGVSGGYAAREFVKQGVQPGELAIISKEAVAPYERPALSKAYLFPQNPARLPGFHVCVGSGGERLLPEWYSEKGIELILSTEIVKADLASKTLTSAAGATFTYEILVIATGSSVIKLSDFGTPGADSNNILYLREVDDADKLYAAIQAKKGGKAVVVGGGYIGLELSAVLKMNNLDVTMVFPEPWCMPRLFTAKIAAFYESYYTNKGVKIVKGTVAVGFDANANGDVTAVQLNDGSVLEADIVVVGVGGRPLTTLFKGQVAEEKGGIKTDASFETSIPGVYAVGDVATFPMKIYNDVRRVEHVDHSRKSAEQAVKAIKGKEAGEAVPEYEYLPYFYSRSFDLSWQFYGDNVGETVLFGDSDPSSAKPKFGSYWIKDGKVLGVFLEGGSAEENSAIAKVAKAQPAAGSLEELKKEGLQFASRI

SEQ ID NO: 7882 - protein, 435 aa, Triticum aestivum
MASGKHFKYIVLGGGVSGGYAAREFAKQGVQPGELAIISKEAVAPYERPALSKAYLFPQSPARLPGFHVCVGSGGERLLPEWYSEKGIELILSTEIVKADLPSKTLTSAAGATFTYEILLIATGSSVIKLSDFGTQGADSNNILYLREIDDADNLYAAIQAKKGGKAVVVGGGYIGLELSAVLKMNDLDVTMVFPEPWCMPRLFTAEIAAFYESYYTNKGVKILKGTIAVGFDADANGDVTAVKLKDGSVLEADIVVVGVGGRPLTTLFKGQVAEEKGGIKTDAFFETSVPGVYAVGDVATFPMKIYNDERRVEHVDHSRKSAEQAVKAIKGKEAGSAVEEYDYLPYFYSRSFDLSWQFYGDNVGDAILFGDADPGSAKPKFGSYWVKDGKCVGAFLEGGSPDENAAIAKLARAQLPAASPDELKAAGLQFASKI

SEQ ID NO: 7883 - protein, 436 aa, Secale cereale
MASGKHFKYIVLGGGVSGGYAAREFAKQGVQPGELAIISKEAVAPYERPALSKAYLFPQNPARLPGFHVCVGSGGERLLPEWYSEKGIELILSTEIVKADLASKTLTSSAGATFTYEILLIATGSSVIKLSDFGTQGADSNNILYLREIDDADNLYAAIQAKKGGKAVVVGGGYIGLELSAVLKMNDLDVTMVFPEPWCMPRLFTAEIAAFYESYYTNKGVKIVKGTVAVGFDADANGDVTAVKLKDGSVLEADIVVVGVGGRPLTTLFKGQVAEEKGGIKTDAFFETSVPGVYAVGDVATFPMKIYNDERRVEHVDHSRKSAEQAVKAIKGKEAGSAVAEYDYLPYFYSRSFDLSWQFYGDNVGDAILFGDADPVSAKPKFGSYWVKDGKCVGAFLEGGSPDENAAIAKLAREQPPAASPAELKAAGLQFASSKI

SEQ ID NO: 7884 - protein, 435 aa, Triticum aestivum
MASGKHFKYIVLGGGVSGGYAAREFAKQGVQPGELAIISKEAVAPYERPALSKAYLFPQNPARLPGFHVCVGSGGERLLPEWYSEKGIELILSTEIVKADLASKTLTSAAGATFTYDTLLIATGSSVIKLSDFGTQGADSNNILYLREIDDADNLYAAIQAKKGGKAVVVGGGYIGLELSAVLKMNDLDVTMVFPEPWCMPRLFTAEIAAFYESYYTNKGVKILKGTIAVGFDADANGDVTAVKLKDGSVLDADIVVVGVGGRPLTNLFKGQVAEEKGGIKTDAFFETSVPGVYAVGDVATFPMKIYNDERRVEHVDHSRKSAEQAVKAIKGKEAGSAVEEYDYLPYFYSRSFDLSWQFYGDNVGDAILFGDTDPGSAKPKFGSYWVKDGKCVGAFLEGGSPDENAAIAKLARAQPPAASPDELKAAGLQFASKI

SEQ ID NO: 7885 - protein, 435 aa, Triticum aestivum
MASGKHFKYIVLGGGVSGGYAAREFAKQGVQPGELAIISKEAVAPYERPALSKAYLFPQSPARLPGFHVCVGSGGERLLPEWYSEKGIELILSTEIVKADLPSKTLTSAAGATFTYDTLLIATGSSVIKLSDFGTQGADSNNILYLREIDDADNLYAAIQAKKGGKAVVVGGGYIGLELSAVLKMNDLDVTMVFPEPWCMPRLFTAEIAAFYESYYTNKGVKILKGTIAVGFDADANGDVTAVKLKDGSVLEADIVVVGVGGRPLTTLFKGQVAEEKGGIKTDAFFETSVPGVYAVGDVATFPMKIYNDERRVEHVDHSRKSAEQAVKAIKGKEAGSAVEEYDYLPYFYSRSFDLSWQFYGDNVGDAILFGDADPGSAKPKFGSYWVKDGKCVGAFLEGGSPDENAAIAKLARAQLPAASPDELKAAGLQFASKI

SEQ ID NO: 7886 - protein, 270 aa, Secale cereale
HQPASQWRPGSTSSTSSVGGGVSGGYAAREFAKQGVQPGELAVISKEAVAPYERPALSKAYLFPQNPARLPGFHVCVGSGGERLLPEWYSEKGIELILSTEIVKADLASKTLTSSAGATFTYEILLIATGSSVIKLSDFGTQGADSNNILYLREIDDADNLYAAIQAKKGGKAVVVGGGYIGLELSAVLKMNDLDVTMVFPEPWCMPRLFTAEIAAFYESYYTNKGVKIVKGTVAVGFDADANGDVTAVKLKDGSVLEADIVVVGVGADR

SEQ ID NO: 7887 - protein, 436 aa, Hordeum vulgare
MATGKHFKYIVLGGGVSGGYAAREFAKQGVQPGELAIISKEAVAPYERPALSKAYLFPQSPARLPGFHVCVGSGGERLLPEWYSEKGIELILSTEIVKADLASKTLTSSAGATFTYEILLIATGSSVIKLSDFGTQGADSNNILYLREVDDADKLYAAIQAKKGGKAVVVGGGYIGLELSAVLKMNNLDVTMVFPEPWCMPRLFTAEIAAFYESYYTNKGVKIVKGTVAVGFDADANGDVTAVKLKDGSVLEADIVVVGVGGRPLTGLFKGQVAEEKGGIKTDAFFETSVPGVYAVGDVATFPMKIYDDVRRVEHVDHSRKSAEQAVKAIKGKEAGSAVAEYDYLPYFYSRSFDLSWQFYGDNVGDAILFGDADPSSAKPKFGSYWVKDGKCVGVFLEGGSPDENGAIAKLARDQPPAASPAELKAAGLQFATSKI

SEQ ID NO: 7888 - protein, 436 aa, Hordeum vulgare
MATGKHFKYIVLGGGVSGGYAAREFAKQGVQPGELAIISKEAVAPYERPALSKAYLFPQSPARLPGFHVCVGSGGERLLPEWYSEKGIELILSTEIVKADLASKTLTSSAGATFTYEILLIATGSSVIKLSDFGTQGADSNNILYLREVDDADKLYAAIQAKKGGKAVVVGGGYIGLELSAVLKMNNLDVTMVFPEPWCMPRLFTAEIAAFYESYYTNKGVKIVKGTVAVGFDADANGDVTAVKLKDGSVLEADIVVVGVGGRPLTGLFKGQVAEEKGGIKTDAFFETSVPGVYAVGDVATFPMKIYDDVRRVEHVDHSRKSAEQAVKAIKGKEAGSAVAEYDYLPYFYSRSFDLSWQFYGDNVGDAILFGDADPSSAKPKFGSYWVKDGKCVGVFLEGGSPDENGAIAKLARDQPPAGSPAELKAAGLQFATSKI

SEQ ID NO: 7889 - protein, 436 aa, Panicum virgatum
MAAEAKHFKYVILGGGVAAGYAAREFGKQGVNPGDLAIISKEPVAPYERPALSKGYLFPQNAARLPGFHTCVGSGGERLLPEWYSEKGIELILSTEIVKADLASKTLTSAAGANFTYETLLIATGSSVIKLTDFGVQGAESNNILYLRDIADADKLVAAMQAKKDGKAVIVGGGYIGLELSAALKMNNFDVTMVYPEPWCMPRLFTSGIAHFYEGYYSNKGIKIVKGTVAAGFEADANGDVTAVKLKDGRVLEADIVVVGVGGRPLTALFKGKLAEEKGGLKTDAFFETSVPGVYAIGDVATFPLKLYNEQRRVEHVDHARKSAEQAVRAIKAKESGEPVPEYDYLPYFYSRSFDIAWQFYGDNVGDDVLFGDNDPASANHKFGSYWVKDGKVVGVFLEGGSAEENQAIARVARTQPPVANVEALKTEGLEFATKA

SEQ ID NO: 7890 - protein, 422 aa, Secale cereale
GVSGGYAAREFAKQGVQPGELAVISKEAVAPYERPALSKAYLFPQNPARLPGFHVCVGSGGERLLPEWYSEKGIELILSTEIVKADLASKTLTSSAGATFTYEILLIATGSSVIKLSDFGTQGADSNNILYLREIDDADNLYAAIQAKKGGKAVVVGGGYIGLELSAVLKMNDLDVTMVFPEPWCMPRLFTAEIAAFYESYYTNKGVKIVKGTVAVGFDADANGDVTAVKLKDGSVLEADIVVVGVGGRPLTTLFKGQVAEEKGGIKTDAFFETSVPGVYAVGDVATFPMKIYNDERRVEHVDHSRKSAEQAVKAIKGKEAGSAVAEYDYLPYFYSRSFDLSWQFYGDNVGDAILFGDADPGSAKPKFGSYWVKDGKCVGAFLEGGSPDENAAIAKLAREQPPAASPAELKAAGLQFASSKI

SEQ ID NO: 7891 - protein, 436 aa, Setaria italica
MAAEARHFKYVVLGGGVAAGYAAREFAKQGVNPGELAIISKEPVAPYERPALSKGYLFPQNAARLPGFHTCVGSGGERLLPEWYSEKGIELILSTEIVKVDLASKTLTSAAGATFTYEILLIATGSSVIKLTDFGVQGAESNNILYLRDIADAEKLVAAMQAKKDGKAVIVGGGYIGLELSAALKINNFDVTMVYPEPWCMPRLFTSGIAHFYEGYYANKGIKIVKGTVAVGFDADANGDVTAVKLKDGRVLEADIVIVGVGGRPLTALFKGQVADEKGGLKTDAFFETSVPGVYAIGDVATFPLKLYNEQRRVEHVDHARKSAEQAVRAIKAKESGESVPEYDYLPYFYSRSFDVAWQFYGDNVGDDVLFGDNDPASAKPKFGSYWVKDGKVVGVFLEGGSAEENQAIARVARAQPAVADVEALKQEGLEFAAKV

SEQ ID NO: 7892 - protein, 438 aa, Pennisetum glaucum
MAAEAEARHFKYVVLGGGVAAGYAAREFAKQGVKPGELAIISKEPVAPYERPALSKGYLFPQNAARLPGFHTCVGSGGERLLPEWYSEKGIELILSTEIVKADLASKTLTSAAEEIFTYEILLIATGSSVIKLTDFGVQGAESNNILYLRDIADADKLVAAMQAKKDGKAVVVGGGYIGLELSAALKINNFDVTMVYPEPWCMPRLFTSGIAHFYEGYYANKGIKIVKGTVAVGFDADANGDVTAVKLKDGRVLEADIVIVGVGGRPLTALFKGQVADEKGGLKTDAFFETSVPGVYAIGDVATFPLKLYNEQRRVEHVDHARKSAEQAVRAIKAKESGESVPEYDYLPYFYSRSFDVAWQFYGDNVGDDVLFGDNDPASAKPKFGSYWVKDGKVVGVFLEGGSAEEYQAIARVARAQPPVVNVEALKQEGLEFAAKV

SEQ ID NO: 7893 - protein, 435 aa, Hordeum vulgare
MASEKHFKYVILGGGVAAGYAAREFGKQGVQPGELAIISKESVAPYERPALSKGYLFPQNAARLPGFHTCVGSGGEKLLPEWYTQKGIELILSTEIVKADLASKTLTSAAGATFTYETLLIATGSSTIKLTDFGVQGAESNNILYLREIDDADKLVAAMQAKKDGKAVVVGGGYIGLELSAALKINNFDVTMVYPEPWCMPRLFTAGIAHFYEGYYASKGINIVKGTVASGFDADANGDVSVVKLKDGRVLDADMVIVGVGGRPLTGLFKGQVDEEKGGLKTDAFFETSVAGVYAIGDVATFPMKLYDEPRRVEHVDHARKSAEQAVKAIKAKESGESVAEYDYLPYFYSRSFDVAWQFYGDNVGETVLFGDNDPAAAKPKFGTYWVKDGKVIGVFLEGGSADENQAIAKVARAQPPVADVEALAKEGLDFATKI

SEQ ID NO: 7894 - protein, 435 aa, Secale cereale
MASEKHFKYVILGGGVAAGYAAREFGKQGVQPGELAIVSKESVAPYERPALSKGYLFPQNAARLPGFHTCVGSGGEKLLPEWYTEKGIELILSTEIVKADLASKTLTSAAGATFTYETLLIATGSSTIKLTDFGVQGAESNNILYLREIDDADKLVAAMQAKKDGKAVVVGGGYIGLELSAALKINNFDVTMVYPEPWCMPRLFTAGIAHFYEGYYASKGINIVKGTVASGFDAEANGDVSVVKLKDGRVLDADIVIVGVGGRPLTGLFKGQVEEEKGGLKTDTFFETSVAGVYAIGDVATFPMKLYNEPRRVEHVDHARKSAEQAVKAIKAKESGESVTEYDYLPYFYSRSFDVAWQFYGDNVGETVLFGDNDPAAAKPKFGTYWVKDGKVIGVFLEGGSADENQAIAKVARAQPPVADVEALGKEGLDFATKI

SEQ ID NO: 7895 - protein, 435 aa, Triticum aestivum
MASEKHFKYVILGGGVAAGYAAREFGKQGVQPGELAIISKESVAPYERPALSKGYLFPQNAARLPGFHTCVGSGGEKLLPEWYTEKGIELILSTEIVKADLASKTLTSAAGATFTYETLLIATGSSTIKLTDFGVQGAESNNILYLREIDDADKLVAAMQAKKDGKAVVVGGGYIGLELSAALKINNFDVTMVYPEPWCMPRLFTAGIAHFYEGYYASKGINIVKGTVASGFDADANGDVSVVKLKDGRVLDADIVIVGVGGRPLTGLFKGQVEEDKGGLKTDTFFETSVAGVYAIGDVATFPMKLYNEPRRVEHVDHARKSAEQAVKAIKAKESGESVAEYDYLPYFYSRSFDVAWQFYGENVGETVLFGDNDPAVAKPKFGTYWVKDGKVIGVFLEGGSADENQAIAKVARAQPPVADVEALGKEGLDFATKI

SEQ ID NO: 7896 - protein, 433 aa, Sorghum bicolor
MAKHFKYVILGGGVAAGYAAREFAKQGVNPGELAIISKEPVAPYERPALSKGYLFPQNAARLPGFHTCVGSGGERLLPEWYSEKGIELVLSTEIVKADLASKTLTSAAGDTFTYETLLIATGSSVIKLTDFGVQGAESNNILYLRDIADADKLVAAMQAKKDGKAVIVGGGYIGLELSAALKINNFDVTMVYPEPWCMPRLFTAGIAHFYEGYYTNKGIKILKGTVAVGFDADANGDVTKVKLKNGSVLDADIVIVGVGGRPLTGLFKRQVDEEKGGLKTDAFFETSVAGVYAIGDVATFPLKLYNEQRRVEHVDHARKSAEQAVRAIKAKESGESVAEYDYLPYFYSRSFDVAWQFYGDNVGDDVLFGDNDPASAKPKFGSYWVKDGKVVGVFLEGGSAEENQAIAKVARVQPPVADVQALKEQGIEFAAKI

SEQ ID NO: 7897 - protein, 435 aa, Triticum aestivum
MASEKHFKYVILGGGVAAGYAAREFGKQGVQPGELAIISKESVAPYERPALSKGYLFPQNAARLPGFHTCVGGGGEKLLPEWYTEKGIELILSTEIVKADLASKTLTSAAGATFTYETLLIATGSSTIKLIDFGVQGAESNNILYLREIDDADKLVAAMQAKKDGKAVVVGGGYIGLELSAALKINNFDVTMVYPEPWCMPRLFTAGIAHFYEGYYASKGINIVKGTVASGFDADANGDVSVVKLKDGRVLDADIVIVGVGGRPLTGLFKGQVEEEKGGLKTDTFFETSVAGVYAIGDVATFPMKLYDEPRRVEHVDHARKSAEQAVKAIKAKESGESVAEYDYLPYFYSRSFDVAWQFYGDNVGETVLFGDNDPAAPKPKFGTYWVKDGKVIGVFLEGGSADENQAIAKVARAQPPVADVEALGKEGLDFATKI

SEQ ID NO: 7898 - protein, 244 aa, Panicum virgatum
MVFPEPWCMPRLFTADIAAFYEAYYTNKGVKILKGTLAVGFDANANGDVNAVKLKDGTVLEADIVVVGVGGRPLTTLFKGQAAEEKGGIKTDAFFETSVPGVYAIGDVATFPLKMYNELRRVEHVDHARKSAEQAVKAIKGKESGESVPEYDYLPYFYSRSFDLGWQFYGDNVGETILFGDSDPTSSKPKFGSYWIKDGKVLGAFLEGGSPDENKAIAKVAKTQPAVASVEELKKEGLQFASKI

SEQ ID NO: 7899 - protein, 435 aa, Oryza sativa
MAAAKHFTYVILGGGVAAGYAAREFAKQGVKPGELAIISKESVAPYERPALSKGYLFPQNAARLPGFHTCVGSGGERLLPEWYSEKGIELILSTEIVKADLASKTLTSSADATFTYDTLLIATGSSVIKLTDFGVQGAEANDILYLRDIEDADKLVAAMQAKKDGKAVIVGGGYIGLELSAALKTNNFDVTMVYPEPWCMPRLFTSGLAAFYEGYYANKGIHIIKGTVAVGFDADANGDVTAVKLKNGNVLEADIVIVGVGGRPLTHLFKGQVAEEKGGIKTDAFFETSVPGVYAIADVAAFPMKLYNEIRRVEHVDHARKSAEQAVKAIKAKEAGESVPEYDYLPYFYSRSFDLSWQFYGDNVGEDVLFGDNDPTAAKPKFGSYWIKDGKVVGVFLEGGSAEENQVIAKVARAQPPVADVEALKKEGLDFAAKV

SEQ ID NO: 7900 - protein, 436 aa, Panicum virgatum
MAAEAKHFKYVILGGGVAAGYAAREFGKQGVNPGDLAIISKEPVAPYERPALSKGYLFPQNAARLPGFHTCVGSGGERLLPEWYSEKGIELILSTEIVKADLASKTLTSAAGANFTYETLLIATGSSVIKLTDFGVQGAESNNILYLRDIADADKLVAAMQAKKDGKVVIVGGGYIGLELSAALKMNNFDVTMVYPEPWCMPRLFTSGIAHFYEGYYSNKGIKIVKGTVAAGFEADANGDVTAVKLKDGRVLEADIVVVGVGGRPLTALFKGQLAEEKGGLKTDAFFETSVPGVYAIGDVATFPLKLYNEQRRVEHVDHARKSAEQAVRAIKAKESGESVPEYDYLPYFYSRSFDIAWQFYGDNVGDDVLFGDNDPASANHKFGSYWVKDGKVVGVFLEGGSAEENQAIARVARTQPAVADVEALKTEGLEFATKV

SEQ ID NO: 7901 - protein, 435 aa, Triticum aestivum
MASEKHFKYVILGGGVAAGYAAREFGKQGVQPGELAIISKESVAPYERPALSKGYLFPQNAARLPGFHTCVGSGGEKLLPEWYTEKGIELILSMEIVKADLASKTLTSADGATFTYETLLIATGSSTIKLTDFGVQGAESNNILYLREIDDADKLVAAMQAKKDGKAVVVGGGYIGLELSAALKINNFDVTMVYPEPWCMPRLFTAGIAHFYEGYYASKGINIVKGTVASGFDADANGDVSVVKLKDGRVLDADIVIVGVGGRPLTGLFKGQVEEEKGGLKTDTFFETSVAGVYAIGDVATFPMKLYDEPRRVEHVDHARKSAEQAVKAIKAKESGESVAEYDYLPYFYSRSFDVAWQFYGDNVGETVLFGDNDPAAAKPKFGTYWVKDGKVIGVFLEGGSADENQAIAKVARAQPPVDDVEALGKEGLDFATKI

SEQ ID NO: 7902 - protein, 433 aa, Zea mays
MARHFKYVILGGGVAAGYAAREFAKQGVNPGELAIISKEPVAPYERPALSKGYLFPQNAARLPGFHTCVGSGGERLLPEWYSEKGIELILSTEIVKADLASKTLTSAAAETFTYETLLIATGSSVIKLTDFGVQGAESNNILYLRDIADADKLVAAMQAKKGGKAVIVGGGYIGLELSAALKINNFDVTMVYPEPWCMPRLFTAGIAHFYEGYYANKGIKVVKGTVAVGFDADANGDVTTVKLKNGSVLEADIVIVGVGGRPLTRLFIGQAADEKGGLKTDAFFETSVAGVYAIGDVATFPLKLYNEQRRVEHVDHARKSAEQAVRAIKAKESGESVAEYDYLPYFYSRSFDLAWQFYGDNVGDDVLFGDNDPASAKPKFGSYWVKDGKVVGVFLEGGSAEENQAIARVARAQPPVADVQALKQEGIEFASKI

SEQ ID NO: 7903 - protein, 436 aa, Panicum virgatum
MAAEARHFKYVVLGGGVAAGYAAREFGNQGVNPGDLAIISKEPVAPYERPALSKGYLFPQNAARLPGFHTCVGSGGERLLPEWYSEKGIELILSTEIVKADLASKTLTSAAGANFTYETLLIATGSSVIKLTDFGVQGAESNNILYLRDIADADKLVAAMQAKKDGKVVIVGGGYIGLELSAALKMNNFDVTMVYPEPWCMPRLFTSGIAHFYEGYYSNKGIKIVKGTVAAGFEADANGDVTAVKLKDGRVLEADIVVVGVGGRPLTALFKGQLAEEKGGLKTDAFFETSVPGVYAIGDVATFPLKIYNEQRRVEHVDHARKSAEQAVRAIKAKESGESVPEYDYLPYFYSRSFDIAWQFYGDNVGDDVLFGDNDPASANHKFGSYWVKDGKVVGVFLEGGSAEENQAIARVARTQPAVADVEALKTEGLEFATKV

SEQ ID NO: 7904 - protein, 433 aa, Saccharum officinarum
MARHFKYVILGGGVAAGYAAREFAKQGVNPGELAIISKEPVAPYERPALSKGYLFPQNAARLPGFHTCVGSGGERLLPEWYSEKGIELILSTEIVKADLASKTLTSASGDTFTYETLLIATGSSVIKLTDFGVQGAESNNILYLRDIADADKLVAAMQAKKDGKAVIVGGGYIGLELSAALKINNFDVTMVYPEPWCMPRLFTAGIAHFYEGYYTNKGIKIVKGTVAVGFDADANGDVTKVKLKNGSVLDADIVIVGVGGRPLTGLFKGQVDEEKGGLKTDAFFETSVAGVYAIGDVATFPLKLFNEQRRVEHVDHARKSAEQAVRAIKAKESGESVAEYDYLPYFYSRSFDVAWQFYGDNVGDDVLFGDNDPASAKPKFGSYWVKDGKVVGVLLEGGSAEENQAIARVGRAQPPVADVQVLKEEGIEFAAKI

SEQ ID NO: 7905 - protein, 434 aa, Musa acuminata
MAEKHFKYVILGGGVAAGYAAREFAKHGLNPGELAIISKEAVAPYERPALSKGYLFPQGAARLPGFHVCVGSGGERLLPEWYSENGIELILSTEIVKADLASKTLTSAAGATFTYDILIIATGSTVINLSDFGTPGANANNIFYLREIDDADKLVAAIETKKNGKVVIVGGGYIGLELSAVMKMNNFDVTMVYPEPWCMPRLFTSDIAAFYEGYYANKGVKIDKGTLVVGFDSDANGDVTSVKLKDGRVLEADIVVVGVGGRPLTKLFKAQVEEEKGGIKTDWFFQTSVPGVYAVGDVATFPMKLYNDIRRVEHVDHARKSAEQAVKAIKASEEGKVIDEYDYLPYFYSRSFDLSWQFYGDNVGETVMFGDNDPASAKPKFGSYWIKDGKLLGAFLEGGSPDETKTIAKLARLQPQVTDLEQLAKEGLSFASKI

SEQ ID NO: 7906 - protein, 434 aa, Manihot esculenta
MAEKTFKYVIVGGGVAAGYAAREFGKQGVKPGELAIISKEAVAPYERPALSKAYLFPEGTARLPGFHVCVGSGGERLAPEWYKEKGIELILSTEIVEADLATKTLTSAAGEAFKYQILIIATGSTVVKLSDFGVQGADAKNIFYLREIDDADKLVEGIKAKKNGKAVVVGGGYIGLELSAALRINNIDVSMVYPEPWCMPRLFTADIAAFYEGYYANKGVKIIKGTFAVGFNADSNGEVKEVKLKDGRVLEADIVVVGVGAIPLTTLFKGQVAEDKGGIKTDAFFRTSVPDVYAVGDVATFPLKLYNELRRVEHVDHARKSAEQAVKAIKSSEEGETIDEYDYLPYFYSRAFDLSWQFYGDNVGDTVLFRDSDQKSPKPKFGSYWIKDGKVVGAFLEGGSPDENKAIAKVARVQPSVQNLDLLTKEGLSFACKI

SEQ ID NO: 7907 - protein, 434 aa, Curcuma longa
MAEKHFKYVILGGGVAAGYAAREFAKHSLNPGELAIISKEAVAPYERPALSKAYLFPQGAARLPGFHVCVGSGGERLLPEWYLEKGIELILSTEIVKADLASKTLTSAAGATFTFDILIVATGSTVINLSDFGTPGADANNILYLREIDDADKLVATIQAKKNGKAVIVGGGYIGLELSAVMKINNFDVTMVYPEPWCMPRLFTPDIAAFYEGYYANKGVKIDKGTLVVGFDSDTNGDVTSVKLKDGRVLDADIVIVGVGGRPLTKLFKGQVEEEKGGIKTDAFFQTSVAGVYAVGDVATFPLKLYNETRRVEHVDHARKSAEQAVKAIKASEEGKVIDEYDYLPYFYSRSFDLSWQFYGDNVGETVIFGDNDPASSKPKFGSYWIKEGELLGAFLEGGSPEGAKAIAELARLQPAVPDLEQLAKEGLSFASKI

SEQ ID NO: 7908 - protein, 450 aa, Avena sativa
MAAEKHFKYVILGGGVAAGYAAKEFANQGVQPGELAIISKESVAPYERPALSKGYLFPQNAARLPGFHTCVGSGGEKLLPEWYTEKGIELILSTDIVKADLASKTLTSAAGATFTYDTLLIATGSSTIKLTDFGVEGAEANNILYLRDIEDADKLVAAMQAKKDGKAVVVGGGYIGLELSAALKINNFDVTMIYPEPWCMPRLFTAGIAHFYEGYYASKGINIVKGTYASGFDADANGDVSKVKLKDGRVLDADIVIVGVGGRPMTGLFKGQVEEEKGGLKTDTFFETSVAGVYAIGDVASFPMKLYNEPRRVEHVDHARKSAEQAVKAIKGKESGETVAEYDYLPYFYSRSFDIAWQFYGDNVGESVLFGDNDPAAAKAKFGTYWVKDGKVLGVFLEGGSADEYQAIAKVARAQPPVADLEALGKEGLDFAARYEDMKICTFCVCVYVS

SEQ ID NO: 7909 - protein, 434 aa, Musa acuminata
MAEKHFKYVILGGGVAAGYAAREFVKLGLNPGELAIISKESVAPYERPALSKGYLFPQGAARLPGFHVCVGSGGERLLPEWYAEKGIELILGTEIVKADLASKTLTSAADVIIKYDILIIATGSTVIRLSDFGVQGADANNIFYLREIDDADKLVAAIHAKKDGKAVIVGGGYIGLELGAALKINNLDVTMVYPEPWCMPRLFTAGIAAFYEGYYANKGIKIIKGTVAVGFDSDANGDVTAVRLKDGRVLEADIVVVGVGGRPLITLFKGQVEEEKGGIKTDGFFKTSIPDVYAVGDVATFPLKLYNEQRRVEHVDHARKSAEQAVKAIKAVEEGESIEEYDYLPYFYSRSFDLSWQFYGDNVGDTILFGDNDPTSAKPKFGTYWIKEGKVVGVFLESGSLEENKLIAKVAKLQPPVQDPEQLEKEGLAFASKI

SEQ ID NO: 7910 - protein, 434 aa, Humulus lupulus
MAEKSFKYVIVGGGVSAGYAAREFAKQGVKPGELAIISKEAVAPYERPALSKAYLFPESPARLPGFHVCVGSGGERLLPEWYKEKGIELILSTEIVKADLAGKTLVSAAGETFKYQILVIATGSTVIKLSDFGVQGADAKNIFYLREIDDADKLVEAIKTKKNGTAVIVGGGYIGLELGAALRINNLDVTMVYPEPWCMPRLFTADIAAFYEGYYANKGVKIIKGTVATGFSSNANGEVTEVKLKDGRVLEADIVVVGVGGRPLTTLFKGQVEEEKGGIKTDAFFKSSVPDVYAVGDVATFPLKLYNENRRVEHVDHSRKSAEQAVKAIKASEEGKSVEEYDYLPYFYSRSFDLAWQFYGDNVGETVLFGDNNPELPKAKFGTYWIKDGKVIGAFLEGGNPEENSAIAKVAKLQPPVESLDQLKKEGLTFASKI

SEQ ID NO: 7911 - protein, 434 aa, Gossypium hirsutum
MAEKSFKYVILGGGVAAGYAAREFAKQGVQPGELAIISKEAVAPYERPALSKAYLFPEGAARLPGFHVCVGSGGERLLPEWYKEKGIELILSTEIVKADLPANTLVSAAGETFKYQILIIATGSTVIKLTDFGVQGADAKNIFYLREIDDADKLVEAIKAKKNGKAVIVGGGYIGLELGAALKINNLDVSMVYPEPWCMPRLFTSGIAAFYEGYYANKGIKIIKGTVAVGFTSDSNGEVKEVQLKDGRVLEADIVVVGVGGRPLTALFKGQVEEETGGIKTDAFFKTSVPTVYAVGDVATFPLKLYNELRRVEHVDHARKSAEQAVKAIKGLEKGQSVDEYDYLPYFYSRSFDLAWQFYGDNVGDTVLFGDNNPQSPKPKFGSYWIKDGKVVGAFLEGGSAEENQAIAKVAKLQPKAENLDALAKEGLPFACKI

SEQ ID NO: 7912 - protein, 434 aa, Elaeis guineensis
MAAKHFKYLILGGGVAAGYAAREFAKQGVKPGELAVISKEAVAPYERPALSKAYLFPQGTARLPGFHVCVGSGGERLLPEWYTEKGIELILSTEIVKADVASKTLTSASGAAFTYDILIIATGSTVIRLSDFGVQGADANNIFYLREIDDADKLVAAIQAKKNGKAVIVGGGYIGLELGAALRINNLDVTMVYPEPWCMPRLFTSGIAAFYEGYYAIKGIKIIKGTVAVGFDSNANGDVTAVKLKDGRVLDADIVVVGVGGRPLAALFKGQVVEEKGGIKTDGFFRTSVPGVYAVGDVATFPLKLYYEMRRVEHVDHARKSAEQAVKAIKASEEGKDIEEYDYLPYFYSRAFDLSWQFYGDNVGDTVLFGDNNPASAKPKFGSYWIKDGKVVGAFLEGGSAEENKAIAKVAKVQPPAGDLEQLTKEGLTFACKI

SEQ ID NO: 7913 - protein, 435 aa, Brachypodium distachyon
MASEKHFKYLVLGGGVAAGYAAREFAKHGLQPGELAIISKESVAPYERPALSKGYLAPQNAARLPGFHTCVGSGGEKLLPEWYADKGIELILSTEIVKADLATKTLTSADGATFICEILLIATGSSTIKLTDFGVQGAESNNILYLRDIEDADKLVAAMQAKKDGKAVVVGGGYIGLELGAALKTNNFDVTMVYPEPWCMPRLFTAGIAHFYEGYYASKGINIVKGTVASGFDADANGDVSKVNLKDGRVLDADIVIVGVGGRPLTGLFKGQVEEEKGGLKTDTFFETSVAGVYAIGDVATFPMKLYNEPRRVEHVDHARKSAEQAVKAIKAKETGETAAEYDYLPYFYSRSFEVAWQFYGDNVGETVLFGDNDPATEKAKFGTYWVKDGKVIGVFLEGGSAEENQAIAKVARAQPPAADLEALSKEGLDFASKI

SEQ ID NO: 7914 - protein, 434 aa, Gossypium hirsutum
MAEKSFKYVILGGGVAAGYAAREFAKQGVHPGELAIISKEAVAPYERPALSKAYLFPEGAARLPGFHVCVGSGGERLLPEWYKEKGIELILSTEIVKADLPANTLVSATGETFKYQILIIATGSTVIKLTDFGVQGADAKNIFYLREIDDADKLVEAIKAKKNGKAVIVGGGYIGLELGAALKINNLDVSMVYPEPWCMPRLFTSGIAAFYEGYYANKGIKIIKGTVAVGFTSNSNGEVKEVQLKDGRVLEADIVVVGVGGRPLTALFKGQVEEEKGGIKTDAFFKTSVPTVYAVGDVATFPLKLYNELRRVEHVDHARKSAEQAVKAIKGLEKGQSVDEYDYLPYFYSRSFDLAWQFYGDNVGDTVLFGDNNPQSPKPKFGSYWIKDGKVVGAFLEGGSAEENQAIAKVAKLQPKAENLDALTKEGLAFACKI

SEQ ID NO: 7915 - protein, 434 aa, Gossypium raimondii
MAEKSFKYVILGGGVAAGYAAREFAKQGVHPGELAIISKEAVAPYERPALSKAYLFPEGAARLPGFHVCVGSGGERLLPEWYKEKGIELILSTEIVKADLPANTLVSATGETFKYQILIIATGSTVIKLTDFGVQGADAKNIFYLREIDDADKLVEAIKAKKNGKAVIVGGGYIGLELGAALKINNLDVSMVYPEPWCMPRLFTSGIAAFYEGYYANKGIKIIKGTVAVGFTSDSNGEVKEVQLKDGRVLEADIVVVGVGGRPLTALFKGQVEEETGGIKTDAFFKTSVPTVYAVGDVATFPLKLYNELRRVEHVDHARKSAEQAVKAIKGLEKGQSVDEYDYLPYFYSRSFDLAWQFYGDNVGDTVLFGDNNPQSPKPKFGSYWIKDGKVVGAFLEGGSAEENQAIAKVAKLQPKAENLDALAKEGLAFACKI

SEQ ID NO: 7916 - protein, 434 aa, Cannabis sativa
MAEKSFKYVIVGGGVSAGYAAREFAKQGVKPGELAIISKEAVAPYERPALSKAYLFPDSPARLPGFHVCVGSGGERLLPEWYKEKGIELILSTEIVKADLAGKTLVSAAGETFKYQILVIATGSTVIKLTDFKVQGADAKNIFYLREIEDADTLVEAIKAKKNGTAVIVGGGYIGLELGAALRINNLDVTMVYPEPWCMPRLFTSEIAAFYEGYYANKGVKIIKGTVATGFSSNANGEVTEVKLKDGRVLEADIVVVGVGGRPLTTLFKGQVEEEKGGIKTDAFFKSSVPDVYAVGDVATFPLKLYNENRRVEHVDHSRKSAEQAVKAIKASEEGKSVEEYDYLPYFYSRSFDLAWQFYGDNVGETVLFGDNNPETPKAKFGTYWIKDGKVIGAFLEGGNPEENSAIAKVAKLQPPVESLDQLKKEGLTFASKI

SEQ ID NO: 7917 - protein, 434 aa, Gossypium raimondii
MAEKSFKYVILGGGVAAGYAAREFAKQGVQPGELAIISKEAVAPYERPALSKAYLFPEGAARLPGFHVCVGSGGERLLPEWYKEKGIQLILSTEIVKADLPAKTLVSAAGETFKYQILIIATGSTVIRLTDFGVEGADAKNIFYLREIDDADKLLEAIKAKKNGKAVIVGGGYIGLELAAVMKINNFDVTMVYPEPWCMPRLFTPDIAAFYEEYYANKGVKIIKGTVAVGFTSDSNGEVKEVKLKDGRALEADIVVVGVGGRPLTTLFKGQVEEEKGGIKTDAFFETSVPNVYAVGDLATFPLKLYNELRRVEHVDHARKSAEQAVKAIKASEEGKSVDEYDYLPYFYSRSFDLSWQFYGDNVGDTVLFGDSNPKSPKAKFGSYWIKDGKVVGAFLEGGTAEENQAIAKVAKLQPSVQSLEAVKHEGLSFACKI

SEQ ID NO: 7918 - protein, 434 aa, Populus trichocarpa
MAEKSFKYVIIGGGVSAGYAAREFCKQGVKPGELAIISKEAVAPYERPALSKAYLFPEGTARLPGFHVCVGSGGERLLPEWYKEKGIELILSTEIVKADLAAKTLVSAAGEIFKYHILIIATGSTVIKLTDFGVQGADAKNILYLREIDDADKLVEAIKGKKNGKAVIVGGGYIGLELSAALRINNIDVTMVYPEPWCMPRLFTAGIAAFYEGYYANKGVKIVKGTVAVGFNADSNGEVKEVKLKDGRVLEADIVVVGVGGRPLTTLFKGQVEEEKGGIKTDAFFKTSISDVYAVGDVATFPLKLYNDIRRVEHVDHARKSAEQAVKAIKSNEEGKTIDVYDYLPFFYSRSFDLSWQFYGDNVGDAVLFGDNDPASPKPKFGSYWIKDGKVVGVFLEGGTPDENKAIAKVARVQPPVENLDVLTKEGLSFACKI

SEQ ID NO: 7919 - protein, 434 aa, Gossypium hirsutum
MAEKSFKYVILGGGVAAGYAAREFAKQGVQPGELAIISKEAVAPYERPALSKAYLFPEGAARLPGFHVCVGSGGERLLPEWYNEKGIQLILSTEIVKADLPAKTLVSAAGETFKYQILIIATGSTVIRLTDFGVEGADAKNIFYLREIDDADKLLEAIKAKKNGKAVIVGGGYIGLELAAVMKINHFDVTMVYPEPWCMPRLFTPDIAAFYEEYYANKGVKIIKGTVAVGFTSDSNGEVKEVKLKDGRALEADIVVVGVGGRPLTTLFKGQVEEEKGGIKTDAFFETSVPNVYAVGDLATFPLKLYNELRRVEHVDHARKSAEQAVKAIKASGEGKSVDEYDYLPYFYSRSFDLSWQFYGDNVGDTVLFGDSNPKSPKAKFGSYWIKDGKVVGAFLEGGTAEENQAIAKVAKLQPSVQSLEAVKHEGLSFACKI

SEQ ID NO: 7920 - protein, 206 aa, Fraxinus spp
MAEKSFKYVIVGGGVAAGYAAREFAKQGVKPGELAIISKEAVAPYERPALSKAYLFPEGTARLPGFHVCVGSGGERLLPEWYTEKGISLILSTEIVKADLSSKTLTSAAGETFKYQILIIATGSSVIKLSDFGVQGADAKNIFYLREIDDADKLVEAIKAKKNGKAVVVGGGYIGLELSAALRVNNIDVTMVYPEPWCMPRLSQLA

SEQ ID NO: 7921 - protein, 434 aa, Eschscholzia californica
MADKHFKYVILGGGVSAGYAAKEFAKQGVKPGELALISKEAVAPYERPALSKAYLFPEAPARLPGFHVCVGSGGERLLPEWYTQKGIELILSTEIVKADLASKTLTSAAGATFKYEVLVIATGSTVIRLTDFGVQGADAKNILYLREIDDADKLIEVIKAKKNGKAVIVGGGYIGLELGAVMQINNLDVTMVYPEPWCMPRLFTSGIAAFYEGYYANKGIKIIKGTVAVGFDSDANGEVKAVKLKDGRVLDADIVIVGVGGRPLTTLFKGQVEEEKGGIKTDTFFKTSVPDVYAVGDVATFPLKLYNEMRRVEHVDHARKSAEQAVKAIKAAEEGKTTEVYDYLPYFYSRSFDLSWQFYGDNVGETVLYGDSDPSSAKPKFGSYWIKDGKVVGAFLEGGTPEENKAIAKVARVQPSVENVDQLAKEGLTFASKI

SEQ ID NO: 7922 - protein, 433 aa, Glycyrrhiza uralensis
MAKTFKYVILGGGVSAGYAAREFAKQGVKPGELAIISKEAVAPYERPALSKAYLFPESPARLPGFHVCVGSGGERLLPEWYQEKGIELILGTEIVKADLAAKSLTSAGGETFNYQILVIATGSSVIRLTDFGVQGADAKNIFYLREVDDADKLYEAIKAKKSGKAVVVGGGYIGLELSAVLRLNGIDVTMVYPEPWCMPRLFTAGIAAFYEGYYANKGVNIIKGTVAVGFTANSNGEVKEVKLKDGRVLEADIVAVGVGGRPLTSLFKGQVEEEKGGIKTDSFFKTNVPGVYAVGDVATFPLKLYGELRRVEHVDHARKSAEQAVKAIKAAEDGKTVEEYDYLPYFYSRSFDLSWQFYGDNVGETVLFGDSDPASSKPKFGTYWIKDGKVIGAFLESGTPDENKAIAKVARVQPAVEDADQLAKEGLSFASKI

SEQ ID NO: 7923 - protein, 434 aa, Tabernaemontana elegans
MSEKSFKYVILGGGVAAGYAAREFAKQGVKPGELAIISKEAVAPYERPALSKAYLFPEGTARLPGFHVCVGSGGERLLPEWYTEKGISLILSTDIVKADLPSKTLTSAAGETFKYQILIIATGSTVIRLSDFGVQGADAKNIFYLREIDDADKLVEAIKAKKNGKAVVVGGGYIGLELSAALKINNIDVSMVYPEPWCMPRLFTADIAAFYEGYYANKGIKIIKGTVAVGFGTHENGEVKDVKLKDGRVLEADIVVVGVGGRPLVTLFKGQVEEEKGGIKTNAFFKTNLPDVYAVGDVATFPLKLYNELRRVEHVDHARKSAEQAVKAIFASEQGKPVDEYDYLPYFYSRAFDLSWQFYGDNVGDSVIFGDSDPTSSSHKFGSYWIKDGKVVGAFLESGTPDENKAIAKVARVQPPASSLAELGKEGITFAAKI

SEQ ID NO: 7924 - protein, 434 aa, Theobroma cacao
MAEKCFKYVILGGGVAAGYAAREFAKQGVQPGELAIISKEAVAPYERPALSKGYLFPEGAARLPGFHVCVGSGGERLLPEWYKEKGIELILSTEIVKADLPANTLVSAAGETFKYQILIIATGSTVIRLTDFGVQGADAKNIFYLREIDDADELIEAIKAKKNGKAVIVGGGYIGLELGAAMKINNFDVNMVYPEPWCMPRLFTSGIAAFYEGYYANKGIKIIKGTVAVGFTSDSNGEVKEVKLKDGRVLEADIVVVGVGGRPLTTLFKGQVEEEKGGIKTDACFKTSVPNVYAVGDVATFPMKLYNDMRRVEHVDHARKSAEQAVKAIKASEEGKSVDEYDYLPFFYSRSFDLAWQFYGDNVGDTVLFGDNDPQSPKAKFGSYWIKEGKVIGAFLEGGSAEENQAIAKVAKLQPTVGDLEALTNEGLSFACKI

SEQ ID NO: 7925 - protein, 434 aa, Gossypium hirsutum
MAEKSFKYVILGGGVAAGYAAREFAKQGVQPGELAIISKEAVAPYERPALSKAYLFPEGAARLPGFHVCVGSGGERLLPEWYKEKGIQLILSTEIVKADLPAKTVVSAAGETFKYQILIIATGSTVIRLTDFGVEGADAKNIFYLREIDDADKLLEAIKAKKNGKAVIVGGGYIGLELAAVMKINNFDVTMVYPEPWCMPRLFTPDIAAFYEEYYANKGVKIIKGTVAVGFTSDSIGEVKEVKLKDGRALEADIVVVGVGGRPLTTLFKGQVEEEKGGIKTDAFFKTSVPNVYAVGDLATFPLKLYNELRRVEHVDHARKSAEQAVKAIKASEEGKSVDEYDYLPYFYSRSFDLSWQFYGDNVGDTVLFGDSNPKSQKAKFGSYWIKDGKVVGAFLEGGTAEENQAIAKVAKLQPSVQSLEAVKHEGLSFACKI

SEQ ID NO: 7926 - protein, 434 aa, Vitis vinifera
MAEKHFKYVILGGGVSAGYAAREFAKQGVKPGELAIISKEAVAPYERPALSKAYLFPEGAARLPGFHVCVGSGGERLLPEWYKEKGIELILSTEIVKADLASKTLISAAGETFKYHILIIATGSTVIRLTDFRVEGADAKNILYLREIDDADKLIDVIKAKKNGKAVIVGGGYIGLELSAVMKINNLDVCMVYPEPWCMPRLFTAGIAAFYEGYYANKGIKIIKGTVAVGFTSDANGEVKEVKLKDGRVLEADIVVVGVGGRPLTTLFKGQVEEEKGGIKTDEFFKTSVPDVYAVGDVATFPLKLYNEIRRVEHVDHARKSAEQAVKAIKASEEGKSVEEYDYLPYFYSRAFDLSWQFYGDNVGETVLFGDNNPASPKAKFGTYWIKDGKVVGAFLEGGTPEENTAIAKVARLQPAVENLDQLTNEGLTFACKI

SEQ ID NO: 7927 - protein, 434 aa, Quercus alba
MAAKSFKYVIVGGGVSAGYAAREFAKQGVKPGELAIISKEAVAPYERPALSKAYLFPESPARLPGFHVCVGSGGERLLPEWYKEKGIELILSTEIVKADLAAKTLISAAGETFNYQILIIATGSSVIRLTDFGVQGADAKNIYYLREVDDADKLVEAIKAKKNGKVVIVGGGYIGLELSAVMKINNLDVKMVYPEPWCMPRLFTADIAAFYEGFYKNKGIQIIKGTVAVGFTADSNGEVKEVKLKDGRVLEADIVVVGVGGRPLTTLFKGQVEEEKGGIKTDSFFKTSVPNVYAVGDVATFPLKLYKELRRVEHVDHSRKSAEQAVKAIKASEEGKTIEEYDYLPFFYSRSFDLSWQFYGDNVGDTVIFGDNNPETPKPKFGSYWIKDGKVLGAFLEGGTPEENKAIAKVARVQPPVENLDVLSKEGLSFACKI

SEQ ID NO: 7928 - protein, 434 aa, Olea europaea
MAEKSFKYVIVGGGVAAGYAAREFAKQGVKPGELAVISKEAVAPYERPALSKAYLFPEGTARLPGFHVCVGSGGERLLPEWYAEKGISLILSTEIVKADLSSKTLASAAGETFKYQILIIATGSTVIKLSDFGVQGADAKNIFYLREIDDADKLVEAIKAKKNGKAVVVGGGYIGLELSAALRVNNIDATMVYPEPWCMPRLFTAGIAAFYEGYYANKGVKIIKGTVAVGFGTNENGEVTDVKLKDGRVLEADIVVVGVGGKPLATLFKGQVEEEKGGIKTDAFFKTSVPDVYAVGDVATFPLKLYGELRRVEHVDHARKSAEQAVKAIFASEQGKSVDEYDYLPFFYSRAFDLSWQFYGDNVGETVLFGDSSPTSTTHKFGSYWIKDGKVVGAFLESGTPEENKAIAKVARVQPLAQNLDQLATEGLNFASKI

SEQ ID NO: 7929 - protein, 432 aa, Platanus occidentalis
MAETHFKYVIVGGGVAAGYAAREFAKQGVKPGELAVISKEAVAPYERPALSKAYLFPEGAARLPGFHVCVGSGGERLLPGWYTEKGIELILSTEIVKADLASKILISAAGAIYNYEILIIATGSTVIRLSDFGVQGADAKNIFYLREIDDADKLIEAIKAKKNGKAVIVGGGYIGLELGAVMKINNFDVTMVYPEPWCMPRLFTAGIAAFYEGYYANKGIKIVKGTVAVGFDSDANGEVKAVKLKDGRVLDADIVVVGVGGRPLTTLFKGQVEEEKGGIKTDGFFKTSVPSVYAIGDVATFPMKLYNEMRRVEHVDHARKSAEQAVKAIMAEGKFIDEYDYLPYFYSRSFDLSWQFYGDNVGDTVMFGDSDPTSPKPKFGSYWIKDGKIVGVFLEAGTPDENKAIAKVARLQPPVENVDQLTKEGVSFACKI

SEQ ID NO: 7930 - protein, 434 aa, Amsonia hubrichtii
MAEKSFKYVILGGGVSAGYAAREFAKQGVKPGELAIISKEAVAPYERPALSKAYLFPEGTARLPGFHVCVGSGGERLLPEWYTEKGILLILSTEIVKADLPSKTLTSAAGETFKYQILIIATGSTVIKLSDFGVQGADAQNIFYLREIDDADKLVEAIKAKKNGKAVVVGGGYIGLELSAALRVNNYDVSMVYPEPWCMPRLFTAGIAAFYEGYYANKGIKIIKGTVAVGFGTHENGEVKDVKLKDGRVLEADIVVVGVGARPLTTLFKGQVEEEKGGIKTDAFFKTNLPDVYAVGDVATFPMKLYHEIRRVEHVDHSRKSAEQAVKAIFASEQGKSIDEYDYLPFFYSRSFDLSWQFYGDNVGDTVLFGDNDPTSSSHKFGSYWIKDGKVVGAFLESGTPEENKAIAKVARVQPPANSLDELAKEGLTFASKI

SEQ ID NO: 7931 - protein, 434 aa, Manihot esculenta
MAEKSFKYVIVGGGVAAGYAAREFGNQGVKSGELAIISKEAVAPYERPALSKAYLFPEGTARLPGFHVCVGSGGERLAPEWYKEKGIELILSTEIVKADLATKTLTSAAGETFKYQILIIATGSTVIRLTDFGVQGADSKNIFYLREIDDADKLVEVIKAKKDGKAVIVGGGYIGLELSAALRINNIDVTMVYPEPWCMPRLFTAELAAFYEGYYANKGINIIKGTVAAGFTADSNGEVKEVKLKDGRVLEADIVVVGVGGRPLTALYKGQVEEEKGGIKTDAFFRTSVPDVYAVGDVATFPLKLYNELRRVEHVDHARKSAEQAVKAIKSSEEGKTIDEYDYLPYFYSRAFELSWQFYGDNVGESVFFGDSDPKAPKPKFGSYWIKDGKVVGAFLEGGSPDENKAIAKVARVQPSIQNLDQLTKEGLSFACNI

SEQ ID NO: 7932 - protein, 434 aa, Castanea mollissima
MAAKSFKYVIVGGGVSAGYAAREFAKQGVKPGELAIISKEAVAPYERPALSKAYLFPESPARLPGFHVCVGSGGERLLPEWYKEKGIELILSTEIVKADLAAKTLISAAGETFNYQILIIATGSSVIRLTDFGVQGADAKNIYYLREIDDADKLIEAIKAKKNGKVVIVGGGYIGLELSAVMKINNLDVSMVYPEPWCMPRLFTAGIAAFYEGFYKNKGIEIIKGTVAVGFTADSNGEVKEVKLKDGRVLKADIVVVGVGGRPLTTLFKGQVEEEKGGIKTDAFFKTSVPNVYAVGDVATFPLKLYKELRRVEHVDHSRKSAEQAVKAIKASEEGKTTEEYDYLPFFYSRSFDLSWQFYGDNVGDTVIFGDNNPESPKPKFGSYWIKDGKVFGAFLEGGTPEENKAIAKVARVQPPVQNLDVLSKEGLSFACKI

SEQ ID NO: 7933 - protein, 434 aa, Euonymus alatus
MAAKIFKYVILGGGVAAGYAAREFAKLGVKLGELAVISKELVAPYERPALSKAYLFPVGTARLPGFHVCVGSGGERLLPEWYKEKGIELILGTEIVKADLAAKTLVSAAGETFEYSTLIIATGSTVIRLSDFGVKGADAKNIFYLREIDDADKLVEAIKAKKNGKAVIVGGGYIGLELSAALKINDLDVTMVYPEPWCMPRLFTADIAAFYEGYYANKGVKIIKGTVAVGFTADSVGEVKEVQLKDGRVLEADIVIVGVGGRPLTTLFKGSVEEEKGGIKTDAFFKTSVPDVYAVGDVATFPMKLYNDIRRVEHVDHARKSAEQAVKAIKAKEEGKQIEEYDYLPFFYSRAFDLSWQFYGDNVGDTVLFGDNSPTSPKPKFGSYWIKDGKVVGAFLEGGSPDENKAIAKVARLKPPVDSLVELRKEGLSFACKI

SEQ ID NO: 7934 - protein, 434 aa, Utricularia gibba
MAEKFFKYVIIGGGVAAGYAAREFAKQGVNPGTLAIISKEAVAPYERPALSKAYLFPEGPARLPGFHVCVGSGGERLLPEWYSEKGISLILSTEIVKADLATKTLISAAGETFKYQILLIATGSSVIRLTDFGVQGADAKNIFYLREIEDADALIEGIKAKKNGKAVIVGGGYIGLELSAVLRINNVDVTMVYPEPWCMPRLFTADIAAFYETYYENKGVNIIKGTVAVGFGTNENGEVTDVKLKDGRVLEADIVVVGVGGRPLTTLFKGQVEEEKGGIKTDGFFKTSVPDVYAVGDVATFPLKLYNELRRVEHVDHARKSAEQAVKAIFSADTGAQIDEYDYLPYFYSRSFDLSWQFYGDNVGDTVLFGDNSPTSPTHKFGTYWIKDGKVIGAFLESGTPEENKAIAKVAKLQPPVASADQLAAEGLSFASKI

SEQ ID NO: 7935 - protein, 434 aa, Valeriana officinalis
MAEKVFKYIIVGGGVSAGYAAREFAKQGVKPGELAIISKEAVAPYERPALSKAYLFPEGAARLPGFHVCVGGGGERLLPEWYPQNGISLILSTEIVKADLSSKSLTSAAGETFKYEILIIATGSTVFRLTDFGVQGADAKNIYYLREIDDADKLVEAIKGKKNGKAVIVGGGYIGLELSAVMKINNYDVTMVFPEPWCMPRLFTAEIAAFYESYYANKGVKIIKGTVAVGFTADANGEVKEVKLKDGSVLEADIVVVGVGGRPLTTLFKGQVEEEKGGIKTDGFFKTSVPGVYAVGDVATFPLKLYNEIRRVEHVDHARKSAEQAVKAIFASEQEKTIEEYDYLPYFYSRSFTLSWQFYGDNVGDAVIFGDSNPTSENPKFGSYWVKDGKVVGVFLENGTPDENKAIAKVARAQPPAASLDQLAQDGLSFASKI

SEQ ID NO: 7936 - protein, 389 aa, Populus trichocarpa
MEEAVVVNKGDDQIHLPAGFRFHPTDEEIISHYLTEKVMKSGFCAIAIGEVDLNKCEPWDLPKKAKMGENEWYFFCQRDRKYPTGMRTNRATESGYWKATGKDKEIHKEKNCLVGMKKTLVFYRGRAPKGEKTNWVMHEYRLEGKFSYYSLPKVARDEWVVCRIFHKSTGMKKTSIHDLLRMNSFGDDFLDCSSLPPLMDPPNYTSSFSDADNNEFKAMMTSRSSDGNYFSNTSMLNNNQGFVQPPNTNYQTPNSSFHLQTPASNPLYTFQTNPNMPVYLQQGKSTNSFPNFQNSTFGNNGQTLLRALAAGNNYGEASDQLGKQCKVEQFSSNQSMVSLSQDTGLSTDVNTTTEISSVVSKQEIGSHNEFYESLEDPLAGPIADYMWDY

SEQ ID NO: 7937 - protein, 389 aa, Populus trichocarpa
MEEAVVVNKGDDQIHLPAGFRFHPTDEEIISHYLTEKVMKSGFCAIAIGEVDLNKCEPWDLPKKAKMGENEWYFFCQRDRKYPTGMRTNRATESGYWKATGKDKEIHKEKNCLVGMKKTLVFYRGRAPKGEKTNWVMHEYRLEGKFSYYSLPKVARDEWVVCRIFHKSTGMKKTSIHDLLRMNSFGDDFLDCSSLPPLMDPPNYTSSFSDADNNEFKAMMTSRSSDGNCFSNTSMLNNNQGFVQPPNTNYQTPNSSFHLQTPASNPLYTFQTNPNMPVYLQQGKSTNSFPNFQNSTFGNNGQTLLRALAAGNNYGEASDQLGKQCKVEQFSSNQSMVSLSQDTGLSTDVNTTTEISSVVSKQEIGSHNEFYESLEDPLAGPIADYMWDY

SEQ ID NO: 7938 - protein, 507 aa, Theobroma cacao
MATQSLFLANPPSILLASSSIYIKGEEQWLGCLPLKRKQMHIRLSNGYRVRARSALNADSTAIEIPRQWYNLIADLSVKPPPPLHPKTCEPVKPEDLSPLFPDELIKQEATNERFIDIPDEVLDIYRLWRPTPLIRAKRLEKLLNTPARIYYKYEGVSPAGSHKPNTAVPQVFYNAQQGIKNVVTETGAGQWGSSLAFACSLFGLGCEVWQVRASYDQKPYRKLMMQTWGAKVHPSPSDITEAGRKILQMDPSSPGSLGIAISEAVEVAATNDDTKYCLGSVLNHVLLHQTVIGEECIRQMEAIGETPDLIIGCTGGGSNFAGLSFPFIREKLSGKINPVIRAVEPTACPSLTKGVYAYDFGDTAGMTPLMKMHTLGHDFIPDPIHAGGLRYHGMAPLISHVYELGFVEAVSIPQNECFQGAIQFARSEGLIPAPEPTHAIAATIREALRCRATGEPKVILMAMCGHGHFDLTSYEKYLQGDMVDLSFEEEKIKESLAKIPRVTGMS

SEQ ID NO: 7939 - protein, 884 aa, Manihot esculenta
MYVTRPLSLYRKFPSALSAEPPEGPYTGYLVITDEESETQDTYCFGACKKRRVKRLPFPQDNILNVIHSSEYHETILARKKVWFLPVLDQPLSSNCYYVIKAKGRYKGQAFTCSRDDDMGLLCCLKKVIKDVKPKPLDPRNIYQQFKIHRHYGRSFFAKSLAPYGYPPELLRNKGWEVRISSSSTHKFQPRIDDALGLDESLRTQLPSFNFPISSKSSSSVIVGTWYCPFVFIREEARIREQMKRSMLYKMTLEQYWEEIFSCDNVNNETNTVIVVDTNVQREVDKVFDMEAEKGERTGRGAFIWYRAVGNRNRRICRGFRVGLSFAIAEKMKWVLEAGGWADGPERTVRVGGRIEIGSEGDGLQIRSQDRKEGSLETSEMIPLSPSSAISFPISSRSNTSIRGEKQWLGCFLMKTKPTCLRLSNGFRARAKAASNANWKAIDIPPQWYNLISDLPVKPPPQLHPKTFEPVKPEDLAALFPDELIKQEATNEKFIDIPEEVLDIYSLWRPTPLIRAKRLEKLLNTPAKIYYKYEGVSPAGSHKPNTAVPQVFYNARQGVKNVVTETGAGQWGSSLAFACSLFGLDCEVWQVRASYDQKPYRRLMMETWGAKVHPSPSSITHAGREILQKDPSSPGSLGIAISEAVEVAARNTDTKYCLGSVLNHVLLHQTIIGEECLKQMEAVGETPDVIIGCTGGGSNFAGLSFPFIREKLSGKINPVIRAVEPTACPSLTKGVYAYDYGDTAGMTPLMKMHTLGHDFIPDPIHAGGLRYHGMAPLISHVYELGFMEAIAIPQTECFQAALQFARSEGLIPAPEPTHAIAATIREALHCRETGEAKVILMAMCGHGHFDLTSYEKYLRGNMVDLSFEEEKIQASLARVPQVKA

SEQ ID NO: 7940 - protein, 891 aa, Citrus clementina
MYVTRPLSLYRNSPSTLSAELPPQEGPYSGILLITDEEAEAEDTFCWGTCKLRGVKRLPFPQDKILTVVHSNDYQETSVTKVWFLPVLDQPLSSNRYYVIRAKGKYKGKTCKSSRETEVGMCCFSNVIKDMKPKPFDFRNIYQQFKVHRYHRHSFFATSAATTDGLPPKFLRKKGWELRSSSSSSRSFLRRWNNDKLSEALGLDISLRTQLPSLNFPITNKRSSVSIVGKWYCPFVFVREESRIRHQMRKSVLYKMTLQQWWEKIFSCVNNGGDDANEVNVNVNVQREASYVYGKQGERDDRGRHLGFVGYRVCDRNRRRRRWSRGGGGGVVGLSLAIDEKMRWLQEEGGWVRGREKELRVSRVEEIAGENGWQRFASQDNCRNFLKMAAQSLLYANLNPLLISGSTGNQIKAREQFLGSFPLKAKTTRPRLSNGCRARAAANAVALPVEIPCQWYNVIADLSVKPPPPLHPKTFEPVKPEDLSPLFPDELIKQEASTDRFIDIPDEVLDIYRLWRPTPLIRAKRLEKILDTPARIYYKYEGVSPAGSHKPNTAVPQVYYNAQEGIKNVVTETGAGQWGSSLAFACSLFGLNCEVWQVRASYDQKPYRRLMMQTWGAKVHPSPSDITEVGRKILQMDPSSPGSLGIAISEAAEVAAANADTKYCLGSVLNHVLLHQTVIGEECIKQMEAVGETPDIIIGCTGGGSNFGGLSFPFIREKLNGKINPVIRAVEPTACPSLTKGVYAYDFGDTAGMTPLMKMHTLGHDFIPDPIHAGGLRYHGMAPLLSHVYELGLMEAISIPQTECFQGAIQFARTEGIIPAPEPTHAIAATIREALRCKETGEAKVILTAMCGHGHFDLASYENYLQGKMVDLSFEEKKIQESLDKIPRVIA

SEQ ID NO: 7941 - protein, 504 aa, Eucalyptus grandis
MASCSLLSADSAAAIFCSRTQSNGEKTGQGSFVLRTKLNHQRAYGSRASVRASLSASLKPTEIPHQWYNLVADLPVKPPPPLNPRTFQPVKPEDLSPLLPDELIKQEASLDRFIDIPDEVRDIYQLWRPTPLIRAKRLEKLLDTPARIYYKYEGGSPAGSHKPNTSVPQVWYNAQEGVKKVVTETGAGQWGSALAFSCSLFGLDCEVWQVRASYDQKPYRRLMMQTWGAKVHPSPSEITEAGRKILQEDPSSPGSLGIAISEAVEVAANNADTKYCLGSVLNHVLLHQTVIGEECIKQMEAIGETPDIIVGCTGGGSNFAGLSFPFIREKLKGNIKPIIRAVEPTACPSLTKGVYAYDYGDTAGMTPLMKMHTLGHDFIPDPIHAGGLRYHGMAPLISHVYELGLMEAIAIPQIECFQGAIQFARSEGIIPAPEPTHAIAATIREALLCRESGESKVILTAMCGHGHFDLAAYEKYLQGDMVDLSFSEEKIHASLAKVPRVIRD

SEQ ID NO: 7942 - protein, 469 aa, Citrus sinensis
LKAKTTRPRLSNGCRVRAAATAVALPVEIPCQWYNVIADLSVKPPPPLHPKTFEPVKPEDLSPLFPDELIKQEASTDRFIDIPDEVLDIYRLWRPTPLIRAKRLEKILDTPARIYYKYEGVSPAGSHKPNTAVPQVYYNAQEGIKNVVTETGAGQWGSSLAFACSLFGLNCEVWQVRASYDQKPYRRLMMQTWGAKVHPSPSDITEAGRKILQMDPSSPGSLGIAISEAAEVAAANADTKYCLGSVLNHVLLHQTVIGEECIKQMEAVGETPDIIIGCTGGGSNFGGLSFPFIREKLNGKINPVIRAVEPTACPSLTKGVYAYDFGDTAGMTPLMKMHTLGHDFIPDPIHAGGLRYHGMAPLLSHVYELGLMEAISIPQTECFQGAIQFARTEGIIPAPEPTHAIAATIREALRCKETGEAKVILTAMCGHGHFDLASYEKYLQGKMVDLSFDEKKIQEALDKIPQVIA

SEQ ID NO: 7943 - protein, 499 aa, Tabernaemontana elegans
MAQSLFLATSVCSKITSRGEEQLFGGPKLKIKTSNLKISSGRKVGITAAYNTNTKATEIPHQWYNIVADLPVKPPPPLHPKTFEPVKPEDLSPLFPEELIKQEASYEQYIDIPEEVLDIYKLWRPTPLIRAKRLEKLLDTPARIYYKYEGVSPAGSHKANTSVPQVWYNAQEGVKNVVTETGAGQWGSALAFACSLFGLNCEVWQVRASYDQKPYRRLMMQTWGAKVHPSPSTITDAGQKILQLDPSSPGSLGIAISEAVEVAAKNANTKYCLGSVLNHVLLHQTVIGEECIKQMEAIGETPDVIIGCTGGGSNFAGLTFPFIREKFNGKINPHIKAVEPTACPSLTRGVYAYDYGDTAGMTPLMKMHTLGHDFIPDPIHSGGLRYHGMAPLISHVYELGFMEAIAIPQTECFQGAIQFARSEGLIPAPEPTHAIAATIREALRCRETGESKVILMAMCGHGHFDLPSYEKYLQGAMVDLEFSEDKMQASLGKIPQLVA

SEQ ID NO: 7944 - protein, 495 aa, Vitis vinifera
MVQSLLSASLLSISSPSFSIKVGEQGKPMLLRASPRCRVRARAASSKAGPQAVEIPHQWYNLIADLPVKPPPALHPQTQEPIKPEDLSPLFPDELIKQEASTDRFIAIPEEVIDVYRLWRPTPLIRAKRLEKLLDTPARIYYKYEGVSPAGSHKPNTAVPQVWYNAQEGVKSVTTETGAGQWGSSLAFACSLFGLDCEVWQVRASYDQKPYRNLMMQTWGAKVHPSPSSITEAGRKILQMNPSSPGSLGIAISEAVEVAAANADTKYCLGSVLNHVLLHQTVIGEECIKQMEAIGETPDVIIGCTGGGSNFGGLTFPFIREKLKGRINPLIRAVEPTACPSLTKGVYAYDYGDTAGMTPLMKMHTLGHDFVPDPIHAGGLRYHGMAPLLSHVYELGFMEAISIPQIECFQGAIQFARTEGLIPAPEPTHAIAATIREALHCRETGESKVILTAMCGHGHFDLPAYEKYLQGNMVDLSFEEEKIKASLANIPQVVA

SEQ ID NO: 7945 - protein, 504 aa, Gossypium hirsutum
MATHSVFNPNPVSTFTSSTISTKGDKQWPGYLMLNGEQMHVRLSNGYRARARSVINVNSTAIEIPHQWYNLVADLAIKPPPPLHPKTFEPVKPEDLSPLFADELIKQEVTDERFIDIPEEVIDVYRLWRPTPLIRAKRLEKLLDTPARIYYKYEGVSPAGSHKPNTAVPQVYYNAQQGVKNVVTETGAGQWGSSLAFACSLFGLGCEVWQVRASYDQKPYRKLMMQTWGAKVHPSPSDITHAGRKILQMDPSSPGSLGIAISEAVEIAAANDDTKYCLGSVLNHVLLHQTVIGEECIRQMEAIGETPDLIIGCTGGGSNFAGLSFPFIREKLKGKINPVIRAVEPAACPSLTKGVYAYDFGDTAGMTPLMKMHTLGHDFIPDPIHAGGLRYHGMAPLISHVHELGFMEAISIPQTECFQGAIRFARSEGIIPAPEPTHAIAATIREAVRCRESGESKVILMAMCGHGHFDLASYEKYLQGSLVDLSFEEEKIKESLAKVPQVQA

SEQ ID NO: 7946 - protein, 504 aa, Gossypium raimondii
MATHSVFNPNPVSTFTSSTISTKGDKQWPGYLMLNGKQMHVRLSNGYRARARSAINVNSTAIEIPHQWYNLVADLAIKPPPPLHPKTFEPVKPEDLSPLFADELIKQEVTDERFIDIPEEVIDVYRLWRPTPLIRAKRLEKLLDTPARIYYKYEGVSPAGSHKPNTAVPQVYYNAQQGVKNVVTETGAGQWGSSLAFACSLFGLGCEVWQVRASYDQKPYRKLMMQTWGAKVHPSPSDITHAGRKILQMDPSSPGSLGIAISEAVEIAAANDDTKYCLGSVLNHVLLHQTVIGEECIRQMEAIGETPDLIIGCTGGGSNFAGLSFPFIREKLKGKINPVIRAVEPAACPSLTKGVYAYDFGDTAGMTPLMKMHTLGHDFIPDPIHAGGLRYHGMAPLISHVHELGFMEAISIPQTECFQGAIRFARSEGIIPAPEPTHAIAATIREAVRCRESGESKVILMAMCGHGHFDLASYEKYLQGSLVDLSFEEEKIKESLAKVPQVQA

SEQ ID NO: 7947 - protein, 865 aa, Prunus persica
MYVTRPLSMYRKSPSTLSIKPPDAPHSGYVVITDEEAESKNTSCWGLCKRGKVKKLPFPQDKILTIVYTSEYQEATATKVWFIPVLDQPLSSNCYYVIRANGRHKGKACRCSRERDMTNCCIRGFLRDKKPKVLNFRDIYQEVKIHRHQGGGFFAESVAPDGVPPKFLKKKGWKVRSSSMYRNQLTDALGLDASLRSRLPDFNFPIFKKCSASSVVGRWYCPFAFVREKATIRHQMKKSKFYRITLEQWWEEIYSLGNVNNEGNVVNVSVDVQREVALVSATEAVKDDRNGRTGFTWFKAYNPRSKKVVSVGLSSAIVQNMRWVLEAGGWVNGDEMDVRVERVEEITGENRWTKFGCYVMVESFSLRRMDGSLAWRSDFRHTDKIRFEEKWLGFTALDRKPTHLKLSNGCRARAALNADPRSIEIPRQWYNLIADLPVKPPPPLHPKTFEPVKPKDLSPLFPDELIKQEASNERFIDIPDEVRDVYRLWRPSPLIRAKRLEKLLDTPARIYYKYEGVSPAGSHKPNTAVPQVWYNAQQGIKKVVTETGAGQWGSALAFACSLFGLECEVWQVRASYDQKPYRRLMMQTWGAKVHPSPSNLTEAGRKILQMDPSSPGSLGIAISEAVEIAAMNADTKYCLGSVLNHVLHHQTVIGEECLKQMEAIGETPDFIIGCTGGGSNFAGLSFPFIREKLKGKMNPVIRAVEPAACPSLTKGVYTYDYGDTAGMTPLMKMHTLGHDFIPDPIHAGGLRYHGMAPLISHVYELGYMEAIAIPQIECFEGAIQFARSEGLIPAPEPTHAIAATIREALNCRETGEAKVILTAMCGHGHFDLPAYDNYLQGKLVDLSFEEEKIQASLARVPKVGG

SEQ ID NO: 7948 - protein, 865 aa, Prunus mume
MYVTRPLSMYRKSPSTLSIKPPDAPHSGYMVITDEEAESKDTSCWGLCKRGKVKKLPFPQDKILTIVYTSEYQEATTTKVWFIPVLDQPLSSNCYYVIRANGRHKGKAYRCSRERDMTNCCIRGFLRDKKPKVLNFRDIYQQVKIHRHQGGGFFAESVAPDGVPPKFLKKKGWKVRSSSMYRNQLTDALGLDASLRSRLPEFNFPIFKKRSASSVVGRWYCPFAFVREKATIRHQMKKSKFYRITLEQWWEEIYSRGNVNNEGNVVNVSVDVQREVALVSATEAVKDDRNGRTGFTWFKAYNPRSKKVVSVGLSSAIIQNMRWVLEAGGWVNGDEMDVRVERVEEITGENRWRKFGCYVMVESFSLRRMDGSLAWRSDFRHTDKIRSEEKWLGFTALDRKPTHLKLSNGCRARAALNADPRSIEIPRQWYNLIADLPVKPPPPLHPKTFEPVKPEDLSPLFPDELIKQEASNERFIDIPDEVRDVYRLWRPSPLIRAKRLEKLLDTPARIYYKYEGVSPAGSHKPNTAVPQVWYNAQQGIKKVVTETGAGQWGSALAFACSLFGLECEVWQVCASYDQKPYRRLMMQTWGAKVHPSPSNLTEAGRKILQMDPSSPGSLGIAISEAVEIAAMNADTKYCLGSVLNHVLHHQTVIGEECLKQMEAIGETPDFIIGCTGGGSNFAGLSFPFIREKLKGKMNPVIRAVEPAACPSLTKGVYTYDYGDTAGMTPLMKMHTLGHDFIPDPIHAGGLRYHGMAPLISHVYDLGYMEAIAIPQIECFEGAIQFARSEGLIPAPEPTHAIAATIREALNCRETGEAKVILTAMCGHGHFDLPAYDNYLQGKLVDLSFEEEKIQASLTRVPKVGG

SEQ ID NO: 7949 - protein, 499 aa, Amsonia hubrichtii
MAQSLFLGTSICTNISKRGEEQWLGGSKLKIEPRYLKLSSGCRIGGRAAYNANAKITEIPHQWYNIVADLPVKPPPSLHPKTHEPVKPEDLSPLFPEELIKQEASNERFIDIPEEVIDVYKLWRPTPLIRAKRLEKLLDTPARIYYKYEGVSPAGSHKANTSVPQVWYNAQQGVKNVVTETGAGQWGSALAFACSLFGLNCEVWQVRASYDQKPYRRLMMQTWGAKVHPSPSIITEAGQKILELDQSSPGSLGIAISEAVEVAIKNADTKYCLGSVLNHVLLHQTVIGEECMKQMEAIGETPDLIIGCTGGGSNFAGLTFPFIREKLNGKINPHIKAVEPTACPSLTKGVYAYDFGDTAGMTPLMKMHTLGHGFIPDPIHAGGLRYHGMAPLISHVYELGFMEAIAIPQTECFQGAIQFARSEGLIPAPEPTHAIAATIREALRCRETGESKVILMAMCGHGHFDLPAYEKYLLGAMVDLDFSEDKLQTSLGKIPQLSA

SEQ ID NO: 7950 - protein, 452 aa, Catharanthus roseus
MAQCLFLAPTVCSKVAGRGEEQWLCGSKLKKKPSNLIFSSRSSIGIRASYNANATAIEIPNQWYNIVADLPVKPPPALHPKTYEPVKPEDLSPLFPDELIKQEASTERSIDIPEEVIDVYKLWRPTPLIRAKRLEKLLDTPARIYYKYEGVSPAGSHKANTSVPQVWYNSQEGVKNVVTETGAGQWGSALAFACSLFGLDCEVWQVRASYDQKPYRRLMMQTWGAKVHPSPSNITEAGRKILQLDPSSPGSLGIAISEAVEIAVKNGNTKYCLGSVLNHVLLHQTVIGEECIKQMEAIGESPDVIIGCTGGGSNFAGLAFPFIREKLNGKINPHIQAVEPTACPSLTKGVYAYDYGDTAGMTPLMKMHTLGHDFIPDPIHAGGLRYHGMAPLISHVYDLGFMEAIAIPQTECFQGAIQFARSEGLIPAPEPTHAIAATIREALRCRETGGSK

SEQ ID NO: 7951 - protein, 863 aa, Fragaria vesca
MYVTKPLSMYRKSPNTLSIQPPDAPYSGHLVVTDEEAEAQDSCCWGIFKREQIKQLPFPQDKILTVVYTSDYQEATTTKVWFIPVLDQPLSSNCYYVIKANGRHKGKACRCSKERDIMNCCFRDFSRDKKPVPLNLRNTYQQVKIHRHQGGGFFAESVAPDGVPPKFLRKKGWVIRSSSLYRWQLSDALGLDTSLRLRFPDFNFPIFKKRSASNVVGKWYSPFVFVRERSSVRRQMKKSKFYRISMEQWWEEIYSCGNTSNEGNVVNVDVSVQREVAFVSAAEAVKDDRNGRTGFTWFKAYNPDSRKLVTIGLSSAIVQNMKWVLEAGGWVTGDEKDTRVQKVEEIRDGWRKFGCYVLVESFKLRRMDGSLVLRHDFRHTNTIRIEKKWLGFITLDRKPRNLKLSKGCRARAALNADTVPVEIPRQWYNLIADLPIKPPPPLHPKTFEPVKPEDLSPLFPDELIKQEASGERYIDIPEEVREIYKLWRPTPLIRAKRLEKLLDTPARIYYKYEGGSPAGSHKPNSAVPQVYYNAKQGIKKVVTETGAGQWGCSLAFASSLFGLDCEVWQVRASYDQKPYRKLMMQTWGAKVHPSPSNITESGRKTLLMDPSTPGSLGIAISEAVEVAAMNADTKYCLGSVLNHVLLHQTVIGEECLKQMEAIGETPDLIIGCTGGGSNFAGLSFPFIREKLNGKMSPVIRAVEPSACPSLTQGVYRYDYGDTAGMTPLMKMHTLGHDFIPDPIHAGGLRYHGMAPLISHVYELGFMEALAIPQTECFRGAIQFARSEGLIPAPEPTHAIAATIREALKCKESGEAKVILTAMCGHGHFDLPAYDNYLQGNLVDLSFDDEKLQAALSSVPNMRS

SEQ ID NO: 7952 - protein, 496 aa, Citrullus lanatus
MAATFLAVGSLASSSINNVEEQLPGCLSLKRIPRHLRFSNGYRTKAALNPNLKAVEVPRQWYNLVADLPVKPPPPLHPKTFEPIKPEDLSHLFPDELIKQEASTDRYINIPDEVLDIYGLWRPTPLIRAKRLEKLLDTPARIYYKYEGVSPAGSHKPNSAVPQVWYNVQEGVKNVVTETGAGQWGSSLAFACSIFGIGCEVWQVRASYDQKPYRRMMMQTWGAKVHPSPSDLTDAGRKLLQVDPSSPGSLGIAISEAVEVAARDADTKYCLGSVLNHVLLHQTVIGEECLKQMEAIGERPDVIIGCTGGGSNFAGLSFPFLREKLAGNINPVIRAVEPAACPSLTKGVYAYDYGDTAGMTPLMKMHTLGHNFIPDPIHAGGLRYHGMAPLISHVYNLGLLEAISLPQTECFQGAIQFARSEGLIPAPEPTHAIAATIREALRCRETGESKVILTAMCGHGHFDLPAYEKYLQGGITDLSFAKEKIQESLTTIPQVG

SEQ ID NO: 7953 - protein, 526 aa, Populus trichocarpa
MASSSLAFPTLQPQFQSLKNKSTSKPSTRRLSFRTIRASVSEKPSVSAPGVTVSPPENTKLPIRKIPGDYGLPLVGPFKDRMDYFYNQGRDNFFKSKVLKYGSTVFRANMGPGPFIAPNPQVVVLLDGKSFPVLFDVTKVEKKDLFTGTYMPSTELTGGYRILSYLDPSEPMHAKLKKFMFYLLKSRRDHVIPEFKASYTELFTSLEKDLALKGKANFVAANDQAAFNFLARAWFGTEPAQTSLGLDGPGLVSKWVLFNLGPVLSLGLPKYLEDLTIHSFRLPPSMIKKNYQRLYDFFYASSSFLLDEAENLGISREEACHNLLFSTCFNSFGGMKILFPNMMKWLGRAGAKLHAQLAEEIRSVVQSDGGNVTMRGMEQMPLMKSAVYEALRIEPPVPLQYGKAKRDLIIESHDAAFEVKEGELLFGFQPFATKDPKIFTRAEEFVADRFIGEGEELLKHVLWSNGPETEKPTLGNKQCAGKDFVVLVARLLVVELFLRYDSFEIEVGKSSLGAAVTVTSLKRARF

SEQ ID NO: 7954 - protein, 526 aa, Populus trichocarpa
MASSSLAFPTLQPQFQSLKNKSTSKPSTRRLSFRTIRASVSEKPSVSAPGVTVSPPENTKLPIRKIPGDYGLPLVGPFKDRMDYFYNQGRDNFFKSKVLKYGSTVFRANMGPGPFIAPNPQVVVLLDGKSFPVLFDVTKVEKKDLFTGTYMPSTELTGGYRILSYLDPSEPMHAKLKKFMFYLLKSRRDHVIPEFKASYTELFTSLEKDLALKGKANFVAANDQAAFNFLARAWFGTEPAQTSLGLDGPDLVSKWVLFNLGPVLSLGLPKYLEDLTIHSFRLPPSLIKKNYQRLYDFFYASSSFLLDEAENLGISREEACHNLLFATCFNSFGGMKILFPNMMKWLGRAGAKLHAQLAEEIRSVVQSNGGNVTMRGMEQMPLMKSAVYEALRIEPPVPLQYGKAKRDLIIESHDAAFEVKEGELLFGFQPFATKDPKIFTRAEEFVADRFIGEGEELLKHVLWSNGPETEKPTLGNKQCAGKDFVVLVARLLIVELFLRYDSFEIEVGKSSLGAAVTVTSLKRARF

SEQ ID NO: 7955 - protein, 476 aa, Oryza sativa
MNSLQSFLALNPPATAAALGGLGLGGARLRPSRVTACLATPTPTPPPPTSAPLAPAAAARRELSAASRAVVEDEARYIVGTYNRSRVVLVAGRGCKLYDADGREYLDMAAGIAVNALGHADPDWVAAVSAQAATLVHASNVQYTVPQASLERVTPTAHHVFDALPNPLVTPSSRDHFFFRVHVALAKRLVEASFADRVFFANTGTEANEAAIKFARKYQRVARPDGDAPTEFMSFTNCFHGRTMGSLALTSKVQYREPFAPVMPGATFAEYGNLEEAKKVIQSGKIAAVFVEPMQGEGGIHSATKEFLQGLRDACDEAGALLVFDEVQCGLGRTGYLWAYEAYGVVPDIMTLAKPLAGGLPIGVVLVTEKVASAINYGDHGTTFGGGPLVCQAALTTLDKIQKPGFLAEVAKKGENFKQLLSTKLSGNAHVKEIRGIGLIVGIELDVPAGPLVDACLDRGVIVLTAGKGNVVRQCC

SEQ ID NO: 7956 - protein, 457 aa, Hordeum vulgare
MNSLQSFLAVAPVKPAAAGARLPSSRRARVSACLAAPAPAPPAAPSARRELSAASRAVMADEAKYIVGTYKRAQVVFVSGRGCKLYDIDGREYLDMAAGIAVNALGHGDPDVDAAAADQRGRLVHASNVGYTVPQVELAKRLVEASFADRAFFANSGTEANEAAIKFARKYQRVAHPDGDAPTEFMSFTNCFHGRTIGSLALTSKVQYREPFEPVMPGSTFAEYGNLEEAKKVIQSGKIAAVFVEPVQGEGGIHSATKEFLQGLRDACDEAGTLLVFDEVQCGLGRTGYLWAHEVYGVVPDIMTLAKPLANGLPIGVALVTEKVAAAINYGDHGTTFGGGPFVCHAALATLDKIQKPGFLAEVTKKGEYFKQLLKTKLGGNPHVKEIRGAGLIVGIELDVPAGPLVDACLDAGVFLLTAGKGNVVRLVPALIVSEKELEQAAEVIRECLPALEASTS

SEQ ID NO: 7957 - protein, 456 aa, Pseudoroegneria spicata
NSLQSFLAVAPVKPAAASAGARLPSSRRARVSACLATPAPAAAASARRELSAASRAVMADEAKYIVGTYKRAQVVFVAGRGCKLYDIDGREYLDMAAGIAVNALGHGDPDVDAAAADQRGRLVHASNVGYTVPQVELAKRLVEASFADRAFFANSGTEANEAAIKFARKYQRVAHPNGDAPTEFMSFTNCFHGRTIGSLALTSKVQYREPFEPVMPGSTFAEYGNLEEAKKVIQSGKIAAVFVEPVQGEGGIHSATKEFLQGLRDACDEAGTLLVFDEVQCGLGRTGYLWAHEVYGVVPDIMTLAKPLANGLPIGVALVTEKVAAAINYGDHGTTFGGGPFVCHAALATLDKIQKPGFLAEVSKKGEYFKQLLKTKLGGNPHVKEIRGAGLIVGIELDVPAGPLVDACLDAGVFLLTAGKGNVVRLVPALIVSEKELEQAAEVIRDCLPALEAHTS

SEQ ID NO: 7958 - protein, 455 aa, Triticum aestivum
SFLAVAPVKPAAAAARLPSSRRARVSACLATPAPAPTTPAAAASARRELSAASRAVMADEAKYIVGTYKRAQVVFVAGRGCKLYDIDGREYLDMAAGIAVNALGHGDPDVDAAAADQRGRLVHASNVGYTVPQVELAKRLVEASFADRAFFANSGTEANEAAIKFARKYQRVAHPNGDAPTEFMSFTNCFHGRTIGSLALTSKVQYREPFEPVMPGSTFVEYGNLEEAKKVIQSGKIAAVFVEPVQGEGGIHSATKEFLQGLRDACDEAGALLVFDEVQCGLGRTGYLWAHEVYGVVPDIMTLAKPLANGLPIGVALVTEKVAAAINYGDHGTTFGGGPFVCHAALATLDKIQKPGFLAEVTKKGEYFKQLLKTKLSGNPHVKEIRGAGLIVGIELDVPAGPLVDACLDAGVFLLTAGKGNVVRLVPALIVSEKELEQAAEVIRECLPALEASTS

SEQ ID NO: 7959 - protein, 455 aa, Triticum aestivum
SFLAVAPVKPAAAAARLPSSRRARVSACLATPAPAPTAPAAATSARRELSAASRAVMADEAKYIVGTYKRAQVVFVAGRGCKLYDIDGREYLDMAAGIAVNALGHGDPDVDAAAADQRGRLVHASNVGYTVPQVELAKRLVEASFADRAFFANSGTEANEAAIKFSRKYQRVAHPNGDAPTEFMSFTNCFHGRTIGSLALTSKVQYREPFEPVMPGSTFAEYGNLEEAKKVIQSGKIAAVFVEPVQGEGGIHSATKEFLQGLRDACDEAGALLVFDEVQCGLGRTGYLWAHEVYGVVPDIMTLAKPLANGLPIGVALVTEKVAAAINYGDHGTTFGGGPFVCHAALATLDKIQKPGFLAEVTRKGEYFKQLLKAKLSGNPHVKEIRGAGLIVGIELDVPAGPLVDACLNAGVFLLTAGKGNVVRLVPALIVSEKELEQAAEAIRECLPALDASTS

SEQ ID NO: 7960 - protein, 445 aa, Secale cereale
PVKPAAAARLPSSRRARVSACLATPAPAPTAPAAARRELSAASRAVMADEAKYIVGTYKRAQVVFVAGRGCKLYDIDGREYLDMAAGIAVNALGHGDPDVDAAAADQRGRLVHASNVGYTVPQVELAKRLVEASFADRAFFANSGTEANEAAIKFARKYQRVAHPNGDAPTEFMSFSNCFHGRTIGSLALTSKVQYREPFEPVMPGSTFVEYGNLEEAKKVIQSGKIAAVFVEPVQGEGGIHSATKEFLQGLRDACDEAGALLVFDEVQCGLGRTGYLWAHEVYGVVPDIMTLAKPLANGLPIGVALVTEKVAAAINYGDHGTTFGGGPFVCHAALATLDKIQKPGFLAEVTRKGEYFKQLLKTKLSGNPHVREIRGAGLIVGIELDVPAGPLVDACLDAGVFLLTAGKGNVVRLVPALIVSEKELEQAAEVIRECLPALEASTS

SEQ ID NO: 7961 - protein, 447 aa, Secale cereale
PVKPAAAARLPSSRRARVSACLATPAPAPTAPAAASARRELSAASRAVMADEAKYIVGTYKRAQVVFVAGRGCKLYDIDGREYLDMAAGIAVNALGHGDPDVDAAAADQRGRLVHASNVGYTVPQVELAKRLVEASFADRAFFANSGTEANEAAIKFARKYQRVAHPNGDAPTEFMSFSNCFHGRTIGSLALTSKVQYREPFEPVMPGSTFVEYGNLEEAKKVIQSGKIAAVFVEPVQGEGGIHSATKEFLQGLRDACDEAGALLVFDEVQCGLGRTGYLWAHEVYGVVPDIMTLAKPLANGLPIGVALVTEKVAAAINYGDHGTTFGGGPFVCHAALATLDKIQKPGFLAEVTRKGEYFKQLLKTKLSGNPHVREIRGAGLIVGIELDVPAGPLVDACLDAGVFLLTAGKGNVVRLVPALIVSEKELEQAAEVIRECLHALEASTS

SEQ ID NO: 7962 - protein, 357 aa, Saccharum officinarum
MESCSFRAATAPSPFPSAPSSSSSSPRAPCPILRFPRPRKGRQIGVRRRASGFDAFPPLPGKVFVDEAIGAEYGEGFETFRMDGPLKVDVDYLNEKLQECFLQRIRHAMKPDEAFGLIFSWDNVIADTDSLKLNAWRQLALEEGKDIPSAAHVRKSILHGAADHVLRKVLYWAKEEDKMEKLKARLIELYYENLFKLDTPVKGLREWLDAVQTAGIPCAVASSLDRRCMIEALDRMALSKYFKAIVTDEDDMESIANRFLSAAMKLDRKPSKCVVFEDDPRGVTAAHNCTMMAVALIGAHPAYELVQADLAIAKYSELSVINLRRLFANKGISFMDLQKQIIEKSPSKRRLTVDTIF

SEQ ID NO: 7963 - protein, 162 aa, Setaria italica
MESCSFRPATAPSPFPSAPSSSSSSPRAPCPNLRFPRPRNGRQVGVRRRASGFDAFPPLPGKVFVDEAIGAEYGEGFETFRMDGPLKIDVDYLNEKLQECFLQRIRHAMKPDEAFGLIFSWDNVIADTDSLKLDAWRQLALEEGKDISKCCSCPKEYPSWCC

SEQ ID NO: 7964 - protein, 357 aa, Panicum virgatum
MESCSFRPATAPSPFPSAPSSSSSSPRAPCPHLRFPRPRNGRQIRVRRRASGFDAFPPLPGKVFVDEAIGAEYGEGFETFRMDGPIKVDVDYLNEKLQECFLQRIRHAMKPDEAFGLIFSWDNVIADTDSLKLDAWRQLALEEGKDIPSAAHVRKSILHGAADHVLRKVLYWAKEEYKMEKLKARLIELYYENLFKLDTPVEGLREWLDAVQTAGIPCAVASSLDRRCMIEALDRMALSKYFKAIVTDEDDMESIANRFLSAAMKLDRKPSKCVVFEDDPRGVTAAHNCTMMAVALIGAHPAYELVQADLAIAKYSELSVINLRRLFANKGISFMDLQKQIIEKAPPRRRLTVDTIF

SEQ ID NO: 7965 - protein, 357 aa, Panicum virgatum
MESCSFRPATAPSPFPSAPSSSSSSPRASCPHLRFPRPRNGRQIRVRRRASGFDAFPPLPGKVFVDEAIGAEYGEGFETFRMDGPLKVDVDYLNEKLQECFLQRIRHAMKPDEAFGLIFSWDNVIADTDSLKLDAWRQLALEEGKDIPSAAHVRKSILHGAADHVLRKVLYWAKGEDKMEKLKARLIELYYENLFKLDTPIEGLREWLDAVQTAGIPCAVVSSLDRRCMIKALDRMALSKYFKAIVTDEDDMESIANRFLSAAMKLDRKPSKCVVFEDDPRGVTAAHNCTMMAVALIGAHPAYELVQADLAIAKYSELSVINLRRLFANKGISFMDLQKQIIEKAPPKRRLTVDTIF

SEQ ID NO: 7966 - protein, 358 aa, Sorghum bicolor
MESCSFRAATAPSPFPSAPSSSSSSSPRARSLILRFPRPRKGRKIGVRRRASGFDAFPPLPGKVFVDEAIGAEYGEGFETFRMDGPLKVDVDYLNEKLQECFLQRIRHAMKPDEAFGLIFSWDNVIADTDSLKLNAWSQLALEEGKDIPSAAHVRKSILHGAADHVLRKVLYWAKEEDKMEKMKARLIELYYENLFKLDTPVEGLREWLDAVQTAGIPCAVASSLDRRCMIEALDRMALSKYFKAIVTDEDDMDSIANRFLSAAMKLDRKPSKCVVFEDDPRGVTAAHNCTMMAVALIGAHPAYELVQADLAIAKYSELSVINLRRLFANKGISFMDLQKQIIEKSPPKRRLTVDTIF

SEQ ID NO: 7967 - protein, 356 aa, Triticum aestivum
MESCSFRTATSPSPFPSAPSSSSSARVPCPSLRFARARNGRQMRMRRMASGFDAFPPLPGKVFVEETIGAEYGEGFETFRMDGPLNIDVDYLNEKLQECFLQRIRHAMKPDEAFGLIFSWDNVIADTDSLKLDAWRQLALEEGKDIPTAAHIQKSILHGAADHVLRKVLYWAKEDDQMERLKARLIELYYESLFRLDTPVEGLREWLDAVRTAGIPCAVASSLDRRCMVEALDRMSLSKYFKAIVTDEDDMESIAHRFLSAAVKLDRKPSKCIVFEDDPRGVTAAHNCTMMAVSLIGAHPAYELEQADLAVARYSELSVINLRRMFAHKGLSFMDMQKQIIERSPPKRKLTVDTIF

SEQ ID NO: 7968 - protein, 355 aa, Pseudoroegneria spicata
ESCSFRTATSPSPFPSAPSSSSSPRAPCPSLRFPRARNGRQMRTRRMASGFDAFPPLPGKVFVEETIGAEYGEGFETFRMDGPLNIDVDYLNEKLQECFLQRIRHAMKPDEAFGLIFSWDNVIADTDSLKLDAWRQLALEEGKDIPTAAHIQKSILHGAADHVLRKVLYWAKEDDQMERLKARLIELYYESLFKLDTPVEGLREWLDAVRTAGIPCAVASSLDRRCMVEALDRMALSKYFKAIVTDEDDMESIAHRFLSAAVKLDRKPSKCIVFEDDPRGVTAAHNCTMMAVSLIGAHPAYELEQADLAVARYSELSVINLRRMFAHKGLSFMDMQKQIIERSPPTRKLTVDTIF

SEQ ID NO: 7969 - protein, 356 aa, Triticum aestivum
MESCSFRTATSPSPFPSAPSSSSSPRAPCPSLRFARARNGRQMRMRRMASGFDAFPPLPGKVFVEETIGAEYGEGFETFRMDGPLNIDVDYLNEKLQECFLQRIRHAMKPDEAFGLIFSWDNVIADTDSLKLDAWRQLALEEGKDIPTAAHIQKSIIHGAADHVLRKVLYWAKEDDQMERLKARLIELYYESLFKLDTPVEGLREWLDAVRTAGIPCAVASSLDRRCMVEALDRMSLSKYFKAIVTDEDDMESIAHRFLSAAVKLDRKPSKCIVFEDDPRGVTAAHNCTMMAVSLIGAHPAYELEQADLAVARYSELSVINLRRMFAHKGLSFMDMQKQIIERSPPKRKLTVDTIF

SEQ ID NO: 7970 - protein, 276 aa, Secale cereale
MDGPLNIDVDYLNEKLQECFLQRIRHAMKPDEAFGLIFSWDNVIADTDSLKLDAWRQLALEEGKDIPTAAHIQKSIIHGAADHVLRKVLYWAKEDDQMERLKARLIELYYESLFKLDTPVEGLREWLDAVRTAGIPCAVASSLDRRCMVEALDRMALSKYFKAIVTDEDDMESIAHRFLSAAVKLDRKPSKCIVFEDDPRGVTAAHNCTMMAVSLIGAHPAYELEQADLAVARYSELSVINLRRMFAHKGLSFMDMQKQIIERSPPKRKLTVDTIF

SEQ ID NO: 7971 - protein, 354 aa, Triticum aestivum
SCSFRTATSPSPFPSAPSSSSSPRAPCPSLRFARARNGRQMRMRRMASGFDAFPPLPGKVFVEETIGAEYGEGFETFRMDGPLNIDVDYLNEKLQECFLQRIRHAMKPDEAFGLIFSWDNVIADTDSLKLDAWRQLALEEGKDIPTAAHIQKSILHGAADHVLRKVLYWAKEDDQMERLKARLIELYYESLFKLDTPVEGLREWLDAVRTAGIPCAVASSLDRRCMVEALDRMSLSKYFKAIVTDEDDMESIAHRFLSAAVKLDRKPSKCIVFEDDPRGVTAAHNCTMMAVSLIGAHPAYELEQADLAVARYSELSVINLRRMFAHKGLSFMDMQKQIIERSPPKRKLTVDTIF

SEQ ID NO: 7972 - protein, 358 aa, Hordeum vulgare
MESCSFRTATSPSPFPSAPSSSSSSSPRAPCPNLRFARARNGRQMRIRRMASGFDAFPPLPGKVFVEETIGAEYGEGFETFRMDGPLNIDVDYLNEKLQECFLQRIRHAMKPDEAFGLIFSWDNVIADTDSLKLDAWRQLALEEGKDIPTAAHIQRSILHGAADHVLRKVLYWAKEDDQMERLKARLIELYYESLFKLDTPVEGLREWLDAVRTAGIPCAVASSLDRRCMVEALDRMALSKYFKAIVTDEDDMESIAHRFLSAAVKLDRKPSKCIVFEDDPRGVTAAHNCTMMAVSLIGAHPAYELEQADLAVARYSELSVINLRRMFAHKGLSFMDMQKQIIERSPPKRKLTVDTIF

SEQ ID NO: 7973 - protein, 356 aa, Triticum aestivum
MESCSFRTATSPSPFPSAPSSSSSPRAPYPNLRFARARNGRQMRMRRMASGFDAFPPLPGKVFVEETIGAEYGEGFETFRMDGPLNIDVDYLNEKLQECFLQRIRHAMKPDEAFGLIFSWDNVIADTDSLKLDAWRQLALEEGKDIPTAAHIQKSIIHGAADHVLRKVLYWAKEDDQMERLKARLIELYYESLFKLDTPVEGLREWLDAVRTAGIPCAVASSLDRRCMVEALDRMALSKYFKAIVTDEDDMESIAHRFLSAAVKLDRKPSKCIVFEDDPRGVTAAHNCTMMAVSLIGAHPAYELEQADLAVARYSELSVINLRRMFAHKGLSFMDMQKQIIERSPPKRKLTVDTIF

SEQ ID NO: 7974 - protein, 356 aa, Avena sativa
MESCSFRTATSPSPFSSAPSSSSPPRLPCPNLRFPRARNGRLMGTRRRASGFDVFPPLPGKVFVEETIGAEYGEGFETFRMDGPLNIDVDYLNEKLQECFLQRIRHAMKPDEAFGLIFSWDNVIADTDSLKLDAWRQLALEEGKDIPTSARIQRSILHGAADHVLRKVLYWAKEDDQMERLKARLIELYYESLFKLDTPVEGLREWLDAVRTAGIPCAVASSLDRRCMVEALDRMALSKYFKAIVTDEDDMESIAHRFLSAAVKLDRKPSKCIVFEDDPRGVTAAHNCTMMAVSLIGAHPAYELEQADLAVAKYGELSVINLRRLFAHKGISFMDMQKQLIERSPPKRKLTVDTIF

SEQ ID NO: 7975 - protein, 358 aa, Brachypodium distachyon
MESCSFRTATSPSPFPSAPSSSYSSYARSPCPNIRFARTRNGRQMGMRRRASGFDAFPPLPGKVFVEETIGAEYGEGFETFRMDGPLNIDVDYLNEKLQECFLQRIRHAMKPDEAFGLIFSWDNVIADTDSLKLDAWRQLALEEGKDIPTAAHIKKSILHGSADHVLRKVLYWAKEDGQMEKLKARLIELYYESLFKLDTPVEGLREWLDAVQTAGIPCAVASSLDRRCMVEALDRMALSKYFKAIVTDEDDMESIAHRFLSAAVKLDRKPSKCIVFEDDPRGVTAAHNCTMMAVSLIGAHPAYELEQADLAVARYNELSVINLRRLFAHKGISFMDMQKQIIERSPPKRKLTVDTIF

SEQ ID NO: 7976 - protein, 372 aa, Festuca arundinacea
  misc_feature (279)..(279): Xaa can be any naturally occurring amino acid
SRLPFLPLSSSPLPISMESCSFRTATSPSPFSSAPSSSSSPRAPCPNLRFARERNGRQMRMRRRASGFDAFPPLPGKVFVEETIGAEYGEGFETFRMDGPLNIDVDYLNEKLQECFLQRIRHAMKPDEAFGLIFSWDNVIADTDSLKLDAWRQLALEEGKDIPTAAHIQRSILHGAADHVLRKVLYWAKEDDQMDRLKARLIELYYESLFKLDTPVEGLREWLDAVRTAGIPCAVASSLDRRCMVEALDRMSLSKYFKAIVTDEDDMESIAHRFLSAAXKLDRKPSKCIVFEDCPRGVTAAHNCTMMAVSLIGAHPAYELEQADLAVAKYNDLSVINLRRLFAHKGISFMDMQKQIIERSPPKRKLTVDTIF

SEQ ID NO: 7977 - protein, 277 aa, Zea mays
MESCSFRAATAPSPFPSAPSSSSSPRAPCPILRFPRPRKGRQIGVRRRASGFDAFASFAGKVFVDEAIGAEYGEGFETFRMDGPLKVDVDYLNEKLQECFLQRIRHAMKPDEAFGLIFSWDNVIADTDSLKLNAWRQLALEEGKDIPSGAHVRKSIIHGAADHVLRKVLYWAKEEDKMEKLKARLIELYYENLFKLDTPVEGLREWLDAVQTAGIPCAVASPLDRRCMIEALDRMALSKYFKAIVTDEDDMESIANRFLSAAMKACSCPTSNRCTSC

SEQ ID NO: 7978 - protein, 287 aa, Panicum virgatum
MGNLCCCVQVDQSTVAIREQFGKFDSVLEPGCHCLPWFIGKRVAGHLTLRLQQLDVRCETKTKDNVFVNVVASIQYRALAGKASDAFYKLSNTRSQIQAYVFDVIRASVPKLILDDAFEQKDEIAKAVEEELEKAMSAYGFEIVQTLIVDIEPDEHVKRAMNEINAAARLRVAANEKAEAEKIVQIKRAEGEAEAKYLSGLGIARQRQAIVDGLRDSVLGFSVNVPGTTAKDVMDMVLITQYFDTMKEIGASSKASSVFIPHGPGAVRDIATQIRDGLLQGSSVSHH

SEQ ID NO: 7979 - protein, 287 aa, Setaria italica
MGNLCCCVQVDQSTVAIREQFGKFDSVLEPGCHCMPWFIGKRVAGHLTLRLQQLDVRCETKTKDNVFVNVVASIQYRALAGKASDAFYKLSNTRSQIQAYVFDVIRASVPKLILDDAFEQKDEIAKAVEEELEKAMSAYGFEIVQTLIVDIEPDEHVKRAMNEINAAARLRVAANEKAEAEKIVQIKRAEGEAEAKYLSGLGIARQRQAIVDGLRDSVLGFSVNVPGTTAKDVMDMVLITQYFDTMKEIGASSKASSVFIPHGPGAVRDIATQIRDGLLQGSAVSHH

SEQ ID NO: 7980 - protein, 287 aa, Eragrostis curvula
MGNLCCCVQVDQSTVAIREQFGKFDSVLEPGCHCLPWFVGKRVAGHLTLRLQQLDVKCETKTKDNVFVNVVASIQYRALAGKASDAFYKLTNTRSQIQAYVFDVIRASVPKLNLDDTFEQKNEIAKAVEEELEKAMSAYGFEIVQTLIVDIEPDEHVKRAMNEINAAARLRMAANEKAEAEKIVQIKRAEGEAEAKYLSGLGIARQRQAIVDGLRDSVLGFSVNVPGTTAKDVMDMVLITQYFDTMKEIGASSKASSVFIPHGPGAVRDIATQIRDGLLQGAATQRH

SEQ ID NO: 7981 - protein, 287 aa, Sorghum bicolor
MGNLCCCVQVDQSTVAIREQFGKFDGVLEPGCHCMPWFVGKRVAGHLTLRLQQLDVRCETKTKDNVFVNVVASIQYRALAGKASDAFYKLSNTRSQIQAYVFDVIRASVPKLHLDDAFEQKDEIAKAVEEELEKAMSAYGFEIVQTLIVDIEPDEHVKRAMNEINAAARLRAAANEKAEAEKIVQIKRAEGEAEAKYLSGLGIARQRQAIVDGLRDSVLGFSVNVPGTTAKDVMDMVLITQYFDTMKEIGASSKASSVFIPHGPGAVRDIATQIRDGLLQGSSVTQH

SEQ ID NO: 7982 - protein, 287 aa, Cenchrus ciliaris
MGNLCCCVQVDQSTVAIREQFGKFDSVLEPGCHCMPWFMGKRVAGHLTLRLQQLDVRCETKTKDNVFVNVVASVQYRALAGKANDAFYKLSNTRSQIQAYVFDVIRASVPKLILDDAFEQKDEIAKAVEEELEKAMSAYGFEIVQTLIVDIEPDEHVKRAMNEINAAARMRVAANEKAEAEKIVQIKRAEGEAEAKYLSGLGIARQRQAIVDGLRDSVLGFSVNVPGTTAKDVMDMVLITQYFDTMKEIGASSKASSVFIPHGPGAVRDIATQIRDGLLQGSSVSHQ

SEQ ID NO: 7983 - protein, 287 aa, Saccharum officinarum
MGNLCCCVQVDQSTVAIREQFGKFDSVLEPGCHCMPWFAGKRVAGHLTLRLQQLDVRCETKTKDNVFVNVVASIQYRALADKASDAFYKLSNTRSQIQAYVFDVIRASVPKLHLDDAFEQKDEIARAVEEELEKAMSAYGFEIVQTLIVDIEPDEHVKRAMNEINAAARLRAAANEKAEAEKIVQIKRAEGEAEAKYLSGLGIARQRQAIVDGLRDSVLGFSVNVPGTTAKDVMDMVLITQYFDTMKEIGASSKASSVFIPHGPGAVRDIATQIRDGLLQGSSVTQH

SEQ ID NO: 7984 - protein, 287 aa, Zea mays
MGNLCCCVQVDQSTVAIREQFGKFDSVLEPGCHCMPWFAGKRVAGQLTLRLQQLDVRCETKTKDNVFVNVVASIQYRALADKASDAFYKLSNTRSQIQAYVFDVIRASVPKLHLDDAFEQKDEIARAVEEELEKAMSAYGFEIVQTLIVDIEPDEHVKRAMNEINAAARLRAAANEKAEAEKIVQIKRAEGEAEAKYLSGLGIARQRQAIVDGLRDSVLGFSVNVPGTTAKDVMDMVLITQYFDTMKEIGASSKASSVFIPHGPGAVRDIATQIRDGLLQGSSVAKH

SEQ ID NO: 7985 - protein, 287 aa, Brachypodium distachyon
MGNLCCCVQVDQSTVAIREQFGRFDSVLEPGCHCLPWMIGKRIVGHLTLRLQQLDVRCETKTKDNVFVTVVASIQYRPLAGKESDAFYKLTNTRSQIQAYVFDVIRASVPKLNLDDAFEQKNDIAKAVEDELEKAMSAYGFEIVQTLIVDIEPDEHVKRAMNEINAAARMRVAANEKAEAEKIVQIKRAEGEAEAKYLSGLGIARQRQAIVDGLRDSVLGFSVNVPGTTAKDVMDMVLITQYFDTMKEIGASSKSSAVFIPHGPGAVRDIATQIRDGLLQGQSAAHQ

SEQ ID NO: 7986 - protein, 286 aa, Cucumis sativus
MGNLFCCVKVDQSTVAIRETFGKFDEVVEPGCHCLPWFLGAQIAGTLSLRLQQLDVRCETKTKDNVFVNVVASIQYRALADKANDAFYKLSNTRSQIQAYVFDVIRASVPKLNLDDAFEQKNDIAKAVEDELEKAMSAYGFEIVQTLIVDIEPDEHVKRAMNEINAAARLRVAANEKAEAEKILQIKRAEGEAEAKYLSGLGIARQRQAIVDGLRDSVLGFSVNVPGTTAKDVMDMVLVTQYFDTMKEIGAASKSTSVFIPHGPGAVRDVASQIRDGLLQGAATSH

SEQ ID NO: 7987 - protein, 287 aa, Panicum virgatum
MGNLCCCVQVDQSTVAIREQFGKFDSVLEPGCHCMPWFIGKRVAGHLTLRLQQLDVRCETKTKDNVFVNVVASIQYRALAGKASDAFYKLSNTRSQIQAYVFDVIRASVPKLILDDAFEQKDEIAKAVEEELEKAMSAYGFEIVQTLIVDIEPDEHVKRSMNEINAAARLRVAANEKGEAEKIVQIKRAEGEAEAKFLSGLGIARQRQAIVDGLRDSVLGFSVNVPGTTAKDVMDMVLITQYFDTMKEIGASSKASSVFIPHGPGAVRDIATQIREGLLQGSSVSHH

SEQ ID NO: 7988 - protein, 174 aa, Pennisetum glaucum
MGNLCCCVQVDQSTVAIREQFGKFDSVLEPGCHCMPWFMGKRVAGHLTLRLQQLDVRCETKTKDNVFVNVVASIQYRALAGKANDAFYKLSNTRSQIQAYVFDVIRASVPKLILDDAFEQKDEIAKAVEEELEKAMSAYGFEIVQTLIVDIEPETRNERDQRSGEDEGGCQREG

SEQ ID NO: 7989 - protein, 286 aa, Cucumis melo
MGNLFCCVQVDQSTIAIRERFGKFEEVLEPGCHCLPWFLGAQIAGNLSLRLQQLDVRCETKTKDNVFVNVVASIQYRALADKANDAFYKLSNTRSQIQAYVFDVIRASVPKLNLDDAFEQKNDIAKAVEDELEKAMSAYGFEIVQTLIVDIEPDEHVKRAMNEINAAARLRVAANEKAEAEKILQIKRAEGEAEAKYLSGLGIARQRQAIVDGLRDSVLGFSVNVPGTTAKDVMDMVLVTQYFDTMKEIGAASKSTSVFIPHGPGAVRDVASQIRDGLLQGAASSH

SEQ ID NO: 7990 - protein, 286 aa, Citrullus lanatus
MGNLFCCVQVDQSTVAIRERFGRFEEVLEPGCHCLPWFLGAQIAGNLSLRLQQLDVRCETKTKDNVFVNVVASIQYRALADKANDAFYKLSNTRSQIQAYVFDVIRASVPKLNLDDAFEQKNDIAKAVEDELEKAMSAYGFEIVQTLIVDIEPDEHVKRAMNEINAAARLRVAANEKAEAEKILQIKRAEGEAEAKYLSGLGIARQRQAIVDGLRDSVLGFSVNVPGTTAKDVMDMVLVTQYFDTMKEIGAASKSTSVFIPHGPGAVRDVASQIRDGLLQGASSSH

SEQ ID NO: 7991 - protein, 287 aa, Triticum aestivum
MGNLCCCVQVDQSTVAIREQFGKFDSVLEPGCHCLPWIFGKRVVGHLTLRLQQLDVRCETKTKDNVFVTVVASIQYRPLAGKESDAYYKLTNTRSQIQAYVFDVIRASVPKLNLDDAFVQKNDIAKAVEDELEKAMSAYGFEIVQTLIVDIEPDAHVKQAMNEINAAARMRVAANEKAEAEKIVQIKRAEGEAEAKYLSGLGIARQRQAIVDGLRDSVLGFSVNVPGTTAKDVMDMVLITQYFDTMKEIGASSKSSAVFIPHGPGAVRDIATQIRDGLLQGQSASDN

SEQ ID NO: 7992 - protein, 151 aa, Cucurbita pepo
MSAYGFEIVQTLIVDIEPDEHVKRAMNEINAAARLRVAANEKAEAEKILQIKRAEGEAEAKYLSGLGIARQRQAIVDGLRDSVLGFSVNVPGTTAKDVMDMVLVTQYFDTMKEIGASSKSTSVFIPHGPGAVRDVASQIRDGLLQGASSSH

SEQ ID NO: 7993 - protein, 89 aa, Secale cereale
MGNLCCCVQVDQSTVAIREQFGKFDSVLQPGCHCLPWVLGKRVVGHLTLRLQQLDVRCETKTKDNVFVTVVASIQYRPLAGKEVTHTTN

SEQ ID NO: 7994 - protein, 162 aa, Secale cereale
MGNLCCCVQVDQSTVAIREQFGKFDSVLQPGCHCLPWVLGKRVVGHLTLRLQQLDVRCETKTKDNVFVTVVASIQYRPLAGKESDAYYKLTNTRSQIQAYVFDVIRASVPKLNLDDAFVQKNDIAKAVEDELEKAMSAYGFEIVQTPHCRHRARRPCQAGDE

SEQ ID NO: 7995 - protein, 287 aa, Leymus cinereus x Leymus triticoides
MGNLCCCVQVDQSTVAIREQFGKFDSVLEPGCHCLPWIFGKRVVGHLTLRMQQLDVRCETKTKDNVFVTVVASIQYRPLAGKESDAYYKLTNTRSQIQAYVFDVIRASVPKLNLDDAFVQKNDIAKAVEDELEKAMSAYGFEIVQTLIVDIEPDAHVKQAMNEINAAARMRVAANEKAEAEKIVQIKRAEGEAEAKYLSGLGIARQRQAIVDGLRDSVLGFSVNVPGTTAKDVMDMVLITQYFDTMKEIGASSKSSAVFIPHGPGAVRDIATQIRDGLLQGQSASDN

SEQ ID NO: 7996 - protein, 287 aa, Secale cereale
MGNLCCCVQVDQSTVAIREQFGKFDSVLQPGCHCLPWILGKRVVGHLTLRLQQLDVRCETKTKDNVFVTVVASIQYRPLAGKESDAYYKLTNTRSQIQAYVFDVIRASVPKLNLDDAFVQKNDIAKAVEDELEKAMSAYGFEIVQTLIVDIEPDAHVKQAMNEINAAARMRVAANEKAEAEKIVQIKRAEGEAEAKYLSGLGIARQRQAIVDGLRDSVLGFSVNVPGTTAKDVMDMVLITQYFDTMKEIGASSKSSAVFIPHGPGAVRDIATQIRDGLLQGQSASDN

SEQ ID NO: 7997 - protein, 287 aa, Hordeum vulgare
MGNLCCCVQVDQSTVAIREQFGKFDSVLQPGCHCLPWIFGKRVVGHLTLRLQQLDVRCETKTKDNVFVTVVASIQYRPLAGKESDAYYKLTNTRSQIQAYVFDVIRASVPKLNLDDAFVQKNDIAKAVEDELEKAMSAYGFEIVQTLIVDIEPDAHVKQAMNEINAAARMRVAANEKAEAEKIVQIKRAEGEAEAKYLSGLGIARQRQAIVDGLRDSVLGFAVNVPGTTAKDVMDMVLITQYFDTMKEIGASSKSSAVFIPHGPGAVRDIATQIRDGLLQGQSASDN

SEQ ID NO: 7998 - protein, 282 aa, Avena sativa
MGNLLCCVQVDQSTVAIREQFGKFDSVLEPGCHCLPWMVGKRIVGHLTLRLQQLDVRCETKTKDNVFVTVVASIQYRPLAGKESDAFYKLTNTRSQIQAYVFDVIRASVPKLLLDDAFEQKNDIAKAVEDELEKAMSAYGFEIVQTLIVDIEPDENVKRAMNDINAAARMRVAANEKAEAEKIVQIKRAEGEAEAKYLSGLGIARQRQAIVDGLRDSVMGFAENVPGTSAKDVMDMVLITQYFDTMKEIGASSKSSAVFIPHGPGAVRDIATQIRDGLLQGQ

SEQ ID NO: 7999 - protein, 285 aa, Elaeis guineensis
MGQLLCCVQVDQSTVAIRETFGKFDDVLEPGCHCLPWIFGRRIAGHLSLRLQQLDVRCETKTKDNVFVNVVASIQYRALSDKANDAFYKLSNTRSQIQAYVFDVIRASVPKLNLDDAFEQKNDIAKAVEEELEKAMSAYGYEIVQTLIVDIEPDEHVKRAMNEINAAARLRVAANEKAEAEKIIQIKRAEGEAESKYLSGLGIARQRQAIVDGLRDSVLGFSVNVPGTTAKDVMDMVLVTQYFDTMKEIGAASKSSAVFIPHGPGAVRDVATQIRDGLLQASAHN

SEQ ID NO: 8000 - protein, 285 aa, Carica papaya
MGNLFCCVQVDQSTVAIRERFGKFDDVLEPGCHCLPWFLGSQLAGHLSLRLQQLDVRCETKTKDNVFVNVVASIQYRALADKANDAFYKLSNTRTQIQAYVFDVIRASVPKLNLDDVFEQKNEIAKAVEDELEKAMSAYGYEIVQTLIVDIEPDEHVKRAMNEINAAARLRVAANEKAEAEKILQIKRAEGEAESKYLSGLGIARQRQAIVDGLRDSVLGFSVNVPGTTAKDVMDMVLVTQYFDTMKEIGAASKSSAVFIPHGPGAVRDVATQIRDGLLQASSHQ

SEQ ID NO: 8001 - protein, 287 aa, Triticum aestivum
MGNLCCCVQVDQSTVAIREQFGKFDSVLEPGCHCLPWIFGKRVVGHLTLRLQQLDVRCETKTKDNVFVTVVASIQYRPLAGKESDAYYKLTNTRSQIQAYVFDVIRASVPKLNLDDAFVQKNDIAQAVEDELEKAMSAYGFEIVQTLIVDIEPDAHVKQAMNEINAAARMRVAANEKAEAEKIVQIKRAEGEAEAKYLSGLGIARQRQAIVDGLRDSVLGFSVNVPGTTAKDVMDMVLITQYFDTMKEVGASSKSSAVFIPHGPGAVRDIATQIRDGLLQGQSASDN

SEQ ID NO: 8002 - protein, 308 aa, Secale cereale
PPFPTLLQPRTEVWAICAAVFRSISLPWPSESSLGSLTVCFSQDATCLPWVLGKRVVGHLTLRLQQLDVRCETKTKDNVFVTVVASIQYRPLAGKESDAYYKLTNTRSQIQAYVFDVIRASVPKLNLDDAFVQKNDIAKAVEDELEKAMSAYGFEIVQTLIVDIEPDAHVKQAMNEINAAARMRVAANEKAEAEKIVQIKRAEGEAEAKYLSGLGIARQRQAIVDGLRDSVLGFSVNVPGTTAKDVMDMVLITQYFDTMKEIGASSKSSAVFIPMALVRFVTSPRRSATVFFRASLPLTTSLLRRHEL

SEQ ID NO: 8003 - protein, 285 aa, Catharanthus roseus
MGNLFCCVQVDQSTVAIKERFGRFQEVLEPGCHCMPWFLGSQLAGHLSLRLQQLDVRCETKTKDNVFVNVVASIQYRALGDKANDAFYKLSNTRSQIQAYVFDVIRASVPKLNLDDAFEQKNEIAKAVEDELEKAMSAYGYEIVQTLIVDIEPDEHVKRAMNEINAAARLRVAANEKAEAEKILQIKRAEGEAEAKYLSGLGIARQRQAIVDGLRDSVLGFSVNVPGTTAKDVMDMVLVTQYFDTMKEIGATSKSSAVFIPHGPGAVRDVATQIRDGLLQASTHQ

SEQ ID NO: 8004 - protein, 130 aa, Tripterygium wilfordii
MGNLLCCIQVGQSTVAIKEQFGKFDGVLEPGCHCLPWFLGSQLAGHLSLRLQQLDVKCETKTKDNVFVNVVASIQYRALADKANDAFYKLSNTKSQIQAYVFDVIRASVPKLNLDDAFEQKNEYCKSCGR

SEQ ID NO: 8005 - protein, 287 aa, Triticum aestivum
MGNLCCCVQVDQSTVAIREQFGKFDSVLEPGCHCLPWIFGKRVVGHLTLRLQQLDVRCETKTKDNVFVTVVASIQYRPLAGKESDAYYKLTNTRSQIQAYVFDVIRASVPKLNLDDAFVQKNDIAQAVEDELEKAMSAYGFEIVQTLIVDIEPDAHVKQAMNEINAAARMRVAANEKAEAEKIVQIKRAEGEAEAKYLSGLGIARQRQAIVDGLRDSVLGFSVNVPGTTAKDVMDMVLITQYFDTMKEVGASSKSSAVFIPHGPGAVRDIATQIRDDLLQGQSASDN

SEQ ID NO: 8006 - protein, 287 aa, Triticum aestivum
MGNLCCCVQVDQSTVAIREQFGKFDSVLEPGCHFLPWIFGKRVVGHLTLRLQQLDVRCETKTKDNVFVTVVASIQYRPLAGKESDAYYKLTNTRSQIQAYVFDVIRASVPKLNLDDAFVQKNDIAQAVEDELEKAMSAYGFEIVQTLIVDIEPDAHVKQAMNEINAAARMRVAANEKAEAEKIVQIKRAEGEAEAKYLSGLGIARQRQAIVDGLRDSVLGFSVNVPGTTAKDVMDMVLITQYFDTMKEVGASSKSSAVFIPHGPGAVRDIATQIRDGLLQGQSASDN

SEQ ID NO: 8007 - protein, 285 aa, Tabernaemontana elegans
MGNLFCCVQVEQSTVAIKERFGKFEDVLEPGCHCMPWFLGSQLAGHLSLRLQQLDVRCETKTKDNVFVNVVASIQYRALGDKANDAFYKLSNTRSQIQAYVFDVIRASVPKLNLDDAFEQKNDIAKAVEDELEKAMSAYGYEIVQTLIVDIEPDEHVKRAMNEINAAARLRLAANEKAEAEKILQIKRAEGEAEAKYLSGLGIARQRQAIVDGLRDSVLGFSVNVPGTTAKDVMDMVLVTQYFDTMKEIGAASKSSAVFIPHGPGAVRDVATQIRDGLLQASAHE

SEQ ID NO: 8008 - protein, 287 aa, Unknown
  Sequence found in Organisms: Cannabis sativa, Humulus lupulus
MGNLFCCVQVDQSTVAIKERFGKFDDVLEPGCHCLPWFLGSQLAGHLTLRLQQLDVRCETKTKDNVFVNVVASIQYRALADKASDAFYKLSNTRSQIQAYVFDVIRASVPKLNLDDTFEQKNEIAKAVEEELEKAMSAYGYEIVQTLIVDIEPDEHVKRAMNEINAAARMRVAANEKAEAEKILQIKRAEGEAESKYLSGLGIARQRQAIVDGLRDSVLGFSVNVPGTTAKDVMDMVLVTQYFDTMKEIGAASKSSAVFIPHGPGAVRDIATQIRDGLLQGSHAQQQ

SEQ ID NO: 8009 - protein, 284 aa, Olea europaea
MGNLLCCVQVDQSKVAIKERFGKFDEVLEPGCHCMPWFLGSQVAGYLSLRLQQLDVRCETKTKDNVFVNVVASIQYRALADKASDAFYKLSNTRSQIQAYVFDVIRASVPKLNLDDAFEQKNDIAKAVEDELEKAMSAYGYEIVQTLIVDIEPDEHVKRAMNEINAAARLRLAANEKAEAEKILQIKRAEGEAEAKYLSGLGIARQRQAIVDGLRDSVLGFSVNVPGTTAKDVMDMVLVTQYFDTMKEIGATSKSSAVFIPHGPGAVRDVATQIRDGLLQASQA

SEQ ID NO: 8010 - protein, 286 aa, Unknown
  Sequence found in Organisms: Gossypium hirsutum, Gossypium raimondii
MGNLFCCVQVDQSTVAIKERFGKFDEVLEPGCHCLPWCIGSQLAGHLTLRLQQLDVRCETKTKDNVFVNVVASIQYRALAEKANDAFYKLSNPRTQIQAYVFDVIRASVPKLDLDDAFEQKNDIAKAVEDELEKAMSAYGYEIVQTLIVDIEPDEHVKRAMNEINAAARMRVAANEKAEAEKIIQIKRAEGEAESKYLSGVGIARQRQAIVDGLRDSVLGFSVNVPGTTAKDVLDMVLITQYFDTMKEIGAASKSSSVFIPHGPGAVRDIATQIRDGLLQASHHHE

SEQ ID NO: 8011 - protein, 237 aa, Secale cereale
MPLLALGLRERVVGHLTLRLQQLDVRCETRQRTMCLSLLLHQFSTVLWLDKESDAYYKLTNTRSQIQAYVFDVIRASVPKLNLDDAFVQKNDIAKAVEDELEKAMSAYGFEIVQTLIVDIEPDAHVKQAMNEINAAARMRVAANEKAEAEKIVQIKRAEGEAEAKYLSGLGIARQRQAIVDGLRDSVLGFSVNVPGTTAKDVMDMVLITQYFDTMKEIGASSKSSAVFTPPWPWCGS

SEQ ID NO: 8012 - protein, 286 aa, Antirrhinum majus
MGNLFCCIQVDQSTVAIKERFGKFEEVLEPGCHCLPWVFGSQLAGHLTLRLQQLDVKCETKTKDNVFVNVVASIQYRALADKASDAFYKLSNTRSQIQAYVFDVIRASVPKLNLDDAFEQKNDIAKAVEDELEKAMSAYGYEIVQTLIVDIEPDEHVKRAMNEINAAARMRLAANEKAEAEKILQIKRAEGEAEAKYLSGLGIARQRQAIVDGLRDSVLGFSVNVPGTTAKDVMDMVLVTQYFDTMKEIGASSKSSAVFIPHGPGAVRDVAAQIRDGLLQGSHGPA

SEQ ID NO: 8013 - protein, 290 aa, Avena sativa
MGNLLCCVQVDQSTVAIREQFGKFDSVLEPGCHCLPWMVGKRIAGHLTLRLQQLDVRCETKTKDNVFVTVVASIQYRPLAGKESDAFYKLTNTRSQIQAYVFDVIRASVPKLLLDNAFEQKNDIAKSVEDELEKAMSAYGFEIVQTLIVDIEPDEHVKRAMNEINAAARMRVAANEKAEAEKIVQIKRAEGEAEAKYLSGLGIARQRQAIVDGLRDSVIGFAENVPGTSAKDVMDMVLITQYFDTMKEIGASSKSSAVFIPHGPGAVSDVAAQIRDGLLQGHSAAAAGRH

SEQ ID NO: 8014 - protein, 285 aa, Amsonia hubrichtii
MGNLFCCVQVDQSTVAIKERFGKFEEVLEPGCHCMPWFLGSQMAGHLSLRLQQLDVRCETKTKDNVFVNVVASIQYRALGGKASDAFYKLSNTRSQIQAYVFDVIRASVPKLNLDDTFEQKNDIAKAVEDELEKAMSAYGYEIVQTLIVDIEPDEHVKRAMNEINAAARMRLAANEKAEAEKILQIKRAEGEAEAKYLSGLGIARQRQAIVDGLRDSVLGFSVNVPGTTAKDVMDMVLVTQYFDTMKEIGAASKSSAVFIPHGPGAVRDVASQIRDGLLQASAHE

SEQ ID NO: 8015 - protein, 286 aa, Liriodendron tulipifera
  misc_feature (272)..(273): Xaa can be any naturally occurring amino acid
  misc_feature (278)..(279): Xaa can be any naturally occurring amino acid
  misc_feature (282)..(282): Xaa can be any naturally occurring amino acid
MGQLLCCIQVDQSTVAIKERFGKFDEVLEPGCHCLPWFLGSQVAGHLSLRLQQLDVRCETKTKDNVFVNVVASIQYRALADKANDAFYKLSNTRSQIQAYVFDVIRASVPKLNLDDTFEQKNDIAKAVEDELEKAMSAYGFEIVQTLIVDIEPDEHVKRAMNEINAAARLRVAANEKAEAEKILQIKRAEGEAESKYLSGLGIARQRQAIVDGLRDSVLGFSVNVPGTTAKDVMDMVLVTQYFDTMKEIGAASKSSAIFIPHGPGAVRDVAXXIRDGXXQGXAANH

SEQ ID NO: 8016 - protein, 130 aa, Secale cereale
MGNLCCCVQVDQSTVAIREQFGKFDSVLQPGCHCLPWVLGKRVVGHLTLRLQQLDVRCETKTKDNVFVTVVASIQYRPLAGQRSDAYYKLTNTRSQIQAYCFDVIRASVTKLNLDDVFRAEERYSKGCGR

SEQ ID NO: 8017 - protein, 286 aa, Vitis vinifera
MGNLLGCIQVDQSTVAIKERFGKFEEVLEPGCHCLPWCFGSQLAGHLSLRLQQLDVRCETKTKDNVFVNVVASIQYRALADKANDAFYKLSNTRSQIQAYVFDVIRASVPKLNLDDAFEQKNEIAKSVEDELEKAMSAYGYEIVQTLIVDIEPDEHVKRAMNEINAAARMRVAANEKAEAEKILQIKRAEGEAESKYLSGLGIARQRQAIVDGLRDSVLGFSVNVPGTTAKDVMDMVLVTQYFDTMKEIGAASKSSAVFIPHGPGAVRDVATQIRDGLLQSTLSHQ

SEQ ID NO: 8018 - protein, 287 aa, Unknown
  Sequence found in Organisms: Brassica napus, Brassica juncea, Brassica rapa
MGNLFCCVQVDQSTVAIKETFGKFEEVLEPGCHFLPWCLGQQVAGYLSLRLQQLDVRCETKTKDNVFVNVVASIQYRALANNANDAFYKLSNTRSQIQAYVFDVIRASVPKLILDDVFEQKNEIAKAVEEELEKAMSAYGFEIVQTLIVDIEPDEHVKRAMNEINAAARMRLAANEKAEAEKILQIKRAEGEAEAKYLSGLGIARQRQAIVDGLRDSVLGFSVNVPGTTAKDVMDMVLVTQYFDTMKEIGASSKSSAVFIPHGPGAVRDVATQIRDGLLQGSFADQS

SEQ ID NO: 8019 - protein, 285 aa, Lactuca sativa
MGNLFCLVQVDQSTVAIKETFGKFDDVLEPGLHCVPWIFGSQVAGQLTLRLQQLDVKCETKTKDNVFVNVVASIQYRALADKASDAFYKLSNTRSQIQAYVFDVIRASVPKLNLDDAFEQKNEIAKAVEDELEKAMSAYGFEIVQTLIVDIEPDEHVKRAMNEINAAARFRMAATEKAEAEKILQIKRAEGEAESKYLSGLGIARQRQAIVDGLRDSVLGFSVNVPGTTAKDVMDMVLVTQYFDTMKEIGASSKSSAVFIPHGPGAVRDVAAQIRDGLLQGNATH

SEQ ID NO: 8020 - protein, 287 aa, Unknown
  Sequence found in Organisms: Brassica napus, Brassica rapa
MGNLFCCIQVDQSTVAIKETFGKFEDVLEPGCHFLPWCLGQQVAGHLSLRLQQLDVRCETKTKDNVFVNVVASIQYRALANKANDAFYKLSNTRSQIQAYVFDVIRASVPKLLLDDVFEQKNEIAKAVEEELEKAMSAYGFEIVQTLIVDIEPDEHVKRAMNEINAAARMRLAANEKAEAEKILQIKRAEGEAEAKYLSGLGIARQRQAIVDGLRDSVLGFSVNVPGTTAKDVMDMVLVTQYFDTMKEIGASSKSSAVFIPHGPGAVRDVATQIRDGLLQGSFAEQP

SEQ ID NO: 8021 - protein, 285 aa, Euonymus alatus
MGNLFCCIQVDQSNVAIKERFGKFEEVLEPGCHCLPWFLGSQLAGHLSLRLQQLDVKCETKTKDNVFVNVVASIQYRALAHKANDAFYKLSNTRSQIQAYVFDVIRASVPKLNLDAAFEQKNEIAKAVEDELEKAMSAYGFEIVQTLIVDIEPDEQVKRAMNEINAAARMRLATNERAEAEKILQIKRAEGEAEAKYLSGLGIARQRQAIVDGLRDSVLGFSVNVPGTTAKDVMDMVLVTQYFDTMKEIGASSKSSAVFIPHGPGAVRDVASQIRDGLLQGSMSH

SEQ ID NO: 8022 - protein, 285 aa, Euonymus alatus
MGNLFCCIQVDQSNVAIKERFGKFEEVLEPGCHCLPWFLGSQLAGHLSLRLQQLDVKCETKTKDNVFVNVVASIQYRALAHKANDAFYKLSNTRSQIQAYVFDVIRASVPKLNLDAAFEQKNEIAKAVEEELEKAMSAYGFEIVQTLIVDIEPDEQVKRAMNEINAAARMRLATNEKAEAEKILQIKRAEGEAEAKYLSGLGIARQRQAIVDGLRDSVLGFSVNVPGTTAKDVMDMVLVTQYFDTMKEIGASSKSSAVFIPHGPGAVRDVASQIRDGLLQGSMSH

SEQ ID NO: 8023 - protein, 287 aa, Olea europaea
MGNLLCCVQVDQSTVAIKERFGKFDEVLEPGCHCLPWFLGSQLAGSLSLRLQQLDVRCETKTKDNVFVNVVASIQYRALSDKASDAFYKLSNTRTQIQAYVFDVIRASVPKLYLDDAFEQKNEIAKAVEDELEKAMSAYGFEIVQTLIVDIEPDEHVKRAMNEINAAARLRLAANEKAEAEKILQIKRAEGEAEAKYLAGLGIARQRQAIVDGLRDSVLGFSVNVPGTTAKDVMDMVLVTQYFDTMKEIGATSKSSAVFIPHGPGAVRDVATQIRDGLLQASQHNLS

SEQ ID NO: 8024 - protein, 284 aa, Phalaenopsis aphrodite
MGQLLCCVQIDQSTVAIREQFGKFDDVLEPGCHCVPWFMGSHIAGYLSLRLQQLDVKCETKTKDNVFVNVVASIQYRALAGKANDAFYKLSNTRTQIQAYVFDVIRASVPKLNLDDVFEQKNEIARAVEDELEKAMSAYGYEIVQTLIVDIEPDEHVKRAMNEINAAARLRSAANEKAEAEKIIQIKRAEGEAEAKYLSGLGIARQRQAIVDGLRDSVLGFSVNVPGTTAKDVMDMVLVTQYFDTMKEIGASSKSSAVFIPHGPGAVRDVADQIRDGLLQANRV

SEQ ID NO: 8025 - protein, 284 aa, Rosa hybrid cultivar
MGNLFCLVQVDQSTVAMREQFGKFVEVMEPGCHCMPWFLGHQVAGHLSLRLQQLDVRCETKTKDNVFVNVVASIQYRALADKANDAFYKLSNTRSQIQAYVFDVIRASVPKLLLDDAFEQKNEIAKAVEDELEKAMSAYGYEIVQTLIVDIEPDEHVKRAMNEINAAARMRVAANEKAEAEKILQIKRAEGEAESKYLSGLGIARQRQAIVDGLRDSVLGFAVNVPGTTAKDVMDMVLVTQYFDTMKEIGASSKSSAVFIPHGPGAVRDVASQIRDGLLQGSHQ

SEQ ID NO: 8026 - protein, 284 aa, Fragaria vesca
MGNLLCCVQVDQSTVAMREQFGKFVDVMEPGCHCMPWFLGHQVAGHLSLRLQQLDVRCETKTKDNVFVNVVASIQYRALADKANDAFYKLSNTRSQIQAYVFDVIRASVPKLLLDDAFEQKNEIAKAVEDELEKAMSAYGYEIVQTLIVDIEPDEHVKRAMNEINAAARMRVAANEKAEAEKILQIKRAEGEAESKYLSGLGIARQRQAIVDGLRDSVLGFAVNVPGTTAKDVMDMVLVTQYFDTMKEIGASSKSSAVFIPHGPGAVRDVASQIRDGLLQGSQQ

SEQ ID NO: 8027 - protein, 287 aa, Eutrema parvulum
MGNLLCCVQVDQSTVAIKETFGRFEDVLEPGCHFLPWCLGKQVAGYLSLRLQQLDVRCETKTKDNVFVNVVASIQYRALANKANDAFYKLSNTRSQIQAYVFDVIRASVPKLLLDDVFEQKNEIAKAVEEELEKAMSAYGFEIVQTLIVDIEPDEHVKRAMNEINAAARMRLAANEKAEAEKILQIKRAEGEAEAKYLSGLGIARQRQAIVDGLRDSVLGFSVNVPGTTAKDVMDMVLVTQYFDTMKEIGASSKSSAVFIPHGPGAVRDVATQIRDGLLQGSFADQS

SEQ ID NO: 8028 - protein, 285 aa, Tragopogon dubius
MGNLFCLVQVDQSTVAIKETFGKFADVLEPGLHCVPWVFGSQVAGYLTLRLQQLDVKCETKTKDNVFVNVVASIQYRALADKASDAFYKLSNTRSQIQAYVFDVIRASVPKLNLDDAFEQKNEIAKAVEEELEKAMSAYGFEIVQTLIVDIEPDEHVKRAMNEINAAARLRMAATEKAEAEKILQIKRAEGEAESKYLSGLGIARQRQAIVDGLRDSVLGFSVNVPGTTAKDVMDMVLVTQYFDTMKEIGASSKSSAVFIPHGPGAVRDVAAQIRDGLLQGNATT

SEQ ID NO: 8029 - protein, 288 aa, Olea europaea
MGNICCCAQVDQSTVAIREQFGKFDEVLEPGCRCVPWFLGKRLAGHLSLRLQQLDVRCETKTKDNVFVNVVASVQYRALADKASDAFYRLSNTRNQIQAYVFDVIRASVPKMNLDDAFEQKNEIAMAVEDELEKAMSAYGYKIVQTLIVDIEPDEHVKRAMNEINAAARLRVAANEKAEAEKILQIKRAEGEAEAKYLSGLGIARQRQAIVDGLRDSVLGFSVNVPGTTAKDVMDMVLVTQYFDTMKEIGATSKSSAVFIPHGPGAVRDVATQIRDGLLQASTQDHLS

SEQ ID NO: 8030 - protein, 286 aa, Theobroma cacao
MGNLFCCVQVDQSTVAIKERFGKFDEVLQPGCHCLPWCLGSQLAGHLTLRLQQLDVRCETKTKDNVFVNVVASVQYRSLAEKANDAFYKLSNPRTQIQAYVFDVIRASVPKLDLDDAFEQKNDIAKAVEDELEKAMSAYGYEIVQTLIVDIEPDEHVKRAMNEINAAARMRVAANEKAEAEKIIQIKRAEGEAESKYLSGVGIARQRQAIVDGLRDSVLGFSVNVPGTTAKDVLDMVLITQYFDTMKEIGAASKSSSVFIPHGPGAVRDIATQIRDGLLQASHHHE

SEQ ID NO: 8031 - protein, 334 aa, Secale cereale
DLGPRSFARTLVVQRTRGRGGFATHTTHCHFTVTAPPSHSLNPGRRYGQSVLLCSGRSVYRGHQRAVWKFDSVLQPDRLPVVPWILGKRVVGHLTLRLQQLDVRCETKTKDNVFVTVVASIQYRPLAGKESDAYYKLTNTRSQIQAYVFDVIRASVPKLNLDDAFVQKNDIAKAVEDELEKAMSAYGFEIVQTLIVDIEPDAHVKQAMNEINAAARMRVAANEKAEAEKIVQIKRAEGEAEAKYLSGLGIARQRQAIVDGLRDSVLGFSVNVPGTTAKDVMDMVLITQYFDTMKEIGASSKSSAVFIPHGPGAVRDIATQIRDGLLQGQSASDN

SEQ ID NO: 8032 - protein, 287 aa, Brassica juncea
MGNLFCCVQVDQSTVAIKETFGKFEDVLEPGCHFLPWCLGQQVAGYLSLRLQQLDVRCETKTKDNVFVNVVASIQYRALANNANDAFYKLSNTRSQIQAYVFDVIRASVPKLILDDVFEQKNEIAKAVEEELEKAMSAYGFEIVQTLIVDIEPDEHVKRAMNEINAAARMRLAANEKAEAEKILQIKRAEGEAEAKYLSGLGIARQRQAIVDGLRDSVLGSSVNVPGTTAKDVMDMVLVTQYFDTMKEIGASSKSSAVFIPHGPGAVRDVATQIRDGLLQGSFAGQS

SEQ ID NO: 8033 - protein, 287 aa, Brassica napus
MGNLCCCVQVDQSTVAIKETFGKFEDVLEPGCHFLPWCLGQQVAGYLSLRLQQLDVRCETKTKDNVFVNVVASIQYRALANNANDAFYKLSNTRSQIQAYVFDVIRASVPKLILDDVFEQKNEIAKAVEEELEKAMSAYGFEIVQTLIVDIEPDEHVKRAMNEINAAARMRLAANEKAEAEKILQIKRAEGEAEAKYLSGLGIARQRQAIVDGLRDSVLGFSVNVPGTTAKDVMDMVLVTQYFDTMKEIGASSKSSAVFIPHGPGAVRDVATQIRDGLLQGSFADQS

SEQ ID NO: 8034 - protein, 285 aa, Castanea mollissima
MGNLLCCVQVDQSTVAIKEKFGKFEEVLEPGCHFLPWCLGSQLSGHLTLRLQQLDVRCETKTKDNVFVNVVASIQYRALADKASDAFYKLSNTRSQIQAYVFDVIRASVPKLTLDDAFEQKNDIAKAVEDELEKAMSAYGYEIVQTLIVDIEPDEHVKRAMNEINAAARMRVAANEKAEAEKILQIKRAEGEAESKYLSGLGIARQRQAIVDGLRDSVLGFSVNVPGTTPKDVMDMVLVTQYFDTMKEIGAASKSSAVFIPHGPGAVRDVASQIRDGLLQGSVQH

SEQ ID NO: 8035 - protein, 285 aa, Cynara scolymus
  misc_feature (283)..(283): Xaa can be any naturally occurring amino acid
MGNLVCLVQVDQSTVAIKETFGKFDDVLEPGCHCVPWIFGSRLAGHLTLRVQQLDVKCETKTKDNVFVNVVASIQYRALADKASDAFYKLSNTRSQIQAYVFDVIRASVPKLNLDDAFEQKNDIAKAVEEELEKAMSAYGFEIVQTLIVDIEPDEHVKRAMNEINAAARLRMAATEKAEAEKILQIKRAEGEAESKYLSGLGIARQRQAIVDGLRDSVLGFSVNVPGTTAKDVMDMVLVTQYFDTMKEIGAASKSSAVFIPHGPGAVRDVAMQIRDGLLQGNXAS

SEQ ID NO: 8036 - protein, 284 aa, Phalaenopsis aphrodite
MGQLLCCVQIDQSTVAIREQFGKFDDVLEPGCHCVPWFMGSHIAGYLSLRLQQLDVKCETKTKDNVFVNVVASIQYRALAGKANDAFYKLSNTRTQIQAYVFDVIRASVPKLNLDDVFEQKNEIARAVEDELEKAMSAYGYEIVQTLIVDIEPDEHVKRAMNEINAAARLRSAANEKAEAEKIIQIKRAEGEAEAKYLSGLGIARQRQAIVDGLRDSVLGFSVNVPGTTAKDVMDMVLVTQYFDTMKEIGAASKSSAVFIPHGPGAVRDVADQIRDGLLQANRV

SEQ ID NO: 8037 - protein, 284 aa, Prunus persica
MGNLFCCVQVDQSKVAVKEKFGRFVEVLEPGCHCLPWFLGHQIAGHLSLRLQQLDVRCETKTKDNVFVNVVASIQYRALADKADDAFYKLSNTRSQIQAYVFDVIRASVPKLNLDAAFEQKNEIAKAVEDELEKAMSAYGYEIVQTLIVDIEPDEHVKRAMNEINAAARMRVAANEKAEAEKILQIKRAEGEAESKYLSGLGIARQRQAIVDGLRDSVLGFSVNVPGTTAKDVMDMVLVTQYFDTMKEIGASSKSSAVFIPHGPGSVRDVASQIRDGLLQGSHQ

SEQ ID NO: 8038 - protein, 287 aa, Raphanus sativus
MGNLLCCVQVDQSTVAIKETFGKFEDVLEPGCHFLPWCLGQQVAGYLSLRLQQLDVRCETKTKDNVFVNVVASIQYRALANNANDAFYKLSNTRSQIQAYVFDVIRASVPKLILDDVFEQKNEIAKAVEEELEKAMSAYGFEIVQTLIVDIEPDEHVKRAMNEINAAARMRLAANEKAEAEKILQIKRAEGEAEAKYLSGLGIARQRQAIVDGLRDSVLGFSVNVPGTTAKDVMDMVLVTQYFDTMKEIGASSKSSAVFIPHGPGAVRDVATQIRDGLLQGSFADQS

SEQ ID NO: 8039 - protein, 287 aa, Carthamus tinctorius
  misc_feature (275)..(275): Xaa can be any naturally occurring amino acid
MGNLLCLVQVDQSTVAIKETFGKFDDVLEPGCHCVPWIFGSRLVGHLTLRLQQLDVKCETKTKDNVFVNVVASIQYRALADKASDAFYKLSNTRSQIQAYVFDVIRASVPKLNLDDAFEQKNDIAKAVEEELEKAMSAYGFEIVQTLIVDIEPDEHVKRAMNEINAAARLRMAATEKAEAEKILQIKRAEGEAESKYLSGLGIARQRQAIVDGLRDSVLGFSVNVPGTTAKDVMDMVLVTQYFDTMKEIGAASKSSAVFIPHGPGAVRDVATQIXDGLLQEMLPADH

SEQ ID NO: 8040 - protein, 286 aa, Helianthus annuus
MGNLFCLVQVDQSTVAIKETFGKFDDVLEPGCHCVPWIFGSRLAGHLTLRVQQLDVKCETKTKDNVFVNVVASIQYRALTDKASDAFYKLSNTRAQIQAYVFDVIRASVPKLNLDDVFEQKNEIAKAVEEELEKAMSAYGFEIVQTLIVDIEPDEHVKRAMNEINAAARLRVAATEKAEAEKILQIKRAEGEAESKYLSGLGIARQRQAIVDGLRDSVLGFSVNVPGTTAKDVMDMVLVTQYFDTMKEIGAASKSSAVFIPHGPGAVRDVATQIRDGLLQGSAAAS

SEQ ID NO: 8041 - protein, 286 aa, Coffea canephora
MGNLFCCVQVDQSTVAMKERFGKFQDVLEPGCHCMPWFLGSQVAGHLSLRLQQLDVRCETKTKDNVFVNVVASIQYRAIVEKANDAFYRLSNTRTQIQAYVFDVIRASVPKLNLDDAFEQKNEIAKAVEEELEKAMSAYGYEIVQTLIVDIEPDEHVKRAMNEINAAARLRVAANEKAEAEKILQIKRAEGEAEAKYLSGMGIARQRQAIVDGLRDSVLGFSVNVPGTTAKDVMDMVLVTQYFDTMKEIGAASKSSAVFIPHGPGAVRDVATQIRDGLLQASAEHL

SEQ ID NO: 8042 - protein, 290 aa, Solanum phureja
MGNLFCCVQVDQSTVAIKERFGKFDDVLEPGCHFLPWCIGSQVAGYLTLRLQQLDVRCETKSKDNVFVTVVASIQYRALADKATDAFYKLSNTRSQIQAYVFDVIRASVPKLNLDDVFEQKNQIAKAVEDELEKAMSAYGYEIVQTLIVDIEPDEHVKRAMNEINAAARLRVAANEKAEAEKIVQIKRAEGDAEAKYLAGLGIARQRQAIVDGLRDSVLGFSVNVPGTTAKDVLDMVLITQYFDTMKEIGASSKSSAVFIPHGPGAVSDIAGQIRQGLLQGSAVEQQNLL

SEQ ID NO: 8043 - protein, 285 aa, Juglans hindsii x Juglans regia
  misc_feature (83)..(83): Xaa can be any naturally occurring amino acid
  misc_feature (226)..(226): Xaa can be any naturally occurring amino acid
MGNLLCCVQVDQSTVAIKERFGKFDEVLQPGCHCLPWCLGSQLSGHLTLRLQQLDVKCETKTKDNVFVNVVASIQYRALADKXSDAFYKLSNTRTQIQAYVFDVIRASVPKLNLDDAFEQKNDIAKAVEDELEKAMSAYGYEIVQTLIIDIEPDEHVKRAMNEINAAARMRVAANEKAEAEKILQIKRAEGEAESKYLSGLGIARQRQAIVDGLRDSVLGFSVNVXGTTAKDVMDMVLVTQYFDTMKEIGAASKSSAVFIPHGPGAVRDVATQIRDGLLQGSSHQ

SEQ ID NO: 8044 - protein, 285 aa, Aquilegia formosa
MGNLFCCVQVDQSTVAIAERFGKFNEVMEPGCHCLPWPVGYKVAGHLSLRLQQLDVKCETKTKDNVFVNVVASIQYRALADKASDAFYKLTNTRSQIQAYVFDVIRASVPKLNLDDTFEQKNEIAKAVEEELEKAMSAYGYEIVQTLIVDIEPDEHVKRAMNEINAAARMRVAAKEKAEAEKILQIKRAEGEAEAKYLSGLGIARQRQAIVDGLRDSVLGFSVNVPGTTAKDVMDMVLVTQYFDTMKEIGASSKSSAVFIPHGPGAVRDVAAQIRDGLLQGSSTQ

SEQ ID NO: 8045 - protein, 284 aa, Prunus mume
MGNLFCCVQVDQSKVAIKEKFGRFVEVLEPGCHCLPWFLGHQIAGHLSLRLQQLDVRCETKTKDNVFVNVVASIQYRALADKADDAFYKLTNTRSQIQAYVFDVIRASVPKLNLDAAFEQKNEIAKAVEEELEKAMSAYGYEIVQTLIVDIEPDEHVKRAMNEINAAARMRVAANEKAEAEKILQIKRAEGEAESKYLSGLGIARQRQAIVDGLRDSVLGFSVNVPGTTAKDVMDMVLVTQYFDTMKEIGASSKSSAVFIPHGPGSVRDVASQIRDGLLQGSHQ

SEQ ID NO: 8046 - protein, 287 aa, Brassica oleracea
MGNLCCCVQVDQSTVAIKETFGKFEDVLEPGCHFLPWCLGQQVAGYLSLRLQQLDVRCETKTKDNVFVNVVASIQYRALANNANDAFYKLSNTRSQIQAYVFDVIRASVPKLILDDVFEQKNEIAKAVEEELEKAMSAYGFEIVQTLIVDIEPDEHVKRAMNEINAAARMRLAANEKAEAEKILQIKRAEGEAEAKYLSGLGIARQRQAIVDGLRDSVLGFSVNVPGTTAKDVMDMVLVTQNFDTMKEIGASSKSSAVFIPHGPGAVRDVATQIRDGLLQGSFADQS

SEQ ID NO: 8047 - protein, 284 aa, Theobroma cacao
MGNLFCCIQVDQSTVAIKERFGRFDDVLEPGCHCLPWFLGSQLAGHLSLRLQQLDVRCETKTKDNVFVNVVASIQYRALADKASDAFYKLSNTRTQIQAYVFDVIRASVPKLNLDDVFEQKTEIAKAVEEELEKAMSAYGYEIVQTLIVDIEPDEHVKRAMNEINAAARLRVAANEKAEAEKILQIKRAEGEAESKYLSGLGIARQRQAIVDGLRDSVLGFSVNVPGTTAKDVMDMVLVTQYFDTMKEIGAASKSSAVFIPHGPGAVRDVATQIRDGLLQAAHQ

SEQ ID NO: 8048 - protein, 287 aa, Manihot esculenta
MGNLFCCVQVDQSTVAIKERFGKFDEVLEPGCHCLPWIFGSQLAGHLSLRLQQLDVRCETKTKDNVFVNVVASIQYRALADKASDAFYKLSNTRIQIQAYVFDVIRASVPKLDLDDAFEQKNEIAKAVEDELEKAMSAYGYEIVQTLIVDIEPDEHVKRAMNEINAAARLRVAAKEKAEAEKILQIKRAEGEAEAKYLAGLGIARQRQAIVDGLRDSVLGFSENVPGTTAKDIMDMVLVTQYFDTMKEIGAASKSSAVFIPHGPGAIRDVASQIRDGLLQASAHTSG

SEQ ID NO: 8049 - protein, 285 aa, Cichorium intybus
MGNLFCLVQVDQSTVAIKETFGKFADVLEPGLHCVPWIFGSQVAGQLTLRLQQLDVKCETKTKDNVFVNVVASIQYRALADKASDAFYKLSNTRSQIQAYVFDVIRASVPKLNLDDAFEQKNEIAKAVEEELEKAMSAYGFEIVQTLIVDIEPDEHVKRAMNEINAAARLRMAATEKAEAEKILQIKRAEGEAESKYLSGLGIARQRQAIVDGLRDSVLGFSVNVPGTTAKDVMDMVLVTQYFDTMKEIGASSKSSAVFIPHGPGAVRDVATPIRDGLLQGNAAQ

SEQ ID NO: 8050 - protein, 285 aa, Euonymus alatus
MGNLFCCIQVDQSTVAIKEQFGKFDEVLEPGCHCLPWFLGSQLAGHLSLRLQQLDVRCETKTKDNVFVNVVASIQYRALAEKANDAFYKLSNTRSQIQAYVFDVIRAGVPKLDLDDVFEQKNEIAKAVEDELEKAMSAYGYEIVQTLIVDIEPDELVKRSMNEINAAARMRAAATDKAEAEKILQIKRAEGEAEAKYLSGLGIARQRQAIVDGLRDSVLGFSVNVPGTTAKDVMDMVLVTQYFDTMKEIGAASKSSAVFIPHGPGAVRDVASQIRDGLLQGSAEQ

SEQ ID NO: 8051 - protein, 285 aa, Citrus sinensis
MGNLFCCVQVDQSTVAIKERFGKFEDVLEPGCHFLPWILGHQLAGHLTLRLQQLDVRCETKTKDNVFVNVVASVQYRALAHKANDAFYKLSNTRTQIQAYVFDVIRASIPKLNLDDAFEQKNEIAKAVEEELEKAMSAYGYEIVQTLIVDIEPDEHVKRAMNEINAAARLRVAANEKAEAEKILQIKRAEGEAESKYLSGLGIARQRQAIVDGLRDSVLGFSINVPGTTAKDVMDMVLVTQYFDTMKEIGAASKSSAVFIPHGPGAVRDVATQIRDGLLQASQHQ

SEQ ID NO: 8052 - protein, 286 aa, Helianthus annuus
MGNLLCLVQVDQSTVAIKETFGKFDDVLEPGCHCVPWIFGSRLAGHLTLRVQQLDVKCETKTKDNVFVNVVASIQYRALTDKASDAFYKLSNTRAQIQAYVFDVIRASVPKLNLDDVFEQKNEIAKAVEEELEKAMSAYGFEIVQTLIVDIEPDEHVKRAMNEINAAARLRVAATEKAEAEKILQIKRAEGEAESKYLSGLGIARQRQAIVDGLRDSVLGFSVNVPGTTAKDVMDMVLVTQYFDTMKEIGAASKSSAVFIPHGPGAVRDVATQIRDGLLQGSAAAS

SEQ ID NO: 8053 - protein, 287 aa, Papaver somniferum
MGNLLCCVQVDQSKVAIRERFGKFDDVLQPGCHCLPWFLGSQIAGHLTLRVQQLDVKCETKTKDNVFVNVVASIQYRALAEKANDAFYKLSNTRGQIQAYVFDVIRASVPKLLLDDVFEQKNDIAKAVEEELEKAMSAYGYEIVQTLIVDIEPDEHVKRAMNEINAAARLRLAATEKAEAEKILQIKRAEGEAESKYLSGLGIARQRQAIVDGLRDSVIGFSVNVPGTTAKDVMDMVLVTQYFDTMKEIGAASKSSAVFIPHGPGAVRDVATQIRDGLLQGSSAHMP

SEQ ID NO: 8054 - protein, 285 aa, Vaccinium corymbosum
MGNLFGCLIVDQSTVAIKEKFGKFDEVLEPGCHCVPWCLGSQLAGHLTLRVQQLDVRCETKTKDNVFVNVVASIQYRALADKANEAFYKLSNTRSQIQAYVFDVIRAFVPKLNLDDTFEQKNDIAKAVEDELEKAMSAYGYEIVQTLIVDIEPDEHVKRAMNEINAAARMRVAANEKAEAEKILQIKRAEGEAESKYLSGLGVARQRQAIVDGLRDSVLGFSVNVPGTTAKDVMDMVLVTQYFDTMKEIGAASKSSAVFIPHGPGAVRDVATQIRDGLLQASSQH

SEQ ID NO: 8055 - protein, 286 aa, Artemisia annua
MGNLFCLYQVDQSTVAIKETFGKFDDVLEPGCHCVPWIFGKQIAGNLTLRLQQLDVKCETKTKDNVFVNVVASVQYRALADKASDAFYRLSNTRSQIQAYVFDVIRATVPKLLLDDAFEQKNEIAKAVEDELEKAMSAYGFEIVQTLIVDIEPDEHVKRAMNEINAAARLRMAATEKAEAEKILQIKRAEGEAESKYLAGVGIARQRQAIVDGLRDSVLGFSVNVPGTTAKDVMDMVLVTQYFDTMKEIGAASKSSAVFIPHGPGAVRDVATQIRDGLLQGNAATS

SEQ ID NO: 8056 - protein, 284 aa, Unknown
  Sequence found in Organisms: Gossypium hirsutum, Gossypium raimondii
MGNLFCCVQVDQSTVAIKERFGRFEDVLEPGCHCLPWFLGSQLAGHLSLRLQQLDVRCETKTKDNVFVNVVASIQYRALADKASDAFYKLTNTRTQIQAYVFDVIRASVPKLNLDDVFEQKTEIAKAVEEELEKAMSAYGYEIVQTLIVDIEPDEHVKRAMNEINAAARLRVAANEKAEAEKILQIKRAEGEAESKYLSGLGIARQRQAIVDGLRDSVLGFSVNVPGTTAKDVMDMVLVTQYFDTMKEIGAASKSSAVFIPHGPGAVRDVATQIRDGLLQATHQ

SEQ ID NO: 8057 - protein, 285 aa, Flaveria ramosissima
MGNLFCLYQVDQSTVAIKESFGKFDDVLEPGCHCVPWIFGKQLAGYLSLRVQQLDVKCETKTKDNVFVNVVASIQYRALADKANDAFYKLSNTRSQIQAYVFDVIRAFVPKLNLDDAFEQKNEIAKAVEQELEKAMSAYGYEIVQTLIVDIEPDEHVKRAMNEINAAARLRMAAAEKAEAEKILQIKRAEGEAESKYLSGLGIARQRQAIVDGLRDSVLGFSVNVPGTTAKDVMDMVLVTQYFDTMKEIGASSKSSAVFLPHGPGAVRDVASQIRDGLLQGSAAT

SEQ ID NO: 8058 - protein, 285 aa, Flaveria ramosissima
MGNLLCLVQVDQSTVAIKETFGKFDDVLEPGCHCVPWIFGSRLAGHLTLRVQQLDVKCETKTKDNVFVNVVASVQYRALSEKASDAFYKLSNTRAQIQAYVFDVIRASVPKLNLDDAFEQKNEIAKAVEEELEKAMSAYGFEIVQTLIVDIEPDEHVKRAMNEINAAARLRMAAAEKAEAEKILQIKRAEGEAESKYLSGLGIARQRQAIVDGLRDSVLGFSVNVPGTTAKDVMDMVLVTQYFDTMKEIGAASKSSAVFIPHGPGAVRDVATQIRDGLLQGSAAS

SEQ ID NO: 8059 - protein, 287 aa, Raphanus sativus
MGNLLCCVQVDQSTVAIKETFGKFEDVLEPGCHFLPWCLGQQVAGYLSLRLRQLDVRCETRTKDNVFVNVVASIQYRALANNANDAFYKLSNTRSQIQAYVFDVIRASVPKLILDDVFEQKNEIAKAVEEELEKAMSAYGFEIVQTLIVDIEPDEHVKRAMNEINAAARMRLAANEKAEAEKILQIKRAEGEAEAKYLSGLGIARQRQAIVDGLRDSVLGFSVNVPGTTAKDVMDMVLVTQYFDTMKEIGASSKSSAVFIPHGPGAVRDVATQIRDGLLQGSFADQS

SEQ ID NO: 8060 - protein, 284 aa, Triphysaria pusilla
MGNLFCCIQVDQSTVAIKERFGRFVEVLEPGCHCLPWCLGSQLAGHLTLRLQQLDVRCETKTKDNVFVNVVASIQYRAIANKASDAFYKLSNTKGQIQAYVFDVIRASVPNMNLDDAFEQKNEIAKAVEDELEKAMSAYGYEIVQTLIVDIEPDEHVKRAMNEINAAARMRVAANEKAEAEKILQIKRAEGEAEAKYLSGLGIARQRQAIVDGLRDSVLGFSVNVPGTTAKDVMDMVLVTQYFDTMKEIGASSKSSAVFIPHGPGAVRDVASQIRDGLLQGSMV

SEQ ID NO: 8061 - protein, 104 aa, Flaveria ramosissima
MGNLLCLVQVDQSTVAIKETFGKFDDVLEPGCHCVPWIFGSRLAGHLTLRVQQLDVKCETKTKDNVFVNVVASVQYRALSEKANDAFYKLSNTRAQIQAYVLML

SEQ ID NO: 8062 - protein, 111 aa, Gossypium raimondii
MGNLFCCVQVDQSTVAIKERFGRFEDVLEPGCHCLPWFLGSQLAGHLSLRLQQLDVRCETKTKDNVFVNVVASIQYRALADKASDAFYKLTNTRTQIQAYVFDVIRAVFRS

SEQ ID NO: 8063 - protein, 290 aa, Capsicum annuum
MGNLFCCVQVDQSTVAIKERFGKFDDVLEPGCHFLPWCIGSQIAGYLTLRLQQLDVRCETKTKDNVFVTVVASIQYRALSDKATDAFYKLSNTRSQIQAYVFDVIRASVPKINLDDVFEQKNQIAKAVENELEKAMSAYGYEIVQTLIVDIEPDEHVKRAMNEINAAARLRVAANEKAEAEKIVQIKRAEGDAEAKYLAGLGVARQRQAIVDGLRDSVLGFSVNVPGTTAKDVLDMVLITQYFDTMKEIGASSKSSAVFIPHGPGAVGDIAGQIRQGLLQGAAVEQQNLL

SEQ ID NO: 8064 - protein, 286 aa, Aristolochia fimbriata
MGQVLGCVQVDQSTVAIKERFGKFEEVLEPGCHCLPWCLGSQLAGHLSLRLQQLDVKCETKTKDNVFVNVVASIQYRALADKASDAFYKLSNTRSQIQAYVFDVIRASVPKLNLDDAFEQKNEIAKAVEDELEKAMSAYGFEIVQTLIVDIEPDEHVKRAMNEINAAARMRVAANEKAEAEKILQIKRAEGEAESKYLSGLGIARQRQAIVDGLRDSVLGFSVNVPGTTAKDVMDMVLVTQYFDTMKEIGAASKSSAVFIPHGPGAVRDVATQIREGLLQASSAHV

SEQ ID NO: 8065 - protein, 287 aa, Tripterygium wilfordii
MGNVFGCIQVDQSTVAITERFGKYNEVLEPGCHCLPWCFGSQLAGHLSLRLQQLDVRCETKTKDNVFVNVVASIQYRALAHKANDAFYKLSNTRTQIQAYVFDVIRASVPKLNLDDVFEQKNEIAKAVEEELEKAMSAYGFEIVQTLIVDIEPDEQVKRAMNEINAAARMRVATNEKAEAEKILQIKRAEGEAEAKYLSGLGIARQRQAIVDGLRDSVLGFSVNVPGTTAKDVMDMVLVTQYFDTMKEIGATSKSSAVFIPHGPGAVRDVASQIRDGLLQGSASAHQ

SEQ ID NO: 8066 - protein, 285 aa, Nicotiana benthamiana
MGNLFCCVQVDQSTVAITEQFGKYQDVLQPGCHCLPWFFGFQLAGHLSLRVQQLDVRCETKTKDNVFVNVVASIQYRALADKANDAFYRLSNTKGQIQAYVFDVIRASVPKLNLDDVFEQKNEIAKAVEDELEKAMSAYGYEIVQTLIVDIEPDEHVKRAMNEINAAARMRLAANEKAEAEKILQIKRAEGEAESKYLSGLGIARQRQAIVDGLRDSVLGFSVNVPGTSAKDVMDMVLLTQYFDTMKEIGASSKSSAVFLPHGPGAVRDVASQIRDGLLQASTEH

SEQ ID NO: 8067 - protein, 287 aa, Arabidopsis lyrata
MGNLLCCVQVDQSTVAIKETFGKFEEVLEPGCHFLPWCLGSQVAGYLSLRVQQLDVRCETKTKDNVFVNVVASIQYRALANKANDAYYKLSNTRSQIQAYVFDVIRASVPKLLLDDVFEQKNDIAKAVEEELEKAMSAYGYEIVQTLIVDIEPDEHVKRAMNEINAAARMRLAANEKAEAEKILQIKRAEGEAESKYLSGLGIARQRQAIVDGLRDSVLGFAVNVPGTTAKDVMDMVLVTQYFDTMKEIGASSKSSAVFIPHGPGAVRDVATQIRDGLLQGSSANLS

SEQ ID NO: 8068 - protein, 285 aa, Arnica chamissonis
MGNLLCLVQVDQSTVAIKETFGKFDDVLEPGCHCVPWIFGSQLAGHLTLRVQQLDVKCETKTKDNVFVNVVASIQYRAMADKASDAFYKLSNTREQIQAYVFDVIRASVPKLLLDDVFEQKNDIAKAVEEELEKAMSAYGYEIVQTLIVDIEPDEHVKRAMNEINAAARLRMAATEKAEAEKILQIKRAEGEAESKYLSGLGIARQRQAIVDGLRDSVLGFSVNVPGTTAKDVMDMVLVTQYFDTMKEIGASSKSSAVFIPHGPGAVRDVATQIRDGLLQGNAAS

SEQ ID NO: 8069 - protein, 284 aa, Unknown
  Sequence found in Organisms: Citrus clementina, Citrus sinensis
MGNAFCCVQVDQSTVAIRERFGKFDEVLDPGCHCVPWLLGCQIAGDLSLRLQQLDVRCETKTKDNVFVNVVASVQYRALAKKASDAFYKLSNTRTQIQAYVFDVIRASVPKLDLDDVFEQKNDIAKAVEEELEKAMSAYGYEIVQTLIVDIEPDVHVKRAMNEINAAARLRVAANEKAEAEKIVQIKRAEGEAESKYLAGVGIARQRQAIVDGLRDSVLGFSENVPGTTAKDILDMVLITQYFDTMKEIGASSKSSSVFIPHGPGAVQDIATQIRNGLLQASSH

SEQ ID NO: 8070 - protein, 285 aa, Citrus clementina
MGNLFCCVQVDQSTVAIKERFGKFEDVLEPGCHFLPWILGHQLAGHLTLRLQQLDVRCETKTKDNVFVNVVASVQYRALAHKADDAFYKLSNTRTQIQAYVFDVIRAGIPKLNLDDAFEQKNEIAKAVEEELEKAMSAYGYEIVQTLIVDIEPDEHVKRAMNEINAAARLRVAANEKAEAEKILQIKRAEGEAESKYLSGLGIARQRQAIVDGLRDSVLGFSINVPGTTAKDVMDMVLVTQYFDTMKEIGAASKSSAVFIPHGPGAVRDVATQIRDGLLQASQHQ

SEQ ID NO: 8071 - protein, 285 aa, Flaveria ramosissima
MGNLLCLAQVDQSTVAIKETFGKFDDVLEPGCHCVPWIFGSRLAGHLTLRVQQLDVKCETKTKDNVFVNVVASVQYRALSEKASDAFYKLSNTRAQIQAYVFDVIRASVPKLNLDDAFEQKNEIAKAVEEELEKAMSAYGFEIVQTLIVDIEPDEHVKRAMNEINAAARLRMAAAEKAEAEKILQIKRAEGEAESKYLSGLGIARQRQAIVDGLRDSVLGFSVNVPGTTAKDVMDMVLVTQYFDTMKEIGAASKSSAVFIPHGPGAVRDVATQIRDGLLQGSAAS

SEQ ID NO: 8072 - protein, 285 aa, Flaveria ramosissima
MGNLLCLVQVDQSTVAIKETFGKFDDVLEPGCHCVPWIFGSRLAGHLTLRVQQLDVKCETKTKDNVFVNVVASVQYRALSEKANDAFYKLSNTRAQIQAYVFDVIRASVPKLNLDDSFEQKNEIAKAVEEELEKAMSAYGFEIVQTLIVDIEPDEHVKRAMNEINAAARLRMAAAEKAEAEKILQIKRAEGEAESKYLSGLGIARQRQAIVDGLRDSVLGFSVNVPGTTAKDVMDMVLVTQYFDTMKEIGSTSKSSAVFIPHGPGAVRDVATQIRDGLLQGSAAS

SEQ ID NO: 8073 - protein, 285 aa, Flaveria ramosissima
MGNLCCLYQVDQSTVAIKESFGKFDDVLEPGCHCVPWIFGKQLAGYLSLRVQQLDVKCETKTKDNVFVNVVASIQYRALADKANDAFYKLSNTRSQIQAYVFDVIRAFVPKLNLDDAFEQKNEIAKAVEQELEKAMSAYGYEIVQTLIVDIEPDEHVKRAMNEINAAARLRMAAAEKAEAEKILQIKRAEGEAESKYLSGLGIARQRQAIVDGLRDSVLGFSVNVPGTTAKDVMDMVLVTQYFDTMKEIGASSKSSAVFLPHGPGAVRDVASQIRDGLLQGSAAT

SEQ ID NO: 8074 - protein, 285 aa, Flaveria ramosissima
MGNLFCLYQVDQSTVAIKESFGKFDDVLEPGCHCVPWIFGKQLAGYLSLRVQQLDVKCETKTKDNVFVNVVASIQYRALADKANDAFYKLSNTRSQIQAYVFDVIRAFVPKLNLDDTFEQKNEIAKAVEQELEKAMSAYGYEIVQTLIVDIEPDEHVKRAMNEINAAARLRMAAAEKAEAEKILQIKRAEGEAESKYLSGLGIARQRQAIVDGLRDSVLGFSVNVPGTTAKDVMDMVLVTQYFDTMKEIGASSKSSAVFLPHGPGAVRDVASQIRDGLLQGSAAT

SEQ ID NO: 8075 - protein, 288 aa, Ipomoea nil
MGNLFCCVQVDQSTVAIKERFGKYQDVLEPGCHCVPWCLGSQLAGHLTLRLQQLDVRCETKTKDNVFVNVVASIQYRALADKANDAFYKLSNTKGQIQAYVFDVIRASVPKLNLDDVFEQKTEIAKAVEDELEKAMSAYGYEIVQTLIVDIEPDEHVKKAMNEINAAARLRVAANEKAEAEKILQIKRAEGEAEAKYLSGLGIARQRQAIVDGLRDSVIGFSVNVPGTTAKDVMDMVLVTQYFDTMKEIGAANKSSTVFIPHGPGAVRDVASQIRDGLLQASQSDHPH

SEQ ID NO: 8076 - protein, 285 aa, Quercus alba
MGNLLCFVQVDQSTVAIKEKFGKFEEVLEPGCHFLPWCLGSQLSGHLTLRLQQLDVRCETKTKDNVFVNVVASIQYRALADKASDAFYKLSNTRSQIQAYVFDVIRASVPKLTLDDAFVQKNDIAKAVEDELEKAMSAYGYEIVQTLIVDIEPDEHVKRAMNEINAAARMRVAANEKAEAEKILQIKQAEGEAESKYLSGLGIARQRQAIVDGLRDSVLGFSVNVPGTTPKDVMDMVLVTQYFDTMKEIGAASKSSAVFIPHGPGAVRDVASQIRDGLLQGSVQH

SEQ ID NO: 8077 - protein, 286 aa, Helianthus annuus
MGNLLCLVQVDQSTVAIKETFGKFDDVLEPGCHCVPWIFGSRLAGHLTLRVQQLDVKCETKTKDNVFVNVVASIQYRALSDKASDAYYKLSNTRAQIQAYVFDVIRASVPKLNLDDVFEQKNDIAKTVEEELEKAMSAYGFEIVQTLIVDIEPDVHVKRAMNEINAAARLRVAATEKAEAEKILQIKRAEGEAESKYLSGLGIARQRQAIVDGLRDSVLGFSVNVPGTTAKDVMDMVLVTQYFDTMKEIGAASKSSAVFIPHGPGAVRDVATQIRDGLLQGSAAAS

SEQ ID NO: 8078 - protein, 287 aa, Eutrema halophilum
MGNLFCCVQVDQSTVAIKETFGKFEDVLEPGCHFLPWCLGSQVAGYLSLRLQQLDVRCETKTKDNVFVNVVASIQYRAIANQANDAFYKLSNTKGQIQAYVFDVIRASVPKLLLDDVFEQKDEIAKAVEEELEKAMSAYGFEIVQTLIVDIEPDEHVKRAMNEINAAARMRLAANEKAEAEKILQIKRAEGEAEAKYLSGLGIARQRQAIVDGLRDSVLGFSVNVPGTTAKDVMDMVLVTQYFDTMKEIGASSKSSAVFIPHGPGAVRDVATQIRDGLLQGSFADQS

SEQ ID NO: 8079 - protein, 284 aa, Cicer arietinum
MGNLFCCVQVDQSTVAMKEGFGRFEEVLQPGCHCMPWVLGKRIAGHLSLRLQQLDIRCETKTKDNVFVNVVASIQYRALVNKANDAFYKLSNTRSQIQAYVFDVIRGTVPKLNLDDAFEQKNEIAKAVEDELEKAMSAYGYEIVQTLIVDIEPDEHVKRAMNEINAAARLRMAAKDKAEAEKILQIKRAEGEAESKYLSGLGIARQRQAIVDGLRDSVLGFSVNVPGTTAKDVMDMVLVTQYFDTMKEIGAASKASAVFIPHGPGAVRDVASQIRDGLLQGSYH

SEQ ID NO: 8080 - protein, 290 aa, Solanum lycopersicum
MGNLFCCVQVDQSTVAIKERFGKFDDVLEPGCHFLPWCIGSQVAGYLTLRLQQLDVRCETKSKDNVFLTVVASIQYRALADKATDAFYKLSNTRSQIQAYVFDVIRASVPKLNLDDVFEQKNQIAKAVEDELEKAMSAYGYEIVQTLIVDIEPDEHVKRAMNEINAAARLRVAANEKAEADKIVQIKRAEGDAEAKYLAGLGVARQRQAIVDGLRDSVLGFSVNVPGTTAKDVVDMVLITQYFDTMKEIGASSKSSAVFIPHGPGAVSDIAGQIRQGLLQGSAVEQQNLL

SEQ ID NO: 8081 - protein, 285 aa, Allium cepa
MGNLICCVQVDQSTVAVKEQFGKFDEVLDPGCHCMPWFLGKRVAGHLSLRVQQLDVKCETKTKDNVFVNVVASIQYRALADKASDAFYKLSNTRSQIQAYVFDVIRATVPKLILDDVFEQKNDIAKAVEDELEKAMSAYGYEIVQTLIVDIEPDVNVKKAMNEINAAARLRLAANDKAEAEKILQIKRAEGEAESKYLSGLGIARQRQAIVDGLRDSVLGFSVNVPGTTAKDVMDMVLVTQYFDTMKEIGAASKSSAVFIPHGPGAVRDVATQIRDGLLQANVGH

SEQ ID NO: 8082 - protein, 285 aa, Flaveria ramosissima
MGNLLCLVQVDQSTVAIKETFGKFDDVLEPGCHCVPWIFGSRLAGHLTLRVQQLDVKCETKTKDNVFVNVVASVQYCALSEKASDAFYKLSNTRAQIQAYVFDVIRASVPKLNLDDAFEQKNEIAKAVEEELEKAMSAYGYEIVQTLIVDIEPDEHVKRAMNEINAAARLRMAAAEKAEAEKILQIKRAEGEAESKYLSGLGIARQRQAIVDGLRDSVLGFSVNVPGTTAKDVMDMVLVTQYFDTMKEIGAASKSSAVFIPHGPGAVRDVATQIRDGLLQGSAAS

SEQ ID NO: 8083 - protein, 283 aa, Flaveria ramosissima
NLLCLVQVDQSTVAIKETFGKFDDVLEPGCHCVPWIFGSRLAGHLTLRVQQLDVKCETKTKDNVFVNVVASVQYRALSEKASDAFYKLSNTRAQIQAYVFDVIRASVPKLNLDDAFEQKNEIAKAVEEELEKAMSAYGFEIVQTLIVDIEPDEHVKRAMNEINAAARLRMAAAEKAEAEKILQIKRAEGEAESKYLSGLGIARQRQAIVDGLRDSVLGFSVNVPGTTAKDVMDMVLVTQYFDTMKEIGAASKSSAVFIPHGPGAVRDVATQIRDGLLQGSAAS

SEQ ID NO: 8084 - protein, 284 aa, Linum usitatissimum
MGNLFCCVQVDQSTVAIREQFGKFDEVLEPGCHCLPWFLGSQLAGHLSLRVQQLDVRCETKTKDNVFVTVVASVQYRALAERANDAFYKLSNTRGQIQAYVFDVIRASVPKLNLDDTFEQKNDIAKAVEDELEKAMSHYGYEIVQTLIVDIEPDERVKKAMNEINAAARMRVAANEKAEAEKILQIKRAEGEAESKYLSGLGIARQRQAIVDGLRDSVLGFSFNVPGTSAKDVMDMVLVTQYFDTMKEIGAASKSSAVFIPHGPGAVRDVAAQIRDGLLQSFVA

SEQ ID NO: 8085 - protein, 285 aa, Orobanche aegyptiaca
MGNLFCCIQVDQSTVAIKERFGKFEDVLEPGCHCLPWCFGSQLAGLLTLRLQQLDVRCETKTKDNVFVNVVASIQYRAIADKASDAFYKLSNTRSQIQAYVFDVIRASVPKMNLDDAFEQKNHIAKAVEEELEKAMSAYGYEIVQTLIVDIEPDEHVKRAMNEINAAARLRAAANEKAEAEKILQIKKAEGEAEAKYLSGLGIARQRQAIVDGLRDSVLGFSINVPGTTAKDVMDMVLVTQYFDTMKEIGASSKSSAVFIPHGPGAVRDVASQIRNGLLQASHDS

SEQ ID NO: 8086 - protein, 288 aa, Arachis hypogaea
MGNLFCCVVVEQSTVVIKERFGKFEEVLEPGCHCIPWVTGDRLAGHLSLRLQQLDVRCETKTKDNVFVNVVASIQYRALADKASDAFYKLSNTKSQIQAYVFDVIRASVPKLNLDDTFEQKNDIARAVEQELEKAMSAYGYEIVQTLIVDIEPDEHVKRAMNEINAAARLRVAATEKAEAEKILQIKRAEGEAESKYLSGLGIARQRQAIVDGLRDSVLGFSVNVPGTTAKDVMDMVLVTQYFDTMREIGAASKSSAVFIPHGPGAVRDVATQIRDGLLQASHHQTHE

SEQ ID NO: 8087 - protein, 284 aa, Cajanus cajan
MGNLFCCVQVDQSTVAIKERFGRFEKVLQPGCHCMPWFLGKQLAGHLSLRLQQLDLRCETKTKDNVFVNVVASIQYRALAEKANDAFYKLSNTKTQIQAYVFDVIRASVPKLNLDDAFEQKNEIARAVEEELEKAMSAYGYEIVQTLIVDIDPDEHVKRAMNEINAAARLRVAANEKAEAEKILLIKRAEGEAESKYLSGLGIARQRQAIVDGLRDSVLGFSINVPGTTAKDVMDMVLVTQYFDTMKEIGAASKSSAVFIPHGPGAVRDVATQIRDGLLQASHG

SEQ ID NO: 8088 - protein, 285 aa, Unknown
  Sequence found in Organisms: Solanum tuberosum, Solanum phureja
MGNLLCCVQVDQSTVAIKEQFGKYQDVLQPGCHFLPWCFGFQLAGHLSLRLQQLDVRCETKTKDNVFVNVVASIQYRALADKANDAFYKLSNTKGQIQAYVFDVIRASVPKLNLDDVFEQKNEIAKAVEDELEKAMSAYGYEIVQTLIVDIEPDEHVKRAMNEINAAARMRVAANEKAEAEKILQIKRAEGEAESKYLSGLGIARQRQAIVDGLRDSVLGFSVNVPGTSAKDVMDMVLLTQYFDTMKEIGASSKSSAVFLPHGPGAVRDVASQIRDGLLQASVDH

SEQ ID NO: 8089 - protein, 152 aa, Secale cereale
MSAYGFEIVQTLIVDIEPDAHVKQAMNEINAAARMRVAANEKAEAEKIVQIKRAEGEAEAKYLSGLGIARQRQAIVDGLRDSVLGFSVNVPGTTAKDVMDMVLITQYFDTMKEIGASSKSSAVFIPHGPGAVRDIATQIRDGLLQGQSASDN

SEQ ID NO: 8090 - protein, 284 aa, Triphysaria pusilla
MGNLFCCIQVDQSTVAIKEKFGKFNDVLEPGCHCLPWCFGSQLAGHLTLRLQQLDVRCETKTKDNVFVNVVASVQYRAIAAKASDAFYKLSNTKGQIQAYVFDVIRASVPNMNLDDAFVQKNDIAKAVEDELEKAMSAYGYEIVQTLIVDIEPDVHVKRAMNEINAAARLRVAANEKAEAEKILQIKRAEGEAEAKYLSGLGIARQRQAIVDGLRDSVLGFSVNVPGTTAKDVMDMVLVTQYFDTLKEIGASSKSSTVFIPHGPGAVSDVAAQIRDGLLQGSVV

SEQ ID NO: 8091 - protein, 285 aa, Populus trichocarpa
MGNLCCCVQVDQSSVAIKETFGKFEAVLDPGCHCLPWFLGSQLAGHLSLRLQQLDVRCETKTKDNVFVNVVASIQYRALADKASDAFYKLTNTRTQIQAYVFDVIRASVPKLNLDDVFEQKNEIAKAVEDELGKAMSAYGYEIVQTLIVDIEPDEHVKRAMNEINAAARLRVAANEKAEAEKILQIKRAEGEAESKYLSGLGIARQRQAIVDGLRDSVLGFSENVPGTSAKDVMDMVLVTQYFDTMKEIGAASKSSAVFIPHGPGAIRDVATQIRDGLLQASAHK

SEQ ID NO: 8092 - protein, 285 aa, Nicotiana benthamiana
MGNLFCCVQVDQSTVAITEQFGKYQDVLQPGCHCLPWFFGFQLAGHLSLRVQQLDVRCETKTKDNVFVNVVASIQYRALADKANDAFYRLTNTKGQIQAYVFDVIRASVPKLNLDDVFEQKNDIARAVEDELEKAMSAYGYEIVQTLIVDIEPDEHVKRAMNEINAAARMRLAANEKAEAEKILQIKRAEGEAESKYLSGLGIARQRQAIVDGLRDSVLGFSVNVPGTSAKDVMDMVLLTQYFDTMKEIGASSKSSAVFLPHGPGAVRDVASQIRDGLLQASTEH

SEQ ID NO: 8093 - protein, 287 aa, Eschscholzia californica
MGNLLCCVQVDQSTVAIRERFGKFDEVLTPGCHCLPWFLGSQLAGELSLRVQQLDVKCETKTKDNVFVNVVASIQYRALADKASDAFYKLSNTRGQIQAYVFDVIRASVPKLLLDDVFEQKNEIAKAVEEELEKAMSAYGYEIVQTLIVDIEPDEHVKRAMNEINAAARMRLAANEKAEAEKILQIKRAEGEAESKYLSGLGIARQRQAIVDGLRDSVLGFSVNVPGTTAKDVMDMVLVTQYFDTMKEIGASSKSSAVFIPHGPGAVRDVATQIRDGLLQANNGQLN

SEQ ID NO: 8094 - protein, 285 aa, Musa acuminata
MGQMLCCVQVEQSTVAIKESFGKYDDVLQPGCHCLPWVFGKRIAGRLSLRMKQLDVKCETKTKDNVFVNVVASIQYRALPDKANDAFYKLSNTQSQIQAYVFDVIRASVPKLNLDDAFEQKNEIARAVEEELEKAMSAYGFEIVQTLIVDMEPDEHVKRAMNEINAAARLRVAANEKAEAEKIVQIKRAEGEAEAKYLSGVGIARQRQAIVDGLRDSVLGFSVNVPGTTPKDVLDMVLITQYFDTMKEIGASSKSSSVFIPHGPGAVRDIAAQVRDGLLQAAPLQ

SEQ ID NO: 8095 - protein, 285 aa, Nicotiana benthamiana
MGNLFCCVQVDQSTVAIKEQFGKYQDVLEPGCHCVPWFLGSQLAGHLSLRVQQLDVRCETKTKDNVFVNVVASIQYRALADKANDAFYKLSNTKGQIQAYVFDVIRASVPKLNLDNVFEQKNEIAKAVEEELEKAMSAYGYEIVQTLIVDIVPDEHVKRAMNEINAAARLRVAANEKAEAEKILQIKRAEGEAESKYLAGLGIARQRQAIVDGLRESVLGFSVNVPGTSAKDVMDMVLVTQYFDTMKEIGASSKSSAVFIPHGPGAVRDVAQQIRDGLLQASVEH

SEQ ID NO: 8096 - protein, 285 aa, Capsicum annuum
MGNLLCCVQVDQSTVAITEQFGKYQDVLQPGCHCLPWFLGYQLAGNLSLRVQQLDVRCETKTKDNVFVNVVASIQYRALAEKANDAFYKLSNTKGQIQAYVFDVIRASVPKLNLDDVFEQKNEIARAVEEELEKAMSAYGFEIVQTLIVDIEPDEHVKRAMNEINAAARMRVAANEKAEAEKILQIKRAEGEAESKYLSGLGIARQRQAIVDGLRDSVLGFSVNVPGTSAKDVMDMVLLTQYFDTMKEIGASSKSSAVFLPHGPGAVRDVASQIRDGLLQASVDH

SEQ ID NO: 8097 - protein, 286 aa, Arabidopsis thaliana
MGNLFCCVQVDQSTVAIKETFGKFEDVLEPGCHFLPWCLGSQVAGYLSLRVQQLDVRCETKTKDNVFVNVVASIQYRALANKANDAYYKLSNTRGQIQAYVFDVIRASVPKLLLDDVFEQKNDIAKAVEEELEKAMSAYGYEIVQTLIVDIEPDEHVKRAMNEINAAARMRLAANEKAEAEKILQIKRAEGEAESKYLSGLGIARQRQAIVDGLRDSVLGFAVNVPGTTAKDVMDMVLVTQYFDTMKEIGASSKSSAVFIPHGPGAVRDVASQIRDGLLQGSSANL

SEQ ID NO: 8098 - protein, 285 aa, Musa acuminata
MGQALCCVKVDQSSVAIKESFGKFEDVLLPGCHCMPWFLGKKVSGRLSLRLQQLDVKCETKTKDNVFVNVVASVQYHALAEKASDAFYKLSNTRSQIQAYVFDVIRASVPKLNLDDAFEQKNDIAKAVEDELEKAMSAYGYEIVQTLIVDIEPDVHVKRAMNEINAAARLRVAANEKAEAEKIIQIKRAEGEAEAKYLSGLGIARQRQAIVDGLRDSVLGFSVNVPGTTAKDVMDMVLITQYFDTMKEIGAQSKSSAVFIPHGPGSVRDVADQIRDGLLQASTHN

SEQ ID NO: 8099 - protein, 286 aa, Eucalyptus grandis
MGNLLCCCVQVDQSTVAIKERFGKFQEVMEPGCHCLPWFLGSQLAGHLSLRLQQLDVKCETKTKDNVFVNVVASVQYRALAGKASDAFYKLTNTRSQIQAYVFDVIRASVPKLNLDDAFEQKNEIAKAVEDELEKAMSAYGYEIVQTLIVDIEPDERVKRAMNEINAAARLRVAANEKAEAEKILQIKKAEGEAESKYLAGLGIARQRQAIVDGLRDSVLGFSEKVPGTTAKDVMDMVLVTQYFDTMKEIGASSKSSAVFIPHGPGAIRDVTTQIRDGLLQASTHQ

SEQ ID NO: 8100 - protein, 285 aa, Quercus alba
MGNLLCFVQVDQSTVAIKEKFGKFEEVLEPGCHFLPWCLGSQLSGHLTLRLQQLDVRCETKTKDNVFVNVVASIQYRALADKASDAFYKLSNTRSQIQAYVYDVIRASVPKLTLDEAFVQKNDIAKAVEDELEKAMSAYGYEIVQTLIVDIEPDEQVKRAMNEINAAARMRVAANEKAEAEKILQIKRAEGEAESKYLSGLGIARQRQAIVDGLRDSVLGFSVNVPGTTPKDVMDMVLVTQYFDTMKEIGAASKSSAVFIPHGPGAVRDVASQIRDGLLQGSVQH

SEQ ID NO: 8101 - protein, 285 aa, Populus trichocarpa
MGNLCCCVQVDQSSVAIKETFGKFEAVLDPGCHCLPWFLGSQLAGHLSLRLQQLDVRCETKTKDNVFVNVVASIQYRALADKASDAFYKLTNTRTQIQAYVFDVIRASVPKLNLDDVFEQKNEIAKAVEDELGKAMSAYGYEIVQTLIVDIEPDEHVKRAMNEINAAARLRLAANEKAEAEKILQIKRAEGEAESKYLSGLGIARQRQAIVDGLRDSVLGFSENVPGTSAKDVMDMVLVTQYFDTMKEIGAASKSSAVFIPHGPGAIRDVATQIRDGLLQASAHK

SEQ ID NO: 8102 - protein, 285 aa, Unknown
  Sequence found in Organisms: Solanum tuberosum, Solanum phureja
MGNLFCCVQVDQSTVAIKEQFGKYQDVLEPGCHCVPWFLGSQLAGHLSLRVQQLDVRCETKTKDNVFVNVVASIQYRAIADKANEAFYKLSNTKGQIQAYVFDVIRASVPKLILDNVFEQKNEIAKAVEEELEKAMSAYGYEIVQTLIVDIVPDEHVKRAMNEINAAARLRVAANEKAEAEKILQIKRAEGEAEAKYLSGLGIARQRQAIVDGLRDSVLGFSVNVPGTTAKDVMDMVLVTQYFDTMKEIGASSKSSAVFIPHGPGAVKDVAQQIRDGLLQASVGH

SEQ ID NO: 8103 - protein, 284 aa, Glycine max
MGNLFCCVQVDQSTVAIREGFGRFEKVLQPGCHCMPWFLGKQLAGHLSLRLQQLDLRCETKTKDNVFVNVVASIQYRALAEKANDAFYKLSNTKTQIQAYVFDVIRASVPKLNLDDAFEQKNEIAKAVEEELEKAMSAYGYEIVQTLIVDIDPDEHVKRAMNEINAAARLRMAANEKAEAEKILLIKRAEGEAESKYLSGLGIARQRQAIVDGLRDSVLGFSVNVPGTTAKDVMDMVLVTQYFDTMKEIGAASKSSAVFIPHGPGAVRDVAGQIREGLLQASHQ

SEQ ID NO: 8104 - protein, 285 aa, Helianthus annuus
MGNLFCLYQVDQSTVAIKESFGKFDDVLEPGCHCVPWIFGKQLAGQLTLRVQQLDVKCETKTKDNVFVNVVASIQYRALADKASDAFYKLSNTRSQIQAYVFDVIRAFVPKLNLDDTFEQKNEIAKAVEEELEKAMSAYGYEIVQTLIVDIEPDEHVKRAMNEINAAARLRMAATEKAEAEKILQIKRAEGEAESKYLSGLGIARQRQAIVDGLRDSVLGFSVNVPGTTAKDVMDMVLVTQYFDTMKEIGASSKSSAIFLPHGPGAVRDVASQIRDGLLQGSSAT

SEQ ID NO: 8105 - protein, 285 aa, Helianthus annuus
MGNLFCLYQVDQSTVAIKESFGKFDDVLEPGCHCVPWIFGKQLAGQLTLRVQQLDVKCETKTKDNVFVNVVASIQYRALADKASDAFYKLSNTRSQIQAYVFDVIRAFVPKLNLDDTFEQKNEIAKAVEEELEKAMSAYGYEIVQTLIVDIEPDEHVKRAMNEINAAARMRMAATEKAEAEKILQIKRAEGEAESKYLSGLGIARQRQAIVDGLRDSVLGFSVNVPGTTAKDVMDMVLVTQYFDTMKEIGASSKSSAVFLPHGPGAVRDVASQIRDGLLQGSSAT

SEQ ID NO: 8106 - protein, 285 aa, Solanum lycopersicum
MGNLFCCVQVDQSTVAIKEQFGKYQDVLEPGCHCVPWFLGSQLAGHLSLRVQQLDVRCETKTKDNVFVNVVASIQYRAIADKANEAFYKLSNTKGQIQAYVFDVIRASVPKLILDDVFEQKNEIAKAVEEELEKAMSAYGYEIVQTLIVDIVPDEHVKRAMNEINAAARLRVAANEKAEAEKILQIKRAEGEAESKYLSGLGIARQRQAIVDGLRDSVLGFSVNVPGTTAKDVMDMVLVTQYFDTMKEIGASSKSSAVFIPHGPGAVKEVAQQIRDGLLQATVGH

SEQ ID NO: 8107 - protein, 285 aa, Solanum lycopersicum
MGNLLGCVQVDQSTVAITEQFGKYQDVLQPGCHCLPWCFGFQLAGHLSLRVQQLDVRCETKTKDNVFVNVVASIQYRALADKANDAFYKLSNTKGQIQAYVFDVIRASVPKLNLDDVFEQKNEIAKAVEDELEKAMSAYGYEIVQTLIVDIEPDENVKRAMNEINAAARLRVAANEKAEAEKILQIKRAEGEAESKYLSGLGIARQRQAIVDGLRDSVLGFSVNVPGTSAKDVMDMVLLTQYFDTMKEIGASSKSSAVFLPHGPGAVRDVASQIRDGLLQASVDH

SEQ ID NO: 8108 - protein, 115 aa, Cicer arietinum
MPLHAMGSWKRIAGHLSLRLQQLDIRCETKTKDNVFVNVVASIQYRALVNKANDAFYKLSNTRSQIQAYVFDVIRGTVPKLNLDDAFEQKMKLQKLWKMNLRRLCRLMDMKLFKH

SEQ ID NO: 8109 - protein, 287 aa, Euphorbia peplus
MGNLLCCVQVDQSTVAVREQFGKFDQILEPGCHCLPWFLGSQIAGYLSLRLQQLDVRCETKTKDNVFVNVVASIQYRALADKANEAFYKLTNTRTQIQAYVFDVIRATVPKLNLDDAFEQKNEIARAVEEELEKAMSAYGYEIVQTLIVDIEPDEHVKRAMNDINAAVRMRMAANEKAEAEKILQIKRAEGEAEAKYLAGLGIARQRQAIVDGLRDSVLGFSENVPGTTPKDIMDMVLVTQYFDTMKEIGASSKSSTVFIPHGPGAIRDVATQIRDGLLQATPHHHL

SEQ ID NO: 8110 - protein, 213 aa, Guizotia abyssinica
MGNLCCLYQVDQSTVVITESFGKFDDVLEPGCHCVPWIFGKQIAGQLTLRVQQLDIKCETKTKDNVFVNVVASIQYRALAEKANDAFYKLSNTKTQIQAYVFDVIRAFVPKLNLDDTFEQKNEIAKAVEQELEKAMSAYGFEIVQTLIVDIEPDEHVKRAMNEINAAARLRMAATEKAEAEKILQIKRAEGEAESNTCRVWVWPDRGRPLWTV

SEQ ID NO: 8111 - protein, 286 aa, Platanus occidentalis
MGNLFCLVQVDQSTVAIKEKFGKFDDVLEPGCHCLPWFLGSQLAGHLSLMLQQLDVKCETKTKDNVFVNVVASIQYRALADKASDAFYKLSNTRTQIQAYVFDVIRASVPKLNLDDVFEQKNDIARAVENELEKAMSAYGYEIVQTLIVDIEPDEHVKRAMNEINAAARMRLAANEKAEAEKILQIKRAEGEAESKYLSGLGIARQRQAIVDGLRDSVMGFAVNVPGTTAKDVMDMVLVTQYFDTMKEIGASAKSSAVFIPHGPGAVRDVASQIREGLLQASSSHQ

SEQ ID NO: 8112 - protein, 286 aa, Aquilegia formosa
MGNFSCCVQVDQSTVAVKERFGKFQEVMEPGCHCLPWYCGSRVAGHLSLRLQQLDVKCETKTKDNVFVNVVASIQYRALADKASDAFYKLSNTRNQIQAYVFDVIRASVPKLNLDDTFEQKNEIAKAVEEELEKAMSAYGYEIVQTLIVDIEPDERVKRAMNEINAAARMRVAANEKAEAEKILQIKRAEGEAESKYLSGLGVARQRQAIVDGLRDSVLGFSVNVPGTTAKDVMDMVLVTQYFDTMKEIGAASKSSAVFIPHGPGAVRDVATQIRDGLLQASSSTQ

SEQ ID NO: 8113 - protein, 285 aa, Musa acuminata
MGQALCCVTVDQSSVAIKESFGKFEDVLLPGCHCMPWFLGKKVSGRLSLRLQQLDVKCETKTKDNVFVNVVASVQYHALAEKASDAFYKLSNTRSQIQAYVFDVIRASVPKLNLDDAFEQKNDIAKAVENELEKAMSAYGYEIVQTLIVDIEPDVHVKRAMNEINAAARLRVAANEKAEAEKIIQIKRAEGEAEAKYLSGLGIARQRQAIVDGLRDSVLGFSVNVPGTTAKDVMDMVLITQYFDTMKEIGAQSKSSAVFIPHGPGSVRDVADQIRDGLLQASTHN

SEQ ID NO: 8114 - protein, 285 aa, Capsicum annuum
MGNLFCCVQVDQSTVAIKEQFGKYRDVLEPGCHCVPWFLGSQLAGHLSLRVQQLDVRCETKTKDNVFVNVVASIQYRALADKANEAFYKLSNTKGQIQAYVFDVIRASVPKLNLDDVFEQKNEIAKSVEEELEKAMSAYGYEIVQTLIVDIVPDEHVKRAMNEINAAARLRVAANEKAEAEKILQIKRAEGEAESKYLSGLGIARQRQAIVDGLRDSVLGFSVNVPGTTAKDVMDMVLVTQYFDTMKEIGAASKSSAVFIPHGPGAVKNVAQQIRDGLLQASVGH

SEQ ID NO: 8115 - protein, 284 aa, Ambrosia trifida
GNLFCLYQVDQSTVAIKESFGKFDDVLEPGCHCVPWIFGKQLAGQLTLRVQQLDVKCETKTKDNVFVNVVASIQYRALADKASDAFYKLSNTRSQIQAYVFDVIRAFVPKLNLDDTFEQKNEIAKAVEEELEKAMSAYGYEIVQTLIVDIEPDEHVKRAMNEINAAARLRMAATEKAEAEKILQIKRAEGEAESKYLSGLGIARQRQAIVDGLRDSVLGFAVNVPGTTAKDVMDMVLVTQYFDTMKEIGASSKSSAVFLPHGPGAVRDVASQIRDGLLQGSAAS

SEQ ID NO: 8116 - protein, 285 aa, Cirsium arvense
MGNLFCLVQVDQSTVAIKETFGKFADVLEPGCHCVPWIFGSQLAGYLTLRVQQLDVKCETKTKDNVFVNVVASIQYRALADKASDAFYKLTNTRSQIQAYVFDVIRAFVPKLNLDDAFEQKNQIAKAVEEELEKAMSAYGYEIVQTLIVDIEPDEHVKRAMNEINAAARMRMAATEKAEAEKILQIKRAEGEAEAKYLSGLGIARQRQAIVDGLRDSVLGFAVNVPGTTAKDVMDMVLVTQYFDTMKEIGASSKSSAVFIPHGPGAVRDVASQIRDGLLQGSLAN

SEQ ID NO: 8117 - protein, 285 aa, Cirsium arvense
MGNLCCLVQVDQSTVAIKEAFGKFDDVLEPGCHCVPWIFGRQLAGHLTLRIQQLDVKCETKTKDNVFVNVVASIQYRALAEKASDAFYKLSNTRSQIQAYVFDVIRASVPKLNLDDVFEQKNDIAKAVEEELAKAMSAYGYEIVQTLIVDIEPDERVKKAMNEINAAARMRLAATEKAEADKILQIKRAEGEAESKYLSGLGIARQRQAIVDGLRDSVLGFSVNVPGTTAKDVMDMVLVTQYFDTMKEIGASSKSSAVFIPHGPGAVRDVATQIRDGLLQGNSAS

SEQ ID NO: 8118 - protein, 284 aa, Actinidia deliciosa
MGNLFCCVKVDQSKVAIKERFGKFEKVLDPGCHCLPWFLGSQLAGHLSLRVQQLDVRCETKTKDNVFVNVVASVQYRALADKANDAFYKLSNTRGQIQAYVFDVIRASVPKLNLDDVFEQKNEIARAVEDELEKAMSAYGYEIVQTLIVDIEPDEQVKRAMNEINAASRLRVAANEKAEAEKILQIKRAEGESESKYLSGLGIARQRQAIVDGLRDSVLGFSVNVPGTTAKDVMDMVLVTQYFDTMKEIGAASKSSAVFIPHGPGAVRDVATQIRDGLLQAAEH

SEQ ID NO: 8119 - protein, 285 aa, Quercus alba
MGNLLCFVQVDQSTVAIKEKFGKFEEVLEPGCHFLPWCLGSQLSGHLTLRLQQLDVRCETKTKDNVFVNVVASIQYRALADKASDAFYKLSNTRSQIQAYVFDVIRASVPKLTLDDAFEQKNDIAKAVEDELEKAMSAYGYEIVQTLIVDIEPNVQVKQAMNEINAAARMRVAANEKAEAEKILQIKRAEGEAESKYLSGLGIARQRQAIVDGLRDSVLGFSVNVPGTTPKDVMDMVLVTQYFDTMKEIGVASKSSAVFIPHGPGAVRDVASQIRDGLLQGSVQH

SEQ ID NO: 8120 - protein, 285 aa, Nicotiana tabacum
MGNLLCCVQVDQSTVAITEQFGKYQDVLQPGCHCLPWFLGFQLAGHLSLRVQQLDVRCETKTKDNVFVNVVASIQYRALADKANDAFYRLTNTKGQIQAYVFDVIRASVPKLNLDDVFEQKNEIAKAVEDELEKAMSAYGYEIVQTLIVDIEPDEHVKRAMNEINAAARMRLAANEKAEAEKILQIKRAEGEAESKYLSGLGIARQRQAIVDGLRDSVLGFSVNVPGTSAKDVMDMVLLTQYFDTMKEIGASSKSSAVFLPHGPGVVRDVASQIRDGLLQASTQH

SEQ ID NO: 8121 - protein, 285 aa, Valeriana officinalis
MGGILCCVQVDQSTVAIKEHFGRFDEVLEPGCHCLPWFLGYQLAGNLTLRVQQLDVRCETKTKDNVFVNVVASIQYRAIAEKANDAFYKLSNTRSQIQAYVFDVIRGTVPKLDLDATFEQKNDIAKAVEDELEKAMSAYGFEIIQTLIVDIEPDEHVKRAMNEINAAARMRMAATEKAEAEKILQIKRAEGEAESKYLSGLGIARQRQAIVDGLRDSVLGFSVNVPGTTAKDVMDMVLVTQYFDTMKEIGASSKSSAVFIPHGPGAVRDVAAQIRDGLLQGSSVQ

SEQ ID NO: 8122 - protein, 285 aa, Lactuca sativa
MGNLLCLVQVDQSTVAIKESFGKFDDVLEPGCHCVPWIFGKQLAGHLSLRVQQLDVKCETKTKDNVFVNVVASIQYRALADKASDAFYKLSNTKSQIQAYVFDVIRAFVPKHNLDDTFEQKNEIAKAVEQELEKAMSAYGYEIVQTLIVDIEPDEHVKKAMNEINAAARFRMAATEKAEAEKILQIKRAEGEAESKYLSGLGIARQRQAIVDGLRDSVLGFSVNVPGTTAKDVMDMVLVTQYFDTMKDIGASSKSSAVFIPHGPGAVREVANQIRDGLLQGSATT

SEQ ID NO: 8123 - protein, 285 aa, Nicotiana benthamiana
MGNLICCVQVDQSTVAIKEQFGKYQDVLEPGCHCVPWFLGSQLVGHLSLRVQQLDVRCETKTKDNVFVNVVASIQYRALADKANDAFYKLSNTKGQIQAYVFDVIRASVPKLNLDNVFEQKNEIAKAVEEELEKAMSAYGYEIVQTLIVDIVPDEHVKRAMNEINAAARLRVAANEKAEAEKILQIKRAEGEAESKYLAGLGIARQRQAIVDGLRESVLGFSVNVPGTNAKDVMDMVLVTQYFDTMKEIGASSKSSAVFIPHGPGAVRDVAQQIRDGLLQASIEH

SEQ ID NO: 8124 - protein, 285 aa, Ambrosia trifida
MGNLLCLAQVDQSTVAIKETFGKFDDVLEPGCHCVPWIFGSRLVGYLTLRVQQLDVKCETKTKDNVFVNVVASIQYRALSDKASDAYYKLSNTRAQIQAYVFDVIRASVPKLNLDDVFEQKNEIAKSVEEELEKAMSAYGYEIVQTLIVDIEPDEHVKRAMNEINAAARLRLAATEKAEAEKILQIKRAEGEAESKYLSGLGIARQRQAIVDGLRDSVLGFSVNVPGTTAKDVMDMVLVTQYFDTMKEIGAASKSSAVFIPHGPGAVRDVATQIRDGLLQGSAAT

SEQ ID NO: 8125 - protein, 287 aa, Amorphophallus konjac
MGNLLCCVQVDQSTVAIKERFGKFEEVLEPGCHCIPWFLGIRLAGQLTLRLQQLDVKCETKTKDNVFVNVVASVQYRALANKADDAYYKLSNTRSQIQAYVFDVIRASVPKLDLDDAFEQKNEIAKAVEGELEKAMSNYGYEIVQTLIVDIEPDVHVKRAMNEINAAQRLRMAANEKAEAEKILQIKRAEGEAESKYLAGLGIARQRQAIVDGLRDSVLGFSVNVPGTTAKDVMDMVLVTQYFDTMKEIGASSKSSAVFIPHGPGAVHDVANQIRDGLLQASAQAHQ

SEQ ID NO: 8126 - protein, 285 aa, Artemisia annua
MGQVFCLYQVDQSTVAIKESWGKFDEVLEPGCHCVPWFLGKNLAGQMTLRVQQLDVKCETKTKDNVFVNVVASIQYRALSDKASDAFYKLSNTRSQIQAYVFDVIRAFVPKHNLDDTFEQKNEIAKAVEEELSKAMSTYGFEIVQTLIVDIEPDEHVKRAMNEINAAARLRMAATEKAEAEKILQIKRAEGEAEAKYLSGLGIARQRQAIVDGLRDSVLGFSVNVPGTTAKDVMDMVLVTQYFDTMKEIGASSKSSAVFIPHGPGAVRDVATQIRDGLLQGNAAS

SEQ ID NO: 8127 - protein, 286 aa, Cichorium intybus
MGNLCCLVQVDQSTVAIKESFGKFDDVLEPGCHCVPWIFGKQLAGHLTLRVQQLDVKCETKTKDNVFVNVVASIQYRALADKASDAFYKLSNTKSQIQAYVFDVIRAFVPKHNLDDTFEQKNEIAKAVEQELEKAMSAYGYEIVQTLIVDIEPDEHVKKAMNEINAAARFRMAATEKAEAEKILQIKRAEGEAESKYLSGLGIARQRQAIVDGLRDSVLGFSVNVPGTTAKDVMDMVLVTQYFDTMKDIGASSKSSAVFIPHGPGAVRDVANQIRDGLLQGSSTKE

SEQ ID NO: 8128 - protein, 286 aa, Lactuca sativa
MGNLLCLVQVDQSTVAIKESFGKFDDVLEPGCHCVPWIFGKQLAGHLTLRVQQLDVKCETKTKDNVFVNVVASIQYRALADKASDAFYKLSNTKAQIQAYVFDVIRAFVPKHNLDDTFEQKNEIAKAVEQELEKAMSAYGYEIVQTLIVDIEPDEHVKKAMNEINAAARFRMAATEKAEAEKILQIKRAEGEAESKYLSGLGIARQRQAIVDGLRDSVLGFSVNVPGTTAKDVMDMVLVTQYFDTMKDIGASSKSSAVFIPHGPGAVREVANQIRDGLLQGSSTTT

SEQ ID NO: 8129 - protein, 286 aa, Elaeis guineensis
MSKACCCLQVDQSTVAIKETFGRFGDVLHPGCHCLPWCLGHQIAGYLSLRVQQLDVRCETKTKDNVFVTVVASIQYRALADKASDAFYKLSNTREQIQSYVFDVIRASVPKLNLDDAFEQKNDIARAVEDELEKAMSMYGYEIVQTLIVDIEPDEHVKRAMNEINAAARLRVAANKKAEAEKILQIKRAEGDAESKYLAGLGIARQRQAIVDGLRDSVLAFSVNVPGTTAKDVMDMVLVTQYFDTMKEIGASSKASSVFIPHGPGAVRDIAAQIRDGLLQASTTQQ

SEQ ID NO: 8130 - protein, 284 aa, Phaseolus coccineus
MGNLLCCVQVEQSTVAVKEGFGRFEQVLQPGCHCMPWFLGKQVAGHLSLRLQQLDLRCETKTKDNVFVNVVASIQYRALAEKANDAFYKLSNTKTQLQAYVFDVIRASVPKLNLDDAFEQKNDIAKAVEEELEKAMSAYGYEIVQTLIVDIDPDEHVKRAMNEINAAARLRVAANEKAEAEKILLIKRAEGEAESKYLSGMGIARQRQAIVDGLRDSVLGFSVNVPGTTAKDVMDMVLVTQYFDTLKEIGAASKSSSVFIPHGPGAVREVASQIRDGLLQASHH

SEQ ID NO: 8131 - protein, 286 aa, Medicago truncatula
MGNLVCCVQVDQSQVAMKEGFGKFEKVLQPGCHCMPWFLGKRIAGHLSLRVQQLDIKCETKTKDNVFVNVVASIQYRALADKANDAFYKLSNTRNQIQAYVFDVIRASVPKLNLDDTFEQKNEIAKAVEEELEKAMSAYGYEIVQTLITDIEPDVHVKRAMNEINAAARMRLAAKEKAEAEKILQIKRAEGEAESKYLSGLGIARQRQAIVDGLRDSVIGFSVNVPGTTAKDVMDMVLVTQYFDTMKEIGAASKSSAVFIPHGPGAVRDVASQIRDGLLQGSLSHQ

SEQ ID NO: 8132 - protein, 290 aa, Nicotiana tabacum
MGNLLCCVQVDQSTVAIKERFGKFNDVLEPGCHFLPWCIGSQIAGYLTLRLQQLDVRCETKSKDNVFVTVVASIQYRALADKATDAFYKLSNTGSQIQAYVFDVIRASVPKLNLDDVFEQKNQIAKAVEDELEKAMSAYGYEIVQTLIVDIEPDEHVKRAMNEINAAARMRVAANEKAEAEKIVQIKRAEGDAEAKYLAGLGVARQRQAIVDGLRDSVLGFSSNVPGTSAKDVLDMVLITQYFDTMKEIGATSKSSAVFIPHGPGAVSDIAGQIRHGLLQGLAVEQKNLL

SEQ ID NO: 8133 - protein, 286 aa, Trigonella foenum-graecum
MGNLVCCVQVDQSQVAMKEGFGKFEKVLQPGCHCMPWFLGKRIAGHLSLRVQQLDIKCETKTKDNVFVNVVASIQYRALANKANDAFYKLSNTRNQIQAYVFDVIRASVPKLNLDDVFEQKNEIAKAVEEELEKAMSAYGYEIVQTLITDIEPDVHVKRAMNEINAAARMRLAANDKAEAEKILQIKRAEGEAESKYLSGLGIARQRQAIVDGLRDSVIGFSVNVPGTTAKDVMDMVLVTQYFDTMKEIGAASKSSAVFIPHGPGAVRDVASQIRDGLLQGSVSHE

SEQ ID NO: 8134 - protein, 286 aa, Trigonella foenum-graecum
MGNLLCCVQVDQSTVAMREGFGKFEEVLQPGCHCMPWFLGKRVAGHLSLRLQQLDIKCETKTKDNVFVNVVASIQYRALADKANEAFYKLSNTRGQIQAYVFDVIRASVPKLYLDDAFEQKNEIAKAVEEELEKAMSAYGYEIVQTLITDIEPDEHVKRAMNEINAAARMRLAAKEKAEAEKILQIKRAEGEAESKYLSGLGIARQRQAIVDGLRDSVIGFSVNVPGTSPKDVMDMVLVTQYFDTLKEIGASSKSSAVFIPHGPGAVRDVASQIRDGLLQGSLSHQ

SEQ ID NO: 8135 - protein, 284 aa, Unknown
  Sequence found in Organisms: Gossypium hirsutum, Gossypium raimondii
MGNLFCCVQVGQSTVAIKERFGRFEDVLEPGCHCLPWFLGSQLAGHLSLRLQQLDVRCETKTKDNVFVNVVASIQYRALADKASDAFYKLTDTRKQIQAYVFDVIRASVPKLNLDDVFEQKTEIAKAVEEELEKAMSAYGYEIAQTLIVDIEPDVHVKRAMNEINAAARMRVAANEKAEAEKILQIKRAEGEAESKYLSGLGIARQRQAIVDGLRDSVLGFSVNVPGTTAKDVMDMVLVTQYFDTMKEIGAASKSSAVFIPHGPGAVRDVATQIREGLLQAAHQ

SEQ ID NO: 8136 - protein, 284 aa, Zingiber officinale
MGQAFCCVQVDQSTVAIKESFGKFDDVLQPGCHCLPWIFGKRVAGRLSLRMKQLDVKCETKTKDNVFVNVVASIQYRALPNKASDAFYRLSNTQSQIQAYVFDVIRASVPKLILDDTFEQKNEIAKAVEEELEKAMSAYGFEIVQTLIVDIEPDEHVKRAMNEINAAARLRMAANEKAEAEKIVQIKKAEGEAEAKYLSGVGIARQRQAIVDGLRDSVLGFSVNVPGTTPKDVLDMVLITQYFDTMKEIGAQSKSSSVFIPHGPGAVRDIAQQVRDGLLQASTL

SEQ ID NO: 8137 - protein, 285 aa, Nicotiana benthamiana
  misc_feature (230)..(230): Xaa can be any naturally occurring amino acid
  misc_feature (245)..(245): Xaa can be any naturally occurring amino acid
MGNLLCCVQVDQSTVAITEQFGKYQDVLQPGCHCLPWFLGFQLAGHLSLRVQQLDVRCETKTKDNVFVNVVASIQYRALADKANDAFYRLTNTKGQIQAYVFDVIRASVPKLNLDDVFEQKNDIARAVEDELEKAMSAYGYEIVQTLIVDIEPDEHVKRAMNEINAAARMRLAANEKAEAEKILQIKRAEGEAESKYLSGLGIARQRQAIVDGLRDSVLGFSVNVPGTSXKDVMDMVLLTQYFDXMKEIGASSKSFAVFLPHGPGAVRDVASQIRDGLLQAFTEH

SEQ ID NO: 8138 - protein, 286 aa, Elaeis guineensis
MGQALCCLQVEQSTVAIKETFGRFTDVLDPGCHFLPWCLGQQIAGYLSLRVQQLDVRCETKTKDNVFVTVVASIQYRALADKASDAFYRLSNTREQIQSYVFDVIRASVPKLNLDDVFEQKNDIAKAVEDELEKAMSMYGYEIVQTLIVDIEPDEHVKRAMNEINAAARLRVAANEKAEAEKILQIKRAEGDAESKYLAGLGIARQRQAIVDGLRDSVLAFSVNVPGTTAKDVMDMVLVTQYFDTMKEIGASSKASSVFIPHGPGAVRDIAAQIRDGLLQASTTQQ

SEQ ID NO: 8139 - protein, 286 aa, Platanus occidentalis
MGQALGCVQVDQSNVAIKETFGKFDEVLEPGCHCLPWCFGSQIAGKLSLRLQQLDVRCETKTKDNVFVTVVASIQYRALADKAADAFYKLSNTKAQIQAYVFDVIRASVPKLDLDSTFEQKNEIAKAVEEELEKAMSAYGFEIVQTLIVDIEPDVHVKRAMNEINSAARLRVAANEKAEAEKIMQIKRAEGDAESKYLSGLGIARQRQAIVDGLRDSVLAFSVSVPGTTAKDVMDMVLVTQYFDTMKEIGASSKSSSVFIPHGPGAVKDIASQIRDGLLQANTTQQ

SEQ ID NO: 8140 - protein, 290 aa, Nicotiana benthamiana
MGNLLCCVQVDQSTVAIKERFGKFNDVLQPGCHFLPWCIGSQIAGYLTLRLQQLDVRCETKSKDNVFVTVVASIQYRALADKATDAFYKLSNTRSQIQAYVFDVIRASVPKLNLDDVFEQKNQIAKAVEDELEKAMSAYGYEIVQTLIVDIEPDEHVKRAMNEINAAARMRVAANEKAEAEKIVQIKRAEGDAEAKYLAGVGVARQRQAIVDGLRDSVLGFSSNVPGTSAKDVLDMVLITQYFDTMKEIGATSKSSAVFIPHGPGAVSDIAGQIRHGLLQGSAVEQKNLL

SEQ ID NO: 8141 - protein, 285 aa, Ricinus communis
MGQALGCVQVDQSTVAIKETFGKFDDVLEPGCHCLPWCLGSQLAGHLSLRVQQLDVRCETKTKDNVFVTVVASIQYRALAEKAADAFYKLSNTRAQIQAYVFDVIRASVPKLDLDSAFEQKNDIAKAVENELEKAMSHYGFEIVQTLIVDIEPDEHVKRAMNEINAAARMRVAASEKAEAEKILQIKRAEGDAESKYLAGLGIARQRQAIVDGLRDSVLAFSENVPGTSSKDVMDMVLVTQYFDTMKEIGASSKSSSVFIPHGPGAVRDIATQIRDGLLQANSTR

SEQ ID NO: 8142 - protein, 286 aa, Castanea mollissima
MGQALCCVQVDQSTVAIKETFGKFDDVLEPGCHCLPWVLGQQLAGHLSLRVQQLDVRCETKTKDNVFVTVVASIQYRALADKASDAFYKLSNTRAQIQSYVFDVIRASVPKLELDSVFEQKNEIAKAVEEELEKAMSAYGFEIVQTLIVDIEPDEHVKRAMNEINAAARMRVAANEKAEAEKILQIKRAEGDAESKYLAGLGIARQRQAIVDGLRDSVLAFSVNVPGTTSKDVMDMVLVTQYFDTMKEIGASSKSNSVFIPHGPGAVRDIASQIRDGLLQGNTVQN

SEQ ID NO: 8143 - protein, 282 aa, Taraxacum officinale
MGNLCCLVQVDQSTVAIKESFGKFDDVLEPGCHCVPWIFGKQLAGHLTLRVQQLDVKCETKTKDNVFVNVVASIQYRALADKAGDAFYKLSNTKSQIQAYVFGVIRAFVPKHNLDDTFEQKNEIAKAVEQELEKAMSAYGYEIVQTLIVDIEPDEHVKKAMNEINAAARFRMAATEKAEAEKILQIKRAEGEAEAKYLAGLGIARQRQAIVDGLRDSVLGFSVNVPGTTAKDVMDMVLVTQYFDTMKDIGASSKSSAVFIPHGPGAVRDVANQIRDGLLQGS

SEQ ID NO: 8144 - protein, 284 aa, Medicago truncatula
MGNLLCCVQVDQSTVAMREGFGKFEEVLQPGCHCMPWFLGKRIAGHLSLRLQQLDIKCETKTKDNVFVNVVASIQYRALADKANEAFYKLSNTRGQIQAYVFDVIRASVPKLYLDDAFEQKNEIAKAVEEELEKAMSAYGYEIVQTLITDIEPDEHVKRAMNEINAAARMRLAAKEKAEAEKILQIKRAEGEAESKYLSGMGIARQRQAIVDGLRDSVIGFSVNVPGTSAKDVMDMVLVTQYFDTLKEIGAASKSSAVFIPHGPGAVRDVASQIRDGLLQGSHQ

SEQ ID NO: 8145 - protein, 286 aa, Elaeis guineensis
MGQACCCLQVDQSTVAIKETFGRFGDVLHPGCHCLPWCLGHQIAGYLSLRVQQLDVRCETKTKDNVFVTVVASIQYRALADKASDAFYKLSNTREQIQSYVFDVIRASVPKLNLDDAFEQKNDIARAVEDELEKAMSMYGYEIVQTLIVDIEPDEHVKRAMNEINAAARLRVAANEKAEAEKILQIKRAEGDAESKYLAGLGIARQRQAIVDGLRDSVLAFSVNVPGTTPKDVMDMVLVTQYFDTMKEIGASSKSSSVFIPHGPGAVRDIAAQIRDGLLQANTTLQ

SEQ ID NO: 8146 - protein, 285 aa, Populus trichocarpa
MGNLLGCVKVDQSTVVIKERFGKFNEVLEPGCHCMPWFLGSQVAGHLTLRLQQLDVRCETKTKDNVFVNVVASVQYRALAHKASDAFYKLTNTRSQIQAYVFDVIRASVPKLLLDDVFEQKNEIARAVEEELEKAMSAYGYEIVQTLIVDIEPDEHVKRAMNEINAAARMRLAANEKAEAEKIIQIKRAEGEAESKYLAGLGIARQRQAIVDGLRDSVLGFSDNVPGTSAKDVLDMVLITQYFDTMKEIGASSKSSAVFIPHGPGSVRDIATQIRDGLLQASAPQ

SEQ ID NO: 8147 - protein, 287 aa, Scabiosa columbaria
MGGILCCVQVDQSTVAIKEQFGKFEDVLDPGCHCLPWFLGYQLAGHLSLRVQQLDVRCETKTKDNVFVNVVASIQYRAIADKASEAFYKLSNTRAQIQAYVFDVIRGTVPKINLDDAFEQKNDIAKAVEDELEKAMSGYGYEIVQTLIVDIEPDEHVKRAMNEINAAARFRMAATEKAEAEKILQVKRAEGEAESKYLSGLGIARQRQAIVDGLRDSVLGFSVNVPGTTAKDVMDMVLVTQYFDTMKEIGASSKSSAVFIPHGPGAVHDIASQIRNGLLQGSSADHH

SEQ ID NO: 8148 - protein, 284 aa, Trigonella foenum-graecum
MGNLFCCVQVGQSTVAMKESFGKFEEVLQPGCHCMPWFLGKRIAGRLSLRIQQLDIKCETKTKDNVFVNVVASIQYRALADKANEAFYKLSNTRSQIQAYVFDVIRAYVPKLNLDDTFEQKNEIAKAVEDELEKAMSAYGYEIIQTLIVDIEPDERVKRAMNEINAATRLRMAANEKAEAEKILQIKRAEGEAESKYLSGLGIARQRQAIVDGLRDSVIGFSDNVPGTSAKDVMDMVLVTQYFDTMKEIGASSKSSAVFIPHGPGAVRDVASQIRDGLLQGSHQ

SEQ ID NO: 8149 - protein, 156 aa, Allium cepa
MGNLLCCVQVDQSTVAVKEQFGKFDEILDPGCHCMPWFLGKRVAGYLSLRVQQLDVKCETKTKDNVFVNVVASIQYRALASKASDAFYRLSNTRLQIQAYVFDVIRATVPKLILDDVLNKRTTLQKQLKMNSRKLCLLMDMKSCRPSLLILNLMSM

SEQ ID NO: 8150 - protein, 122 aa, Medicago truncatula
MGNLLCCVQVDQSTVAMKEGFGKFEEVLQPGCHCMPWFLGKRIAGHLSLRLQQLDIKCETKTKDNVFVNVVASIQYRALADNANDAFYKLSNTRSQIQAYVFDVIRAYVPKLNLDDTFEQKK

SEQ ID NO: 8151 - protein, 287 aa, Amborella trichopoda
MGQFLCCCIQVDQSTVAIKERFGRFDDVLEPGCHCMPWFLGSQLAGHLTLRLQQLDVRCETKTKDNVFVTVVASIQYRALADKASDAFYKLSNTRTQIQAYVFDVIRASVPKLDLDDVFEQKNDIAKAVEDELEKAMSAYGYQIVQTLIVDIEPDEHVKRAMNEINAASRMRLATKEKAEAEKIIQIKRAEGEAESKYLAGLGIARQRQAIVDGLRDSVLGFSVNVPGTTAKDVMDMVLVTQYFDTMKEIGATSKSSAVFIPHGPGAVRDVAAQIRDGLLQSQVHHE

SEQ ID NO: 8152 - protein, 245 aa, Catharanthus roseus
MGNRLCFVQVDQSTVSIKERFGKFDEVLNPGCHFLPWCLGSQIAGNLSLRVQQLDVRCETKTKDNVFVTVVASIQYRALAEKASDAFYRLTNTRNQIQAYVFDVIRASVPKLILDDVFEQKNDIARAVEDELEKAMSTYGYEIVQTLIVDIEPDEHVKRAMNEINAAARLRVAANEKAEAEKIIQIKRAEGEAESKYLAGLGVARQRQAIVDGLRDSVLGFSGNVPGTTAKDVMDMVLVTQYLIP

SEQ ID NO: 8153 - protein, 285 aa, Lactuca sativa
MGNLLCLVQVDQSTVAIKETFGKFDDVLQPGCHCVPWIFGRRLAGHLTLRLRQLDVKCETKTKDNVFVNVVASIQYRALADKASEAFYKLTNTSTQIQAYVFDVIRASVPKLNLDDVFEQKNEIAKAVDRELEKAMSAYGFEIVQTLIVDIEPDERVKKAMNEINAAARMRLAAIEKGEAEKILQIKRAEGEAESKYLSGLGIARQRQAIVDGLRDSVLGFSVNVPGTTAKDVMDMVLVTQYFDTMKEIGAASKSSAVFIPHGPGAVRDVAAQIRDGLLMGSATT

SEQ ID NO: 8154 - protein, 285 aa, Manihot esculenta
MGQALGCIQVDQSTVAIKETFGKFDDVLEPGCHCLPWCLGSQLAGHLSLRVQQLDVRCETKTKDNVFVTVVASVQYRALAEKAADAFYKLSNTRAQIQAYVFDVIRASVPKLELDSAFEQKNEIAKAVEDELEKAMSHYGFEIVQTLIVDIEPDEHVKRAMNEINAAARMRVAANEKAEAEKILQIKRAEGDAESKYLAGLGIARQRQAIVDGLRDSVLAFSVNVPGTTSKDVMDMVLVTQYFDTMKEIGASSKSNSVFIPHGPGAVRDIATQIRDGLLQANSNQ

SEQ ID NO: 8155 - protein, 285 aa, Cirsium arvense
MGNLFCLVQVDQSTVAIKETFGKFDDVLDPGCHCVPWIFGSKLAGHLTLRIQQLDVKCETKTKDNVFVNVVASIQYRALAEKANDAFYKLSNTRSQIQAYVFDVIRASVPKLYLDDVFEQKNDIAKAVEEELAKAMSAYGYEIVQTLIIDIEPDERVKKAMNEINAAARMRLAATEKAEADKILQIKRAEGEAESKHLSGLGIARQRQAIVDGLRDSVLGFSVNVPGTTTKDVMDMVLVTQYFDTMKEIGASSKSSAIFIPHGPGAVRDVATQIRDGLLQGNSAS

SEQ ID NO: 8156 - protein, 285 aa, Cucumis melo
MGQALGCIQVDQSTVAIRETFGKFDDVLQPGCHCLPWCLGSQIAGHLSLRLQQLDVRCETKTKDNVFVTVVASIQYRALADKASDAFYKLSNTREQIQAYVFDVIRASVPKLDLDSTFEQKNDIAKAVEDELEKAMSAYGYEIVQTLIVDIEPDEHVKRAMNEINAAARLRVAATEKAEAEKILQIKRAEGDAESKYLAGLGIARQRQAIVDGLRDSVLAFAENVPGTTSKDVMDMVLVTQYFDTMKEIGASSKSNSVFIPHGPGAVKDIASQIRDGLLQASQTQ

SEQ ID NO: 8157 - protein, 287 aa, Mimulus guttatus
MGQAFGCIQVDQSTVAVKEQFGKFDEVLEPGCHFLPWCIGYQLAGSLTLRLQQLDVRCETKTKDNVFVTVVASIQYRALADKAADAFYKLSNTKEQIQAYVFDVIRATVPKLDLDSTFEQKNDIAKAVENELEKAMSAYGFEIVQTLIVDIEPDAQVKRAMNEINAAARLRVAATEKAEAEKILQIKRAEGEAESKYLSGLGIARQRQAIVDGLRDSVIAFSENVPGTSAKDVMDMVLVTQYFDTMKEIGASSKSSAVFIPHGPGAVKDIATQIREGLLQGSAASTS

SEQ ID NO: 8158 - protein, 286 aa, Quercus alba
MGQALCCVQVDQSTVAIKETFGKFDDVLDPGCHCLPWVLGQQIAGHLSLRVQQLDVRCETKTKDNVFVTVVASIQYRALADKASDAFYKLSNTRAQIQSYVFDVIRASVPKLELDSVFEQKNEIAKAVEEELEKAMSAYGFEIVQTLIVDIEPDEHVKRAMNEINAAARMRVAANDKAEAEKILQIKRAEGDAESKYLAGLGIARQRQAIVDGLRDSVLAFSVNVPGTTSKDVMDMVLVTQYFDTMKEIGASSKSNSVFIPHGPGAVRDIASQIRDGLLQGNTVQN

SEQ ID NO: 8159 - protein, 287 aa, Silene vulgaris
MGNLLCCVQVDQSTVAIEESFGKYTDVLEPGCHCVPWFLGYQIAGKLTLRVQQLDVRCETKTKDNVFVNVVASIQYRAIAEKASDAFYKLSNTRSQIQAYVFDVIRGTVPRLNLDDVFEQKTEIAKAVASELEKAMSHYGFEIVETLIVDIEPDEQVKRAMNEINAAARLRLATSEKAEAEKIIQIKRAEGEAEAKYLSGLGIARQRQAIVDGLRDSVLGFSVNVPGTSAKDVMDMVLVTQYFDTLKEIGASSKSSAVFIPHGPGAVRDVATQIRDGLLQASSMSTS

SEQ ID NO: 8160 - protein, 286 aa, Fragaria vesca
MGQCLGCVQVDQSTVAIRETFGKFDDVLEPGCHCLPWCLGSAIAGHLSLRLQQLDVRCETKTKDNVFVTVVASIQYRALADKASDAFYKLSNTRGQIQSYVFDVIRASVPKLDLDSTFEQKNDIAKAVEEELEKAMSHYGFEIVQTLIVDIEPDEHVKRAMNEINAAARMRLAATEKAEAEKILQIKRAEGEAESKYLSGLGIARQRQAIVDGLRDSVLAFSENVPGTSSKDVMDMVLVTQYFDTMKEIGASSKSNSVFIPHGPGAVKDIASQIRDGLLQGNSSRS

SEQ ID NO: 8161 - protein, 285 aa, Tripterygium wilfordii
MGQAFCCIQVDQSNVAIKETFGKFDDVLEPGCHCLPWFLGSQLAGHLSLRVQQLDVRCETKTKDNVFVTVVASIQYRALAEKASDAFYKLSNTRAQIQAYVFDVIRASVPKLDLDSTFEQKNDIAKAVEDELEKAMSHYGYEIVQTLIVDIEPDEHVKRAMNEINAAARMRLAANEKAEAEKILQIKRAEGDAESKYLAGLGIARQRQAIVDGLRDSVLAFSENVPGTTSKDVMDMVLVTQYFDTMKEIGASSKSNSVFIPHGPGAVKDIAAQIRDGLLQANTTT

SEQ ID NO: 8162 - protein, 286 aa, Unknown
  Sequence found in Organisms: Prunus persica, Prunus mume
MGQALGCVQVDQSTVAIRETFGKFDDVLEPGCHCLPWCLGSQIAGHLSLRVQQLDVRCETKTKDNVFVTVVASIQYRALAEKASDAFYKLSNTRGQIQSYVFDVIRASVPKLDLDSTFEQKNDIAKAVEEELEKAMSHYGFEIVQTLIVDIEPDEHVKRAMNEINAAARMRLAATEKAEAEKILQIKRAEGEAESKYLSGLGIARQRQAIVDGLRDSVLAFSENVPGTSSKDVMDMVLVTQYFDTMKEIGASSKSNSVFIPHGPGAVRDIASQIRDGLLQANPPQV

SEQ ID NO: 8163 - protein, 285 aa, Theobroma cacao
MGQVLGCIQVEQSTVAITETFGKFDEVLEPGCHCLPWCFGKQAAGFLSLRVQQLDVRCETKTKDNVFVNVVASIQYRALADKAQDAFYKLSNTRAQIQSYVFDVIRASVPKLDLDSVFEQKNDIAKAVEEELEKAMSHYGFEIVQTLIVDIEPDEHVKRAMNEINAAARLRVAANEKAEAEKILQIKRAEGDAESKYLAGLGVARQRQAIVDGLRDSVLAFSVNVPGTTSKDVMDMVLVTQYFDTMKEIGASSKSNSVFIPHGPGAVRDIASQIRDGLLQGRTIE

SEQ ID NO: 8164 - protein, 284 aa, Cucumis sativus
MGQALGCIQVDQSTVAIRETFGRFDDVLQPGCHCLPWCLGSQIAGHLSLRLQQLDVRCETKTKDNVFVTVVASIQYRALADKASDAFYKLSNTREQIQAYVFDVIRASVPKLDLDSTFEQKNDIAKAVEDELEKAMSAYGYEIVQTLIVDIEPDEHVKRAMNEINAAARLRVAATEKAEAEKILQIKRAEGDAESKYLAGLGIARQRQAIVDGLRDSVLAFAENVPGTTSKDVMDMVLVTQYFDTMKEIGASSKSNSVFIPHGPGAVKDIASQIRDGLLQASQT

SEQ ID NO: 8165 - protein, 272 aa, Taraxacum officinale
MGNLFCLVQVDQSTVAIKETFGKFSDVLEPGLHCVPWIFGSQVAGQLTLRLQQLDVKCETKTKDNVFVNVVASIQYRALADKASDAFYKLSNTRSQIQAYVFDVIRASVPKLNLDDAFEQKNEIAKAVEEELEKAMSAYGFEIVQTLIVDIEPDEHVKRAMNEINAAARLRMAATEKAEAEKILQIKRAEGEAESKYLSGLGIARQRQAIVDGLRDSVLGFSVNVPGTTAKDVMDMVLVTQYFDTMKEIGASSKSSAVFIPHGPGAVRDVAS

SEQ ID NO: 8166 - protein, 285 aa, Euphorbia peplus
MGNLLCCVQVDQSTIAVKETFGKYDEILQPGCHCMPWFLGSRVAGHLSLRLQQLDVRCETKTKDNVFVTVVASIQYRPLAQKESDAFYKLTNTKGQIQAYVFDVIRASVPKLNLDDAFEQKNEIAKAVEEELEKAMSAYGYEIVQTLIVDIEPDEHVKRAMNEINAAARMRVAANEKAEAEKIVQIKRAEGEAESKYLSGVGIARQRQAIVDGLRDSVLGFSVNVPGTTAKDVLDMVLITQYFDTMKEIGAASKSSAVFIPHGPGAVNDVATQIRNGLLQAHPHQ

SEQ ID NO: 8167 - protein, 282 aa, Euphorbia peplus
MGQALGCVQVDQSTVAIKETFGKFDDVLEPGCHCLPWCLGSQLAGHLSLRVQQLDVRCETKTKDNVFVTVVASIQYRALAGKAADAFYKLSNTRAQIQAYVFDVIRASVPKLELDSTFEQKNDIAKAVEQELEKAMSHYGYEIVQTLIVDIEPDEHVKRAMNEINAAARMRVAANEKAEAEKILQIKRAEGEAESKYLAGVGIARQRQAIVDGLRDSVLAFSENVPGTSSKDVMDMVLVTQYFDTMKEIGASSKSSSVFIPHGPGAVRDVATQIRDGLLQAR

SEQ ID NO: 8168 - protein, 280 aa, Flaveria ramosissima
LFVSSGSMTVAIKESFGKFDDVLEPGCHCVPWIFGKQLAGYLSLRVQQLDVKCETKTKDNVFVNVVASIQYRALADKANDAFYKLSNTRSQIQAYVFDVIRAFVPKLNLDDTFEQKNEIAKAVEQELEKAMSAYGYEIVQTLIVDIEPDEHVKRAMNEINAAARLRMAAAEKAEAEKILQIKRAEGEAESKYLSGLGIARQRQAIVDGLRDSVLGFSVNVPGTTAKDVMDMVLVTQYFDTMKEIGASSKSSAVFLPHGPGAVRDVASQIRDGLLQGSAAT

SEQ ID NO: 8169 - protein, 285 aa, Citrullus lanatus
MGQAFGCIQVDQSTVAIRETFGKFDHVLQPGCHCLPWCFGSQVAGHLSLRVQQLDVRCETKTKDNVFVTVVASIQYRALADKASDAFYKLSNTREQIQAYVFDVIRASVPKLDLDSTFEQKNDIAKAVEDELEKAMSAYGYEIVQTLIVDIEPDEHVKRAMNEINAAARLRVAASEKAEAEKILQIKRAEGDAESKYLAGLGIARQRQAIVDGLRDSVLAFAENVPGTTSKDVMDMVLVTQYFDTMKEIGASSKSNSVFIPHGPGAVKDIASQIRDGLLQASRTQ

SEQ ID NO: 8170 - protein, 156 aa, Fagus grandifolia
MGQALCCVQVDQSTVAIKETFGKFDDVLEPGFHCLPWVFGQQVAGHLSLRVQQLDVRCETKTKDNVFVTVVASIQYRALSDKAADAFYKLSNTRAQIQSYVFDVIRASVPKLELDSVFEQKTKSRKLWKRNSRRPCQLMDMRSFKHSSWTLNLMSM

SEQ ID NO: 8171 - protein, 284 aa, Zostera marina
MGQAFCCLQVDQSTVAIKERFGKFEEVLEPGCHFFPWIFGIQLAGNLSLRVQQLDVKCETKTKDNVFVNVVASIQYRALSEKAGDAFYKLSNTRAQIQAYVFDVIRASVPKLYLDDAFEQKNDIAKSVEEELEKAMSAYGFEIVQTLIVDIEPDEHVKRAMNEINAASRMRMAASEKAEAEKILQIKRAEGEAESKYLSGLGIARQRQAIVDGLRDSVLGFSVNVPGTTAKDVMDMVLVTQYFDTMKEIGAASKSSAVFIPHGPGAVRDVATQIREGLLQATST

SEQ ID NO: 8172 - protein, 277 aa, Fagus grandifolia
VQVDQSTVAIKEKFGKFDEVLEPGCHCLPWFLGSKLSGHLSLRLQQLDVRCETKTKDNVFVNVVASIQYRALADKASDAFYKLSNTRRQIQAYVFDVIRASVPKLTLDAAFEQKNEIAKAVEDELEKAMSAYGYEIVQTLIVDIEPDEHVKRAMNEINAAARLRVAVNEKAEAEKILQIKRAEGEAESKYLSGLGIARQRQAIVDGLRESVVGFSSNVPGTTTKDVMDMVLVTQYFDTMKEIGAASKSSAVFIPHGPGAVRDVATQIRDGLHQASVH

SEQ ID NO: 8173 - protein, 285 aa, Citrus clementina
MGQALGCIQVDQSTVAIRETFGKFDEVLEPGCHCLPWCLGSQVAGQLSLRVQQLDVRCETKTKDNVFVNVVASVQYRALAEKASDAFYKLSNTRSQIQAYVFDVIRASVPKLDLDATFEQKNDIAKAVEEELEKAMSHYGYEIVQTLIVDIEPDEHVKRAMNEINAAARLRLAANEKAEAEKILQIKRAEGEAESKYLAGLGIARQRQAIVDGLRDSVLAFSENVPGTSSKDVMDMVLVTQYFDTMKEIGASSKTNSVFIPHGPGAVKDIASQIREGLLQANATM

SEQ ID NO: 8174 - protein, 285 aa, Eucalyptus grandis
MGNLFCCIQVDQSTVAIRERFGKFDDVLQPGCHFLPWCLGSQLAGHLSLRVQQLDVRCETKTKDNVFVNVVASIQYRALANQASDAFYKLTNTKGQIQAYVFDVIRASVPRLNLDDVFEQKNEIAKAVEDELEKAMSTYGYEIVQTLIVDIEPDEHVKRAMNEINAAARLRLAANEKAEAEKILQIKRAEGEAESKYLSGLGIARQRQAIVDGLRDSVLGFSENVPGTSAKDVMDMVLVTQYFDTLKEIGAASKTSAVFIPHGPGAVRDVASQIREGLLQASSVS

SEQ ID NO: 8175 - protein, 286 aa, Actinidia deliciosa
MGQAFGCIQVDQSTVAVKEQFGKFDDVLEPGCHCLPWCLGYQVAGELSLRVQQLDVRCETKTKDNVFVNVVASIQYRAMADKASDAFYKLSNTKGQIQAYVFDVIRASVPKMDLDSTFEQKNDIAKAVEDELEKAMSAYGFEIVQTLIVDIEPDINVKRAMNEINAAARMRVAANEKAEAEKILQIKRAEGEAESKYLSGLGIARQRQAIVDGLRDSVLAFSENVPGTSAKDVMDMVLVTQYFDTMKEIGASSKSSAVFIPHGPGAVRDVAAQIREGLLQGASVQH

SEQ ID NO: 8176 - protein, 285 aa, Citrus sinensis
MGQALGCIQVDQSTVAIKETFGKFDDVLEPGCHCLPWCLGSQVAGQLSLRVQQLDVRCETKTKDNVFVNVVASVQYRALAEKASDAFYKLSNTRSQIQAYVFDVIRASVPKLDLDATFEQKNDIAKAVEEELEKAMSHYGYEIVQTLIVDIEPDEHVKRAMNEINAAARLRLAANEKAEAEKILQIKRAEGEAESKYLAGLGIARQRQAIVDGLRDSVLAFSENVPGTSSKDVMDMVLVTQYFDTMKEIGASSKTNSVFIPHGPGAVKDIASQIREGLLQANATT

SEQ ID NO: 8177 - protein, 284 aa, Phalaenopsis aphrodite
MGQLLCCVQIDQSTVAIREQFGKFDDVLEPGCHCVPWFMGSHIAGYLSLRLQQLDVKCETKTKDNVFVNVVASIQYRALAGKANDAFYKLSNTRTQIQAYVFDVIRASVPKLNLDDVSSRRTKSREPWKTNLEKAMSAYGYEIVQTLIVDIEPDEHVKRAMNEINAAARLRSAANEKAEAEKIIQIKRAEGEAEAKYLSGLGIARQRQAIVDGLRDSVLGFSVNVPGTTAKDVMDMVLVTQYFDTMKEIGAASKSSAVFIPHGPGAVRDVADQIRDGLLQANRV

SEQ ID NO: 8178 - protein, 285 aa, Populus trichocarpa
MGQAFGCLQVDQSNVAIKEQFGKFVDVLEPGCHCLPWCFGYQVAGGLSLRVQQLDVRCETKTKDNVFVTVVASIQYRAMAEKASDAFYKLSNTKAQIQAYVFDVIRASVPKLLLDDTFEQKNDIAKAVENELEKAMSAYGYEIVQTLIVDIEPDINVKRAMNEINAAARLRVAANEKAEAEKILQIKRAEGEAESKYLSGLGIARQRQAIVDGLRDSVLAFSENVPGTSAKDVMDMVLVTQYFDTMKEIGASSKSSSVFIPHGPGAVRDITSQIRDGLLQGNSAQ

SEQ ID NO: 8179 - protein, 286 aa, Silene vulgaris
MGQVLGCVQVDQSTVAIRETFGKFDSVLEPGCHCLPWCLGSQLAGHLTLRVQQLDVRCETKTKDNVFVTVVASVQYRALAENAGDAFYKLSNTREQIQAYVFDVIRASVPKLLLDNAFEQKNDIAKAVEEELEKAMSAYGYQIVQTLIVDIEPDVNVKRAMNEINAAARMRVAANEKAEAEKILQIKRAEGEAESKYLSGLGIARQRQAIVDGLRDSVLNFSENVPGTTAKDVMDMVLVTQYFDTMREIGASSKSSAVFIPHGPGAVKDVASQIRDGLLQGNVMER

SEQ ID NO: 8180 - protein, 284 aa, Glycine max
MGNLFCCVKVDQSTVAMREGFGRFEKVLQPGCHCMPWFLGKQLAGHLSLRLQQLDLRCETKTKDNVFVNVVASIQYRALAEKANDAFYKLSNTKTQIQAYVFDVIRASVPKLNLDDAFEQKSEIARAVEEELEKAMSAYGYEIVQTLIVDIDPDVHVKRAMNEINAAARLRLAANEKAEAEKILLIKRAEGEAESKYLSGLGIARQRQAIVDGLRDSVLGFSVNVPGTSARDVMDMVLVTQYFDTMKDIGAASKSSAVFIPHGPGAVRDVASQIRDGLLQASHQ

SEQ ID NO: 8181 - protein, 290 aa, Nicotiana benthamiana
MGNLLCCVQVDQSTVAIKERFGKFNDVLEPGCHFLPWCIGSQIAGYLTLRLQQLDVRCETKSKDNVFVTVVASIQYRALADKATDAFYKLSNTRSQIQAYVFNVIRASVPKLNLDDVFEQKNQIAKAVEDELEKAMSAYGYEIVQTLIVDIEPDEHVKRAMNEINAAARMRAAANEKAEAEKIVQINRAEGDAEAKYLAGLGVARQRQAIVDGLRDSVLGFSSNVPGTSAKGVLDMVLITQYFDTMKEIGATSKSSAVFIPHGPGAVSDIAGQIEHGLLQGSTVQQQNLM

SEQ ID NO: 8182 - protein, 287 aa, Papaver somniferum
MGNLLCCVQVDQSKVAIKERFGKFEEVLDPGCHCLPWFLGSQIAGHLTLRVQQLDVKCETKTKDNVFVNVVASIQYRALAEKASDAFYKLSNTRGQIQAYVFDVIRASVPKLILDDVFEQKNDIARAVEEELEKAMSAYGYEIVQTLIVDIEPDVNVKRAMNEINAAARLRLAATDKAEAEKILQIKRAEGEAESKYLAGLGIARQRQAIVDGLRDSVVGFSTNVPGTSAKDVMDMVLVTQYFDTMKEIGANSKTSAVFIPHGPGAVRDVVTQIRDGLLQGSSAHMT

SEQ ID NO: 8183 - protein, 285 aa, Nicotiana benthamiana
MGNMLCCVKVDQSTVAITEQFGKYQNVLQPGCHCLPSFLGFKVAGHLSLRVQQLDVRCETKTKDNVFVNVVASVQYRALANKANDAFYRLTNTKGQIQAYVFDVIRASVPKLNIDDVFEQKNGIARAVEDELEKAMSAYGYEIVQTLIVDIEPDEHVKRAMNEINAAARMRVAANEKAEAEKILQIKRAEGEAESKYLSGLGVARQRQAIVDGLRDSVLGFSVNVPGTSAKDVMDMVLLTQYFDTMKEIGASSKSSAVFLPHGPGAVRDVASQIRDGLLQASTER

SEQ ID NO: 8184 - protein, 284 aa, Amborella trichopoda
MGQLFCCLQVDQSNVAIREQFGKFDDVLEPGCHFLPWCLGSQVAGYLTLRVQQLDVRCETKTKDNVFVTVVASIQYRALADKASDAFYKLSNTKNQIQAYVFDVIRASVPKLNLDDAFEQKNEIAKAVEEELEKAMSAYGYEIVQTLIVDIEPDARVKQAMNEINAASRMRVAANEKAEAEKILQIKRAEGEAESKYLSGLGIARQRQAIVDGLRESVIAFSSNVPGTSAKDVMDMVLVTQYFDTMKEIGASAKSSSVFIPHGPGAVRDVASQIRDGLLQANLG

SEQ ID NO: 8185 - protein, 286 aa, Aquilegia formosa
MGNVFCAQVDQSTVAIKETWGKFDEILEPGCHFLPCCLGQSIAGYLSLRVQQLDVRCETKTKDNVFVTVVASIQYRALADKASDAYYKLSNTRAQIQAYVFDVIRASVPKLDLDSTFEQKNDIAKAVEDELEKAMSLYGYEIVQTLIVDIEPDEHVKRAMNEINAAARMRAAANEKAEAEKILQIKRAEGEAESKYLAGVGIARQRQAIVDGLRDSVLAFSSNVPGTSSKDVMDMVLITQYFDTMKEIGASSKSSSVFIPHGPGAVKDIASQIRDGLLQGEAGSHH

SEQ ID NO: 8186 - protein, 286 aa, Beta vulgaris
MGQALGCVQVDQSTVAISERFGKFQDVLDPGCHCVPWCLGSQLAGQLTLRLQQLDVRCETKTKDNVFVTVVASVQYRALAEKAADAFYKLSNTREQIQAYVFDVIRASVPKLYLDSAFEQKNDIAKAVEEELEKAMSAYGYEIVQTLIVDIEPDVNVKRAMNEINAAARMRLAANEKAEAEKILQIKRAEGEAEAKYLSGLGIARQRQAIVDGLRDSVLNFSETVPGTSAKDVMDMVLVTQYFDTMKEIGASSKSSAVFIPHGPGAVKDIATQIRDGLLQGNTMER

SEQ ID NO: 8187 - protein, 285 aa, Cucurbita pepo
MGQALGCIQVDQSTIAIRETFGKFDDVLEPGCHCLPWCLGSQVAGYLSLRVQQLDVRCETKTKDNVFVTVVASIQYRALADKASDAFYKLSNTREQIQAYVFDVIRASVPKLDLDSTFEQKNDIAKAVEDELEKAMSAYGYEIVQTLIVDIEPDEHVKRAMNEINAAARMRVAANEKAEAEKILQIKRAEGDAESKYLAGLGIARQRQAIVDGLRDSVLAFAENVPGTTSKDVMDMVLVTQYFDTMKEIGASSKTNSVFIPHGPGAVKDITSQIRDGLLQGSRTQ

SEQ ID NO: 8188 - protein, 285 aa, Zingiber officinale
MGQLLCCVQVDQATVAISEQFGKFDAVLQPGCNCVPWVTGKRIAGHLSLRLQQLDVKCETKTKDNVFVNVIASVQYRAMTNKASDAFYKLTNTRTQIQAYVFDVIRATVPKLNLDDVFEQKSEIAKAVEDELEKAMSAYGYEIVQTLIVDIEPDEHVKRAMNEINAAARLRMAANEKAEAEKIIQIKRAEGEAEAKYLSGLGIARQRQAIVDGLRDSVLGFSGNVPGTSPKDVMDMVLITQYFDTMKEIGASNKSSAVFVPHGPGAVHDIAQQMRDGILQASLSK

SEQ ID NO: 8189 - protein, 286 aa, Vitis vinifera
MGQAFCCIQVDQSNVAIKEQFGKFDEVLEPGCHCLPWCFGSQLAGHLSLRVQQLDVRCETKTKDNVFVTVVASIQYRALAEKASDAFYKLSNTRAQIQAYVFDVIRASVPKLDLDSTFEQKNEIAKAVEEELEKAMSAYGFEIVQTLIVDIEPDEHVKRAMNEINAASRMRLAATEKAEAEKILQIKRAEGDAESKYLAGLGIARQRQAIVDGLRDSVLAFSVNVPGTSSKDVMDMILVTQYFDTLKDIGASSKASSVFIPHGPGAVGDIASQIRVGLLQAETAKH

SEQ ID NO: 8190 - protein, 266 aa, Pseudoroegneria spicata
GNFDSVLEPGCHCLPWIFGKRVVGHLTLRLQQLDVRCETKTKDNVFVTVVASIQYRPLAGKESDAYYKLTNTRSQIQAYVFDVIRASVPKLNLDDAFVQKNDIAKAVEDELEKAMSAYGFEIVQTLIVDIEPDAHVKQAMNEINAAARMRVAANEKAEAEKIVQIKRAEGEAEAKYLSGLGIARQRQAIVDGLRDSVLGFSVNVPGTTAKDVMDMVLITQYFDTMKEIGASSKSSAVFIPHGPGAVRDIATQIRDGLLQGQSASDN

SEQ ID NO: 8191 - protein, 284 aa, Oryza sativa
MGQALGLVQVDQSTVAIKESFGKFDEVLEPGCHFLPWCIGKQIAGYLSLRVQQLDVRCETKTKDNVFVNVVASVQYRALAEKASDAFYRLSNTREQIQSYVFDVIRASVPKMNLDDAFEQKNEIAKAVEDELEKAMSMYGYEIVQTLIVDIEPDEHVKRAMNEINAAARLRVAANEKAEAEKILQIKRAEGDAESKYLAGLGIARQRQAIVDGLRDSVLAFSENVPGTSAKDVMDMVLVTQYFDTMKEIGASSKSSSVFIPHGPGAVKDIAAQIRDGQLQAKLI

SEQ ID NO: 8192 - protein, 283 aa, Trigonella foenum-graecum
LVCCVQVDQSKVAMKEGFGKFEKVLQPGCHCMPWFLGKRIAGHLSLRVQQLDIKCETKTKDNVFVNVVASIQYRALADKANDAFYKLSNTRKQIQANVLDVIRASVPKLYLDDAFEQKNEIAKAVEEELEKAMSAYGYEIVQTLITDIEPDEHVKRAMNEINAAARMRLAAKEKAEAEKILQIKRAEGEAESKYLSGLGIARQRQAIVDGLRDSVIGFSVSVPGTTAKDVMDMVLVTQYFDTMKEIGAASKSSAVFIPHGPGAVRDVASQIRDGLLQGSVSHE

SEQ ID NO: 8193 - protein, 291 aa, Vinca minor
MGNLFCLTQVDQSQVAIKEKFGKFDDILEPGCHFLPWCLGSQIAGYLSLRVQQLDVRCETKTKDNVFVNVVASIQYRALADKASDAFYRLTNTRAQIQAYVFDVIRASVPKMNLDDAFEQKNEIARAVEDELAKAMSAYGYEIVQTLIVDIEPDEHVKRAMNEINAAARFRVAANEKAEAEKIIQIKRAEGEAESKYLAGLGIARQRQAIVDGLRDSVLGFSVNVPGTTAKDVMDMVLVTQYFDTMKEIGASSKSSAVFLPHGPGAVRDVAQQIRDGLLQATTAHQQANLL

SEQ ID NO: 8194 - protein, 156 aa, Fagus grandifolia
MGQALCCVQVDQSTVAIKETFGKFDDVLEPGFHCLPWVFGQQVAGHLSLRVQQLDVRCETKTKDNVFVTVVASIQYRALSDKAADAFYKLSNTRAQIQSYVFDVIRASVPKLELDSVFETKNEIAKAVEEELEKACQLMDMRSFKHSSWTLNLMSM

SEQ ID NO: 8195 - protein, 289 aa, Elaeis guineensis
MSKVDSACCCLQVDQSTVAIKETFGRFGDVLHPGCHCLPWCLGHQIAGYLSLRVQQLDVRCETKTKDNVFVTVVASIQYRALADKASDAFYKLSNTREQIQSYVFDVIRASVPKLNLDDAFEQKNDIARAVEDELEKAMSMYGYEIVQTLIVDIEPDEHVKRAMNEINAAARLRVAANEKAEAEKILQIKRAEGDAESKYLAGLGIARQRQAIVDGLRDSVLAFSVNVPGTTPKDVMDMVLVTQYFDTMKEIGASSKSSSVFIPHGPGAVRDIAAQIRDGLLQANTTLQ

SEQ ID NO: 8196 - protein, 806 aa, Malus domestica
MIVKLDNGKDAKNWVLTVGCNLPGKWVLHWGVNYVDDVGSEWDQPPSEMRPAGSVSIKDYAIETPLKESLSPVGGDTSHEVKIDVTPNSAIAAINFVLKDEETGAWYQHRGRDFKVPFVGYLQDDDNVVGATRALGAWSGTLGKLSNVFVKAETSNSKDQESSSESRDPQQKTMRLEGFYEELPIAKEIAVNHSATVSVRKCPETTKNLLYLETDLPDHAVVHWGVCRDDAKRWEIPAAPHPPETVVFKDKALRTRLQQREDGNGCSGLFTLEEGLAGFLFVFKLNETMWLNCVGNDFYIPLLSSNNSIAVQNEVQSEDAQVPDRSRETNFTAYTDGIINEIRNLVSDISSEKSQRKRSKEAQETILQEIEKLAAEAYSIFRTTVPTLPEEIIAETEKVKVAPAKICSGTGTGFEILCQGFNWESSKSGRWYEELKSKAAELSSLGFTVIWFPPPTDSVSPQGYMPRDLYNMNSRYGNMDELKETVKTFHDAGLKVLGDAVLNHRCAEYQNQNGVWNIFGGRLNWDERAVVADDPHFQGRGNKSSGDSFHAAPNIDHSQDFVRKDIREWLCWLRDDIGYDGWRLDFVRGFWGGYVKDYMDASEPYFAVGEYWDSLSYTYGEMDHNQDAHRQRIVDWINATNGTCGAFDVTTKGILHAALERCEYWRLSDEKGKPPGVLGWWPSRAVTFIENHDTGSTQGHWRFPNKKEMQGYAYILTHPGTPTVFYDHIFSHYQSEIAALISLRNRNKLNCRSRVKITKAERDVYAAIIDEKVAIKIGPGHYEPASGPQNWNKSLEGRDYKVWEAS

SEQ ID NO: 8197 - protein, 286 aa, Aquilegia formosa
MGNVFCAQVDQSTVAIKETWGKFDEILEPGCHFLPCCLGQSIAGYLSLRVQQLDVRCETKTKDNVFVTVVASIQYRALADKASDAYYKLSNTRAQIQAYVFDVIRASVPKLDLDSTFEQKNDIAKAVEDELEKAMSLYGYEIVQTLIVDIEPDEHVKRAMNEINAAARMRAAANEKAEAEKILQIKRAEGEAESKYLAGVGIARQRQAIVDGLRDSVLAFSSNVPGTSSKDVMDMVLITQYFDTMKEIGASSKSSSVFIPHGPGAVKDIASQIREGLLQGEAGSHH

SEQ ID NO: 8198 - protein, 268 aa, Secale cereale
MGNLCCCVQVDQSTVAIREQFGKFDSVLQPGCHCLPWILGKRVVGHLTLRLQQLDVRCETKTKDNVFVTVVASIQYRPLAGKESDAYYKLTNTRSQIQAYVFDVIRASVPKLNLDDAFVQKNDIAKAVEDELEKAMSAYGFEIVQTLIVDIEPDAHVKQAMNEINAAARMRVAANEKAEAEKIVQIKRAEGEAEAKYLSGLGIARQRQAIVDGLRDSVLGFSVNVPGTTAKDVMDMVLITQYFDTMKEIGASSKSSAVFTPHRPWCGS

SEQ ID NO: 8199 - protein, 141 aa, Fagus grandifolia
MGQALCCVQVDQSTVAIKETFGKFDDVLEPGFHCLPWVFGQQVAGHLSLRVQQLDVRCETKTKDNVFVTVVASIQYRALSDKAADAFYKLSNTRAQIQSYVFDVIRASVPKLELDSVLETKKRNDESCGRGTREGHVSLWI

SEQ ID NO: 8200 - protein, 285 aa, Musa acuminata
MGQAFCCIQVDQSTVAMRETFGKFDHVLEPGCHFLPWCLGKQIAGYLSLRVQQLDVRCETKTKDNVFVTVVASIQYNAIADQASDAFYRLSNTKEQIQSYVFDVIRASVPKLNLDDVFEQKNDIARAVEDELGKAMSSYGYKIVQTLIVDIEPDNHVKKAMNEINAASRMRVAANEKAEAEKILQIKRAEGEAESKYLSGLGIARQRQAIVDGLRDSVLAFSVNVPGTTAKDVMDMVLVTQYFDTMKEIGASSKSSSVFIPHGPGAVRDIASQVRDGLLQGSAIH

SEQ ID NO: 8201 - protein, 272 aa, Brassica juncea
AIKETFGKFEDVLEPGCHFLPWCLGQQVAGYLSLRLQQLDVRCETKTKDNVFVNVVASIQYRALANNANDAFYKLSNTRSQIQAYVFDVIRASVPKLILDDVFEQKNEIAKAVEEELEKAMSAYGFEIVQTLIVDIEPDEHVKRAMNEINAAARMRLAANEKAEAEKILQIKRAEGEAEAKYLSGLGIARQRQAIVDGLRDSVLGFSVNVPGTTAKDVMDMVLVTQYFDTMKEIGASSKSSAVFIPHGPGAVRDVATQIRDGLLQGSFADQS

SEQ ID NO: 8202 - protein, 286 aa, Unknown
  Sequence found in Organisms: Citrus clementina, Citrus sinensis
MGQTLGCIQVEQSKVVIREQFGKFDHVLEPGCQCLPWCLGYKVAGRLSLRVQQLDVKCETKTKDNVFVNVVASVQYRALADKAYDAFYKLSNTRGQIQAYVFDVIRASVPKLNLDAAFEQKNEIAKAVEEELEKAMSHYGYEIVQTLIVDIEPDVHVKRAMNEINAAARLRLAANEKAEAEKILQIKRAEGEAEAKYLSGLGIARQRQAIVDGLRDSVLAFSENVPGTTSKDVMDMVLVTQYFDTMKEIGASSKSSSVFIPHGPGAVKDIATQIREGLLQANQVQK

SEQ ID NO: 8203 - protein, 285 aa, Fagopyrum esculentum
MGQAFGCMQVDQSTIAIKETFGKFDEVLEPGCHWVPWCLGSQIAGLLSLRVQQLDVRCETKTKDNVFVTVVASVQYRAMGDKASDAFYKLSNTREQIQAYVFDVIRASVPKLILDDTFEQKNDIAKAVEDELEKAMSAYGYEIVQTLIVDIEPDVHVKRAMNEINAAARMRVAANEKAEAEKILQIKKAEGEAESKYLSGLGIARQRQAIVDGLRDSVLNFSTNVPGTTAKDVMDMVLVTQYFDTMREIGASSKSSSVFIPHGPGAVRDVASQIREGLLQGNAGQ

SEQ ID NO: 8204 - protein, 1284 aa, Musa acuminata
MESISSAASSSRRPASFFTQANALLRKNLTFQKRNLKTNIGIVAFPIFICVLIVLIQQVINNELNKDKFQCGCQGGDCGLQYSTLDQVDTCPISSPPEWSALIQVPRPQYRAVRTDFSQSADLPDESCRASQSCPAAVLLTGGNRSLAQSISSSALNFSDYPSSLSNVILGTDTPTENTQFIEPAFVSDRPFYVVQPQCTTNATSPISFKNANISIELGLECVQGLTLWRDNSSLINDELFKGYRQGNSERKANEFIAAYDFLNSDENGFNLNIWYNSTYNNDTGFVEVALVRVPRTVNAASNAYLKFRKGAGAMVMFDFVKEMPKTGTDRRFDFSSLLGPLFFTWIIELLFPVILTYVVYERQQKLRIMMKMHGLKDGPYWFISYIYFFSLSSVYMICFVIFGSIIGLKFFRLNDYSIQVVFYFIYINLQIALAFLIAPFFSAVKTATVFGYNYVFGSGLLGEFLLRFFIEDTSFPRGWILVMELVPGFSLYRGLFEFSQYSFSGDSMGTSGMKWGDLDDSQNGMKAVLIIMFVEWLVLLVVAFYLDQLIGGGIRKDPFFFLRYFQKKSSVSQRKPSFQRQGSKVFVEMERPDVSQEREVVEQLLLESSFSHAVISDNLKKVYPGRDGNPDKLAVRGLSLALPNGECFGMLGPNGAGKTTFINMMIGLITPTSGTAYVQGVDIRTNMDEIYTSMGVCPQHDLLWETLTGREHLLFYGRLKNLKGAALLQAVDESLKSVNLFYGGVGDKQAGKYSGGMKRRLSVAISLIGDPKVVYMDEPSTGLDPASRNNLWNVVKNAKRDRAIILTTHSMEEAEVLCDRLGIFVDGGFQCIGNPKELKARYGGSYVFTMTTSVNEEEEVESLVRQLSPSANKIYHISGTQKFELPKQEVRIADVFRAVEIAKSKFTIHAWGLADTTLEDVFIKVAKGAQSLNSSEHPRSPSFPLWFSAPIIPPSSVVGRRDPSSLPIRFTRRASGVLFSDTTFRGKEKEMGQALGCVQVDQSTVAVRETFGKFDEILEPGCHFLPWCIGRQIAGYLSLRVQQLDVRCETKTKDNVFVTVVASVQYRALAGKASDAFYRLSNTREQIQSYVFDVIRASVPKLNLDDAFEQKNDIAKAVEDELEKAAMSMYGYEIVQTLIVDIEPDEHVKRAMNEINAGKWFIVWTARLRVAANEKAEAEKILQIKRAEGDAESKYLAGLGIARQRQAIVDGLRDSVLAFSVNVPGTTAKDVMDMVLVTQYFDTMKEIGASSKSSSVFIPHGPGAVRDIATQIRDGLLQANTLQ

SEQ ID NO: 8205 - protein, 286 aa, Vaccinium corymbosum
MGQAFGCIQVDQSTVAIRETFGKFDAVLDPGCHLMPWCIGKQTAGILSLRVQQLDVRCETKTKDNVFVTVVASVQYQALAEKASDAFYKLSNTKEQIQAYVFDVIRASVPKLELDSVFEQKNEIAKAVENELEKAMSHYGFEIVQTLIVDIEPDELVKRSMNEINAASRLRLAATEKAEAEKILQIKRAEGEAESKYLSGLGIARQRNAIVDGLRDSVLAFSTNVPGTTSKDVMDMVLVTQYFDTMKEIGASSKSSSVFIPHGPGAVRDIASQIRDGLLQGQTTAC

SEQ ID NO: 8206 - protein, 286 aa, Allium cepa
MGQALCCVQVDQSTVAVKETFGKYDDILQPGCHFLPWIFGQQIAGYLSLRVQQLDVRCETKTKDNVFVTVVASIQYRALAEKASDAFYKLSNTREQIQSYVFDVIRASVPKLILDDVFEQKNDIAKAVENELEKAMSTYGYEIVQTLIVDIEPDEMVKRAMNEINAAARMRVAANEKAEAEKILQIKRAEGDAESKYLAGLGIARQRQAIVDGLRDSVLAFSVNVPGTTSKDVMDMVLVTQYFDTMKDIGASSKSTSVFIPHGPGAVRDIASQIRDGLLQGSSTNN

SEQ ID NO: 8207 - protein, 286 aa, Malus domestica
MGQALGCIQVDQSTVAIRETFGKFDDVLAPGCHCLPWCFGSQVAGRLSLRVQQLDVRCETKTKDNVFVTVVASIQYRALAEKASDAFYKLSNTRGQIQSYVFDVIRASVPKLDLDSTFEQKNDIAKSVEEELEKAMSHYGFEIVQTLIVDIEPDEHVKRSMNEINAAARMRVAASEKAEAEKILQIKRAEGEAESKYLSGLGIARQRQAIVDGLRDSVLAFSENVPGTSSKDVMDMVLVTQYFDTMKEIGASSKSNSVFIPHGPGAVRDIASQIRDGLLQGSSIQE

SEQ ID NO: 8208 - protein, 284 aa, Persea americana
MGQALGCVQVDQSTVAIKENFGKFNDVLEPGCHCVPWCFGSQVAGHLSLRIQQLDVRCETKTKDNVFVTVVASIQFRALAEKAEDAFYRLSNTRSQIQAYVFDVIRSSVPKLNLDDAFEQKNDIAKAVEDELEKAMSHYGFEIVQTLIVDIEPDQRVKGAMNEINAAARLRVAANEKAEAEKILQIKKAEGDAESKYLAGLGVARQRQAIVDGLRESVLAFSTNVHGTTAKDVMDMVLVTQYFDTMKEIGASSKSSSVFIPHGPGAVRDIVSQIRDGLLQGSQH

SEQ ID NO: 8209 - protein, 285 aa, Fagopyrum esculentum
MGQAFGCIQVDQSTIAIKETFGKFDEVLDPGCHWVPWCLGSQIAGLLSLRVQQLDVRCETKTKDNVFVTVVASVQYRAMGNKASDAFYKLSNTREQIQAYVFDVIRASVPKLILDDTFEQKNDIAKAVEDELEKAMSAYGYEIVQTLIVDIEPDVHVKRAMNEINAAARMRVAANEKAEAEKILQIKKAEGEAESKYLSGLGIARQRQAIVDGLRDSVLNFSTNVPGTTAKDVMDMVLVTQYFDTMREIGASSKSSSVFIPHGPGAVRDVASQIREGLLQGNAGQ

SEQ ID NO: 8210 - protein, 267 aa, Lactuca sativa
  misc_feature (202)..(202): Xaa can be any naturally occurring amino acid
  misc_feature (220)..(220): Xaa can be any naturally occurring amino acid
MGNLFCLVQVDQSTVAIKETFGKFDDVLEPGLHCVPWIFGSQVAGQLTLRLQQLDVKCETKTKDNVFVNVVASIQYRALADKASDAFYKLSNTRSQIQAYVFDVIRASVPKLNLDDAFEQKNEIAKAVEDELEKAMSAYGFEIVQTLIVDIEPDEHVKRAMNEINAAARFRMAATEKAEAEKILQIKRAEGEAESKYLSGLXIARQRQAIVDGLRDSVLXFSVNVPGTTAKDVMDMVLVTQYFDTMKEIGASSKSSAVFIPHGPGAV

SEQ ID NO: 8211 - protein, 284 aa, Lotus japonicus
MGNLFCCVQVDQSTVAIKERFGRFEEVLQPGCHCLPWILGSQLAGHLSIRVQQLDVKCETKTKDNVFVNVVASVQYRALSEKASDAFYKLSNTKTQIQAYVFDVIRASVPKLLLDDAFEQKNDIAKAVEEELEKAMSAYGYEIVQTLIVDIEPDENVKRAMNEINAAARLRLAATDKAEAEKILQIKRAEGEAESKYLHGVGIARQRQAIVDGLRDSVLGFSGNVPGTTAKDVLDMVLVTQYFDTMKEIGATSKSSAVFIPHGPGAVRDVASQIRDGLLQASHH

SEQ ID NO: 8212 - protein, 286 aa, Carica papaya
MGQVLGCVQVDQSTVAIKETFGKFDDVLEPGCHCLPWCLGSQLAGHLSLRVQQLDVRCETKTKDNVFVTVVASIQYRALADKAADAFYKLSNTRAQIQAYVFDVIRASVPRLDLDSSFAQKNEIAKAVEDELEKAMSHYGFEIVQTLIVDIEPDEHVKRAMNEINAAARMRVAANDKAEAEKILQIKKAEGDAESKYLAGLGIARQRQAIVDGLRDSVLAFSESVPGTTSKDVMDMVLVTQYFDTMKEIGAASKSNSVFIPHGPGAVRDIASQIRDGLLQANTTTR

SEQ ID NO: 8213 - protein, 285 aa, Phalaenopsis aphrodite
MGQLLCCLQVEQSTVAIKESFGKFDDVLEPGIHLVPWILGKKVAGYLSLRVQQLDVRCETKTKDNVFVTVVASVQYRALANKAADAFYKLSNTREQIQSYVFDVIRASVPKLNIDAVFEQKNDIAKAVEDELEKAMSTYGYEIVQTLIVDIEPDEHVKRAMNEINAAARLRLAANEKAEAEKILQIKRAEGEAESKYLAGLGIARQRQAIVDGLRDSVLAFSANVPGTSAKDVMDMVLITQYFDTMKEIGAASKSSAVFIPHGPGAVRDVAAQVRDGLLQGGAFH

SEQ ID NO: 8214 - protein, 287 aa, Lippia dulcis
MGQALGCVQVDQSTVAVKEQFGKFEEVLEPGCHCLPWCFGYQLAGTLSLRLQQLDVRCETKTKDNVFVNVVASIQYRALADKASDAYYKLSNTKEQIQAYVFDVIRASVPKLDLDATFEQKDDIARAVENELEKAMSAYGFEIVQTLIVDIEPDAQVKRAMNEINAAARLRLAATEKAEAEKILQIKRAEGEAESKYLSGLGIARQRQAIVDGLRESVLAFSENVPGTTSKDVMDMVLVTQYFDTMKEIGASSKSSAVFIPHGPGAVKDIATQIRNGLLQGESAMSS

SEQ ID NO: 8215 - protein, 286 aa, Rosa hybrid cultivar
MGQCLGCIQVDQSTVAIRETFGKFDDVLEPGCHCLPWCLGSAVAGHLSLRVQQLDVRCETKTKDNVFVTVVASIQYRALADKASDAFYKLSNTRGQIQSYVFDVIRASVPKLDLDSTFEQKNDIAKAVEEELEKAMSHYGFEIVQTLIVDIEPDEHVKRAMNEINAAARMRLAASERAEGDKILQIKRAEGEAESKYLSGLGIARQRQAIVDGLRDSVLAFSENVPGTSSKDVMDMVLVTQYFDTMKEIGASSKSNSVFIPHGPGAVKDIASQIRDGLLQGNSTHQ

SEQ ID NO: 8216 - protein, 284 aa, Sorghum bicolor
MGQALGLVQVDQSTVAIKESFGKFDEILEPGCHFLPWCIGKQIAGYLSLRVQQLDVRCETKTKDNVFVNVVASVQYRALADKASDAFYRLSNTREQIQSYVFDVIRASVPKMNLDDAFEQKNEIAKAVEDELEKAMSMYGYEIVQTLIVDIEPDEHVKRAMNEINAAARLRLAATEKAEAEKILQIKRAEGDAESKYLAGLGIARQRQAIVDGLRDSVLAFSENVPGTSAKDVMDMVLVTQYFDTMKEIGASSKSSSVFIPHGPGAVRDIAAQIRDGQLQASLL

SEQ ID NO: 8217 - protein, 104 aa, Flaveria ramosissima
MGNLLCLVQVDQSTVAIKETFGKFDDVLEPGCHCVPWIFGSRLAGHLTLRVQQLDVKCETKTKDNVFVNVVASVQYRALSEKASDAFYKLSNTRAQIQAYVLML

SEQ ID NO: 8218 - protein, 286 aa, Antirrhinum majus
  misc_feature (264)..(264): Xaa can be any naturally occurring amino acid
MGQTLGCIQVDQSNVAVKEHFGKFDEVLQPGCHCLPWCLGYQVAGSLTLRVQQIDVRCETKTKDNVFVTVVASIQYRALAEKASDAFYKLSNTKEQIQAYVFDVIRASVPKLDLDSTFEQKNDIAKAVEDELEKAMSAYGYEIVQTLIVDIEPDAQVKRAMNEINAAARLRVAATEKAEAEKILQIKRAEGEAESKYLSGIGIARQRQAIVDGLRDSVLAFSENVPGTSAKDVMDMVLITQYFDTMKEIGASSKSSAVFVPHGXGAVKDIATQIRDGLLQAESVGH

SEQ ID NO: 8219 - protein, 286 aa, Fagus grandifolia
MGQALGCLQVDQSNVVIREQFGKFSDVLEPGCHCLPWCLGYQVAGGLSLRVQQLDVRCETKTKDNVFVNVVASIQYRAMAEKASDAFYKLTNTREQIQSYVFDVIRASVPKLNLDAVFEQKNDIAKAVEEELEKAMSTYGYEIVQTLIVDIEPDVHVKRAMNEINAAARMRLAANEKAEAEKILQIKKAEGEAESKYLSGLGIARQRQAIVDGLRDSVLAFSENVPGTTAKDVMDMVLVTQYFDTMKEIGASSKSSSVFIPHGPGAVRDVASQIRDGLLQSHSVES

SEQ ID NO: 8220 - protein, 287 aa, Chelidonium majus
MGQALCCLQVDQSTVAIKETFGKFDDILEPGCHFLPWCFGSQVAGYLTLRVQQLDVRCETKTKDNVFVTVVASIQYRALADKASDAFYKLSNTREQIQAYVFDVIRASVPKLDLDSTFEQKNDIAKTVEQELEKAMSHYGYEIVQTLIVDIEPDVHVKRAMNEINAAARMRMAATEKAEAEKILQIKRAEGEAESKYLSGLGIARQRQAIVDGLRDSVLAFSVNVPGTSAKDVMDMILVTQYFDTMKEIGASSKSSTVFIPHGPGAVKDIASQIREGLLQGNAADLQ

SEQ ID NO: 8221 - protein, 285 aa, Curcuma longa
MGQLPCCVQVDQATVAISEQFGKFDAVLQPGCNCVPWVFGKRIAGHLSLRLQQLDVKCETKTKDNVFVNVIASVQYRAMANKASDAFYKLTNTRTQIQAYVFDVIRATVPKLNLDNVFEQKSEIAKAVEDELEKAMSTYGFEIVQTLIIDIEPDEHVKRAMNEINAAARLRVAANEKAEAEKIIQIKRAEGEAVAKYLSGLGIARQRQAIVDGLRDSILGSSGNVPGTSPKDAMDMVLITQYFDTMKEIGASNKSSAVFVPHGPGAVRDIALQIRDDMLQASLSK

SEQ ID NO: 8222 - protein, 285 aa, Eschscholzia californica
MGQALCCFQVDQSNVAIKETFGKFDEVLEPGCHFLPWCLGSQVAGYLSLRVQQLDVRCETKTKDNVFVTVVASIQYRALADKASDAFYKLSNTREQIQAYVFDVIRASVPKLDLDSTFEQKNDIAKTVEVELEKAMSHYGYEIVQTLIVDIEPDVHVKRAMNEINAAARMRVAANEKAEAEKIIQIKRAEGDAESKYLAGLGIARQRQAIVDGLRDSVLAFSVNVPGTTAKDVMDMVLVTQYFDTMKDIGASSKSSAVFIPHGPGAVKDIASQIREGLLQGNAAN

SEQ ID NO: 8223 - protein, 285 aa, Eucalyptus grandis
MGQALGCIQVDQSTVAIKETFGKFDDVLDPGCHCLPWCLGSQVAGHLSLRVQQLDVRCETKTKDNVFVTVVASIQYRALAQKASDAFYRLSNTRAQIQAYVFDVIRASVPKLELDSTFEQKNEIAKAVEEELEKAMSAYGYEIVQTLIVDIEPDEHVKRAMNEINAAARLRVAATEKAEAEKILQIKRAEGDAESKYLAGLGIARQRQAIVDGLRDSVLAFSENVPGTSSKDVMDMVLVTQYFDTMKEIGASSKSSSVFIPHGPGAVRDVAVQIREGLLQAHAAQ

SEQ ID NO: 8224 - protein, 284 aa, Lotus japonicus
MGNLLCCVQIEQSTVAIKEKFGRFEEVLEPGFHCVPMFLGDRLAGHLSLRLQQLDIQCETKTKDNVFVNVVASIQYRALADKASDAFYKLSNTRTQIQAYVFDVIRAYVPKLNLDDAFEQKNKIAKAVEEELEKAMSGYGYEIVQTLIIDIEPDVHVKRAMNEINAAARLRLAATEKAEAEKILQIKRAEGEAEAKYLSGLGIARQRQAIVNGLRDSVLGFAVNVPGTSAKDVMDMVLVTQYFDTMKEIGAASKSSAVFIPHGPGAVRDVASQIRNGLLQASHQ

SEQ ID NO: 8225 - protein, 284 aa, Zea mays
MGQALGLIQVDQSTVAIKETFGKFDEVLEPGCHFLPWCIGKQIAGYLSLRVQQLDVRCETKTKDNVFVNVVASVQYRALADKASDAFYRLSNTREQIQSYVFDVIRASVPKMNLDDAFEQKNEIAKAVENELEKAMSMYGYEIVQTLIVDIEPDEHVKRAMNEINAAARLRLAASEKAEAEKILQIKRAEGDAESKYLAGLGIARQRQAIVDGLRDSVLAFSENVPGTSAKDVMDMVLVTQYFDTMKEIGASSKSSSVFIPHGPGAVRDIAAQIRDGQLQASLL

SEQ ID NO: 8226 - protein, 286 aa, Glycine max
MGQALGCYQVDQSNVAIKEHFGKFDDVLEPGCHCLPWCLGYQIAGSLSLRVQQLDVRCETKTKDNVFVTVVASVQYRAVSEKASDAFYRLTNTREQIQSYVFDVIRASVPKLELDSVFEQKNDIAKAVEEELEKAMSTYGFEIVQTLIVDIEPDVNVKRAMNEINAAARLRLAANEKAEAEKILQIKKAEGEAESKYLSGLGIARQRQAIVDGLRDSVLAFSENVPGTTAKDVMDMVLVTQYFDTMKEIGASSKSSSVFIPHGPGAVKDIAMQIRDGLLQATTSQN

SEQ ID NO: 8227 - protein, 284 aa, Saccharum officinarum
MGQALGLIQVDQSTVAIKESFGKFDEILEPGCHFLPWCIGKQIAGYLSLRVQQLDVRCETKTKDNVFVNVVASVQYRALADKASDAFYRLSNTREQIQSYVFDVIRASVPKMNLDDAFEQKNEIAKAVEDELEKAMSMYGYEIVQTLIVDIEPDEHVKRAMNEINAAARLRLAATEKAEAEKILQIKRAEGDAESKYLAGLGIARQRQAIVDGLRDSVLAFSENVPGTSAKDVMDMVLVTQYFDTMKEIGASSKSSSVFIPHGPGAVRDIAAQIRDGQLQASLL

SEQ ID NO: 8228 - protein, 286 aa, Triphysaria pusilla
MGNTLGCVQVDQSTVAVKEHFGKFVDVLEPGCHCLPWCVGYQLAGTLTLRVQQLDVRCETKTKDNVFVTVVASIQYRAMAENAADAFYKLSNTKEQIQSYVFDVIRASVPKLDLDSTFEQKNDIAKAVESELEKAMSAYGYEIVQTLIVDIEPDAQVKRAMNEINAAARLRLAATEKAEAEKILQIKRAEGEAEAKYLSGMGIARQRQAIVDGLRDSVLAFSDNVPGTSAKDVMDMVLVTQYFDTMKEIGASSKSSAVFIPHGPGAVKDVASQIREGLLQGQSVSH

SEQ ID NO: 8229 - protein, 287 aa, Vigna unguiculata
MGQAFGCYQVDQSNVAIKEHFGKFSDVLEPGCHCLPWCLGYQIAGGLSLRVQQLDVRCETKTKDNVFVTVVASVQYRAVAEKASDAFYRLTNTREQIQSYVFDVIRASVPKLELDSVFEQKNDIAKAVEEELEKAMSTYGFEIVQTLIVDIEPDVNVKRAMNEINAAARLRLAANEKAEAEKILQIKKAEGEAESKYLSGLGIARQRQAIVDGLRDSVLAFSSNVPGTTAKDVMDMVLVTQYFDTMKEIGASSKSSSVFIPHGPGAVKDIAVQIRDGLLQASASQTN

SEQ ID NO: 8230 - protein, 286 aa, Vaccinium corymbosum
MGQALGCVQVDQSTVAIKEHFGRFAEVLEPGCHCLPWCLGYQVAGELSLRVQQLDVRCETKTKDNVFVNVVASIQYRAVADNASDAFYKLSNTKGQIQAYVFDVIRASVPKMELDSAFEQKNDIAKAVEEELEKAMSAYGYEIVQTLIVDIEPDINVKRAMNEINAAARMRVAANEKAEAEKILQIKRAEGEAESKYLSGLGIARQRQAIVDGLRDSVLAFSENVPGTTSKDIMDMVLVTQYFDTMKEIGASSKSSAVFIPHGPGAVRDVASQIREGLLQAGSVQH

SEQ ID NO: 8231 - protein, 284 aa, Panicum virgatum
MGQALGLIQVDQSTVAIKESFGKFDEILGPGCHFLPWCIGKQIAGYLSLRVQQLDVRCETKTKDNVFVNVVASVQYRALADKASDAFYRLTNTREQIQSYVFDVIRASVPKMNLDDAFEQKNEIAKAVEDELEKAMSMYGYEIVQTLIVDIEPDEHVKRAMNEINAAARLRVAANEKAEAEKILQIKRAEGDAESKYLAGLGIARQRQAIVDGLRDSVLAFSENVPGTSAKDVMDMVLVTQYFDTMKEIGASSKSSSVFIPHGPGAVKDIAAQIRDGQLQASML

SEQ ID NO: 8232 - protein, 287 aa, Vigna unguiculata
MGQAFGCYQVDQSNVAIKEHFGKFSDVLEPGCHCLPWCLGYQIAGGLSLRVQQLDVRCETKTKDNVFVTVVASVQYRAVAEKASDAFYRLTNTREQIQSYVFDVIRASVPKLELDSVFEQKNDMAKAVEEELEKAMSTYGFEIVQTLIVDIEPDVNVKRAMNEINAAARLRLAANEKAEAEKILQIKKAEGEAESKYLSGLGIARQRQAIVDGLRDSVLAFSSNVPGTTAKDVMDMVLVTQYFDTMKEIGASSKSSSVFIPHGPGAVKDIAVQIRDGLLQASASQTN

SEQ ID NO: 8233 - protein, 286 aa, Fagopyrum esculentum
MGQAIGLLQVDQSTVAIKENFGKFDDVLDPGCHWVPWWFGSQIAGILSLRVQQLDVRCETKTKDNVFVTVVASIQYRAMAEKAADSFYKLSNTREQIQAYVFDVIRASVPKLNLDDTFEQKNDIAKAVENELEKAMSNYGYEIVQTLIVDIEPDVHVKRAMNEINAAARMRVAANEKAEAEKILQIKKAEGEAEAKYLAGLGIARQRQAIVDGLRESVINFSSNVPGTTAKDVMDMVLVTQYFDTMREIGASSKSSSVFIPHGPGAVKDIAVQIRDGLLQGNAAQQ

SEQ ID NO: 8234 - protein, 288 aa, Arachis hypogaea
MGQALGCYQVDQSNVAIKEHFGKFDEILEPGCHCLPWCLGYQIAGALSLRVQQLDVRCETKTKDNVFVTVVASVQYRAVADKASDAFYRLSNTRGQIQSYVFDVIRASVPKLELDAVFEQKNDIAKSVEEELDKAMSTYGYQIVQTLIVDIEPDTNVKRAMNEINAAARLRVAANEKAEAEKILQIKKAEGEAESKYLSGLGIARQRQAIVDGLRDSVLAFSENVPGTTAKDVMDMVLVTQYFDTMKEIGASSKSSSVFIPHGPGAVRDIATQIRDGLLQGNASQNLI

SEQ ID NO: 8235 - protein, 263 aa, Plantago ovata
KFDEVLEPGCHCLPWFLGKQLAGHLSLRLQQLDVKCETKTKDNVFVNVVASIQYRALSDKASDAFYKLSNTRSQIQAYVFDVIRASVPKLLLDDAFEQKNEIAKAVEDELEKAMSAYGYEIVQTLIVDIEPDEHVKRAMNEINAAARMRLAANEKAEAEKILQIKRAEGEAEAKYLSGLGIARQRQAIVDGLRDSVLGFSVNVPGTTAKDVMDMVLVTQYFDTMKEIGASSKSSAVFIPHGPGAVRDVAAQIRDGLLQGGSVN

SEQ ID NO: 8236 - protein, 67 aa, Fagopyrum esculentum
MGNLFCCIRVEQSNVAIKERFGKFNDVLQPGCHCVPWFIGTRLRGNSLFVCSNWMSNARPKLRIMSL

SEQ ID NO: 8237 - protein, 103 aa, Fagopyrum esculentum
MGNLFCCIRVEQSNVAIKERFGKFNDVLQPGCHCVPWFIGDEVAGKLTLRVQQLDVKCETKTKDNVFVNVVASIQYRAMSAKASDAFYKLTNTRTQIQAYVLT

SEQ ID NO: 8238 - protein, 287 aa, Phaseolus coccineus
MGQAFGCYQVDQSNVAIKEHFGKFSDVLEPGCHCLPWCLGYQIAGGLSLRVQQLDVRCETKTKDNVFVTVVASVQYRAVADKASDAFYRLTNTREQIQSYVFDVIRASVPKLELDSVFEQKNDIAKSVEEELEKAMSTYGYEIVQTLIVDIEPDVNVKRAMNEINAAARLRLAANEKAEAEKILQIKKAEGEAESKYLSGLGIARQRQAIVDGLRDSVLAFSENVPGTSAKDVMDMVLVTQYFDTMKEIGASSKSSSVFIPHGPGAVRDIAVQIRDGLLQASASHTN

SEQ ID NO: 8239 - protein, 286 aa, Nicotiana benthamiana
MGQALCCIQVDQSTVAVKEHFGKFDEVLEPGCHCLPWCLGYQVPGYLSLRLQQLDVRCETKTKDNVFVTVVASIQYRALAENAADAFYKLSNTKGQIQSYVFDVIRASVPRLGLDAAFEQKNEIAKAVEEELEKAMSAYGYEIVQTLIVDIEPDPHVKRAMNEINAAARLRVAANEKAEAEKILQIKRAEGEAESKYLSGLGIARQRQAIVDGLRDSVIAFSENVPGTTAKDVMDMVLVTQYFDTMKEIGATSKSSAVFIPHGPGAVKDIASQIREGLLQAESIQR

SEQ ID NO: 8240 - protein, 284 aa, Panicum virgatum
MGQALGLIQVDQSTVAIKESFGKFDEILGPGCHFLPWCIGKQIAGYLSLRVQQLDVRCETKTKDNVFVNVVASVQYRALADKASDAFYRLTNTREQIQSYVFDVIRASVPKMNLDDAFEQKNDIAKAVEDELEKAMSMYGYEIVQTLIVDIEPDEHVKRAMNEINAAARLRLAANEKAEAEKILQIKRAEGDAESKYLAGMGIARQRQAIVDGLRDSVLAFSENVPGTSAKDVMDMVLVTQYFDTMKEIGASSKSSSVFIPHGPGAVKDIAAQIRDGQLQARML

SEQ ID NO: 8241 - protein, 286 aa, Castanea mollissima
MGQAFGCLQVDQSNVIIREHFGKFDDVLEPGCHCLPWCLGYQVAGGLSLRVQQLDVRCETKTKDNVFVTVVASVQYRAVADKASDAFYRLTNTREQIQSYVFDVIRASVPKLNLDAVFEQKNDIAKAVEDELEKAMSTYGYEIVQTLIVDIEPDPHVKRAMNEINAAARMRVAANDKAEADKILQIKKAEGEAESKYLSGLGIARQRQAIVDGLRDSVLAFSENVPGTTAKDVMDMVLVTQYFDTMKEIGASSKSSSVFIPHGPGAVRDVASQIREGLLQAQSLKS

SEQ ID NO: 8242 - protein, 285 aa, Unknown
  Sequence found in Organisms: Gossypium hirsutum, Gossypium raimondii
MGQALGCIQVEQSTVAITEAFGKFDDVLQPGCHCLPWCFGKQAAGTLSLRVQQLDVRCETKTKDNVFVNVVASIQYRALAEKAQDAFYKLSNTRAQIQSYVFDVIRASVPKLELDAVFEQKNDIARAVEEELEKAMSHYGYEIVQTLIVDIEPDEHVKRAMNEINAAARMRVAANEKAEAEKILQIKRAEGDAESKYLAGLGVARQRQAIVDGLRDSVLAFSENVPGTSSKDVMDMVLVTQYFDTMKEIGASSKSNSVFIPHGPGAVRDIASQIRDGLLQASQNN

SEQ ID NO: 8243 - protein, 285 aa, Eucalyptus grandis
MGNLFCCVQVDQSTVAIKERFGKFDEVLQPGCHFLPWISGSRLVGHLSLRVQQLDVRCETKTKDNVFVNVVASVQYCALANQASDAFYKLSNTKGQIQAYVFDVIRASVPRLLLDDVFEQKNEIAKAVDVELEKAMSTYGYEIVQTLIIDIEPDVYVKRAMNEINAAARLRVAANEKAEAEKILQIKRAEGEAESKYLAGLGIARQRQAIVDGLRDSVLGFSENVPGTNAKDVMDMVLVTQYFDTMKEIGAASKSSAVFIPHGPGAVRDVASQIREGLLQASSVS

SEQ ID NO: 8244 - protein, 284 aa, Setaria italica
MGQALGLIQVDQSTVAIKESFGKFDEILGPGCHFLPWCIGKQIAGYLSLRVQQLDVRCETKTKDNVFVNVVASVQYRALADKASDAFYRLTNTREQIQSYVFDVIRASVPKMNLDDTFEQKNEIAKAVEDELEKAMSMYGYEIVQTLIVDIEPDEHVKRAMNEINAAARLRVAANEKAEAEKILQIKRAEGDAESKYLAGLGIARQRQAIVDGLRDSVLAFSENVPGTSAKDVMDMVLVTQYFDTMKEIGASSKSSSVFIPHGPGAVKDIAAQIRDGSLQAKLV

SEQ ID NO: 8245 - protein, 286 aa, Ipomoea nil
MGQSLGCLQVDQSTVAVMEHFGKFDDVLEPGCHCVPWCLGYQSAGTLSLRVQQIDVRCETKTKDNVFVTVVASIQYRALAEKASDAFYKLSNTKSQIQSYVFDVIRASVPRLNLDAAFEQKNEIAKAVEDELEKAMSTYGFEIVQTLIVDIEPDIHVKRAMNEINAAARLRVAANEKAEAEKILQIKKAEGEAESKYLSGLGIARQRQAIVDGLRDSVLAFSENVPGTTAKDIMDMVLVTQYFDTMKEIGSSSKSSSVFIPHGPGAVKDISSQIREGLLQASSIKP

SEQ ID NO: 8246 - protein, 286 aa, Unknown
  Sequence found in Organisms: Medicago truncatula, Trigonella foenum-graecum
MGQALGCVQVDQSNVAIKEHFGKFADVLEPGCHCLPWCLGYQIAGGLSLRVQQLDVKCETKTKDNVFVNVVASVQYRAVADKASDAFYRLTNTREQIQSYVFDVIRASVPKLELDAVFEQKNDIAKAVEEELEKAMSMYGYQIVQTLIVDIEPDVNVKRAMNEINAAARMRLAANEKAEAEKILQIKKAEGEAESKYLSGLGIARQRQAIVDGLRDSVLAFSENVPGTTAKDVMDMVLVTQYFDTMKEIGASSKSSSVFIPHGPGAVRDIAVQIRDGLLQGNAANL

SEQ ID NO: 8247 - protein, 284 aa, Pennisetum glaucum
MGQALGLIQVDQSTVAIKESFGKFDEILGPGCHFLPWCIGKQIAGYLSLRVQQLDVRCETKTKDNVFVNVVASVQYRALADKASDAFYRLTNTREQIQSYVFDVIRASVPKMNLDDAFEQKNEIAKAVEDELEKAMSMYGYEIVQTLIVDIEPDEHVKRAMNEINAAARLRVAANEKAEAEKILQIKRAEGDAESKYLAGLGIARQRQAIVDGLRDSVLAFSENVPGTSAKDVMDMVLVTQYFDTMKEIGASSKSSSVFIPHGPGVVKDIAAQIRDGSLQAKFV

SEQ ID NO: 8248 - protein, 285 aa, Cajanus cajan
MGQAFGCYQVDQSNVAIKEHFGKFSDVLEPGCHCLPWCFGYQIAGRLSLRVQQLDVRCETKTKDNVFVTVVASVQYRAVSEKASDAFYRLTNTREQIQSYVFDVIRASVPKLELDSVFEQKNDIAKAVEEELEKAMSTYGYEIVQTLIVDIEPDVNVKRAMNEINAAARLRLAANEKAEAEKILQIKKAEGEAESKYLSGLGIARQRQAIVDGLRDSVLAFSENVPGTTAKDVMDMVLVTQYFDTMKEIGASSKSSSVFIPHGPGAVKDIAVQIRDGLLQASATN

SEQ ID NO: 8249 - protein, 287 aa, Oryza sativa
MGQCLGLVQIDQSTVAIKENFGKFSEVLEPGCHFLPWCIGQQIAGYLSLRVKQLDVRCETKTKDNVFVTVVASVQYRALADKASDAFYKLSNTREQIQSYVFDVIRATVPKLNLDDAFEQKNDIAKAVEDELEKAMSAYGYEIVQTLIIDIEPDVHVKRAMNEINAAARLRVAANEKAEAEKILQIKKAEGEAESKYLAGVGIARQRQAIVDGLRDSVLAFSENVPGTTAKDIMDMVLVTQYFDTMKEIGASSKSTSVFIPHGPGAVKDVAAQIRDGLLQANAERND

SEQ ID NO: 8250 - protein, 286 aa, Glycine max
MGQAFGCYQVDQSNVAIKEHFGKFDDVLEPGCHCLPWCLGYQIAGSLSLRVQQLDVRCETKTKDNVFVNVVASVQYRAVSEKASDAFYRLTNTREQIQSYVFDVIRASVPKLELDSVFEQKNDIAKAVEEELEKAMSTYGFEIVQTLIVDIEPDVNVKRAMNEINAAARLRLAANEKAEAEKILQIKKAEGEAESKYLSGLGIARQRQAIVDGLRDSVLAFSENVPGTSAKDVMDMVLVTQYFDTMKEIGASSRSSSVFIPHGPGAVKDIAVQIRDGLLQATASQN

SEQ ID NO: 8251 - protein, 286 aa, Nicotiana tabacum
MGQALGCIQVDQSTVAVKEHFGKFDEVLEPGCHCLPWCLGYQVPGYLSLRVQQLDVRCETKTKDNVFVTVVASIQYRALAENAADAFYKLSNTKGQIQSYVFDVIRASVPRLGLDAAFEQKNEIAKAVEEELEKAMSAYGYEIVQTLIVDIEPDPHVKRAMNEINAAARLRVAANEKAEAEKILQIKRAEGEAESKYLSGLGIARQRQAIVDGLRDSVLAFSENVPGTTAKDVMDMVLVTQYFDTMKEIGATSKSSAVFIPHGPGAVKDVASQIREGLLQAESIQH

SEQ ID NO: 8252 - protein, 288 aa, Juglans hindsii x Juglans regia
  misc_feature (70)..(70): Xaa can be any naturally occurring amino acid
MGQAFGCIQVDQSNVVVREHFGKFDDVLEPGCHCLPWCLGYQVAGSLTLRVQQLDVRCETKTKDNVFVNXVASVQYRAIAEKASDAFYRLTNTREQIQSYVFDVIRASVPKLNLDAVFEQKNDIAKAVEEELEKAMSTYGFEIVQTLIVDIEPDVQVKRAMNEINAAARLRLAANEKAEAEKILQIKKAEGEAESKYLSGLGIARQRQAIVDGLRDSVLAFSDNVPGTTPKDVMDMVLVTQYFDTMKEIGASSKSSSVFIPHGPGAVRDVATQIREGLLQASSVEKPI

SEQ ID NO: 8253 - protein, 286 aa, Unknown
  Sequence found in Organisms: Brassica napus, Brassica rapa
MGQVLGCVQVDQSTVAIKETFGKFDDVLEPGCHCLPWCLGSQVAGHLSLRVQQLDVRCETKTKDNVFVTVVASIQYRALAESAQDAFYKLSNTRNQIQAYVFDVIRASVPKLDLDSTFEQKNDIAKTVESELEKAMSHYGYEIVQTLIVDIEPDVHVKRAMNEINAASRMREAASEKAEAEKILQIKRAEGEAESKYLSGLGIARQRQAIVDGLRNSVLAFSESVPGTSSKDVMDMVLVTQYFDTLKEIGASSKSNSVFIPHGPGAVKDIASQIRDGLLQGNAAAE

SEQ ID NO: 8254 - protein, 285 aa, Eucalyptus grandis
MGNLFCCVQVDQSTVAIKERFGKFDDVLQPGCHCLPWILGSQLAGHLSLRVQQLDVRCETKTKDNVFVNVVASVQYRALANQASDAFYKLSNTEGQIQAYVFDVIRASVPRLNLDDVFKQKNEIAKAVEDEVEKAMSTYGYEIVQTLIVDIEPDGHVKRAMNEINAAARLRLAANEKAEAGKILQIKRAEGEAESRYLAGLGIARQRQAIVDGLRDSVLGFSENVPGTSAKDVMDLVLITQYFDTMKEIGAASKSSAVFIPHGPGSIRDVASQIREGLLHASSVS

SEQ ID NO: 8255 - protein, 286 aa, Quercus alba
MGQAFGCLQVDQSNVIIREHFGKFDDVLEPGCHCLPWCLGYQVAGGLSLRVQQLDVRCETKTKDNVFVTVVASVQYRAVADKASDAFYRLTNTREQIQSYVFDVIRASVPKLNLDAVFEQKNDIAKSVEDELEKAMSTYGYEIVQTLIVDIEPDPHVKRAMNEINAAARMRVAANDKAEADKILQIKKAEGEAESKYLSGLGIARQRQAIVDGLRDSVLAFSENVPGTTAKDVMDMVLVTQYFDTMKEIGASSKSSSVFIPHGPGAVRDVASQIREGLLQAQSLKS

SEQ ID NO: 8256 - protein, 286 aa, Quercus alba
MGNLFCCVKINQSTVAVRERFGKYDDILEPGCHCVPWVTGSKLAGLVSLRLQQLDVRCETKTKDNVFVNVVASVQYRVLANKAYDAFYKLSNPRTQIQAYVFDVIRGAVPKLELDDVFEQKNGIAKAVEDELEKAMSAYGYEIVQTLIVDIEPDEHVKRSMNEINAAARMRLATNEKAEAEKIIQIKRAEGEAESKYLSGLGIARQRQAIVDGLRESVIGFSVNVPGTTAKDVLDMVLITQYFDTMKEIGASSKSSAVFIPHGPGTVHDVATQIRDGLLQASHQQS

SEQ ID NO: 8257 - protein, 268 aa, Platanus occidentalis
MGNLCCCIQVDQSTVAIKERFGKFDEILEPGCHCLPWFLGSQLAGHLTLRLQQLDVRCETKTKDNVFVNVVASIQYRALANKASDAFYKLSNTRTQIQAYVFDVIRASVPKLNLDDVFEQKNEIAKAVEDELEKAMSAYGYEIVQTLIVDIEPDEHVKRAMNEINAAARMRVAANEKAEAEKILQIKRAEGEAESKYLSGLGIARQRQAIVDGLRDSVLGFSVNVPGTTAKDVMDMVLVTQYFDTMKEIGAASKSSAVFHPPWTWCCS

SEQ ID NO: 8258 - protein, 286 aa, Papaver somniferum
MGQALCCVQVDQSTVAIKETFGKFDEILQPGCHFLPWCLGSQISGYLSLRVQQLDVRCETKTKDNVFVTVVASIQYRALADSASDAFYKLSNTREQIQAYVFDVIRASVPKLELDATFEQKNDIARAVEEELAKAMSNYGYEIVQTLIVDIEPDVHVKRAMNEINAAARMRLAANEKAEAEKILQIKRAEGEAESKYLSGLGIARQRQAIVDGLRDSVLAFSANVSGTTPKDVMDMVLVTQYFDTMKEIGASSKSSAVFIPHGPGAVRDVASQIRDGLLQGSSSLI

SEQ ID NO: 8259 - protein, 281 aa, Primula obconica
GCIQVDQSTVAIRETFGKFDKVLEPGCHIMPWCIGRQMAGLLSLRVQQLDVRCETKTKDNVFVTVVASIQYRALAEKASDAFYKLSNTKEQIQAYVFDVIRASVPKLELDSTFEQKNDIAKAVENELEKAMSHYGYEIVQTLIVDIEPDVRVKTAMNEINAAARMRVAATEKAEAEKILQIKRAEGDAESKYLAGLGIARQRQAIVDGLRDSVLAFSSNVPGTSSKDVMDMILITQYFDTIKEIGASSKASSVFIPHGPGAVKDIATQIRDGLLQGQAMER

SEQ ID NO: 8260 - protein, 285 aa, Eutrema parvulum
MGQALGCIQVDQSTVAIKETFGKFDDVLEPGCHCLPWCLGSQVAGHLSLRVQQLDVRCETKTKDNVFVTVVASIQYRALAESAQDAFYKLSNTRNQIQAYVFDVIRASVPKLNLDSTFEQKNDIAKTVESELEKAMSHYGYEIVQTLIVDIEPDVHVKRAMNEINAASRMREAASEKAEAEKILQIKRAEGEAESKYLSGLGIARQRQAIVDGLRNSVLAFSESVPGTSSKDVMDMVLVTQYFDTLKEIGASSKSNSVFIPHGPGAVKDIASQIRDGLLQGNAAA

SEQ ID NO: 8261 - protein, 286 aa, Triphysaria pusilla
MGQLLCCVQVDQSTLAVKEQFGKFDKVLEPGCHCLPWCFGYKLAGKLSLRVQQIDVRCETKTKDNVFVTVVASIQYRAVADNAADAFYKLSNTRAQIQAYVFDVIRATVPRLELDSVFEQKNDVAKAVEDELEKAMSAYGFEIVQTLIVDIEPDVHVKRAMNEINAAARMRVAANEKAEAEKILQIKKAEGEAESKYLSGLGIARQRQAIVDGLRDSVLAFSENVPGTTAKDVMDMVLVTQYFDTMKEIGASSKSSAIFVPHGPGAVKDVASQIREGLLQAESVHK

SEQ ID NO: 8262 - protein, 291 aa, Vinca minor
MGNLFCLTQVDQSQVAIKEKFGKFEDILEPGCHFLPWCLGSQIAGYLSLRVQQLDVRCETKTKDNVFVNVVASIQYRALADKASDAFYRLTNTRAQIQAYVFDVIRASVPKMNLDDVFEQKNEIARAVEDELEKAMSTYGYEIVQTLIVDIEPDEHVKRAMNEINAAARMRVAANEKAEAEKIIQIKRAEGEAESKYLAGLGIARQRQAIVDGLRESVIGFSVNVPGTTSKDVMDMVLVTQYFDTMKEIGASSKSSAIFLPHGPGAVRDVAQQIRDGLLQATTAHPQPNLL

SEQ ID NO: 8263 - protein, 111 aa, Humulus lupulus
MGNLLCCIQVDQSTVAIKERFGKFNDVLEPGCHCLPWILGSQLAGHLSLRLQQLDVRCETKTKDNVFVNVVASVQYRVIIDKASEAYYKLSNPRTQIQAYVFDVIRASVPS

SEQ ID NO: 8264 - protein, 67 aa, Olea europaea
MGQAFGCVQVDQSTVAVKDILADLMMYSSLGVIACLGVWGISWQVHYHCVYNSLMSVAKPKLRTMCL

SEQ ID NO: 8265 - protein, 175 aa, Sarracenia psittacina
MDLDSTLEQKNEIAKAVEEELEKAMSAYGYEIVQTLTVDIEPDINVKRAMNEINAAARMRVAANEKAEAEKILQIKRAEGEAESKYLSGLGIARQRQAIVDGLRDSVLAFSSNVPGTSAKDVMDMVLVTQYFDTMKEIGASSKSSAVFIPHGPGAVRDVAAQIREGLLQADSVQH

SEQ ID NO: 8266 - protein, 286 aa, Lotus japonicus
MGQALGCVQVDQSNVAIKEHFGKFSEILEPGCHCLPWCLGYQIAGGLSLRVQQLDVRCETKTKDNVFVTVVASVQYRAVADKASDAFYRLTNTREQIQSYVFDVIRASVPKLELDSVFEQKNDIAKSVEEELEKAMSTYGYEIVQTLIVDIEPDVNVKRAMNEINAAARMRLAANEKAEAEKILQIKKAEGEAESKYLSGLGIARQRQAIVDGLRDSVLAFSENVPGTSAKDVMDMVLVTQYFDTMKEIGASSKSSSVFIPHGPGAVRDIAVQIRDGLLQGNAAHI

SEQ ID NO: 8267 - protein, 294 aa, Panicum virgatum
MGKLLAAIGKFFCFVQVNQSTVGIKERFGKFEEVLNPGCHFMPWIIGNRVTGQLTLRLRQLDVRCETKTKDNVFVTVVASIQYRAMEDKASDAYYKLSNPRAQIQAYVFDVIRASIPKLELDDAFEQKNEIAKAVEEELEKAMFAYGYEIVQTLIVDIEPDEKVKRAMNEINAAARLRVAANEKAEAEKIVQIKRAEGEAEAKYLSGLGIARQRQAIVDGLRDSVLGFSGNVPGTSAKDVMDLVLLTQYFDTMKEIGAASKSSAVFLPHGPGAVADIAGQIRDGFLQTSTQQAK

SEQ ID NO: 8268 - protein, 213 aa, Ipomoea batatas
MGQSLGCLQVDQSTVAVMEQFGKFDDVLEPGCHCVPWCLGYQSAGTLSLRVQQIDVRCETKTKDNVFVTVVASIQYRALAEKASDAFYKLSNTKAQIQSYVFDVIRATVPRLNLDAAFEQKNEIAKAVEDELEKAMSAYGFEIVQTLIVDIEPDIHVKRAMNEINAAEGLGLPQMKRLKLRRYCRSRKLRGKRNQNTCQDLALHVSAKRLWMG

SEQ ID NO: 8269 - protein, 289 aa, Raphanus sativus
MGQVLGCVQVDQSTVAIKETFGKFDDVLEPGCHCLPWCIGSQVAGHLSLRVQQLDVRCETKTKDNVFVTVVASIQYRALAESAQDAFYKLSNTRNQIQAYVFDVIRASVPKLDLDSTFEQKNDIAKTVESELEKAMSHYGYEIVQTLIVDIEPDVHVKRAMNEINAASRMREAASEKAEAEKILQIKRAEGEAESKYLSGLGIARQRQAIVDGLRNSVLAFSESVPGTSSKDVMDMVLVTQYFDTLKGLVRLPSRTRCSYRTVRVLSRTLLRRSGMVFFRETLLLSDDE

SEQ ID NO: 8270 - protein, 155 aa, Sarracenia psittacina
MSAYGYEIVQTLIVDIEPDERVKRAMNEINAAARLRVAANEKAEAEKIVQIKRAEGDAESKYLSGLGIARQRQAIVDGLRDSVLGFSVNVPGTSAKDVLDMVMVTQYFDTMKEIGASSKSSAVFIPHGPGAVRDVAGQIRDGLLQGSVHQDHKLL

SEQ ID NO: 8271 - protein, 284 aa, Artemisia annua
MGQALGCIVVDQSTVAVKEHFGKFDNVLQPGCHCLPWCLGYQMAGKLSLRVNQLDVRCETKTKDNVFVNVVASIQYRALSEKAADAFYKLSNTKQQIQAYVFDVIRASVPKLLLDDVFVQKNDIAKGVEEELEKAMSGYGFEIVQTLIVDIEPDQHVKRSMNEINAAARMRVAANEKAEAEKILQIKRAEGEAESKYLSGLGIARQRQAIVDGLRDSVLAFSENVPGTSAKDVMDMVLVTQYFDTMKDIGASSKSSAVFIPHGPGAVKDIADQIRDGLLQAQGV

SEQ ID NO: 8272 - protein, 286 aa, Brassica oleracea
  misc_feature (11)..(11): Xaa can be any naturally occurring amino acid
MGQVLGCVQVXQSTVAIKETFGKFDDVLEPGCHCLPWCLGSQVAGHLSLRVQQLDVRCETKTKDNVFVTVVASIQYRALAESAQDAFYKLSNTRNQIQAYVFDVIRASVPKLDLDSTFEQKNDIAKTVESELEKAMSHYGYEIVQTLIVDIEPDVHVKRAMNEINAASRMREAASEKAEAEKILQIKRAEGEAESKYLSGLGIARQRQAIVDGLRNSVLAFSESVPGTSSKDVMDMVLVTQYFDTLKEIGASSKSNSVFIPHGPGAVKDIASQIRDGLLQGNAAAE

SEQ ID NO: 8273 - protein, 284 aa, Brachypodium distachyon
MGQVLGLVQIDQSTVAIKESFGKFDAILEPGCHCLPWCFGKQIAGYLSLRVQQLDVRCETKTKDNVFVNVVASVQYRALADKASDAFYRLSNTREQIQSYVFDVIRASVPKMNLDDVFEQKNEIAKAVEDELEKAMSAYGYEIVQTLIVDIEPDEHVKRAMNEINAAARMRLAATEKAEAEKILQIKRAEGDAESKYLAGLGIARQRQAIVDGLRDSVLAFSENVPGTSSKDVMDMVLVTQYFDTMKDIGATSKTSAVFIPHGPGAVKDIASQIRDGQLQAKMG

SEQ ID NO: 8274 - protein, 286 aa, Cicer arietinum
MGQALGCYQVDQSNVAIKEQFGRFVDVLEPGCHCLPWCLGYQIAGGLSLRVQQLDVKCETKTKDNVFVMVVASVQYRAVADKASDAFYRLTNTREQIQSYVFDVIRASVPKLELDAVFEQKNDIAKAVEDELEKAMSNYGYEIVQTLIVDVEPDVNVKRAMNEINAAARLRLAANDKAEAEKILQIKKAEGEAESKYLSGLGIARQRQAIVDGLRDSVLAFSENVPGTSAKDVMDMVLVTQYFDTMKEIGASSKSSSVFIPHGPGAVRDIAVQIRDGLLQGNAANL

SEQ ID NO: 8275 - protein, 284 aa, Cirsium arvense
MGNAFGCIQVDQSTVAIKETFGKFDDILTPGCHCMPWCLGQQLAGYLSLRVQQLDIRCETKTKDNVFVTVVASVQYRALADNASDAFYKLSNTREQIQAYVFDVIRASVPRIELDLVFEQKNDIAKSVEDELEKAMSTYGYEIVQTLIVDIEPDELVKKSMNEINAAARMRVAANEKAEAEKILQIKRAEGEAEAKYLSGLGIARQRQAIVDGLRDSVVGFSSNVPGTSAKDVMDMILVTQYFDTMKEIGASSKSTSVFIPHGPGAVRDVAAQIRDGLLQGNAP

SEQ ID NO: 8276 - protein, 286 aa, Fraxinus spp
MGQALGCVQVDQSTVAVKEHFGRFDDVLEPGCHCLPWCLGYQLAGSLSLRVQQLDVRCETKTKDNVFVTVVASIQYRALSEKAADAFYKLSNTKAQIQAYVFDVIRASVPRLDLDSTFEQKNDIAKAVENELEKAMSAYGFEIVQTLIVDIEPDAQVKRAMNEINSAARLRLAANEKAEADKILQIKRAEGEAESKYLSGLGIARQRQAIVDGLRDSVLAFSANVPGTTSKDVMDMVLVTQYFDTMKEIGASSKSSAVFIPHGPGAVKDIAAQIREGLLQAESVNQ

SEQ ID NO: 8277 - protein, 285 aa, Tropaeolum majus
MGQALGCIQVDQSTVAIKETFGKFDDVLTPGCHCLPWCLGSQVAGLLSLRVQQLDVRCETKTKDNVFVVVVASIQYRAVAEKAEDAFYKLSNTREQIQAYVFDVIRASVPKLELDAAFEQKNDIAKAVENELEKAMSHYGFQIVQTLIVDIEPDVHVKRAMNEINAAARMRVAANERAEAEKILQIKKAEGEAESKYLQGLGIARQRQAIVDGLRDSVLAFSENVPGTSSKDVMDMVLVTQYFDTMKDIGASSKSTAVFIPHGPGAVKDIASQIRDGLLQGNTVQ

SEQ ID NO: 8278 - protein, 286 aa, Unknown
  Sequence found in Organisms: Solanum tuberosum, Solanum phureja
MGQTLGCIQVDQSTVAVKEQFGKFDQVLEPGCHCLPWCLGYQVAGSLSLRVQQLDVRCETKTKDNVFVTVVASIQYRALAENAADAFYKLSNTKGQIQSYVFDVIRASVPRMGLDAAFEQKNEIAKAVEEELEKAMSAYGYEIVQTLIVDIEPDIHVKRAMNEINAAARLRVAANEKAEAEKILQIKKAEGEAESKYLSGLGIARQRQAIVDGLRDSVLAFSENVPGTSPRDVMDMVLVTQYFDTMKEIGASSKSSAVFIPHGPGAVKDVASQIREGLLQAESIQH

SEQ ID NO: 8279 - protein, 268 aa, Primula obconica
ERFGKFEDVLEPGCHCLPWFLGSQIAGRLSLRLQQLDVRCETKTKDSVFVNVVASIQYRALADKANDAFYKLSNTRAQIQAYVFDVIRAFVPKLNLDDTFEQKNEIAKAVEEELEKAMSAYGFEIVQTLIVDIEPDENVKRAMNEINAAARMRLAATEKAEAEKILQIKRAEGEAEAKYLSGLGIARQRQAIVDGLRDSVLGFSGNVPGTSAKDVMDMVLVTQYFDTLKEIGASSKSSAVFIPHGPGAVKDVADQIRDGLLQGQASLK

SEQ ID NO: 8280 - protein, 286 aa, Eutrema halophilum
MGQVLGCVQVDQSTVAIKETFGKFDDVLEPGCHCLPWCLGSQVAGHLSLRVQQLDVRCETKTKDNVFVTVVASIQYRALAESAQDAFYKLSNTRNQIQAYVFDVIRASVPKLDLDSTFEQKNDIAKTVESELEKAMSHYGYEIVQTLIVDIEPDVHVKRAMNEINAASRMREAASEKAEAEKILQIKRAEGEAESKYLSGMGIARQRQAIVDGLRNSVLAFSESVPGTSSKDVMDMVLVTQYFDTLKEIGASSKSNSVFIPHGPGAVKDIASQIRDGLLQGNAADS

SEQ ID NO: 8281 - protein, 285 aa, Valeriana officinalis
MGQTLGCIQVDQSNVAVKEQFGKFSDVLEPGCHCMPWCFGYKLAGKLSLRVQQLDVRCETKTKDNVFVTVVASIQYRAMSEKAADAFYKLSNTKGQIQAYVFDVIRACVPKLLLDATFEQKNDIAKAVEEELEKAMSAYGYEIVQTLIVDIEPDAQVKRAMNEINAAARLRVAANDKAEAEKILQIKRAEGEAESKYLSGLGIARQRQAIVDGLRDSVIAFSENVPGTSAKDVMDMILITQYFDTMKEIGASSKSSAVFIPHGPGAVKDIASQIRDGLLQGGSTS

SEQ ID NO: 8282 - protein, 285 aa, Cephalotaxus harringtonia
MGQLLCCCVQVEQSTVAMKERFGRYEEVLEPGCHCLPWFLGSQIGGHLSLRVQKLDVRCETKTKDNVFVTVIASVQYRALLEKASDAFYKLSNTREQIQAYVFDVIRSSVPKMNLDDVFEQKNEVAKAVEDELEKAMSTYGFEIVQTLIVDIEPDETVKRAMNEINAAARMRVATRDKAEAEKILQIKRAEAEAESKFLSGQGIARQRQAIVDGLRDSVLAFSVNVPGTTAKDVMDMVLVTQYFDTMKEIGASSKSSAVFIPHGPGAVRDVAEQIRDGLLQAQAN

SEQ ID NO: 8283 - protein, 267 aa, Gossypium raimondii
MMCFSLVVIVCRGVSGNRQPVLSPLRVQQLDVRCETKTKDNVFVNVVASIQYRALAEKAQDAFYKLSNTRAQIQSYVFDVIRASVPKLELDAVFEQKNDIARAVEEELEKAMSHYGYEIVQTLIVDIEPDEHVKRAMNEINAAARMRVAANEKAEAEKILQIKRAEGDAESKYLAGLGVARQRQAIVDGLRDSVLAFSENVPGTSSKDVMDMVLVTQYFDTMKEIGASSKSNSVFIPHGPGAVRDIASQIRDGLLQASQKQLSNCRG

SEQ ID NO: 8284 - protein, 284 aa, Panicum virgatum
MGQILGLVQVDQSTVAIKETFGKFNEVLEPGCHFLPWCIGQQIAGYLSLRVRQLDVRCETKTKDNVFVTVVASVQYRALADKASDAFYKLSNTREQIQSYVFDVIRATVPKLDLDDAFEQKNDIAKAVEDELEKAMSTYGYEIVQTLIVDIEPDDRVKRAMNEINAAARMRVAASEKAEAEKILQIKKAEGEAESKYLAGVGIARQRQAIVDGLRDSVLAFSENVPGTTAKDIMDMVLVTQYFDTMKEIGASSKSSSVFIPHGPGAVKDVAAQIRDGLLQANLQ

SEQ ID NO: 8285 - protein, 127 aa, Amorphophallus konjac
MGQAFCCLQVDQSTVAIKENFGKFDGVLEPGCHCLPWILGSQVAGSLSLRVQQLDVRCETKLRITYLSLLLHLFNIVHWLRRLLMLFIGSATPGSKFNPMFLMSSGQVYQNWTWMMSLSRRMRLQKQ

SEQ ID NO: 8286 - protein, 300 aa, Manihot esculenta
MGQACGCIQVEQSKVVIREHFGKYDAVLEPGCHCMPWCLGYKVSGKLSLRVQQLDIKCETKTKDNVFVNVVASIQYRALAEKAADAYYKLSNTKAQIQAYVFDVIRASVPKLSLDAAFEQKNEIAKAVEDELEKAMSAYGFEIVQTLIVDIEPDTHVKKAMNEINAAARQRVAASEKAEGVKILQIKRAEGEAESKYLSGIGIARQRQAIVDGLRDSVLGFSENVPGTSAKDVLDMVLLTQYFDTMKEIGASSKSSSVFIPHGPGAVRDIASQIRGGLLQGNSANQRFSGCMETCVPANE

SEQ ID NO: 8287 - protein, 294 aa, Setaria italica
MGKLPAAIGRFFCFVQVNQSTVGIKERFGKFEEVLNPGCHFMPWIIGNRVTGQLTLRLRQLDVRCETKTKDNVFVTVVASIQYRAMEDKASDAYYKLSNPKAQIQSYVFDVIRASVPKLELDDAFEQKNEIAKAVEEELEKAMSAYGYEIVQTLIVDIEPDEKVKRAMNEINAAARLRVAANEKAEAEKIIQIKRAEGEAEAKYLSGLGIARQRQAIVDGLRDSVLGFSGNVPGTSAKDVMDLVLLTQYFDTMKEIGAASKSSAVFLPHGPGAVADIASQIRDGFLQASTQQAK

SEQ ID NO: 8288 - protein, 287 aa, Mimulus guttatus
MGQALCCVQVDQSTVAMKEHFGKFDSVLDPGCHCLPWCFGYQMAGTLSLRVQQLDVRCETKTKDNVFVTVVASIQYRAVAQNASDAFYKLTNTKAQIQSYVFDVIRASVPRLLLDSVFEQKNEIAKAVEEELEKAMSAYGFEIVQTLIVDIEPDVHVKRAMNEINAAARMRVATNEKAEAEKILQIKKAEGEAESKYLSGLGIARQRQAIVDGLRDSVLAFSENVPGTSAKDVMDMVLVTQYFDTMKEIGASSKTSAVFIPHGPGAVKDITSQIREGLLQGQSVVDQ

SEQ ID NO: 8289 - protein, 284 aa, Arachis hypogaea
MGLALGCLQVDQSTVAIKEVFGKFDDVLEPGCHFVPWCLGNQVAGYLSLRVQQLDVRCETKTKDNVFVTVVASIQYRALAEGAVDAFYKLSNTRAQIQAYVFDVIRASVPKMELDASFEQKNEIAKAVEEELEKAMCAYGYEIVQTLIVDIEPDEHVKRAMNEINAAARLRVAANEKAEAEKILQIKRAEGEAESKYLAGLGIARQRQAIVDGLRDSVLAFSENVPGTTSKDVMDMVLVTQYFDTLKEIGASSKSNSVFVPHGPGAVKDISSQIREGLLQGNVA

SEQ ID NO: 8290 - protein, 286 aa, Raphanus sativus
  misc_feature (278)..(279): Xaa can be any naturally occurring amino acid
MGQVLGCVQVDQSTVAIKETFGKFDDVLEPGCHCLPWCIGSQVAGHLSLRVQQLDVRCETKTKDNVFVTVVASIQYRALAESAQDAFYKLSNTRNQIQAYVFDVIRASVPKLDLDSTFEQKNDIAKTVESELEKAMSHYGYEIVQTLIVDIEPDVHVKRAMNEINAASRMREAASEKAEAEKILQIKRAEGEAESKYLSGLGIARQRQAIVDGLRNSVLAFSESVPGTSSKDVMDMVLVTQYFDTLKEIGASSKSNSVFIPHGPGAVKDIASQIRDGXXQGNAAAE

SEQ ID NO: 8291 - protein, 285 aa, Scabiosa columbaria
MGQTLGCIQVDQSNVVVKEHFGRFDEILDPGCHCMPWCLGYQIAGQLSLRVQQLDVRCETKTKDNVFVTVVASIQYRALAEKASDAFYKLSNTKGQIQAYVFDVIRASVPKLLLDDAFEQKNDIARAVEEELEKAMSAYGYEIVQTLIVDIEPDAQVKRAMNEINAAARMRLAANEKAEAEKILQIKRAEGEAESKYLSGLGIARQRQAIVDGLRDSVIAFSENVPGTSAKDVMDMVLVTQYFDTMKEIGSSSKASAVFIPHGPGAVKDIASQIRDGLLQGNMAQ

SEQ ID NO: 8292 - protein, 286 aa, Glycine max
MGQVLGCVQVDQSSLAIKEVFGKYDDVLEPGCHCVPWCFGSRVAGALSLRVKQLDVRCETKTKDNVFVTVVASIQYRALAEKAVDAYYKLSNTRSQIQSYVFDVIRASVPKMELDATFEQKNEIAKAVEEELEKAMSAYGYEIVQTLIVDIEPDEHVKRAMNEINAAARLRVAANEKAEAEKILQIKRAEGDAESKYLAGLGIARQRQAIVDGLRDSVLAFSENVPGTTSKDIMDMVLMTQYFDTMKDIGASSKSNAVFIPHGPGAVQDVASQIRNGLLQGNATQS

SEQ ID NO: 8293 - protein, 208 aa, Fagopyrum esculentum
MAEKAADSFYKLSNTREQIQAYVFDVIRASVPKLKLDDTFVQKNDIAKAVEDEPEKAMSNYGYEIVQTLIVDIEPDVHVKRAMNEINAAARMRVAANDKAEAEKILQIKKAEGEAEAKYLAGLGIARQRQAIVDGLRESVINFSSNVPGTTAKDVMDMVLVTQYFDTMREIGASSKSSSVFIPHGPGAVKDIAVQIRDGLLQGNAARD

SEQ ID NO: 8294 - protein, 287 aa, Sequoia sempervirens
MGQYLCCCVQVEQSNVALKERFGRYEEVLEPGCHCLPWFLGSQIGGHLSLRVQKLDVRCETKTKDNVFVTVIASVQYRALLEKASDAFYKLSNTREQIQAYVFDVIRSSVPKMNLDDVFEQKNEVAKAVEDELEKAMTTYGYEIVQTLIVDIEPDETVKRAMNEINAAARMRVATRDKAEAEKILQIKRAEAEAESKFLSGQGIARQRQAIVDGLRDSVLAFSVNVPGTTAKDVMDMVLVTQYFDTMKEIGASSKSSSVFIPHGPGAVRDVAEQIRDGLLQAQAQAH

SEQ ID NO: 8295 - protein, 293 aa, Unknown
  Sequence found in Organisms: Secale cereale, Triticum aestivum
MGKLVAAIGKLLCCVQVDQSTVAIKERFGKFEDVLDPGCHCVPWIIGSRVSGKLTLRLRQMDVRCETKTKDNVFVTIVASIQYRAMEDKANDAYYKLSNPKSQIQSYVFDVIRASIPKLQLDDVFEQKNDIAKSVEQELEKAMFAYGYEIVQTLIVDIEPDEKVKKAMNEINAAARMRVAANEKAEAEKIVQIKRAEGEAEAKYLSGLGIARQRQAIVDGLRDSVLGFSGNVPGTSAKDVMDLVLLTQYFDTMKEIGASSKSSAVFLPHGPGAVADIASQIRNGFLQASTHNA

SEQ ID NO: 8296 - protein, 210 aa, Sarracenia psittacina
MGNLLGCVQVEQSTVAIKERFGRFEEVLDPGCHCVPWFLGSQLAGHLSVRVQQLDVRCETKTKDNVFVNVVASVQYRALAGKASDAFYKLTNTRSQIQAYVFDVIRASVPNLNLDDTFEHKNKIAKAVEDQLEKAMSAYGYEIVQTLIVDIEPDERVKHAMNEINAAARQRAAANDRAEAEKILQIKRAEGEAESKYLSGLVSPATSSNC

SEQ ID NO: 8297 - protein, 294 aa, Panicum virgatum
MGKLLAAVGKFFCFVQVNQSTVGIKERFGKFEEVLNPGCHFMPWIIGNRVTGQLTLRLRQLDVRCETKTKDNVFVTVVASIQYRAMEDKASDAYYKLSNPKAQIQAYVFDVIRASIPKLELDDAFEQKNEIAKAVEEELEKAMFAYGYEIVQTLIVDIEPDEKVKRAMNEINAAARLRVAANEKAEAEKIIQIKRAEGEAEAKYLSGLGIARQRQAIVDGLRDSVLGFSGNVPGTSAKDVMDLVLLTQYFDTMKEIGAASKSSAVFLPHGPGAVKDIAGQIRDGFLQASTQEAK

SEQ ID NO: 8298 - protein, 142 aa, Sarracenia psittacina
MGQALGCVQVDQSTVAVKEQFGKFDDLLEPGCHCLPWCLGYQLAGELSLRVQQLDVRCETKTKDNVFVNVVASIPYVPWQKKHLMLSTSFPTPKDKSKPMFLMLLGQVYQRWTWIPLLSRRMKLQKLWRKNLKRLCLHMGMK

SEQ ID NO: 8299 - protein, 284 aa, Triticum aestivum
MGGVLGLIQIDQSTVAIKETFGKFDAILQPGCHCLPWCLGQQIAGYLSLRVQQLDVRCETKTKDNVFVNVVASVQYRALADKASDAFYRLSNTREQIQSYVFDVIRASVPKMNLDDVFEQKNEIARAVEDELEKAMSAYGYEIVQTLIVDIEPDEHVKRAMNEINAAARMRLAATEKAEAEKILQIKRAEGEAESKYLAGVGIARQRQAIVDGLRDSVLAFSENVPGTSSKDVMDMVLVTQYFDTMKDIGASSKSSAVFIPHGPGAVKDIASQIRDGQLQGRMV

SEQ ID NO: 8300 - protein, 286 aa, Zostera marina
MGQALGCIQVDQSTIAIEEGFGKFDEVLQPGCHCVPWCFGKNIVGYLSLRIQQLDVRCETKTKDNVFVTVVASIQYRALPEKAEDAYYKLSNTREQIQAYVFDVIRASVPKLILDDVFEQKNDIAKSVEEELSKAMSTYGYEIVQTLIVDIEPDERVKRAMNEINSAARLRVAANEKAEAEKILQIKRAEGDAESKYLSGLGIARQRQAIVDGLRESVLAFSGNVPGTTAKEVMDMVLVTQYFDTMKEIGASSKSSSVFIPHGPGAVKDVVSQIRDGLLQANEAGN

SEQ ID NO: 8301 - protein, 286 aa, Arabidopsis thaliana
MGQALGCIQVDQSNVAIKETFGKFDEVLEPGCHCLPWCLGSQVAGHLSLRVQQLDVRCETKTKDNVFVTVVASIQYRALAESAQDAFYKLSNTRNQIQAYVFDVIRASVPKLDLDSTFEQKNDIAKTVETELEKAMSHYGYEIVQTLIVDIEPDVHVKRAMNEINAASRMREAASEKAEAEKILQIKRAEGEAESKYLSGMGIARQRQAIVDGLRNSVLAFSESVPGTSSKDVMDMVLVTQYFDTLKEIGASSKSNSVFIPHGPGAVRDIASQIRDGLLQGNSAAE

SEQ ID NO: 8302 - protein, 284 aa, Brachypodium distachyon
MAGILGLVQVDQSTVAIKETFGKFSEVLEPGCHFLPWCIGQRIVGYLSLRVKQLDVRCETKTKDNVFVTVVASIQYRALADKASDAFYKLSNTKQQIQSYVFDVIRATVPKLGLDDAFEQKDDIAKAVEEELEKAMSMYGYEIVQTLIVDIEPDVHVKRAMNEINAAARMRSATNEKAEAEKIIQIKRAEGEAESKYLAGVGIARQRQAIVDGLRDSVLAFSENVPGTTAKDVMDMVLVTQYFDTMKEIGASSKSSSVFIPHGPGAVKDVASQIRDGLLQSNIV

SEQ ID NO: 8303 - protein, 284 aa, Cannabis sativa
MGQALGCVQVDQSNVAIKETFGKFDDILEPGCHCVPWFFGSNLAGQLSLRVQQLDVRCETKTKDNVFVTVVASIQYRAIAEKASDAFYKLSNTRAQIQSYVFDVIRASVPKLDLDSTFEQKNDIAKAVEEELEKAMSHYGFEIVQTLIVDIEPDERVKRAMNEINAAARMRVAANEKAEAEKILQIKRAEGDAESKYLAGLGIARQRQAIVDGLRDSVLAFSSNVPGTSSKDVMDMVLVTQYFDTMKEIGASSKTNSVFIPHGPGVVRDVASQIRDGFIQANVN

SEQ ID NO: 8304 - protein, 283 aa, Cenchrus ciliaris
MGQVLGLVQVDQSTVAIKETFGKFSEVLEPGCHFLPWCIGQQISGYLSLRVRQLDVRCETKTKDNVFVTVVASVQYRALAEKASDAFYKLSNTREQIQSYVFDVIRATVPKLDLDDAFEQKNDIAKAVEDELEKAMSAYGYEIVQTLIVDIEPDDRVKRAMNEINAAARMRLAASEKAEAEKIIQIKKAEGEAESKYLAGVGIARQRQAIVDGLRDSVLAFSENVPGTTAKDIMDMVLVTQYFDTMKEIGASSKSSSVFIPHGPGAVKDVAAQIRDGLLQANQ

SEQ ID NO: 8305 - protein, 284 aa, Leymus cinereus x Leymus triticoides
MGGVLGLIQIDQSTVAIKETFGKFDAILEPGCHCLPWCLGQQIAGYLSLRVQQLDVRCETKTKDNVFVNVVASVQYRALADKASDAFYRLSNTREQIQSYVFDVIRASVPKMILDDVFEQKNEIARAVEEELEKAMSAYGYEIVQTLIVDIEPDEHVKRAMNEINAAARMRLAATEKAEAEKILQIKRAEGEAESKYLSGLGIARQRQAIVDGLRDSVLAFSENVPGTSSKDVMDMVLVTQYFDTMKDIGASSKSSAVFIPHGPGAVKDIASQIRDGQLQSRMV

SEQ ID NO: 8306 - protein, 286 aa, Petunia hybrida
MGQALGCIQVDQSTVAVKEQFGKFDEVLEPGCHCLPWCFGYQVPGYLPLRVQQIDVRCETKTKDNVFVTVVASIQYRALAEKAADAFYKLSNTKGQIQSYVFDVIRASVPRMELDAAFEQKNDLAKAVEEELEKAMSAYGYEIVQTLIVDIEPDINVKRAMNEINAAARLRVAANEKAEAEKILQIKKAEGEAESKYLSGLGIARQRQAIVDGLRDSVLAFSENVPGTTAKDVMDMVLVTQYFDTMKEIGASSKSSAVFIPHGPGAVKDVASQIREGLLQAASVGQ

SEQ ID NO: 8307 - protein, 285 aa, Raphanus sativus
MGQVLGCVQVDQSTVAIKETFGKFDNVLQPGCHCMPWCLGSQVAGHLSLRVQQLDVRCETKTKDNVFVTVVASIQYRALAESAQDAFYKLSNTRNQIQAYVFDVIRASVPKLDLDSTFEQKNDIAKTVESELEKAMSHYGYEIVQTLIVDIEPDVHVKKAMNEINAASRMREAASEKAEAEKILQIKRAEGEAESKYLSGLGIARQRQAIVDGLRNSVLAFSESVPGTSSKDVMDMVLITQYFDTLKDIGASSKSNSVFIPHGPGAVKDIASQIRDGLLQGKAAE

SEQ ID NO: 8308 - protein, 284 aa, Sorghum bicolor
MGQALGLVQVDQSTVAIKENFGKFSEVLEPGCHFLPWCIGQQIAGYLSLRVRQLDVRCETKTKDNVFVTVVASVQYRALAEKASDAFYKLSNTREQIQSYVFDVIRATVPKLDLDDAFEQKNDIAKAVEEELEKAMSMYGYEIVQTLIVDIEPDDRVKRAMNEINAAARMRVAASEKAEAEKILQIKKAEGEAESKYLAGVGIARQRQAIVDGLRDSVLAFSENVPGTTAKDIMDMVLVTQYFDTMKEIGASSKSSSVFIPHGPGAVKDVAAQIRDGLLQAKLQ

SEQ ID NO: 8309 - protein, 293 aa, Centaurea maculosa
  misc_feature (14)..(14): Xaa can be any naturally occurring amino acid
  misc_feature (285)..(285): Xaa can be any naturally occurring amino acid
MGNLCCLVQVDQSXVAIKEAFGKFDDVLEPGCHCVPWIFGRQLAGHLTLRIQQLDVKCETKTKDNVFVNVVASIQYRALAEKASDAFYKLSNTRSQIQAYVFDVIRASVPKLNLDDVFEQKNDIAKAVEEELAKAMSAYGYEIVQTLIVDIEPDERVKKAMNEINAAARMRLAATEKAEADKILQIKRAEGEAESKYLSGLGIARQRQAIVDGLRDSVLGFSVNVPGTTAKDVMDMVLVTQYFDTMKEIGASSKSSASHPAWTRAVVMCYSERDGSSGTPPADRXSPRYINLE

SEQ ID NO: 8310 - protein, 286 aa, Distylium racemosum
MGQLLCCCVQVEQSKVAMKERFGRFEEVLEPGCHCLPWFLGSQIGGQLSLRVQKLDVRCETKTKDNVFVTVIASVQYRALLEKASDAFYKLSNTREQIQAYVFDVIRSSVPKMNLDDVFEQKNEVAKAVEQELEKAMSTYGFEIVQTLIVDIEPDETVKRAMNEINAAARMRVATRDKAEAEKILQIKRAEAEAESKYLSGLGIARQRQAIVDGLRDSVLAFSVNVPGTTAKDVMDMVLVTQYFDTMKEIGASSKSSAVFIPHGPGAVHDVAEQIRDGLLQAQQIR

SEQ ID NO: 8311 - protein, 284 aa, Triticum aestivum
MGGVLGLIQIDQSTVAIKETFGKFDAILQPGCHCLPWCLGQQIAGYLSLRVQQLDVRCETKTKDNVFVNVVASVQYRALADKASDAFYRLSNTREQIQSYVFDVIRASVPKMNLDDVFEQKNEIARAVEDELEKAMSAYGYEIVQTLIVDIEPDEHVKRAMNEINAAARMRLAATEKAEAEKILQIKRAEGEAESKYLAGVGIARQRQPIVDGLRDSVLAFSENVPGTSSKDVMDMVLVTQYFDTMKDIGASSKSSAVFIPHGPGAVKDIASQIRDGQLQGRMV

SEQ ID NO: 8312 - protein, 286 aa, Arabidopsis lyrata
MGQALGCIQVDQSNVAIKETFGKFDEVLEPGCHCLPWCLGSQVAGHLSLRVQQLDVRCETKTKDNVFVTVVASIQYRALAESAQDAFYKLSNTRNQIQAYVFDVIRASVPKLDLDSTFEQKNDIAKTVETELEKAMSHYGYEIVQTLIVDIEPDVHVKRAMNEINAASRMREAASEKAEAEKILQIKRAEGEAESKYLSGMGIARQRQAIVDGLRNSVLAFSESVPGTSSKDVMDMVLVTQYFDTLKEIGASSKSNSVFIPHGPGAVKDIASQIRDGLLQGNSVAE

SEQ ID NO: 8313 - protein, 293 aa, Hordeum vulgare
MGKLVAAIGKLLCCVQVDQSTVAIKERFGKFEDVLDPGCHCVPWIIGSRVSGKLTLRLRQMDVRCETKTKDNVFVTIVASIQYRAMEDKANDAYYKLSNPKTQIQSYVFDVIRASIPKLQLDDVFEQKNDIAKSVEQELEKAMFAYGYEIVQTLIVDIEPDEKVKKAMNEINAAARMRVAANEKAEAEKIVQIKRAEGEAEAKYLSGLGIARQRQAIVDGLRDSVLGFSGNVPGTSAKDVMDLVLLTQYFDTMKEIGASSKSSAVFLPHGPGAVADIASQIRNGFLQASTHNA

SEQ ID NO: 8314 - protein, 286 aa, Fraxinus spp
MGQTLGCVQIDQSTVAMKEHFGKFAMCLSLDAIACLGVWGTSWLVHYLCGYNSLTCGVKQKLKDNVFVTVVASIQYRAMAEKAADAFYKLSNTKEQIQAYVFDVIRASVPRLDLDSTFEQKNDIAKAVENELEKAMSAYGYEIVQTLIVDIEPDAQVKRSMNEINAAARLRVATNEKAEAEKILQIKKAEGEAESKYLSGLGIARQRQAIVDGLRDSVLAFSENVPGTTAKDVMDMVLVTQYFDTMKDIGASSKSSAVFIPHGPGAVKDVAAQIREGLLQAESGGQ

SEQ ID NO: 8315 - protein, 284 aa, Pennisetum glaucum
MGQVLGLVQVDQSTVAIKETFGKFSEVLEPGCHFLPWCIGQQIAGYLSLRVRQLDVRCETKTKDNVFVTVVASVQYRALSEKASDAFYKLSNTREQIQSYVFDVIRATVPKLDLDDAFEQKNDIAKAVEDELEKAMSAYGYQIVQTLIVDIEPDDRVKRAMNEINAAARMRLAAGEKAEAEKIIQIKKAEGEAESKYLAGVGIARQRQAIVDGLRDSVLAFSENVPGTTAKDIMDMVLVTQYFDTMKEIGASSKSSSVFIPHGPGAVKDVAAQIRDGLLQANQQ

SEQ ID NO: 8316 - protein, 286 aa, Quercus alba
MGQAFGCLQVDQSNVIIREHFGKFDDVLEPGCHCLPWCLGYQVAGGLSLRVQQLDVRCRNKNEDNVFVTVVASVQYRAVADKASDAFYRLTNTREQIQSYVFDVIRASVPKLNLDAVFEQKNDIAKSVEDELEKAMSTYGYEIVQTLIVDIEPDPHVKRAMNEINAAARMRVAANDKAEADKILQIKKAEGEAESKYLSGLGIARQRQAIVDGLRDSVLAFSENVPGTTAKDVMDMVLVTQYFDTMKEIGASSKSSSVFIPHGPGAVRDVASQIREGLLQAQSLKS

SEQ ID NO: 8317 - protein, 284 aa, Avena sativa
MGQAIGLIQIDQSTVAIKETFGKFDAILEPGCHCLPWCIGQQIAGYLSLRVQQLDVKCETKTKDNVFVNVVASVQYRALADKASDAFYKLSNTREQIQSYVFDVIRASVPKMILDDVFEQKNEIAKAVENELEKAMSAYGYEIVQTLIVDIEPDVNVKRAMNEINAAARMRLAATEKAEAEKILQIKRAEGDAESKYLAGLGIARQRQAIVDGLRDSVLAFSENVPGTSSKDVMDMVLVTQYFDTMKDIGASSKSSAVFIPHGPGAVRDIAAQIRDGQLQGRMV

SEQ ID NO: 8318 - protein, 284 aa, Unknown
  Sequence found in Organisms: Pseudoroegneria spicata, Secale cereale
MGGVLGLIQIDQSTVAIKETFGKFDAILQPGCHCLPWCLGQQIAGYLSLRVQQLDVRCETKTKDNVFVNVVASVQYRALADKASDAFYRLSNTREQIQSYVFDVIRASVPKMNLDDVFEQKNEIARAVEDELEKAMSAYGYEIVQTLIVDIEPDEHVKRAMNEINAAARMRLAATEKAEAEKILQIKRAEGEAESKYLAGVGIARQRQAIVDGLRDSVLAFSENVPGTSSKDVMDMVLVTQYFDTMKDIGASSKSSAVFIPHGPGAVKDIASQIRDGQLQSRMV

SEQ ID NO: 8319 - protein, 267 aa, Secale cereale
LGSLTVCFSQDATCLPWILGKRVVGHLTLRLQQLDVRCETKTKDNVFVTVVASIQYRPLAGKESDAYYKLTNTRSQIQAYVFDVIRASVPKLNLDDAFVQKNDIAKAVEDELEKAMSAYGFEIVQTLIVDIEPDAHVKQAMNEINAAARMRVAANEKAEAEKIVQIKRAEGEAEAKYLSGLGIARQRQAIVDGLRDSVLGFSVNVPGTTAKDVMDMVLITQYFDTMKEIGASSKSSAVFTPHGPGAVRDIATQIRDGLLQGQSASDN

SEQ ID NO: 8320 - protein, 284 aa, Picea glauca
MGQLFCCVQVEQSEVAMKETFGRFNEVLEPGCHCLPWIFGQQIAGHLSLRVQKLDVRCETKTKDNVFVTVIASVQYRAILDKAEDAFYKLSNTREQIQAYVFDVIRASVPKMNLDDFFEQKNDVARAVEEELEKVMTNYGFEIVQTLIVDIEPDELVKRAMNEINAAARMRVATKDKAEAEKILQIKRAEGEAEAKYLSGLGIARQRQAIVDGLRDSVLAFSDNVPGTTAREVMDMVLVTQYFDTMKEIGASSKSSTVFIPHGPGAVRDVAEEIRNGLLQAQAR

SEQ ID NO: 8321 - protein, 209 aa, Panicum virgatum
  misc_feature (32)..(32): Xaa can be any naturally occurring amino acid
  misc_feature (46)..(46): Xaa can be any naturally occurring amino acid
MGKLLAAVGKFFCFVQVNQSTVGIKERFGKFXEVLNPGCHFMPWIXGNRVTGQLTLRLRQLDVRCETKTKDNVFVTVVASIQYRAMEDKASDAYYKLSNPKAQIQAYVFDVIRASIPKLELDDAFEQKNEIAKAVEEELEKAMFAYGYEIVQTLIVDIEPDEKVKRAMNEINAAARLRVAANEKAEAEKIIQIKRAEGEAEAKYLSGLA

SEQ ID NO: 8322 - protein, 111 aa, Pinus pinaster
MGQLLCCVQVDQSQVAMKETFGRFNEVLEPGCHCMPWIFGQKIGGYLSLRVQKLDVRCETKTKDNVFVIVVASVQYRAILGKAVDAFISLAIQGSRSKLMFLMSFGQVFQR

SEQ ID NO: 8323 - protein, 286 aa, Olea europaea
MGQILGCVQIDQSNVAVKENFGKFDKVLEPGCHCLPWCVGYQLAGSLSLRVQQLDVRCETKTKDNVFVTLVASIQYRAMPERAADAFYKLSNTKEQIQAYVFDVIRASIPRLDLDSTFEQKNDIAKAVENELEKAMSAYGYEIVQTLIVDIEPDSQVKRAMNEINAAARLRVAANEKAEAEKILQIKKAEGEAESKYLSGLGIARQRQAIVDGLRESVLAFSENVPGTTAKDVMDMVLITQYFDTMKEIGASSKSSAVFIPHGPGAVKDVAAQIREGLLQAESVEQ

SEQ ID NO: 8324 - protein, 286 aa, Prunus mume
MGQALGCIQVNQSKVAVREQFGKFDHVLEPGCHCLPWCFGYKIAGELSLRVRQLEVRCETKTKDNVFVNVVASIQYRALPEKIADAFYKLSNANSQIQAYVFDVIRASVPKLELDAVFEQKSDIAKAVEEELAKAMSTYGYEIVQTLIVDIVPDVHVKRAMNEINAAARHRLAAKEKAEAEKILQIKRAEGEAESKYLAGLGIARQRQAIVDGLRDSVLVFSENVPGTSAKDVMDMVLVTQYFDTMKEIGASSKSSSVFIPHGPGAVRDVASQIREGLLQADHAKE

SEQ ID NO: 8325 - protein, 285 aa, Brassica rapa
MGQVLGCVQVDQSTVAIKETFGKFDDVLQPGCHCMPWCLGSQVAGHLSLRVQQLDVRCETKTKDNVFVTVVASIQYRALAESAQDAFYKLSNTRNQIQAYVFDVIRASVPKLDLDSTFEQKNDIAKTVESELEKAMSHYGYEIVQTLIVDIEPDVHVKKAMNEINAASRMREAASEKAEAEKILQIKRAEGEAESKYLSGLGIARQRQAIVDGLRNSVLAFSESVPGTSSKDVMDMVLVTQYFDTLKDIGASSKSNAVFIPHGPGAVKDIASQIRDGLLQGKAAE

SEQ ID NO: 8326 - protein, 284 aa, Hordeum vulgare
MGGVLGLIQIDQSTVAIKETFGKFDAILQPGCHCLPWCLGQQVAGYLSLRVQQLDVRCETKTKDNVFVNVVASVQYRALADKASDAFYRLSNTREQIQSYVFDVIRASVPKMNLDDVFEQKNEIARAVEEELEKAMSAYGYEIVQTLIVDIEPDEHVKRAMNEINAAARMRLAATEKAEAEKILQIKRAEGEAESKYLAGVGIARQRQAIVDGLRDSVLAFSENVPGTSSKDVMDMVLVTQYFDTMKDIGASSKSSAVFIPHGPGAVKDIASQIRDGQLQGRMV

SEQ ID NO: 8327 - protein, 286 aa, Cirsium arvense
MGNAFGCIQVDQSTVAIKETFGKFDDILTPGCHCMPWCLGQQLAGYLSLRVQQLDIRCETKTKDNVFVTVVASVQYRALADKASDAYYKLSNTREQIQAYVFDVIRASVPRIELDLVFEQKNDIAKSVENELEKAMSAYGYEIVQTLIVDIEPDEVVKKSMNEINAAARMRVAANEKAEAEKILQIKRAEGEAEAKYLSGLGIARQRQAIVDGLRESVVGFSSNVPGTSAKDVMDMILVTQYFDTMREIGSSSKSTSVFIPHGPGAVKDVAAQIRDGLLQGNMTRM

SEQ ID NO: 8328 - protein, 283 aa, Setaria italica
MGQVLGLVQVDQSTVAIKETFGKFSEVLEPGCHFLPWCIGQQVAGYLSLRVRQLDVRCETKTKDNVFVTVVASVQYRALADKASDAFYKLSNTREQIQSYVFDVIRATVPKLELDDAFEQKNDIAKAVEEELEKAMSTYGYEIVQTLIVDIEPDDRVKRAMNEINAAARMRLAASEKAEAEKIIQIKKAEGEAESKYLAGVGIARQRQAIVDGLRDSVLAFSENVPGTTAKDIMDMVLVTQYFDTMKEIGASSKSSSVFIPHGPGAVKDVAAQIRDGLLQASQ

SEQ ID NO: 8329 - protein, 284 aa, Avena sativa
MGQAIGLIQIDQSTVAIKETFGKFDAILEPGCHCLPWCIGQQIAGYLSLRVQQLDVKCETKTKDNVFVNVVASVQYRALADKASDAFYKLSNTREQIQSYVFDVIRASVPKMILDDVFEQKNEIAKAVENELEKAMSAYGYEIVQTLIVDIEPDVNVKRAMNEINAAARMRLAATEKAEAEKILQIKRAEGDAESKYLAGLGIARQRQAIVDGLRDSVLAFSENVPGTSSKDVMDMVLVTQYFDTMKDIGASSKSSAVFIPHGPGAVKDIAAQIRDGQLQGRMV

SEQ ID NO: 8330 - protein, 289 aa, Arachis hypogaea
MGQALGCIIVGQSNVAIKEHFGKFDDILQPGCHCLPWCLGYQIAGGLSLRVQQLDVKCETKTKDNVFVNVVASVQYRALADKASDAFYRLTNTKEQIQSYVFDVIRASVPKLELDAVFEQKNDIARAVEDELEKAMSAYGYEIVQTLIVDIEPDVHVKRAMNEINAAARLRLAANEKAEAEKILQIKKAEGEAESKYLSGLGIARQRQAIVDGLRDSVLAFSENVPGTTAKDIMDMVLVTQYFDTMKEIGASSKSSAVFIPHGPGAVRDVSEQIRDGLLQANASPNLLN

SEQ ID NO: 8331 - protein, 286 aa, Prunus persica
MGQALGCIQVKQSKVAVREQFGKFDNVLEPGCHCLPWCFGYKIAGELSLRVRQLEVRCETKTKDNVFVNVVASIQYRALPEKIADAFYKLSNANSQIQAYVFDVIRASVPKLELDAVFEQKSDIAKAVEEELAKAMSTYGYEIVQTLIVDIVPDVHVKRAMNEINAAARHRLAAKEKAEAEKILQIKRAEGEAESKYLAGLGIARQRQAIVDGLRDSVLVFSENVPGTSAKDVMDMVLVTQYFDTMKEIGASSKSSSVFIPHGPGAVRDVASQIREGLLQADYAKE

SEQ ID NO: 8332 - protein, 249 aa, Secale cereale
MGNLCCCVQVDQSTVAIREQFGKFDSVLQPGCHCLPWVLGKRVVGHLTLRLQQLDVRCETKTKDNVFVTVVASIQYRPLAGKESDAYYKLTNTRSQIQAYVFDVIRASVPKLNLDDAFVQKNDIAKAVEDELEKAMSAYGFEIVQTLIVDIEPDAHVKQAMNEINAAARMRVAANEKAEAEKIVQIKRAEGEAEAKYLSGLGIARQRQAIVDGLRDSVLGFSVNVPGTTAKDVMDMVLITQYFDTMKEI

SEQ ID NO: 8333 - protein, 284 aa, Pseudoroegneria spicata
MGGVLGLVQVDQSTVAIKETFGKFNEVLEPGCHFLPWCIGQRIVGYLSLRVKQLDVRCETKTKDNVFVTVVASVQYRALGDKASDAFYKLSNTKQQIQSYVFDVIRATVPKLELDDAFVQKDDIAKAVEEELEKAMSMYGYEIVQTLIVDIEPDVHVKRAMNEINAASRMRSAANDKAEAEKILQIKRAEGEAESKYLAGVGIARQRQAIVDGLRDSVLAFSENVPGTTAKDIMDMVLVTQYFDTMKEIGASSKSSSVFIPHGPGAVKDVASQIRDGLLQANTL

SEQ ID NO: 8334 - protein, 292 aa, Oryza sativa
MGKLVAAIGKLLCCVQVDQSTVGIKERFGKYEEVLDPGCHCVPWIIGSRVAGELTLRLRQLDVRCETKTKDNVFVTVVASIQYRAMEDKASDAYYKLSNPKSQIQSYVFDVIRASIPKLELDDAFLQKNEIARAVEEELEKAMLAYGYEIVQTLIVDIEPDEKVKRAMNEINAAARLRVAANEKAEAEKIIQIKRAEGEAEAKYLSGLGIARQRQAIVDGLRDSVLGFSGNVPGTSAKDVMDLVLLTQYFDTMKEIGSTSKSSAIFLPHGPGAVADIASQIRDGCLQAHQTK

SEQ ID NO: 8335 - protein, 284 aa, Picea glauca
MGQLFCCIQVDQSQVAMKETFGRFNEVLEPGCHCLPWILGQKIGGHLSLRVQKLDVRCETKTKDNVFVTVIASVQYRAILEKAVDAFYKLSNTREQIQAYVFDVIRATVPKMNLDDFFEQKNHVAKAVEQELEKVMTNYGFEIVQTLIVDIEPDETVKRAMNEINAAARMRVATKDKAEAEKILQIKRAEGEAEAKYLSGLGIARQRQAIVDGLRDSVIAFSDNVPGTTAREVMDMVLVTQYFDTMKEIGASSKSSAVFIPHGPGAVSDVAEQIRNGLLQAQAH

SEQ ID NO: 8336 - protein, 291 aa, Cannabis sativa
MGNLLCCIKVDQSTVAVKERFGKFTEVLEPGCHCLPWILGSQLAGHLSLRLQQLDVRCETKTKDNVFVNVVASVQYRVIIDKASEAYYKLSNPRTQIQAYVFDVIRASVPKLNLDDVFEQKNEIARAVEDELEKAMCAYGYEIVQTLIIDIEPDEHVKRSMNEINAAARMRLATNERAEAEKIIQIKRAEGEAESKYLSGVGIARQRQAIVDGLRESVVGFSLNVPGTTAKDVLDMVLLTQYFDTMKEIGATSKSSTVFIPHGPGVVRDVATQIRDGLLQATSTSSPHSHS

SEQ ID NO: 8337 - protein, 232 aa, Vigna unguiculata
MGLALGCLQVEQSTVAIKEIFGKYDDVLQPGFHCVPWFFGTQIAGYLSLRVQQLDVRCETKTKDNVFVTVVASIQYRALAEKADDAFYKLSNTREQIQAYVFDVIRACVPKMDLDASFEQKKEIARAVEEELEKAMSAYGYEIVQTLIVDIEPDERVKRAMNEINAAARLRVAANEKAEAEKILQIKKAEGEAESKYLAGLGIARQRQAIVDGLRDSVLAFSENVPGTSSKM

SEQ ID NO: 8338 - protein, 286 aa, Podocarpus macrophillus
MGQLLCCCIQVEQSNVAMKERFGRYEEVLEPGCHCLPWFLGSQVGGYLSLRVQKLDVRCETKTKDNVFVTVIASVQYRALLEKASDAFYKLSNTREQIQAYVFDVIRSSVPKMNLDDVFEQKNEVAKAVEEELEKAMSTYGFEIVQTLIVDIEPDETVKRAMNEINAAARMRVATRDKAEAEKILQIKRAEAEAESKYLSGVGIARQRQAIVDGLRDSVLAFSVNVPGTTAKDVMDMVLVTQYFDTMKEIGASSKSSSVFIPHGPGAVRDVAEQIRDGLLQASQIH

SEQ ID NO: 8339 - protein, 284 aa, Hordeum vulgare
MGGVLGLVQVDQSTVAVKETFGKFNEVLEPGCHFLPWCIGQRIVGYLSLRVKQLDVRCETKTKDNVFVTVVASVQYRALVDKASDAFYKLSNTKQQIQSYVFDVIRATVPKLELDDAFVQKDDIAKAVEQELEKAMSMYGYEIVQTLIVDIEPDVHVKRAMNEINAASRMRSAANDKAEAEKILQIKRAEGEAESKYLAGVGIARQRQAIVDGLRDSVLAFSENVPGTTAKDIMDMVLVTQYFDTMKEIGASSKSSSVFIPHGPGAVKDVASQIRDGLLQANTL

SEQ ID NO: 8340 - protein, 286 aa, Cirsium arvense
MGQSLGCIQVQQSTVAVKEHFGKFDDVLQPGCHCLPWCLGYRLAGKLSLRVNQIDVRCETKTKDNVFVTMVASIQYRALSDKAADAFYKLSNTKQQIQAYVFDVIRASVPKLQLDDVFLQKNDIAKGVEEELEKAMSGYGFEIVQTLIVDIEPDPHVKRSMNEINAASRMRVATNEKAEAEKILQIKRAEGEAESKYLSGLGIARQRQAIVDGLRDSVLAFSDNVPGTSAKDVMDMVLLTQYFDTMKEIGASSKSSAVFLPHGPGAVKDIASQIREGLLQAESVHE

SEQ ID NO: 8341 - protein, 79 aa, Cleome spinosa
MGQAFGCIQVDQSKVAIKETFGKYDEVLEPGCHCLPWCLGSQVAGYLSLRVQQLDVRCETKTRICFCHGGCFHSIPSLS

SEQ ID NO: 8342 - protein, 260 aa, Gerbera hybrid cultivar
GCHCVPWIFGSQLAGHLTLRLQQLDVKCETKTKDNVFVNVVASIQYRALADKASDAFYKLSNTRSQIQAYVFDVIRASVPKLNLDDAFEQKNEIAKAVEEELEKAMSAYGYEIVQTLIVDIEPDEHVKRAMNEINAAARLRMAATEKAEAEKILQIKRAEGEAESKYLSGLGIARQRQAIVDGLRDSVLGFSVNVPGTTAKDVMDMVLVTQYFDTMKEIGAASKSSAVFIPHGPGAVRDVANQIRDGVLQGSATTRFSGI

SEQ ID NO: 8343 - protein, 284 aa, Zea mays
MGQILGLVQVDQSTVAIKENFGKFSEVLEPGCHFLPWCIGQQIAGYLSLRVRQLDVRCETKTKDNVFVTVVASVQYRALADKASDAFYKLSNTREQIQSYVFDVIRATVPKLGLDDAFEQKNEIAKAVEEELEKAMSTYGYQIVQTLIVDIEPDDRVKRAMNEINAAARMRVAASEKAEAEKILQIKKAEGEAESKYLAGVGIARQRQAIVDGLRDSVLAFSENVPGTTAKDIMDMVLVTQYFDTMREIGASSKSSSVFIPHGPGAVKDVSAQIRDGLLQANLH

SEQ ID NO: 8344 - protein, 285 aa, Elaeis guineensis
MGQVFGCIQVDQSTVAIKESFGKFDDVLDPGCHFLPWCLGSRVAGYLSLRVQQLDIRCETKTKDNVFVTVVASIQYKAMSDKAVDAFYKLSNKKEQIQSYVFDVIRASVPKLNLDDVFEQKNDIAKSVEDELEKAMSTYGYKIVQTLIVDIEPDVHVKRAMNEINAAARMRVAANEKAEAEKILQIKRAEGDAESKYLAGLGMARQRQAIVDGLRDSVLAFSGNVPGTTAKDVLDMILVTQYFDTMKEIGAHSKSSAVFIPHGPGAVNDIASQVRDGFLQAKTTP

SEQ ID NO: 8345 - protein, 213 aa, Secale cereale
MGGVLGLIQIDQSTVAIKETFGKFDAILQPGCHCLPWCLGQQIAGYLSLRVQQLDVRCETKTKDNVFVNVVASVQYRALADKASDAFYRLSNTREQIQSYVFDVIRASVPKMNLDDVFEQKNEIARAVEDELEKAMSAYGYEIVQTLIVDIEPDEHVKRAMNEINAAARMRLAATEKAEAEKILQIKRAEGEAESKYLAGVGIARQREPIVDG

SEQ ID NO: 8346 - protein, 79 aa, Secale cereale
MSMYGYEIVQTLIVDIEPDVHVKRAMNEINAAARMRSAANDKAEAEKILQIKRAEGEAESKYLAGVGIARQRRSVSWMV

SEQ ID NO: 8347 - protein, 286 aa, Phaseolus coccineus
MGLALGCLQVEQSTVAIKEVFGKYDDVLEPGFHCVPWFFGTQIAGYLSLRVQQLDVHCETKTKDNVFVTVVASIQYRALAEKAVDAFYKLSNTREQIQAYVFDVIRACVPKMDLDSSFEQKKEIARAVEEELEKAMSAYGYEIVQTLIVDIEPDERVKRAMNEINAAARLRVAANEKAEAEKILQIKKAEGDAESKYLAGLGIARQRQAIVDGLRDSVLAFSENVPGTSSKDVMDMVLVTQYFDTLKEIGASSKSNSVFVPHGPGAVRDIASQCRDGLLQGSMARS

SEQ ID NO: 8348 - protein, 286 aa, Amsonia hubrichtii
MGQTLGCIQVDQSTVAVKEHFGKFNKVLEPGCHCLPWCLGYKLAGSLSLRVQQLDVRCETKTKDNVFVTVVASIQYCALARKAADAYYKLTNTRAQIQSYVFDVIRASVPRLELDSVFVQKNEIAKAVEEELEKAMSTYGFEIVQTLIVDIEPDVHVKRAMNEINAAARMRVAANEKAEAEKILQIKKAEGEAESKFLSGLGIARQREAIVDGLRDSVLSFSENVPGTSAKDVMDMVLVTQYFDTMKEIGASSKSSAVFVPHGPGAVRDIATQIRNGLLQAESASY

SEQ ID NO: 8349 - protein, 285 aa, Brassica napus
MGQVLGCVQVDQSTVAIKETFGKFDDVLQPGCHCMPWCLGSQVAGHLSLRVQQLDVRCETKTKDNVFVTVVASIQYRALAESAQDAFYKLSNTRNQIQAYVFDVIRASVPKLDLDSTFEQKNDIAKTVESELEKAMSHYGYEIVQTLIVDIEPDVHVKKAMNEINAASRMREAASEKAEAEKILQIKRAEGEAESKYLSGLGIARQRQAIVDGLRNSVLAFSESVPGTSSKDVMDMVLVTQYFDTLKDIGASSKSNAVLIPHGPGAVKDIASQIRDGLLQGKAAE

SEQ ID NO: 8350 - protein, 284 aa, Festuca arundinacea
MGQALGLIQIDQSTVAIKETFGKFNAILEPGCHCLPWCIGQQIAGYLSLRVQQLDVKCETKTKDNVFVNVVASVQYRALADKASDAFYKLSNTREQIQSYVFDVIRASVPKMILDDVFEQKNEIAKAVENELEKAMSAYGYEIVQTLIVDIEPDVNVKRAMNEINAAARMRLAATEKAEAEKILQIKRAEGDAESKYLAGLGIARQRQAIVDGLRDSVLAFSENVPGTSSKDVMDMVLVTQYFDTMKDIGASSKSSAVFIPHGPGAVKDIAAQIRDGQLQGRMV

SEQ ID NO: 8351 - protein, 286 aa, Cajanus cajan
MGQVFGCVQVDQSSVAIKEGFGKYNDVLDPGCHCVPWCFGSRVAGALSLRVKQLDVRCETKTKDNVFVTVVASIQYRVLAEKAVDAYYKLSNTSAQIQSYVFDVIRASVPRMELDATFEQKNDIAKAVEEELEKAMSAYGYEIVQTLIVDIEPDEHVKKAMNEINAAARLRVAANEKAEAEKILQIKRAEGDAESKYLAGLGVARQRQAIVDGLRDSVLAFSENVPGTTSKDIMDMVLMTQYFDTMKDIGASSKSNAVFIPHGPGAVNDVASQIRDGLLQGNATLS

SEQ ID NO: 8352 - protein, 287 aa, Pseudotsuga menziesii
MGQLCCCIQVEQSQVAMKETFGRFNEVLEPGCHCLPWIFGQNIGGHLSLRVQKLDVRCETKTKDNVFVTVIASVQYRAILEKAVDAFYKLSNTREQIQAYVFDVIRASVPKMNLDEFFEQKNHVAKAVEQELEKVMTNYGFQIVQTLIVDIEPDETVKRAMNEINAAARMRVATKDKAEAEKILQIKRAEGEAEAKYLSGLGIARQRQAIVDGLRDSVLAFSDNVPGTTAREVMDMVLVTQYFDTMKEIGASSKSSAVFIPHGPGAVRDVAEQIRTGLLQAQAHQTS

SEQ ID NO: 8353 - protein, 284 aa, Secale cereale
MGGVLGLVQVDQSTVAIKETFGKFNEVLEPGCHFLPWCIGQRIVGYLSLRVKQLDVRCETKTKDNVFVTVVASVQYRALVDKASDAFYKLSNTKQQIQSYVFDVIRATVPKLELDDAFVQKDDIAKAVEEELEKAMSMYGYEIVQTLIVDIEPDVHVKRAMNEINAAARMRSAANDKAEAEKILQIKRAEGEAESKYLAGVGIARQRQAIVDGLRDSVLAFSENVPGTTAKDIMDMVLVTQYFDTMKEIGASSKSSSVFIPHGPGAVKDVASQIRDGLLQANTL

SEQ ID NO: 8354 - protein, 322 aa, Abies balsamea
MASKETVCVTGASGFIGSWIVRLLLERGYSVQGTVQDLGNEKETKHLVAMEGAKERLKLFQIDLLDYGSIEAAINGSVGVFHLASPCIVEEVKDPQSQLLDPAVKGTMHVLQAAQKAKVRRLVLTSSISAIIPSPNWPSDVPKDENCWTDLDYCKQNGIWYPASKTLAEKAAWDFAKEVGLDVVVINPGTVMGPILPPAINASMGMLLHLLQGGTDGYQNFCMGFVHVKDVAEGHILLYETPSASGRHLCVEAITHWSDFAETVAKLYPEYKIHRFTEVTQPGLLRVQNGAKKLIDLGLVFTPMEQIIKDSVSSLKEKGFFN

SEQ ID NO: 8355 - protein, 406 aa, Setaria italica
MAAAPQHVRAAPLARALRARATATATATAAAAPPKSQSQGVTSRRALLGLSEPELRQLALDLGQQSYRGKQLHDLLYKSRASQIQDFNYVPKAFREALLGAGWTVGRSPVHHAVTASDGTTKILLKLEDNRLIETVGIPVDDDSKGSSRLTACVSSQVGCPLRCSFCATGKGGFARNLRPHEIVEQVLAIEEMFKHRVTNVVFMGMGEPMLNLKSVLEAHRCFNKELKIGQRMMTISTVGVPNTIKMLASHKLQSTLAVSLHAPNQKLRETIVPSAKSYPLGALMDDCKSYFLETGRRVSFEYTLLAGINDEKEHAEELAELLHTCGGGYHVNLIPYNPIEGSEYKRPYRKVVQAFVDALEARKITVSVRQTRGLDANAACGQLRNEFQKNPLLESSPSEPSLVPA

SEQ ID NO: 8356 - protein, 412 aa, Zea mays
MAAPQHVRAAPLARALRATATATATATASVPVPVPVPAGIKSQGTSRRALLGLSEPQLRQLAIDLGQQSYRGKQLHDLLYKSRAKQIQEFNHVPKAFREALLGAGWSVGRSPVHHAVTASDGTTKILLKLEDNRLIETVGIPVDDDNKGSSRLTACVSSQVGCPLRCSFCATGKGGFARNLQPHEIVEQVLAIEETFKHRVTNVVFMGMGEPMMNLKSVLEAHQCFNKELKIGQRMMTISTVGVPNTIKMLASHKLQSTLAVSLHAPNQKLRETIVPSAKSYPLGALMDDCKSYFLETGRRVSFEYTLLAGINDEKEHAEELAELLRMCGGGYHVNLIPYNPIEGSEYKRPYRKVVQAFVDALEARKITVSVRRTRGLDANAACGQLRNEFQKNPLLEIEPSPSTERTLVAA

SEQ ID NO: 8357 - protein, 216 aa, Triticum aestivum
MGMGEPMLNLKAVLEAHQCLNKELKIGQRMMTISTVGVPNTISKLASHKLQSTLAVSLHAPNQRLRETIVPSAKAYPLEALMDDCKNYFLETGRRVSFEYTLLAGINDEKAHAEELAALLHACGGGYHVNLIPYNPVEGSEYKRPYRKAIQAFVDALESRKITVSVRQTRGLDANAACGQLRNEFQKNPLLESSPPSEPNQLLESSTPSESSLVPA

SEQ ID NO: 8358 - protein, 588 aa, Brachypodium distachyon
MAFVGGGAAAAAALAVAFLLPLLAAASDSDHKYQEEDPVTLWVNKVGPYNNPQETYNYYSLPFCHKSDNPVHKWGGLGEVLGGNELIDSQIDIKFRKNVDKDTICSMELDPDKAKQLSDAIENSYWFEFFIDDLPLWGFVGEADKNNDNKYFLFTHKNILIRYNGNQIIHVNLTQESPKLIDAGKALDMTYSVKWEPTNVMFAHRFDVYLDYPFFEHQIHWFSIFNSFMMVIFLSGLVSMILMRTLRNDYAKYARDDDDLETLERDVNEESGWKLVHGDVFRPPRSLALLSALVGIGTQLSALILLVILLAIIGMLYIGRGAIVTTFIVCYALTSFISGYVSGALYSRHGGKNWIKSMIMTASLFPFMCFGIGLALNTVAIFYRSLAAIPFGTMVVMFILWAFISFPLALLGTVVGRNWSGAPNNPCRVKTIPRPIPEKKWYLTPSVIALMGGLLPFGSIFIEMYFVFTSFWNYKVYYVYGFMLLVFLILLIVTICVTIVGTYFLLNAENYHWQWTSFFSAASTAVYVYLYSIYYYNVKTKMSGFFQTSFYFGYTLMFCLGLGTLCGAVGYLGSTLFVRRIYRNIKCD

SEQ ID NO: 8359 - protein, 585 aa, Setaria italica
MASAGGAALAALALLVLLPVAAASDSDHKYQADEPVTLWVNKVGPYNNPQETYNYYSLPFCHATENHVHKWGGLGEVLGGNELIDSQIDIKFRKNVDKATICSLDLDLDKAKQLSDAIENLYWFEFFIDDLPLWGFVGEADRNNDNKYFLFTHKNIVIRYNGNQIIHVNLTQESPKLIDANKAMDMTYSVKWEPTNITFAHRFDVYLDYPFFEHQIHWFSIFNSFMMVIFLTGLVSMILMRTLRNDYAKYARDDDDIETLERDVNEESGWKLVHGDVFRPPRNLVLLSSLVGIGTQLAALILLVILLAIIGMLYIGRGAIVTTFIVCYALTSFISGYVSGALYSRHGGKNWIKAMAMTASLFPFMCFGIGLVLNTIAIFYGSLAAIPFGTMVVVFILWAFISFPLALLGTVVGRNWSGAPNNPCRVKTIPRPIPEKKWYLTPSVIALMGGLLPFGSIFIEMYFVFTSFWNYKVYYVYGFMLLVFLILIIVTICVTIVGTYFLLNAENYHWQWTSFFSAASTAVYVYLYSIYYYHMKTKMSGFFQTSFYFGYTLMFCLGLGTLCGAVGYLGSTLFVRRIYRNIKCD

SEQ ID NO: 8360 - protein, 585 aa, Sorghum bicolor
MASAAGAASAAIALLILLPLAAASDSDHKYQAEEPVTLWVNKVGPYNNPQETYNYYSLPFCHASENHVHKWGGLGEVLGGNELIDSQIDIKFRKNVDKATICSLDLDLVKAKQLSDAIENSYWFEFFIDDLPLWGFVGEADRNNDNKYFLFTHKNIVIRYNGNQIIHVNLTQESPKLIDVNKALDMTYSVKWEPTDITFAHRFDVYLDYPFFEHQIHWFSIFNSFMMVIFLTGLVSMILMRTLRNDYAKYARDDDDIETLERDVNEESGWKLVHGDVFRPPCNLVLLSALVGIGTQLAALILLVILLAIIGMLYIGRGAIVTTFIVCYALTSFISGYVSGALYSRHGGKNWIKAMAMTASLFPFMCFGIGLGLNTIAIFYGSLAAIPFGTMVVVFILWAFISFPLALLGTVVGRNWSGAPNNPCRVKTIPRPIPEKKWYLTPSVIALMGGLLPFGSIFIEMYFVFTSFWNYKVYYVYGFMLLVFLILIIVTICVTIVGTYFLLNAENYHWQWTSFFSAASTAVYVYLYSIYYYHMKTKMSGFFQTSFYFGYTLMFCLGLGTLCGAVGYLGSTLFVRRIYRNIKCD

SEQ ID NO: 8361 - protein, 582 aa, Panicum virgatum
MASAGVAALALLVLLPVAAASDSDHKYRADEPVTLWVNKVGPYNNPQETYNYYSLPFCHATENHVHKWGGLGEVLGGNELIDSQIDIKFRKNVDKGTICSLDLDADRAKQLSDAIENSYWFEFFIDDLPLWGFVGEADRNNDNKYFLFTHKNIVIRYNGNQIIHVNLTQESPKLIDANKAMDMTYSVKWEPTNITFAHRFDVYLDYPFFEHQIHWFSIFNSFMMVIFLTGLVSMILMRTLRNDYAKYARDDDDIETLERDVNEESGWKLVHGDVFRPPRNLVLLSSLVGIGTQLAALILLVILLAIIGMLYVGRGAIVTTFIVCYALTSFISGYVSGALYSRHGGKNWIKAMAMTASFFPFMCFGIGLVLNTIAIFYGSLAAIPFGTMVVVFILWAFISFPLALSGTVVGRNWSGTPNNPCRVKTIPRPIPEKKWYLTPSVIALMGGLLPFGSIFIEMYFVFTSFWNYKVYYVYGFMLLVFLILIVVTICVTIVGTYFLLNAENYHWQWTSFFSAASTAVYVYLYSLYYYHMKTKMSGFFQTSFYFGYTLMFCLGLGTLCGAVGYLGSTLFVRRIYRNIKCD

SEQ ID NO: 8362 - protein, 582 aa, Zea mays
MASAAGAAFAAITLLILVPLTAASDSDHKYQAAEPVTLWVNKVGPYNNPQETYNYYSLPFCHASENHVHKWGGLGEVLGGNELIDSQIDIKFGKNVDKATICSLDLDLVKAKQLSDAIENSYWFEFFIGFVGEADRNNDNKYFLFTHKNIVIRYNGNQIIHVNLTQESPKLIDVNKALDMTYSVKWEPTNITFAHRFDVYLDYPFFEHQIHWFSIFNSFMMVIFLTGLVSMILMRTLRNDYAKYARDDDDIETLERDVNEESGWKLVHGDVFRPPCNLVLLSALVGIGTQLAALILLVILLAIIGMLYIGRGAIVTTFIVCYALTSFISGYVSGALYSRHGGGAGKNWIKAMAMTASLFPFMCFGIGLVLNTIAIFYGSLAAIPFGTMVVVFILWAFISFPLALLGTVVGRNWSGAPNNPCRVKTIPRPIPEKKWYLTPSVIALMGGLLPFGSIFIEMYFVFTSFWNYKVYYVYGFMLLVFLILIIVTICVTIVGTYFLLNAENYHWQWTSFFSAASTAVYVYLYSIYYYHMKTKMSGFFQTSFYFGYTLMFCLGLGTLCGAVGYLGSTLFVRRIYRNIKCD

SEQ ID NO: 8363 - protein, 565 aa, Panicum virgatum
PDHRCCFLQYQADEPVTLWVNKVGPYNNPQETYNYYSLPFCHATENHVHKWGGLGEVLGGNELIDSQIDMKFRKNVDKGTICSLDLDPDKAKQLSDAIENSYWFEFFIDDLPLWGFVGEADRNNDNKYFLFTHKNIVIRYNGNQIIHVNLTQESPKLIDANKAMDMTYSVKWEPTNITFAHRFDVYLDYPFFEHQIHWFSIFNSFMMVIFLTGLVSMILMRTLRNDYAKYARDDDDIETLERDVNEESGWKLVHGDVFRPPRNLVLLSSLVGIGTQLAALILLVILLAIIGMLYIGRGAIVTTFIVCYALTSFISGYVSGALYSRHGGKNWIKAMAMTASLFPFMCFGIGLALNTIAIFYGSLAAIPFGTMVVVFILWAFISFPLALLGTVVGRNWSGAPNNPCRVKTIPRPVPEKKWYLTPSVIALMGGLLPFGSIFIEMYFVFTSFWNYKVYYVYGFMLLVFLILIIVTICVTIVGTYFLLNAENYHWQWTSFFSAASTAVYVYLYSIYYYHMKTKMSGFFQTSFYFGYTLMFCLGLGTLCGAVGYLGSTLFVRRIYRNIKCD

SEQ ID NO: 8364 - protein, 586 aa, Panicum virgatum
MLRRGVLLLAAVLLAVARPPHAYASEADHKYKTEEPVKLWVNKVGPYNNPQETYNYYSLPFCQPSENPTHKWGGLGEVLGGNELIDSQIDIKFLKNVDKGPICTIDLDAQKVQQFSDAIESSYWFELFIDDLPLWGFVGETDKNNENKHYLYTHKNIVVKYNGNRIIHVNLTQESPKLLEAGKKLDMTYSVKWVQTNVAFARRFEVYLDYPFFEHQIHWFSIFNSFMMVIFLTGLVSMILMRTLRNDYAKYAREDDDLESLERDVNEESGWKLVHGDVFRPPRGLVFLSALVGIGTQLAALILLVIVLAIVGMLYVGRGAIITTFIVCYALTSFISGYVSGGLYSRNGGKNWIKSMILTASLFPFLCFSIGLVLNTIAIFYRSLAAIPFGTMVVIFVLWAFISFPLVLLGTVVGRNWSGAPNNPCRVKTIPRPIPEKKWYLTPSVISLMGGLLPFGSIFIEMYFVFTSFWNYKVYYVYGFMLLVFVILIIVTICVTIVGTYFLLNAENYHWQWTSFFSAASTALYVYLYSIYYYHVKTKMSGFFQTSFYFGYTLMFCLGLGILCGAVGYVGSTLFVRRIYRNIKCD

SEQ ID NO: 8365 - protein, 586 aa, Setaria italica
MLRRGVLLLVAVLLAVARLPHAYASEADHKYKAEEPVKLWVNKVGPYNNPQETYNYYSLPFCQPSENPTHKWGGLGEVLGGNELIDSQIDIKFLKNVDKGLICTIELDAQKVRQFSDAIESSYWFELFIDDLPLWGFVGETDKNNENKHYLYTHKNIVVKYNGNRIIHVNLTQESPKLLEAGKKLDMTYSVKWVQTNVAFARRFEVYLDYPFFEHQIHWFSIFNSFMMVIFLTGLVSMILMRTLRNDYAKYAREDDDLESLERDVNEESGWKLVHGDVFRPPRGLVFLSAFVGIGTQLAALILLVIVLAIVGMLYVGRGAIITTFIVCYALTSFISGYVSGGLYSRNGGKNWIKSMILTASLFPFLCFSIGLVLNTIAIFYRSLAAIPFGTMVVIFVLWAFISFPLVLLGTVVGRNWSGAPNNPCRVKTIPRPIPEKKWYLTPSVISLMGGLLPFGSIFIEMYFVFTSFWNYKVYYVYGFMLLVFVILIIVTICVTIVGTYFLLNAENYHWQWTSFFSAASTALYVYLYSIYYYHVKTKMSGFFQTSFYFGYTLMFCLGLGILCGAVGYLGSTLFVRRIYRNIKCD

SEQ ID NO: 8366 - protein, 590 aa, Sorghum bicolor
MLRRGVLLQAAVHLLLLLAVARSPLAYASEADHKYKTEEPVKLWVNKVGPYNNPQETYNYYSLPFCQPSENPSHKWGGLGEVLGGNELIDSQIDIKFIKNVDKGAICTIELDAQKVEQFANAIENSYWFELFIDDLPLWGFVGETDKNNENKHYLYTHKNIVVKYNGNRIIHVNLTQESPKLLVAGKKLDMTYSVKWVQTNVAFARRFEVYLDYPFFEHQIHWFSIFNSFMMVIFLTGLVSMILMRTLRNDYAKYAREDDDLESLERDVSEESGWKLVHGDVFRPPRSLVFLSALVGIGTQLAALILLVIVLAIVGMLYVGRGAIITTFIVCYALTSFISGYVSGGLYSRNGGKTWIKAMVLTASLFPFLCFSIGLVLNTIAIFYRSLAAIPFGTMVVMFVLWAFISFPLVLLGTVVGRNWSGAPNNPCRVKTIPRPIPEKKWYLTPSVISLMGGLLPFGSIFIEMYFVFTSFWNYKVYYVYGFMLLVFVILIIVTICVTIVGTYFLLNAENYHWQWTSFFSAASTALYVYLYSIYYYHVKTKMSGFFQTSFYFGYTLMFCLGLGILCGAVGYLGSTLFVRRIYRNIKCD

SEQ ID NO: 8367 - protein, 586 aa, Panicum virgatum
MLSRGVLLLAAILLTVARLPHAYASEADHKYKTEEPVKLWVNKVGPYNNPQETYNYYSLPFCQPSENPTHKWGGLGEVLGGNELIDSQIDIKFLKNVDKGPICTIDLDAQKVQQFSDAIESSYWFELFIDDLPLWGFVGETDKNNENKHYLYTHKNIVVKYNGNRIIHVNLTQESPKLLEAGKKLDMTYSVKWVQTNVAFARRFEVYLDYPFFEHQIHWFSIFNSFMMVIFLTGLVSMILMRTLRNDYAKYAREDDDLESLERDVNEESGWKLVHGDVFRPPRGLVFLSALVGIGTQLAALILLVIVLAIVGMLYVGRGAIITTFIVCYALTSFISGYVSGGLYSRNGGKNWIKSMILTASLFPFLCFSIGLVLNTIAIFYRSLAAIPFGTMVVIFVLWAFISFPLVLLGTVVGRNWSGAPNNPCRVKTIPRPIPEKKWYLTPSVISLMGGLLPFGSIFIEMYFVFTSFWNYKVYYVYGFMLLVFVILIIVTICVTIVGTYFLLNAENYHWQWTSFFSAASTALYVYLYSIYYYHVKTKMSGFFQTSFYFGYTLMFCLGLGILCGAVGYMGSTLFVRRIYRNIKCD

SEQ ID NO: 8368 - protein, 591 aa, Musa acuminata
MLSGARSLSSLPAAFHLFLLLFLAASASASESDHKYQAEDPVTLWVNKVGPYNNPQETYNYYSLPFCHPSKNLAHKWGGLGEVLGGNELIDSQIQIKFQRNVEKGSICALELDDAKVAQFTSAIENSYWFEFFIDDLPLWGFVGESDKNNKDKHYLYTHKNIVIQHNGNQIIHVNLTQESPKLLEVGMKLDMTYSVKWLPTDVAFSRRFEVYLDYPFFEHQIHWFSIFNSFMMVIFLTGLVSMILMRTLRNDYAKYAREDDDLETLERDVSEESGWKLVHGDVFRPPRRLVLISALVGTGAQLAMLVLLVILLAIIGTLYIGRGAIVTTFIVCYALTSFISGYVSGGLYSRNGGKSWIKAMILAASLFPFLCFGIGFMLNTIAIFYGSLAAIPFGTMVVVFILWAFISFPLTLLGTVVGRNWSGAPNNPCRVKTIPRPIPEKKWYLTPSVVSLMGGLLPFGSIFIEMYFVFTSFWNYKVYYVYGFMLLVFLILIIVTICVTIVGTYFLLNAENYHWQWTSFLSAASTAVYVYLYSVYYYYVKTKMSGFFQTSFYFGYTLMFCLGLGILCGAVGYLGSTLFVRRIYRNIKCD

SEQ ID NO: 8369 - protein, 587 aa, Musa acuminata
MLSGARSRPSLSAAFLVVLAVSAFASESDHKYQAEEPVTLWVNKVGPYNNPQETYNYHSLPFCQPSENPAHKWSGLGEVLGGNELIDSQFQIKFQRNVDRGSICTIELDATKVKQFADAIENSYWFEFFIDDLPMWGFVGETDKNNKDKRYLFTHKNIIIQHNEYQIIHVNLTQESPKLLEAGKRLDMTYSVKWLPTNVTFARRFEVYLDYPFFEHQIHWFSIFNSFMMVIFLTGLVSMILMRTLRNDYAKYAREDDDLETLERDVSEESGWKLVHGDVFRPARTLVLLSSLIGTGAQLAMLVLLVILLAIIGTLYIGRGSITTTFIVCYALTSFISGYVSGGLYSRNGGKHWIKSMIVTASLFPFMCFGIGFILNTIAIFYGSLAAIPFGTIVVVFILWAFISFPLALLGTVVGRNWSGSPNNPCRVKTIPRPIPEKKWYLTPSVVSLMGGLLPFGSIFIEMYFVFTSFWNYKVYYVYGFMLLVFLILIIVTICVTIVGTYFLLNAENYHWQWTSFFSAASTAVYVFLYSIYYYYVKTKMSGFFQTSFYFGYTLMFCLGLGILCGAVGYLGSTLFVRRIYRNIKCD

SEQ ID NO: 8370 - protein, 586 aa, Elaeis guineensis
MHSATRSLLPLLALLLLLVAGAVASEFDHKYKADDPVTLWVNKVGPYNNPQETYNYYSLPFCQPSENPAHKWGGLGEVLGGNELIDSQIEMKFQRNVEKGSICALELDAAKVKHFTDAIVNSYWLEFFIDDLPLWGFVGETDKNNENKHFLFTHKSIVIRYNNSQIIHVNLTQESPKLLEAGKTLDMTYSVKWSPTDVTFARRFDVYLDYPFFEHQIHWFSIFNSFMMVIFLTGLVSMILMRTLRNDYAKYAREDDDLETLERDVSEESGWKLVHGDVFRPPQSLVLLSALVGTGAQLAMLVLLVIVLAIIGMLYIGRGAIVTTFIVCYALTSFISGYVSGGLYSRNGGKNWIKSMILSASLFPFMCFGIGFLLNTIAIFYGSLAAIPFGTMVVVFILWAFISFPLALLGTVVGRNWSGSPNNPCRVKTIPRPIPEKKWYLTPSVVSLMGGLLPFGSIFIEMYFVFTSFWNYKVYYVYGFMLLVFLILIIVTVCVTIVGTYFLLNAENYHWQWTSFFSAASTAVYVYLYSIYYYNVKTKMSGFFQTSFYFGYTLMFCLGLGILCGAVGYLGSTLFVRRIYRNIKCD

SEQ ID NO: 8371 - protein, 593 aa, Oryza sativa
MHRRGGHHLHLLLAAAVVLLLTVAGLPLASASESDHKYKAEETVKLWVNKVGPYNNPQETYNYYSLPFCQPSENPAHKWGGLGEVLGGNELIDSQVDIKFLKNVEKGPICTIELDDNKIQQFTDAIERSYWFELFIDDLPLWGFVGETDKNNENKHYLYTHKNIVVKYNGNRIIHVNLTQESPKLLEAGKKLDMTYSVKWVQTNVAFARRFEVYLDYPFFEHQIHWFSIFNSFMMVIFLTGLVSMILMRTLRNDYAKYAREDDDLESLERDVSEESGWKLVHGDVFRPPRSLVFLSAFVGIGTQLAALILLVIVLAIVGMLYVGRGAIITTFIVCYALTSFISGYVSGGLYSRNGGKNWIKSMILTASLFPFLCFSIGLVLNTIAIFYRSLAAIPFGTMVVIFVLWAFISFPLVLLGTVVGRNWSGAPNNPCRVKTIPRPIPEKKWYLTPSVISLMGGLLPFGSIFIEMYFVFTSFWNYKVYYVYGFMLLVFVILIIVTICVTIVGTYFLLNAENYHWQWTSFFSAASTALYVYLYSIYYYHVKTKMSGFFQTSFYFGYTLMFCLGLGILCGAVGYLGSTLFVRRIYRNIKCD

SEQ ID NO: 8372 - protein, 588 aa, Musa acuminata
MPPGARSLPYLSAAFLLFLLVASASASESDHKYQAEDPVTLWVNKVGPYNNPQETYNYYSLPFCQPSENPAHKWSGLGEVLGGNELIDSHIPIKFQRNVDKGSICTIELDATKVKQFIDAIDNSYWFEFFIDDLPLWGFVGETDKNNKDKHYLFTHKDIVIQHKGYQIIHVNLTQASPKLLEVGKKLDMTYSVKWLPTNVTFARRFEVYLDYPFFEHQIHWFSIFNSFMMVIFLTGLVSMILMRTLRNDYAKYAREDDDLETLERDVSEESGWKLVHGDVFRPPRSLVLLSTLVGTGAQLAMLVLLVIVLAIVGTLYIGRGSIITTFIVCYALTSFIAGYVSGGLYSRNGGKNWIKAMIVTASLFPFMCFAIGFVLNTIAIFYGSLAAIPFGTMMVVFVLWAFISFPLALLGTVVGRNWSGSPNNPCRVKTIPRPIPEKKWYLTPFVVSLMGGLLPFGSIFIEMYFVFTSFWNYKVYYVYGFMLLVFLILIIVTICVTIVGTYFLLNAENYHWQWTSFFSAASTAVYVYLYSIYYYHVKTKMSGFFQTSFYFGYTLMFCLGLGILCGAVGYLGSTLFVRRIYRNIKCD

SEQ ID NO: 8373 - protein, 592 aa, Gossypium hirsutum
MSSSVFSAVRSFSLFAFLFLFLSPALASESDHKYQSDDPVTLWVNKVGPYNNPQETYNYYSLPFCHPGTNPAHKWGGLGEVLGGNELIDSQIDIKFQKNVDKSTICQLELDEAKVRQFKDAIENSYWFEFFMDDLPLWGFVGELHPDKNSDNGKHVLYTHKNIVIKYNKDQIIHVNLTQESPKPLEAGRVLDLTYSVKWLQTNVTFARRFDVYLDYPFFEHQIHWFSVFNSFMMVIFLTGLVSMILMRTLRNDYAKYAREDDDLESLERDVSEESGWKLVHGDVFRPPRYLALLSAVVGTGAQLAMLVLLVILLAIVGTLYVGRGAIVTTFILCYAFTSFISGYVSGGMYSRNGGKNWIKAMILTASLFPFMCFGIGFILNTIAIFYGSLAAIPFGTMVVVFVIWAFISFPLALLGTVVGRNWSGAPNNPCRVKTIPRPIPEKKWYLTPSVVSMMGGLLPFGSIFIEMYFVFTSFWNYKVYYVYGFMLLVFLILIIVTICVTIVGTYFLLNAENYHWQWTSFFSAASTAIYVYLYSVYYYHVKTKMSGFFQTSFYFGYTLMFCLGLGILCGAVGYLGSNLFVRRIYRNIKCD

SEQ ID NO: 8374 - protein, 586 aa, Zea mays
MLRRGVLLLAAILIAVAHSPLAYASEAEHKYKTEEPVKLWVNKVGPYNNPQETYNYYSLPFCQPSENPAHKWGGLGEVLGGNELIDSQIDIKFIKNVDKGAICTIELDVQKVQQFANAIENSYWFELFIDDLPLWGFVGETDKNNEKKHYLYTHKNIVVKYNGNRIIHVNLTQESPKLLEAGKKLDMTYSVKWVQTNVAFARRFEVYLDYPFFEHQIHWFSIFNSFMMVIFLTGLVSMILMRTLRNDYAKYAREDDDLESLERDVNEESGWKLVHGDVFRPPRGQVFLSALVGIGTQLAALILLVIVLAIVVMLYVGRGAIITTFIVCYALTSFISGYVSGGLYSRNGGKNWIKAMILTASLFPFLCFSIGLLLNTIAIFYRSLAAIPFGTMVVMFILWAFISFPLVLLGTVVGRNWSGAPNNPCRVKTIPRPIPEKKWYLTPSVISLMGGLLPFGSIFIEMYFVFTSFWNYKVYYVYGFMLLVFVILIIVTICVTIVGTYFLLNAENYHWQWTSFFSAASTALYVYLYSIYYYHVKTKMSGFFQTSFYFGYTLMFCLGLGILCGAVGYLGSTLFVRRIYRNIKCD

SEQ ID NO: 8375 - protein, 586 aa, Elaeis guineensis
MIATARSLALAAAVLLAAATAASASESDHKYQVDDPVTLWVNKVGPYNNPQETYNYYSLPFCQPSGNPAHKWGGLGEVLGGNELIDSQIEIKFQRNVDKRFICRLELDAAKVKQFKDAIQSSYWFEFFMDDLPLWGYVGEIDKKNENKLYLFTHSNILVQYNGERIIHVNLTQESPKLVEVGKTLDMTYSVKWMQTDVTFARRFDVYLDHPFFEHQIHWFSIFNSFMMVIFLTGLVSMILMRTLRKDYAKYAHEDDDLESLERDVNEESGWKLVHGDVFRPPRNLVLLSAVVGTGAQLALLVLLVILLAIIGMLYIGRGAIVTTFIVCYALTSFISGYVSGGLYSRSGGKNWIKSMILTASLFPFMCFGIGIVLNTIAIFYRSLAAIPFGTMVVVFIIWAFISFPLALLGTVVGRNWSGSPNNPCRVKTIPRPIPEKKWYLTPTVVSLMGGLLPFGSIFIEMYFVFTSFWNYKVYYVYGFMLLVFLILIIVTVCVTIVGTYFLLNAENYHWQWTSFFSAASTAVYVYLYSVYYYHVKTKMSGFFQTSFYFGYTLMFCLGLGILCGAVGYLGSNMFVRRIYRNIKCD

SEQ ID NO: 8376 - protein, 585 aa, Brachypodium distachyon
MRLLLVLVIAALLAVACTPLASASESDHKYKVDESVKLWVNKVGPYNNPQETYNYYSLPFCLPSENPAHKWGGLGEVLGGNELIDSQIDIKFLKHVEKGPICTIELDAKKVQQFTDAIESSYWFELFIDDLPLWGFVGETDKNNENKHYLYTHKNVVVKYNGNRIIHVNLTQESPKLLEAGKKLDMTYSVKWVQTNVAFARRFEVYLDYPFFEHQIHWFSIFNSFMMVIFLTGLVSMILMRTLRNDYAKYAREDDDLESLERDVSEESGWKLVHGDVFRPPRSLMFLSAVVGIGTQLAALIMLVIVLAIVGMLYVGRGAIITTFIVCYALTSFISGYVSGGLYSRNGGKNWIKSMILTASLFPFLCFSIGLVLNTIAIFYHSLAAIPFGTMVVIFVLWAFISFPLVLLGTVVGRNWSGAPNNPCRVKTIPRPIPEKKWYLTPSVISLMGGLLPFGSIFIEMYFVFTSFWNYKVYYVYGFMLLVFVILLIVTICVTIVGTYFLLNAENYHWQWTSFFSAASTALYVYLYAIYYYHVKTKMSGFFQTSFYFGYTLMFCLGLGILCGAIGYLGSTLFVRRIYRNIKCD

SEQ ID NO: 8377 - protein, 592 aa, Vitis vinifera
MASAVGSAALSLLALYLALLLLLSPASASDYDHKYQQNEPVTLWVNKVGPYNNPQETYNYYSLPFCRPPGKAVHKWIGLGELLGGNELIESQIDIKFQKNVDKGVICQLELDEAKVKQFKDAIENNYWLEFFVDDLPLWGFVGELHPDKNSDNKHVLFTHKNINITYNKNQIIHVNLSQENPKPMEAGRTLDMTYSVKWIPTTVTFARRFDVYLDYPFFEHQIHWFSIFNSFMMVIFLTGLVSMILMRTLRNDYAKYAREDDDLETLERDVSEESGWKLVHGDVFRPPPNLVLLSAVVGTGAQLALLVLLVILLAIVAMLYIGRGAIVTTFIVCYALTSFISGYVSGGMYSRNGGKTWIKSMILTASLFPFMCFGIGFLLNTIAIFYGSLAAIPFGTMVVVFFIWAFFSFPLALLGTVVGRNWSGAPNNPCRVKTIPRPIPEKKWYLTPSVVSMMGGLLPFGSIFIEMYFVFTSFWNYKVYYVYGFMLLVFLILIIVTVCVTIVGTYFLLNAENYHWQWTSFFSAASTAVYVYLYSIYYYYVKTKMSGFFQTSFYFGYTLMFCLGLGILCGAVGYLGSTLFVRRIYRNIKCD

SEQ ID NO: 8378 - protein, 589 aa, Prunus persica
MFSTVRSLSPFLVFAFLLLSPAFASEADHKYQTEEPVTLWVNKVGPYNNPQETYNYYSLPFCHPSENAAHKWGGLGEVLGGNELIDSQIDIKFQKNVDRATICQLELDDQKVKQFKDAIENSYWFEFFMDDLPLWSFVGELHQDKNSENGKHVLFTHKLIIVKYNKDQIIHVNLTQDSPRPLEAGKKLDLTYSVKWIPTTVTFARRFDVYLDYPFFEHQIHWFSIFNSFMMVIFLTGLVSMILMRTLRNDYAKYAREDDDLETLERDVSEESGWKLVHGDVFRPPRSLVILSAVVGTGAQLALLVLLVILLAIVGMLYVGRGAIVTTFIVCYALTSFISGYVSGGMYSRNGGKNWIKSMILTASLFPFMCFGIGFVLNTIAIFYGSLAAIPFGTMVVVFVIWAFISFPLALLGTVVGRNWSGAPNNPCRVKTIPRPIPEKKWYLTPSVVSMMGGLLPFGSIFIEMYFVFTSFWNYKVYYVYGFMLLVFLILIIVTVCVTIVGTYFLLNAENYHWQWTSFFSAASTAVYVYLYSIYYYYAKTKMSGFFQTSFYFGYTLMFCLGLGILCGAVGYLGSNLFVRRIYRNIKCD

SEQ ID NO: 8379 - protein, 589 aa, Prunus mume
MFSTVRSLSPLLVFALLLLSPAFASEADHKYQTEEPVTLWVNKVGPYNNPQETYNYYSLPFCHPSENAAHKWGGLGEVLGGNELIDSQIDIKFQKNVDRATICQLELDDQKVKQFKDAIENSYWFEFFMDDLPLWSFVGELHQDKNSENGKHVLFTHKNIIVKYNKDQIIHVNLTQDSPRPLEAGKKLDLTYSVKWIPTTVTFARRFDVYLDYPFFEHQIHWFSIFNSFMMVIFLTGLVSMILMRTLRNDYAKYAREDDDLETLERDVSEESGWKLVHGDVFRPPRSLVILSAVVGTGAQLALLVLLVILLAIVGMLYVGRGAIVTTFIVCYALTSFISGYVSGGMYSRNGGKNWIKSMILTASLFPFMCFGIGFVLNTIAIFYGSLAAIPFGTMVVVFVIWAFISFPLALLGTVVGRNWSGAPNNPCRVKTIPRPIPEKKWYLTPSVVSMMGGLLPFGSIFIEMYFVFTSFWNYKVYYVYGFMLLVFLILIIVTVCVTIVGTYFLLNAENYHWQWTSFFSAASTAVYVYLYSIYYYHAKTKMSGFFQTSFYFGYTLMFCLGLGILCGAVGYLGSNLFVRRIYRNIKCD

SEQ ID NO: 8380 - protein, 598 aa, Fragaria vesca
MFSTVGSLSLFTFAFAFAFAFAFACLLLSPASASEPDHKYQAEEAVTLWVNKVGPYNNPQETYNYYSLPFCRPSDNAAHKWGGLGEVLGGNELIDSQIDIKFGKNVDRATICQLELDDHKVKQFKDAIENSYWFEFFMDDLPLWGFVGELHQDKNSENGKHVLFTHKNIIIKYNKDQIIHVNLTQDSPKPLEAGKKLDLTYSVKWIPTPITFARRFDVYLDYPFFEHQIHWFSIFNSFMMVIFLTGLVSMILMRTLRNDYAKYAREDDDLETLERDVSEESGWKLVHGDVFRPPRSLVILSAVVGTGAQLALLVLLVILLAIVGMLYVGRGAIVTTFIVCYALTSFISGYVSGGMYSRHGGKNWIKSMILTASLFPFMCFGIGFVLNTIAIFYGSLAAIPFGTMVVVFVIWGFISFPLALLGTVVGRNWSGAPNNPCRVKTIPRPIPEKKWYLTPSVVSMMGGLLPFGSIFIEMYFVFTSFWNYKVYYVYGFMLLVFLILIIVTVCVTIVGTYFLLNAENYHWQWTSFFSAASTAVYVYLYSVYYYYAKTKMSGFFQTSFYFGYTLMFCLGLGILCGAVGYLGSNLFVRRIYRNIKCD

SEQ ID NO: 8381 - protein, 585 aa, Triticum aestivum
MLLLRGLLLAALLAVARQPLASASESDHKYKISEPVKLWVNKVGPYNNPQETYNYYSLPFCQPAENPAHKWGGLGEVLGGNELIDSQIDIQFLKNVDKGPICTIELDAKKVQQFTDAIESSYWFELFIDDLPLWGFVGETDKNNENKHYLYTHKNIVVKYNGNRVIHVNLTQESPKLLEAGRKLDMTYSVKWVQTNVAFARRFEVYLDYPFFEHQIHWFSIFNSFMMVIFLTGLVSMILMRTLRNDYAKYAREDDDLESLERDVSEESGWKLVHGDVFRPPRNLMFLSAVVGIGTQMAALILLVIVLAIVGMLYVGRGAIITTFIVCYALTSFISGYVSGGLYSRNGGKNWIKSMVLTASLFPFLCFSIGLVLNTIAIFYHSLAAIPFGTMVVIFVLWAFISFPLVLLGTVVGRNWSGAPNNPCRVKTIPRPIPEKKWYLTPSVISLMGGLLPFGSIFIEMYFVFTSFWNYKVYYVYGFMLLVFVILLIVTVCVTIVGTYFLLNAENYHWQWTSFFSAASTALYVYLYAIYYYHVKTKMSGFFQTSFYFGYTLMFCLGLGILCGAIGYLGSTLFVRRIYRNIKCD

SEQ ID NO: 8382 - protein, 585 aa, Hordeum vulgare
MLLLRGLLLAALLAVARPPLASASESDHKYKISEPVKLWVNKVGPYNNPQETYNYYSLPFCQPAENPAHKWGGLGEVLGGNELIDSQIDIQFLKNVDKGPVCTIELDAKKVQQFTDAIESSYWFELFIDDLPLWGFVGETDKNNENKHYLYTHKNIVVKYNGNRVIHVNLTQESPKLLEAGRKLDMTYSVKWVQTNVAFARRFEVYLDYPFFEHQIHWFSIFNSFMMVIFLTGLVSMILMRTLRNDYAKYAREDDDLESLERDVSEESGWKLVHGDVFRPPRNLMFLSAVVGIGTQMAALILLVIVLAIVGMLYVGRGAIITTFIVCYALTSFISGYVSGGLYSRNGGKNWIKSMVLTASLFPFLCFSIGLVLNTIAIFYHSLAAIPFGTMVVIFVLWAFISFPLVLLGTVVGRNWSGAPNNPCRVKTIPRPIPEKKWYLTPSVISLMGGLLPFGSIFIEMYFVFTSFWNYKVYYVYGFMLLVFVILLIVTVCVTIVGTYFLLNAENYHWQWTSFFSAASTALYVYLYAIYYYHVKTKMSGFFQTSFYFGYTLMFCLGLGILCGAIGYLGSTLFVRRIYRNIKCD

SEQ ID NO: 8383 - protein, 592 aa, Panicum virgatum
MLPSSSGARARGLLLGLALALASLLAPASASESDHKYKAEEPVKLWVNKVGPYNNPQETYNYYSLPFCQPSENPIHKWGGLGEVLGGNELIDSQLEMKFLRNEEKGFICTLELDSKKVQQFADAIENSYWFEFFIDDLPLWGFVGETDKNSENKHYLYTHKNILVKYNENRIIHVNLTQESPKLLEVGKKLDMTYSVKWVATDVSFARRFEVYLDYPFFEHQIHWFSIFNSFMMVIFLTGLVSMILMRTLRNDYAKYAREDDDLESLERDVNEESGWKLVHGDVFRPPRSLMFLSALVGIGTQLAALILLVIVLAIVGMLYIGRGAIITTFIVCYALTSFISGYVSGGLYSRNGGKNWIKAMVLTASLFPLLCFSIGFALNTIAIFYRSLAAIPFGTMVVMFVLWAFISFPLVLLGTVVGRNWSGAPNNPCRVKTIPRPIPEKKWYLTPSVISLMGGLLPFGSIFIEMYFVFTSFWNYKVYYVYGFMLLVFIILLIVTICVTIVGTYFLLNAENYHWQWTSFFSAASTALYVYLYSIYYYHVKTKMSGFFQTSFYFGYTLMFCLGLGILCGAIGYLGSTLFVRRIYRNIKCD

SEQ ID NO: 8384 - protein, 588 aa, Aristolochia fimbriata
MLSAVRSSSAIFFFLFSLVRLTSASESDHKYQADDPITLWVNKVGPYNNPQETYNYYSLPFCQPASNPTHKWGGLGEVLGGNELIDSQIDIKYQKNVDRGTICELELDAPKVKHFKDAIENAYWFEFFIDDLPAWGFVGELHPDKSNEHRHLLYTHKNIVIKYNGDQIIHVNLTQESPKPLEAGKTFDLTYSVKWVPTNITFARRFDVYLDYPFFEHQIHWFSIFNSFMMVIFLTGLVSMILMRTLRNDYAKYAREDDDLETLERDVNEESGWKLVHGDVFRPPRNLVLLSAVVGTGAQLATLVLLVILLAIIGMLYIGRGAIVTTFIVCYALTSFISGYVSGGLYSRHGGKNWIKSMILTASLFPFMVFGIGFLLNTIAIFYGSLAAIPFGTMVVVFIIWAFISFPLALLGTVVGRNWSGSPNNPCRVKTIPRPIPEKKWYLTPSVVSLMGGLLPFGSIFIEMYFVFTSFWNYKVYYVYGFMLLVFLILIIVTICVTIVGTYFLLNAENYHWQWTSFFSAASTAVYVYLYSIYYYYVKTKMSGFFQTSFYFGYTLMFCLGLGILCGAVGYLGSTLFVRRIYRNIKCD

SEQ ID NO: 8385 - protein, 588 aa, Solanum phureja
MLPTARSLSLVLFLAAFIIVPPALASESDHKYQADDPVTLWVNKVGPYNNPQETYNYYSLPFCHASGNTHKWGGLGEVLGGNELIDSQIDLRFQKNVDKGSICELELDETKVKQFKDAIENNYWFEFFIDDLPLWGFVGELHTDRNSDNKHVLYTHKNINIKYNKDQIIHVNLSQESPKPLEAGRTLDMTYSVKWEPTNISFAHRFDVYLDYPFFEHQIHWFSIFNSFMMVIFLTGLVSMILMRTLRNDYAKYAREDDDLETLERDVSEESGWKLVHGDVFRPPHYLALISALVGTGAQLALLVLLVILLAIVGTLYVGRGAIVTTFIVCYALTSFISGYVSGAMYSRNGGKSWIKSMILTASLFPFLCFGIGFILNTIAIFYGSLAAIPFGTMVVVFVIWAFISFPLALLGTVFGRNWSGAPNNPCRVKTIPRPIPEKKWYLTPSVVSLMGGLLPFGSIFIEMYFVFTSFWNYKVYYVYGFMLLVFLILIIVTVCVTIVGTYFLLNAENYHWQWTSFSSAASTAVYVYLYSVYYYYVKTKMSGFFQTSFYFGYTLMFCLGLGILCGAVGFLGSNLFVRRIYRNIKCD

SEQ ID NO: 8386 - protein, 612 aa, Secale cereale
ATQTPQPAPTLHTRSRGRCCRRRRRRDAPPPWPPPRRAPRRRAAAPRRPPPTSDHKYKISRTSKALGNKVGPYNNPQETYNYYSLPFCQPAENYAHKWGGLGEVLGGNELIDSQIDIQFLKNVDKGPICTIELDPKKVQQFTDAIESSYWFELFIDDLPLWGFVGETDKNNENKHYLYTHKNIVVKYNGNRVIHVNLTQESPKLLEAGRKLDMTYSVKWVQTNVAFARRFEVYLDYPFFEHQIHWFSIFNSFMMVIFLTGLVSMILMRTLRNDYAKYAREDDDLESLERDVSEESGWKLVHGDVFRPPRNLMFLSAVVGIGTQMAALILLVIVLAIVGMLYVGRGAIITTFIVCYALTSFISGYVSGGLYSRNGGKNWIKSMVLTASLFPFLCFSIGLVLNTIAIFYHSLAAIPFGTMVVIFVLWAFISFPLVLLGTVVGRNWSGAPNNPCRVKTIPRPIPEKKWYLTPSVISLMGGLLPFGSIFIEMYFVFTSFWNYKVYYVYGFMLLVFVILLIVTVCVTIVGTYFLLNAENYHWQWTSFFSAASTALYVYLYAIYYYHVKTKMSGFFQTSFYFGYTLMFCLGLGILCGAIGYLGSTLFVRRIYRNIKCD

SEQ ID NO: 8387 - protein, 573 aa, Secale cereale
LAVARPPLASASESDHKYKISEPVKLWVNKVGPYNNPQETYNYYSLPFCQPAENPAHKWGGLGEVLGGNELIDSQIDIQFLKNVDKGPVCTIELDPKKVQQFTDAIESSYWFELFIDDLPLWGFVGETDKNNENKHYLYTHKNIVVKYNGNRVIHVNLTQESPKLLEAGRKLDMTYSVKWVQTNVAFARRFEVYLDYPFFEHQIHWFSIFNSFMMVIFLTGLVSMILMRTLRNDYAKYAREDDDLESLERDVSEESGWKLVHGDVFRPPRNLMFLSAVVGIGTQMAALILLVIVLAIVGMLYVGRGAIITTFIVCYALTSFISGYVSGGLYSRNGGKNWIKSMVLTASLFPFLCFSIGLVLNTIAIFYHSLAAIPFGTMVVIFVLWAFISFPLVLLGTVVGRNWSGAPNNPCRVKTIPRPIPEKKWYLTPSVISLMGGLLPFGSIFIEMYFVFTSFWNYKVYYVYGFMLLVFVILLIVTVCVTIVGTYFLLNAENYHWQWTSFFSAASTALYVYLYAIYYYHVKTKMSGFFQTSFYFGYTLMFCLGLGILCGAIGYLGSTLFVRRIYRNIKCD

SEQ ID NO: 8388 - protein, 227 aa, Citrus sinensis
MSSAARSLSLFLLLLFVSPSLASESDHKYQQDEPVTLWVNKVGPYNNPQETYNYYSLPFCHASGNPAHKWGGLGEVLGGNELIDSQIDIKFQRNVDKASICSLDLDEAKVKQFKDAIENNYWFEFFLDDLPLWGFVGDLHPDKNSDNGKHVLYTHKIINFKYNKDQIIHVNLTQDGPKPLEVGRTLDMTYSVKWTPTNVTFAVVLMYIWTTLSLSTRSIGSPFSILS

SEQ ID NO: 8389 - protein, 590 aa, Aquilegia formosa
MLSTVRLFSISVLVVLLFIVVPQTFAVDSDHKYQQEEAVTLWVNKVGPYNNPQETYNYYSLPFCQPPGNAAHKWGGLGEVLGGNELIDSQIEIKFGKNVDKSSICELELDAAKVKQFKDAIENTYWFEFFIDDLPLWGFVGELHPDKNNDNKHVLYTHKTINVKYHGDQIIHVNLTQESPKPLEVGKTLEMTYSVRWVPTNITFERRFDVYLDYPFFEHQIHWFSIFNSFMMVIFLTGLVSMILMRTLRNDYAKYAREDDDLETLERDVSEESGWKLVHGDVFRPPRNLVILSAVVGTGAQLAMLILLVILLAIIGMLYVGRGAIVTTFIVCYALTSFISGYVSGGLYSRSGGKKWIKSMILTASLFPFLCFGIGFVLNTIAIFYGSLAAIPFGTMVVVFVIWAFISFPLALLGTVVGRNWSGAPNNPCRVKTIPRPIPEKKWYLTPSVVSLMGGLLPFGSIFIEMYFVFTSFWNYKVYYVYGFMLLVFIILIIVTVCVTIVGTYFLLNAENYHWQWTSFFSAASTAVYVYLYSIYYYYMKTKMTGFFQTSFYFGYTLMFCLGLGILCGAVGYLGSTLFVRRIYRNIKCD

SEQ ID NO: 8390 - protein, 587 aa, Citrus clementina
MSSAARSLTLFLLLLFVSPSLASESDHKYQQDEPVTLWVNKVGPYNNPQETYNYYSLPFCHASGNPAHKWGGLGEVLGGNELIDSQIDIKFQRNVDKATICSLDLDEAKVKQFKDAIENNYWFEFFLDDLPLWGFVGDLHPDKNSDNGKHVLYTHKIISFKYNKDQIIHVNLTQDGPKPLEVGRTLDMTYSVKWTPTNVTFARRFDVYLDYPFFEHQIHWFSIFNSFMMVIFLTGLVSMILMRTLRNDYAKYAREDDDLETLERDVSEESGWKLVHGDVFRPPHNLVVLSAVVGTGAQLALLVLLVILMAIVGTLYIGRGAIVTTFIVCYALTSFISGYVSGGMYSRNGGKNWIKSMILTASLFPFMVFGIGFLLNTIAIFYGSLAAIPFGTMVVVFVIWAFISFPLALLGTVVGRNWSGAPNNPCRVKTIPRPIPEKKWYLTPSVVSMMGGLLPFGSIFIEMYFVFTSFWNYKVYYVYGFMLLVFVILIIVTVCVTIVGTYFLLNAENYHWQWTSFFSAASTAVYVYLYSIYYYYVKTKMSGFFQTSFYFGYTLMFCLGLGILCGAVGYLGSNLFVRRIYRNIKCD

SEQ ID NO: 8391 - protein, 585 aa, Eucalyptus grandis
MVPALRSLPLLLLLLSSAALASESDHKYQPDEAVTLWVNKVGPYNNPQETYNYYSLPFCRAPGNPAHKWGGLGEVLGGNELIDSQIEIKFQKKVEKGVICQLELDEAKVKQFKDAIENSYWFEFFIDDLPLWGFVGELHADKNSDTKHVLYTHKSISIKYNKNQIIHAGLTPENPKPLEVGKTYDMTYSVKWEETTVSFARRFDIYLDYPFFEHQIHWFSIFNSFMMVIFLTGLVSMILMRTLRNDYAKYAREDDDLETLERDVSEESGWKLVHGDVFRPPRNLVLLSALVGTGGQLSLLVLLVILLAIVGMLYVGRGAIVTTFILCYAFTSFISGYVSGGMYSRHGGKSWIKSMILTASLFPFMCFGIGFILNTIAIFYGSLAAIPFGTMVVVFVIWAFISFPLALLGTVVGRNWSGAPNNPCRVKTIPRPIPEKKWYLTPSVVSLMGGLLPFGSIFIEMYFVFTSFWNYKVYYVYGFMLLVFLILIIVTVCVTIVGTYFLLNAENYHWQWTSFFSAASTAVYVYLYSIYYYHVKTKMSGFFQTSFYFGYTLMFCLGLGILCGAVGYLGSNLFVRRIYRNIKCD

SEQ ID NO: 8392 - protein, 594 aa, Sorghum bicolor
MLPSSGGGRCRGRHLLLGFGLAVAALLALASASESDHKYKTEEPVKLWVNKVGPYNNPQETYNYYSLPFCQPSENPTHKWGGLGEVLGGNELIDSQLEIKFLKNVEKGSICTLELDAKKVQQFADAIESSYWFEFFIDDLPLWGFVGETDKNSENKHYLYTHKNILVKYNDNRIIHVNLTQESPKLLEDGKKLEMTYSVKWVATDVSFARRFEVYLDYPFFEHQIHWFSIFNSFMMVIFLTGLVSMILMRTLRNDYAKYAREDDDLESLERDVNEESGWKLVHGDVFRPPRSLMFLSALVGIGTQLAALILLVIVLAIVGMLYIGRGAIITTFIVCYALTSFISGYVSGGLYSRNGGKNWIKAMVLTASLFPFLCFSIGFALNTIAIFYRSLAAIPFGTMVVMFVLWAFISFPLVLLGTVVGRNWSGAPNNPCRVKTIPRPIPEKKWYLTPSVISLMGGLLPFGSIFIEMYFVFTSFWNYKVYYVYGFMLLVFVILLIVTICVTIVGTYFLLNAENYHWQWTSFSSAASTALYVYLYSIYYYHVKTKMSGFFQTSFYFGYTLMFCLGLGILCGAIGYLGSTLFVRRIYRNIKCD

SEQ ID NO: 8393 - protein, 594 aa, Saccharum officinarum
MLPSSGGGRGRGGHLLLGLALALAALLALASASESDHKYKTEEPVKLWVNKVGPYNNPQETYNYYSLPFCQPSENPTHKWGGLGEVLGGNELIDSQLEIKFLKNVEKGFICTLELDAKKVQQFADAIESSYWFEFFIDDLPLWGFVGETDKNSENKHYLYTHKNILVKYNDNRIIHVNLTQESPKLLEDGKKLEMTYSVKWVATDVSFARRFEVYLDYPFFEHQIHWFSIFNSFMMVIFLTGLVSMILMRTLRNDYAKYAREDDDLESLERDVNEESGWKLVHGDVFRPPRSLMFLSALVGIGTQLAALILLVIVLAIVGMLYIGRGAIITTFIVCYALTSFISGYVSGGLYSRNGGKNWIKAMVLTASLFPFLCFSIGFALNTIAIFYRSLAAIPFGTMVVMFVLWAFISFPLVLLGTVVGRNWSGAPNNPCRVKTIPRPIPEKKWYLTPSVISLMGGLLPFGSIFIEMYFVFTSFWNYKVYYVYGFMLLVFVILLIVTICVTIVGTYFLLNAENYHWQWTSFSSAASTALYVYLYSIYYYHVKTKMSGFFQTSFYFGYTLMFCLGLGILCGAIGYLGSTLFVRRIYRNIKCD

SEQ ID NO: 8394 - protein, 588 aa, Solanum lycopersicum
MLPTAPSLSLVLFLAAFIIFPPALASESDHKYQADDPVTLWVNKVGPYNNPQETYNYYSLPFCHASGNTHKWGGLGEVLGGNELIDSQIDLRFQKNVDKGSICELELDEMKVKQFKDAIENNYWSEFFIDDLPLWGFVGELHTDRISDNKHVLYTHKNINIKYNKDQIIHVNLSQESPKPLEAGRTLDMTYSVKWEPTNITFAHRFDVYLDYPFFEHQIHWFSIFNSFMMVIFLTGLVSMILMRTLRNDYAKYAREDDDLETLERDVSEESGWKLVHGDVFRPPHYLALISALVGTGAQLALLVLLVILFAIVGTLYIGRGAIVTTFIVCYALTSFISGYVSGAMYSRNGGKSWIKSMILTASLLPFLCFGIGFILNTIAIFYGSLAAIPFGTMVVVFVIWAFISFPLALLGTVFGRNWSGAPNNPCRVKTIPRPIPEKKWYLTPSVVSLMGGLLPFGSIFIEMYFVFTSFWNYKVYYVYGFMLLVFLILIIVTVCVTIVGTYFLLNAENYHWQWTSFSSAASTAVYVYLYSVYYYYVKTKMSGFFQTSFYFGYTLMFCLGLGILCGAVGFLGSNLFVRRIYRNIKCD

SEQ ID NO: 8395 - protein, 595 aa, Triticum aestivum
MLPSSRGGGRRRFVLLLSLTAVLAFASPLRASASESDHKYKAGDSVKLWVNKVGPYNNPQETYNYHSLPFCQPSENPGHKWGGLGEVLGGNELIDSQLDIKFLRNVERGSICTLELDPKKTQQFADAIESSYWFEFFIDDLPLWGFVGETDKNSENKHYLYTHKNILVKYNDNRIIHVNLTQESPKLLDAGKKLDMTYSVKWVPTDVSFARRFEVYLDYPFFEHQIHWFSIFNSFMMVIFLTGLVSMILMRTLRNDYAKYARDDDDLESLERDVNEESGWKLVHGDVFRPPRSLTLLSALVGIGTQLAALILLVIVLAIVGMLYVGRGAIITTFIVCYALTSFISGYVSAGLYSRNGGKNWIKAMILTASLFPFLHFAIGFALNTIAIFYGSLAAIPFGTMVVMFVLWAFISFPLVLLGTVVGRNWSGAPNNPCRVKTIPRPIPERKWYLTPSVISLMGGLLPFGSIFIEMYFVFTSFWNYKVYYVYGFMLLVFVILLIVTICVTIVGTYFLLNAENYHWQWTSFFSAASTALYVYLYSIYYYHVKTKMSGFFQTSFYFGYTLMFCLGLGILCGAIGYLGSTLFVRRIYRNIKCD

SEQ ID NO: 8396 - protein, 597 aa, Setaria italica
MLPSSRAARGRGLGLGCLLLGLALTLASLLALAAASEADHKYKAEEPVKLWVNKVGPYNNPQETYNYYSLPFCQLSENPIHKWGGLGEVLGGNELIDSQLDIKFLRNEEKGFICTLELDSKKVQQFADAIENSYWFELFIDDLPLWGFVGETDKNSENKHYLYTHKNILVKYNENRIIHVNLTQESPKLLEAGKKLDMTYSVKWVATDVSFARRFEVYLDYPFFEHQIHWFSIFNSFMMVIFLTGLVSMILMRTLRNDYAKYAREDDDLESLERDVNDESGWKLVHGDVFRPPRSLMFLSALVGIGTQLAALILLVIVLAIVGMLYIGRGAIITTFIVCYALTSFISGYVSGGLYSRNGGKNWIKAMVLTASLFPFLCFSIGFALNTIAIFYRSLAAIPFGTMVVMFVLWAFISFPLVLLGTVVGRNWSGAPNNPCRVKTIPRPIPEKKWYLTPSVISLMGGLLPFGSIFIEMYFVFTSFWNYKVYYVYGFMLLVFVILLIVTICVTIVGTYFLLNAENYHWQWTSFFSAASTALYVYLYSIYYYHVKTKMSGFFQTSFYFGYTLMFCLGLGILCGAIGYVGSTLFVRRIYRNIKCD

SEQ ID NO: 8397 - protein, 598 aa, Oryza sativa
MLLPTSASACRGSGRALLLALAAALLALATPRPASASESDHKYKVEEPVKLWVNKVGPYNNPQETYNYHSLPFCQPSENPAHKWGGLGEVLGGNELIDSQIDIKFLRNEERGSICTLELDSKKVQQFSDAIDNSYWFEFFMDDLPLWGFVGETDKNNENKRYLYTHKSILVKYNDNRIIHVNLTQESPKLLEAGKKLDMTYSVKWLQTDVTFARRFEVYLDYPFFEHQIHWFSIFNSFMMVIFLTGLVSMILMRTLRNDYAKYAREDDDLESLERDVNEESGWKLVHGDVFRPPRSLAFLSAVVGIGTQLAALILLVIVLAIVGMLYVGRGSIITTFIVCYALTSFISGYVSGGLYSRNGGKNWIKAMILTASLFPFLCFAIGFVLNTIAIFYRSLAAIPFGTMVVMFVLWAFISFPLVLLGTVVGRNWSGAPNNPCRVKTIPRPIPEKKWYLTPSVISLMGGLLPFGSIFIEMYFVFTSFWNYKVYYVYGFMLLVFVILLIVTICVTIVGTYFLLNAENYHWQWTSFLSAASTALYVYLYSIYYYHVKTKMSGFFQTSFYFGYTLMFCLGLGILCGAIGYLGSTLFVRRIYRNIKCD

SEQ ID NO: 8398 - protein, 589 aa, Malus domestica
MFSSVRSLSLSLLFVFFLLAPAFAAEADHKYQTEESVTLWVNKVGPYNNPQETYNYYSLPFCHQSENAAHKWGGLGEVLGGNELIDSQIEIKFQKNVDRATICQLELDDQKVKQFKDAIENNYWFEFFMDDLPLWGFVGELQQDKNSGNGKHVLYTHKNIIVKYNNDQIIHVNLTQDSPKPLEVGKKLDLTYSVKWIATTVTFARRFDVYLDYPFFEHQIHWFSIFNSFMMVIFLTGLVSMILMRTLRNDYAKYAREDDDLETLERDVSEESGWKLVHGDVFRPSRNLVILSALVGTGAQLALLVLLVILLAIVGMLYVGRGAIVTTFIVCYALTSFISGYVSGGMYSRHGGKNWIKSMILTASLFPFMCFGIGFVLNTIAIFYGSLAAIPFGTMVVVFVIWAFISFPLALLGTVVGRNWSGAPNNPCRVKTIPRPIPEKKWYLTPSVVSMMGGLLPFGSIFIEMYFVFTSFWNYKVYYVYGFMLLVFLILIIVTVCVTIVGTYFLLNAENYHWQWTSFFSAASTAVYVYLYSIYYYYAKTKMSGFFQTSFYFGYTLMFCLGLGILCGAVGYLGSNLFVRRIYRNIKCD

SEQ ID NO: 8399 - protein, 592 aa, Zea mays
MLPSTVGGRGRYLMLGIALALAALLALASASESDHKYKTEEPVKLWVNKVGPYNNPQETYNYYSLPFCQPSENPTHKWGGLGEVLGGNELIDSQLEIKFLKNVEKGFICTLELDAKKVQQFADAIESSYWFEFFIDDLPLWGFVGETDKNSENKHYLYTHKNILVKYNDNRIIHVNLTQESPTLLEDGKKLEMTYSVKWVATDVSFARRFEVYLDYPFFEHQIHWFSIFNSFMMVIFLTGLVSMILMRTLRNDYAKYAREDDDLESLERDVNEESGWKLVHGDVFRPPQSLMFLSALVGIGTQLAALILLVIVLAIVGMLYIGRGAIITTFIVCYALTSFISGYVSGGLYSRNGGKNWIKAMVLTASLFPFLCFSIGFALNTIAIFYRSLAAIPFGTMVVMFVLWAFISFPLVLLGTVVGRNWSGAPNNPCRVKTIPRPIPEKKWYLTPSVISLMGGLLPFGSIFIEMYFVFTSFWNYKVYYVYGFMLLVFVILLIVTICVTIVGTYFLLNAENYHWQWTSFSSAASTALYVYLYSIYYYHVKTKMSGFFQTSFYFGYTLMFCLGLGILCGAIGYLGSTLFVRRIYRNIKCD

SEQ ID NO: 8400 - protein, 596 aa, Zea mays
MLPSSGSGWGRGRGRHLLLSRALALAALLALASASESDHKYKTEEPVKLWVNKVGPYNNPQETYNYYSLPFCQPSENPTHKWGGLGEVLGGNELIDSQLEIKFLKNVEKGFICTLELDAKKVQQFADAIESSYWFEFFIDDLPLWGFVGESDKNSENKHYLYTHKNILVKYNDNRIIHVNLTQESPKLLEDGKKLEMTYSVKWVATDVSFARRFEVYLDYPFFEHQIHWFSIFNSFMMVIFLTGLVSMILMRTLRNDYAKYAREDDDLESLERDVNEESGWKLVHGDVFRPPRSLMFLSALVGIGTQLAALILLVIVLAIVGMLYIGRGAIITTFIVCYALTSFISGYVSGGLYSRSGGKNWIKAMVLTASLFPFLCFSIGFALNTIAIFYRSLAAIPFGTMVVMFVLWAFISFPLVLLGTVVGRNWSGAPNNPCRVKTIPRPIPEKKWYLTPSVISLMGGLLPFGSIFIEMYFVFTSFWNYKVYYVYGFMLLVFVILLIVTICVTIVGTYFLLNAENYHWQWTSFSSAASTALYVYLYSIYYYHVKTKMSGFFQTSFYFGYTLMFCLGLGILCGAIGYLGSTLFVRRIYRNIKCD

SEQ ID NO: 8401 - protein, 583 aa, Mimulus guttatus
MFSSVRSFCIFVFFFAFLVSSSLGKYQDDEAVTLWVNKVGPYNNPQETYNYYSLPFCHLPGNAPHKWGGLGEVLGGNELIDSQIDIKFKRDVEKSSICDIELDAVKAKHFKDAIDNSYWFEFFMDDLPLWGFIGEVLPDRNRDHKHVLFTHKNLVINYNQDQIIHVNLTQENPKALDEGRTLDMTYSVKWVPTNITFARRFDVYLDYPFFEHQIHWFSVFNSFMMVIFLTGLVSMILMRTLRNDYAKYAREDDDLETLERDVSEESGWKLVHGDVFRPPQNLALLTAVVGTGAQLSTLVLLVIILAIVGMLYIGRGAIVTTFIVCYAFTSFIAGYVSGGMYSRHGGKKWIKSMILTASLFPFLCFGIGFVLNTVAIFYGSLAAIPFGTMVVVFVIWAFISFPLALLGTVVGRNWSGAPNNPCRVKTIPRPIPEKKWYLTPSIISLMGGLLPFGSIFIEMYFVFTSFWNYKVYYVYGFMLLVFVILIIVTICVTIVGTYFLLNAENYHWQWTSFFSAASTALYVYLYSIYYYHVKTKMSGFFQTSFYFGYTLMFCLGLGILCGAVGYLGSNLFVRRIYRNIKCD

SEQ ID NO: 8402 - protein, 595 aa, Triticum aestivum
MLPSSRGGGRRRFVLLLSLTAVLAFASPLRAFASESDHKYKAGDSVKLWVNKVGPYNNPQETYNYHSLPFCQPSENPGHKWGGLGEVLGGNELIDSQLDIKFLRNVERGSICTLELDPKKTQQFADAIESSYWFEFFIDDLPLWGFVGETDKNSENKHYLYTHKNILVKYNDNRIIHVNLTQESPKLLDAGKKLDMTYSVKWVPTDVSFARRFEVYLDYPFFEHQIHWFSIFNSFMMVIFLTGLVSMILMRTLRNDYAKYARDDDDLESLERDVNEESGWKLVHGDVFRPPRSLTLLSALVGIGTQLAALILLVIVLAIVGMLYVGRGAIITTFIVCYALTSFISGYVSAGLYSRNGGKNWIKAMILTASLFPFLHFAIGFALNTIAIFYGSLAAIPFGTMVVMFVLWAFISFPLVLLGTVVGRNWSGAPNNPCRVKTIPRPIPERKWYLTPSVISLMGGLLPFGSIFIEMYFVFTSFWNYKVYYVYGFMLLVFVILLIVTICVTIVGTYFLLNAENYHWQWTSFFSAASTALYVYLYSIYYYHVKTKMSGFFQTSFYFGYTLMFCLGLGILCGAIGYVGSTLFVRRIYRNIKCD

SEQ ID NO: 8403 - protein, 587 aa, Unknown
  Sequence found in Organisms: Solanum tuberosum, Solanum phureja
MRPTVRSLTLLSFLAALLLVSPALASESDHKYQSDDPVTLWVNKVGPYNNPQETYNYYSLPFCHASGSHKWGGLGEVLGGNELIDSQIDIKFQKNVDKGSICELELDEAKVKQFKDAIENNYWFEFFIDDLPMWGFVGEQHPDRNSDNKHVLYTHKNIHIKYNKDQIIHVNISQEGPKPLEAGRTLDMTYSVKWEPTNISFARRFEVYLDYPFFEHQIHWFSIFNSFMMVIFLTGLVSMILMRTLRNDYAKYAREDDDLETLERDVSEESGWKLVHGDVFRTPLNLVLLSALVGTGAQLALLVLLVILLAIVGMLYVGRGSIVTTFIVCYALTSFISGYVSGAMYSRNGGKSWIKSMILTASLFPFMCFGIGFVLNTIAIFYGSLAAIPFGTMVVVFVIWAFISFPLALLGTVVGRNWSGAPNNPCRVKTIPRPIPVKKWYLTPSVISLMGGLLPFGSIFIEMYFVFTSFWNYKVYYVYGFMLLVFLILIVVTVCVTIVGTYFLLNAENYHWQWTSFFSAFSTAVYVYLYSVYYYYVKTKMSGFFQTSFYFGYTLMFCLGLGILCGAVGFLGSHLFVRRIYRNIKCD

SEQ ID NO: 8404 - protein, 595 aa, Secale cereale
MLPSSRGGDRRRLVVLLSLTAVLAFASPLRASASESDHKYKAGDSVKLWVNKVGPYNNPQETYNYHSLPFCQPSENPGHKWGGLGEVLGGNELIDSQLDIKFLRNVERGSICTLELDSKKIQQFADAIESSYWFEFFIDDLPLWGFVGETDKNSENKHYLYTHKNILVKYNDNRIIHVNLTQESPKLLDAGKKLDMTYSVKWVPTDVSFARRFEVYLDYPFFEHQIHWFSIFNSFMMVIFLTGLVSMILMRTLRNDYAKYARDDDDLESLERDVNEESGWKLVHGDVFRPPRSLTLLSALVGIGTQLAALILLVIVLAIVGMLYVGRGAIITTFIVCYALTSFISGYVSAGLYSRNGGKNWIKAMILTASLFPFLHFAIGFALNTIAIFYGSLAAIPFGTMVVMFVLWAFISFPLVLLGTVVGRNWSGAPNNPCRVKTIPRPIPERKWYLTPSVISLMGGLLPFGSIFIEMYFVFTSFWNYKVYYVYGFMLLVFVILLIVTICVTIVGTYFLLNAENYHWQWTSFFSAASTALYVYLYSIYYYHVKTKMSGFFQTSFYFGYTLMFCLGLGILCGAIGYVGSTLFVRRIYRNIKCD

SEQ ID NO: 8405 - protein, 588 aa, Nicotiana benthamiana
MIRPTVRSLTLFSFLAAFLVVSPALASESDHKYQQDDPVTLWVNKVGPYNNPQETYNYYSLPFCHASGSHKWGGLGEVLGGNELIDSQIDIRFQKNVDKGSICELELDEAKVKQFKDAIENNYWFEFFIDDLPLWGFVGEQHPDRNSDNKHVLYTHKNIHIRYNKDQIIHVNISQEGPKPLEAGRTLDMTYSVKWEPTNISFARRFEVYLDYPFFEHQIHWFSIFNSFMMVIFLTGLVSMILMRTLRNDYAKYAREDDDLETLERDVSEESGWKLVHGDVFRTPRTLVLLSALVGTGAQLALLVLLVILLAIVGMLYVGRGAIVTTFIVCYALTSFISGYVCCSIYLLIAGKSWIKSMILTASLFPFLCFGIGFILNTIAIFYGSLAAIPFGTMVVVFVIWAFISFPLALLGTVVGRNWSGAPNNPCRVKTIPRPIPVKKWYLTPSVISLMGGLLPFGSIFIEMYFVFTSFWNYKVYYVYGFMLLVFLILIVVTVCVTIVGTYFLLNAENYHWQWTSFFSAASTAVYVYLYSVYYYYVKTKMSGFFQTSFYFGYTLMFCLGLGILCGAVGFLGSHLFVRRIYRNIKCD

SEQ ID NO: 8406 - protein, 590 aa, Gossypium hirsutum
MLSSVRSFSLSAFIFFVFFSSLAFASESDHKYQPDDPITLWVNKVGPYNNPQETYNYYILPFCHPGVNPAHKWGGLGEVLGGNELIDSQIDIKFQKNVDKGTICQLELDEAKVKQFKDAIENNYWFEFFVDDLPLWGFVGELHPDKNSDNGKHVLYTHKNIVIKYNKDQIIHVNLTQGSPKPLEAGRVLDMTYSIKWLPTNVTFARRFDVYLDYPFFEHQIHWFSVFNSFMMVIFLTGLVSMILMRTLRNDYAKYAREDDDLETLERDVSEESGWKLVHGDVFRPPRGLVLLSAVVGTGAQLALLVLLVILLAIVGTLYVGRGAIVTTFILCYAFTSFISGYVSGGMYSRNGGKSWIKSMILSASLFPFLCFGIGFILNTIAIFYGSLAAIPFGTMVVVFVIWAFISFPLALLGTVVGRNWSGAPNNPCRVKTIPRPIPEKKWYLTPSVVSLMGGLLPFGSIFIEMYFVFTSFWNYKVYYVYGFMLLVFLILVIVTVCVTIVGTYFLLNAENYHWQWTSFFSAASTAVYVYMYSVYYYYVKTKMSGFFQTSFYFGYTLMFCLGLGILCGAVGYLGSNLFVRRIYRNIKCD

SEQ ID NO: 8407 - protein, 402 aa, Gossypium hirsutum
MSSAVFSAVRSFSVFVFVLLFLSLAFASESDHKYQPDDPITLWVNKVGPYNNPQETYNYYSLPFCQPGTNPAHKWGGLGEVLGGNELIDSQIYMKFQKNVDRGTICQLELDEAKVRQFKDAIENSYWFEFFVDDLPLWGFVGELHPDRNSENGKHVLYTHKNIVIKYNKDQIIHVNLTQESPKQLEAGRTLDMTYSVKWLPTNVTFARRFDIYLDYPFFEHQIHWFSVFNSFMMVIFLTGLVSMILMRTLRNDYAKYAREDDDLETLERDVSEECGWKLVHGDVFRPPSNLALLSAVVGTGAQLALLVLLVILLAIVGTLYVGRGAIVTTFILCYAFTSFISGYVSGGMYSRNGGKNWIKSMILTASLFPFLCFGIGFLLNTVAIFYGSLAAIPFGTMVVVL

SEQ ID NO: 8408 - protein, 595 aa, Triticum aestivum
MLPSSRGGGRRRLVLLLALTAVFAFASPLRASASESDHKYKAGDSVKLWVNKVGPYNNPQETYNYHSLPFCQPSENPGHKWGGLGEVLGGNELIDSQLDIKFLRNVERGSICTLELDSKKVQQFADAIESSYWFEFFIDDLPLWGFVGETDKNSENKHYLYTHKNILVKCNDNRIIHVNLTQESPKLLDAGKKLDLTYSVKWVPTDVSFARRFEVYLDYPFFEHQIHWFSIFNSFMMVIFLTGLVSMILMRTLRNDYAKYARDDDDLESLERDVNEESGWKLVHGDVFRPPRSLTLLSALVGIGTQLAALILLVIVLAIVGMLYVGRGAIITTFIVCYALTSFISGYVSAGLYSRNGGKNWIKAMILTASLFPFLHFAIGFALNTIAIFYGSLAAIPFGTMVVMFVLWAFISFPLVLLGTVVGRNWSGAPNNPCRVKTIPRPIPERKWYLTPSVISLMGGLLPFGSIFIEMYFVFTSFWNYKVYYVYGFMLLVFVILLIVTICVTIVGTYFLLNAENYHWQWTSFFSAASTALYVYLYSIYYYHVKTKMSGFFQTSFYFGYTLMFCLGLGILCGAIGYVGSTLFVRRIYRNIKCD

SEQ ID NO: 8409 - protein, 565 aa, Triticum aestivum
ASASESDHKYKISEPVKLWVNKVGPYNNPQETYNYYSLPFCQPAENPAHKWGGLGEVLGGNELIDSQIDIQFLKNVDKGPICTIELDAKKVQQFTDAIESSYWFELFIDDLPLWGFVGETDKNNENKHYLYTHKNIVVKYNGNRVIHVNLTQESPKLLEAGRKLDMTYSVKWVQTNVAFARRFEVYLDYPFFEHQIHWFSIFNSFMMVIFLTGLVSMILMRTLRNDYAKYAREDDDLESLERDVSEESGWKLVHGDVFRPPRNLMFLSAVVGIGTQMAALILLVIVLAIVGMLYVGRGAIITTFIVCYALTSFISGYVSGGLYSRNGGKNWIKSMVLTASLFPFLCFSIGLVLNTIAIFYHSLAAIPFGTMVVIFVLWAFISFPLVLLGTVVGRNWSGAPNNPCRVKTIPRPIPEKKWYLTPSVISLMGGLLPFGSIFIEMYFVFTSFWNYKVYYVYGFMLLVFVILLIVTVCVTIVGTYFLLNAENYHWQWTSFFSAASTALYVYLYAIYYYHVKTKMSGFFQTSFYFGYTLMFCLGLGILCGAIGYLGSTLFVRRIYRNIKCD

SEQ ID NO: 8410 - protein, 589 aa, Malus domestica
MFSSVRSLSPLLLFVFFLLAPAFASESDHKYKTEESVTLWVNKVGPYNNPQETYNYYSLPFCHQSENAAHKWGGLGEVLGGNELIDSQIEIKFQKNVDRATICQLELDDQKVKHFKDAIENNYWFEFFMDDLPLWGFVGELHPDKNSENGKHVLYTHKNIIVKYNKDQIIHVNLTQDSPKPLEAGKKLDLTYSVKWIATTITFARRFDVYLDYPFFEHQIHWFSIFNSFMMVIFLTGLVSMILMRTLRNDYAKYAREDDDLETLERDVSEESGWKLVHGDVFRPSRNLVILSAVVGTGAQLALLVLLVILLAIVGMLYVGRGAIVTTFIVCYALTSFISGYVSGGMYSRHGGKNWIKSMILTASLFPFMCFGIGFILNTIAIFYGSLAAIPFGTMVVVFVIWAFISFPLALLGTVVGRNWSGAPNNPCRVKTIPRPIPEKKWYLTPSVVSMMGGLLPFGSIFIEMYFVFTSFWNYKVYYVYGFMLLVFLILIIVTVCVTIVGTYFLLNAENYHWQWTSFFSAASTAVYVYLYSIYYYYAKTKMSGFFQTSFYFGYTLMFCLGLGILCGAVGYLGSNLFVRRIYRNIKCD

SEQ ID NO: 8411 - protein, 587 aa, Solanum lycopersicum
MRSTVPSLTLLSFLAALLLVSPALASESDHKYQSDDPVTLWVNKVGPYNNPQETYNYYSLPFCHASGSHKWGGLGEVLGGNELIDSQIDIKFQKNVDKGSICELELDEAKVKQFKDAIENNYWFEFFIDDLPMWGFVGEQHPDRNSDNKHVLYTHKNIHIKYNKDQIIHVNISQEGPKPLEAGRTLDMTYSVKWEPTNISFARRFEVYLDYPFFEHQIHWFSIFNSFMMVIFLTGLVSMILMRTLRNDYAKYAREDDDLETLERDVSEESGWKLVHGDVFRTPLNLVLLSALVGTGAQLALLVLLVILLAIVGMLYVGRGSIVTTFIVCYALTSFISGYVSGAMYSRNGGKSWIKSMILTASLFPFMCFGIGFVLNTIAIFYGSLAAIPFGTMVVVFVIWAFISFPLALLGTVVGRNCSGAPNNPCRVKTIPRPIPVKKWYLTPSVISLMGGLLPFGSIFIEMYFVFTSFWNYKVYYVYGFMLLVFLILIVVTVCVTIVGTYFLLNAENYHWQWTSFFSAFSTAVYVYLYSVYYYYVKTKMSGFFQTSFYFGYTMMFCLGLGILCGAVGFLGSHLFVRRIYRNIKCD

SEQ ID NO: 8412 - protein, 588 aa, Musa acuminata
MVLTARSLAPLLLILLVVAAASPASASESDHTYQNDDHVTLWVNKVGPYNNPQETYNYYILPFCQLPGNAAHKWGGLGEVLGGNQLVDSQIEIKFRKNVDKASICAINLDAAKVKQFKDAVESSYWFEFFIDDLPLWGFIGETDKTNENRHYLFTHKDIVVKYNGDQIIHVNLTQESPKLLEAGKSLDMTYSVKWIETDVKFARRFDVYLDYPFFEHQIHWFSIFNSFMMVIFLTGLVSMILMRTLRNDYAKYAREDDDLETLERDASEESGWKLVHGDVFRPPCNLVLLSAVVGTGAQLAMLVLLVILLAIIGMLYVGRGAIATTFIVCYALTSFISGYVSGGLYSQNGGKSWIKSMILAASLFPFMCFGIGFILNTIAIFYGSLAAIPFGTMVVVFIIWAFISFPLALLGTVVGRNWSGSPNNPCRVKTIPRLIPEKKWYLTPSIISLMGGLLPFGSIFIEMYFVFTSFWNYKVYYVYGFMLLVFLILIIVTMCVTIVGAYFLLNAENYHWQWTSFFSAASTAVYVYLYSVYYYYMKTKMSGFFQTSFYFGYTLMFCLGLGILCGAVGYLGSTMFVRRIYRNIKCD

SEQ ID NO: 8413 - protein, 565 aa, Triticum aestivum
ASASESDHKYKISEPVKLWVNKVGPYNNPQETYNYYSLPFCLPAENPAHKWGGLGEVLGGNELIDSQIDIQFLKNVDKGPVCTIELDAKKVQQFTDAIESSYWFELFIDDLPLWGFVGETDKNNENKHYLYTHKNIVVKYNGNRVIHVNLTQESPKLLEAGRKLDMTYSVKWVQTNVAFARRFEVYLDYPFFEHQIHWFSIFNSFMMVIFLTGLVSMILMRTLRNDYAKYAREDDDLESLERDVSEESGWKLVHGDVFRPPRNLMFLSAVVGIGTQMAALILLVIVLAIVGMLYVGRGAIITTFIVCYALTSFISGYVSGGLYSRNGGKNWIKSMVLTASLFPFLCFSIGLVLNTIAIFYHSLAAIPFGTMVVIFVLWAFISFPLVLLGTVVGRNWSGAPNNPCRVKTIPRPIPEKKWYLTPSVISLMGGLLPFGSIFIEMYFVFTSFWNYKVYYVYGFMLLVFVILLIVTVCVTIVGTYFLLNAENYHWQWTSFFSAASTALYVYLYAIYYYHVKTKMSGFFQTSFYFGYTLMFCLGLGILCGAIGYLGSTLFVRRIYRNIKCD

SEQ ID NO: 8414 - protein, 594 aa, Brachypodium distachyon
MRPSSSCGRGRLLLLLALAAVLAVASPPRASASESDHKYKTGDPVKLWVNKVGPYNNPQETYNYHSLPFCQLSENPPHKWGGLGEVLGGNELIDSQLDIKFLSDVEKGSICTLELDSKKIQQFADAIENSYWFEFFIDDLPLWGFVGETDKNSENKHYLYTHKNILVKYNDNRIIHVNLTQESPKLLEAGKKFDMTYSVKWVATEVSFARRFEVYLDYPFFEHQIHWFSIFNSFMMVIFLTGLVSMILMRTLRNDYAKYARDDDDLESLERDVNEESGWKLVHGDVFRPPRSLTFLSALVGIGTQLAALILLVIVLAIVGMLYVGRGAIITTFIVCYALTSFISGYISAGLYSRNGGKNWIKAMILTASLFPFLHFAIGFALNTIAIFYGSLAAIPFGTMVVMFVLWAFISFPLVLLGTVVGRNWSGAPNNPCRVKTIPRPIPERKWYLTPSVISLMGGLLPFGSIFIEMYFVFTSFWNYKVYYVYGFMLLVFVILLIVTICVTIVGTYFLLNAENYHWQWTSFFSAASTALYVYLYSIYYYHVKTKMSGFFQTSFYFGYTLMFCLGLGILCGAIGYLGSTLFVRRIYRNIKCD

SEQ ID NO: 8415 - protein, 593 aa, Gossypium hirsutum
MSSSVVSTVRSTLSLFVVVFIFFSPVFASESDHKYQPDDPVTLWVNKVGPYNNPQETYNYYSLPFCHPGTNPAHKWGGLGEVLGGNELIDSQIDIKFQKNVEKSTICQLELDEAKVREFKDATENSYWFEFFMDDLPLWGFVGELHPDRNSDNGKHVLYTHKNIIIKYNKDQIIHVNLTQESPKPLEAGRIFDLTYSIKWIPTNVTFARRFDVYLDYPFFEHQIHWFSVFNSFMMVIFLTGLVSMILMRTLRNDYAKYAREDDDLETLERDVSEESGWKLVHGDVFRPPYNLVLLSAVVGTGAQLALLVLLVILLAIVGTLYVGRGAIVTTFILCYAFTSFISGYVSGGMYSRNGGKSWIKSMILTACLFPFMCFGIGFILNTVAIFYGSLAAIPFGTMVVVFVIWAFISFPLALLGTVVGRNWSGAPNNPCRVKTIPRPIPEKKWYLTPSVVSLMGGLLPFGSIFIEMYFIFTSFWNYKVYYVYGFMLLVFLILIIVTVCVTIVGTYFLLNAENYHWQWTSFFSAASTAVYVYLYSVYYYHVKTKMSGFFQTSFYFGYTLMFCLGLGILCGAVGYLGSNLFVRRIYRNIKCD

SEQ ID NO: 8416 - protein, 591 aa, Populus trichocarpa
MSSAIRSLPLIAFISLLLLSPALAFDADHRYGQEEAVKLWVNKVGPYNNPQETYNYYSLPFCHPSSNDGTHKWGGLGEVLGGNELIDSQIDLKFAKNVDKAVICQLELDEAKVKQFKDAIENSYWFEFFIDDLPLWGFVGELRPDKNSDNGKHLLFTHKSITIKYNKDQIIHVNLTQENPKPLEAGTVLEMTYSVKWSLTNVSFARRFDVYLDYPFFEHQIHWFSIFNSFMMVIFLTGLVSMILMRTLRNDYAKYARDDDDLVESLERDVSEETGWKLVHGDVFRPPRSLVLLSAVVGTGAQLAMLVLLVILMAIVGTLYVGRGAIVTTFIVCYALTSFIAGYVSGGMYSRHGGKSWIKSMILTACLFPFMCFGIGFILNTIAIFYGSLAAIPFGTMVVVFVIWAFISFPLALLGTVVGRNWSGAPNNPCRVKTIPRPIPEKKWYLTPSVVSMMGGLLPFGSIFIEMYFVFTSFWNYKVYYVYGFMLLVFLILIIVTVCVTIVGTYFLLNAENYHWQWTSFFSAASTAVYVYLYSIYYYSMKTKMSGFFQTSFYFGYTLMFCLGLGILCGAVGYLGSNLFVRRIYKNIKCD

SEQ ID NO: 8417 - protein, 587 aa, Zostera marina
MPSNVHSTAIFLSLFLLVFSASAGESDHKYQLEDPVVLWVNKVGPYNNPQETYNYYSLPFCQPQENPVHRWGGLGEVLGGNELIDSQIEIKYQKPVDKVTICSIDLDEAKVTQFKNAIDSSYWFEFFMDDLPLWGFVGETRIDKSNENKHFLFTHKDIIIKYNGFQIIHVNLTQDSAKLLEVGKTLDMTYSVKWIKTNIEFAHRFDVYLDYPFFEHQIHWFSIFNSFMMVIFLTGLVSMILMRTLRNDYAKYAREDDDLETLERDVSEESGWKLVHGDVFRPPQNLTVLSAVIGTGSQLAMLVLMVILLAIIGMLYIGRGAIVTTFIVCYALTSFITGYVSGGMYSRNGGKNWIKSMIFSASLFPFMCFGIGFILNTIAIFYGSLAAIPFGTMVVVFIIWGFISLPLAFLGTIVGRNWSGSPNNPCRVKTIPRPIPEKKWHLTPSAISLMGGLLPFGSIFIEMYFVFTSFWNYKVYYVYGFMLLVFIILIIVTVCVTIVGTYFLLNAENYHWQWTSFFSAASTAGYVYLYSIYYYHSKTKMSGFFQTSFYFGYTLMFCLGLGILCGAVGYLGSTLFVRRIYRNIKCD

SEQ ID NO: 8418 - protein, 583 aa, Glycine max
MLFRFSLLLPLFLSTAFASESDHRYQQDDPVILWVNKVGPYNNPQETYNYYSLPFCRSPGNPAHKWGGLGEVLGGNELIDSQLEIKFLGNVEKTTFCRIELDEAKVKQFKDAIENNYWFEFFMDDLPLWGYVGELHPDKNGDNGKHVLYTHKNINVQYNKDQIIHVNLTYDNPRPLEVGKSLDMTYSVKWSPTNVTFGRRFDVYLDYPFFEHQIHWFSIFNSFMMVIFLTGLVSMILMRTLRNDYAKYAREDDDLETLERDVSEESGWKLVHGDVFRPPRSLVILSAVVGTGAQLALLVLLVILLAIIGMLYVGRGAIVTTFIVCYALTSFISGYVSGGMYSRNGGKNWIKSMILTASLFPFMCFGIGFILNTIAIFYGSLAAIPFGTMVVVFVIWAFISFPLALLGTVVGRNWSGAPNNPCRVKTIPRPIPEKKWYLTPSVVSLMGGLLPFGSIFIEMYFVFTSFWNYKVYYVYGFMLLVFLILTIVTVCVTIVGTYFLLNAENYHWQWTSFFSAASTAVYVYLYSVYYYYVKTKMSGFFQTSFYFGYTLMFCLGLGILCGAVGYLGSNLFVRRIYRNIKCD

SEQ ID NO: 8419 - protein, 593 aa, Castanea mollissima
MSSTVRSLSFLSFLFLSLFLSLSSVSLASDSDHKYQPDDPVTLWVNKVGPYNNPQETYNYYSLPFCRPEGNAGHKWGGLGEVLGGNELIDSQIDIKFDKNVEKAVICQLKLDEATVKHFKDAIENNYWFEFFVDDLPLWGFVGALHPDKNSDNGKHVLFTHKKIVVQFNKDQIIHVNLTQEGPKPLTVGKTLDMTYSVKWMPTNVTFARRFDVYLDYPFFEHQIHWFSIFNSFMMVIFLTGLVSMILMRTLRNDYAKYAREDDDLETLERDVSEESGWKLVHGDVFRPPRNLVLLSAVVGTGAQLALLVLLVILLAIVGMLYIGRGAIITTFIVCYALTSFISGYVSGGMYSRHGGKNWIKSMILTASLFPFMCFGIGFILNTVAIFYGSLAAIPFGTMVVVFVIWAFISFPLALLGTVVGRNWSGAPNNPCRVKTIPRPIPEKKWYLTPSVVSIMGGLLPFGSIFIEMYFVFTSFWNYKVYYVYGFMLLVFVILIIVTVCVTIVGTYFLLNAENYHWQWTSFFSAASTAVYVYLYSIYYYYVKTKMSGFFQTSFYFGYTMMFCLGLGILCGAVGYLGSNLFVRRIYRNIKCD

SEQ ID NO: 8420 - protein, 589 aa, Euonymus alatus
MSSAGRFVSLFALIFVFLFPAAFASESDHKYQLDDPVALWVNKVGPYNNPQETYNYYSLPFCRPAGDPAHKWGGLGEVLGGNELIDSLIDIKFGKNVDKSLICQLDLTAEKVKQFKDAIENSYWFEFFMDDLPLWGFVGELHPDKNSDNRKHVLYTHKSITVKYNNDQIIHVNLSQETPKPLEDGRTLDMTYSVKWIPTNITFGRRFDVYLDYPFFEHQIHWFSIFNSFMMVIFLTGLVSMILMRTLRNDYAKYAREDDDLETLERDVSEESGWKLVHGDVFRPPRNLVLLSAVVGTGAQLALLVLLVILLAIVGTLYVGRGAIVTTFIVCYALTSFISGYVSGGMYSRHGGKSWIKSMILTASLFPFMCFGIGFILNTVAIFYGSLAAIPFGTMVVVFVIWAFISFPLALLGTVVGRNWSGAPNNPCRVKTIPRPIPEKKWYLTPSVVSMMGGLLPFGSIFIEMYFVFTSFWNYKVYYVYGFMLLVFLILIIVTVCVTIVGTYFLLNAENYHWQWTSFFSAASTAVYVYLYSIYYYYVKTKMFGFFQTSFYFGYTLMFCLGLGILCGAVGYLGSNLFVRRIYRNIKCD

SEQ ID NO: 8421 - protein, 585 aa, Cajanus cajan
MSIFSRFSLLFLFLLSPAFASESDHRYQQDEQVILWVNKVGPYNNPQETYNYYSLPFCRPPGNAAHKWGGLGEVLGGNELIDSQLDIKFLANVEKTTYCRVELDEAKVKQFKDAIENNYWLEFFMDDLPLWGYVGELHPDKNSDNGKHVLYTHKNINVKYNKDQIIHVNLTHDNPKPLEVGRPLDMTYSVKWTPTNVTFARRFDVYLDYPFFEHQIHWFSIFNSFMMVIFLTGLVSMILMRTLRNDYAKYAREDDDLETLERDVSEESGWKLVHGDVFRPPRSLVVLSAVVGTGAQLALLVLLVILLAIVGMLYVGRGAIVTTFIVCYALTSFISGYVSGGMYSRNGGKNWIKSMILTASLFPFMCFGIGFILNTIAIFYGSLAAIPFGTIVVVFVIWAFIAFPLALLGTVVGRNWSGAPNNPCRVKTIPRPIPEKKWYLTPSVVSLMGGLLPFGSIFIEMYFVFTSFWNYKVYYVYGFMLLVFLILIIVTVCVTIVGTYFLLNAENYHWQWTSFFSAASTAVYVYLYSVYYYYVKTKMSGFFQTSFYFGYTLMFCLGLGILCGAVGYLGSNLFVRRIYRNIKCD

SEQ ID NO: 8422 - protein, 459 aa, Ambrosia trifida
MDDLPLWGYVGELHTDRNSDSKHMLFTHKNITIQYNKDQIIHVNLTQENPKPLEAGKTLDMTYSVKWTETNISFAHRFDVYLDYHFFEHQIHWFSIFNSFMMVIFLTGLVSMILMRTLRNDYAKYAREDDDLESLERDVSEESGWKLVHGDVFRPPRHLVILSAVVGTGAQLALLILLVILFAIVATLYIGRGAIVTTFIVCYALTSFVSGYVSGGMYSRHGGKNWIKSMILTASLFPFLCFGIGFVLNTIAIFYGSLAAIPFGTMVVVFVIWAFISFPLALLGTVVGRNWSGAPNNPCRVKTIPRPIPEKKWYLTPSVVSIMGGLLPFGSIFIEMYFVFTSFWNYKVYYVYGFMLLVFLILIIVTVCVTIVGTYFLLNAENYHWQWTSFFSAASTAIYVYLYSIYYYSVKTKMSGFLQTSFYFGYTAMFCLGLGILCGAVGYLGSNLFVRRIYRNIKV

SEQ ID NO: 8423 - protein, 630 aa, Phaseolus coccineus
MKVKINISNESVAQREKERVSILQGQVLVVFLFSLFSSPLRSPMAVFFRFSLLLLLPLFLSPAFASDSDHRYQPEEKVMLWVNKVGPYNNPQETYNYYSLPFCRPPGHPAHKWGGLGEVLGGNELIDSQLEIKFLGNVEKTTFCRLQLNEANVKQFKDAIENNYWFEFFMDDLPLWGYVGELHPDKNSDNGKHVLYAHKNINIQYNKDQIIHVNLTHDNPRPLEVGKTLDLTYSVKWTPTNVTFARRFDVYLDYPFFEHQIHWFSIFNSFMMVIFLTGLVSMILMRTLRNDYAKYAREDDDLETLERDVSEESGWKLVHGDVFRPPRSLVILSAVVGTGAQLALLVFLVILLAIIGMLYVGRGAIVTTFIVCYALTSFISGYVSGGMYSRNGGKSWIKSMILTASLFPFMCFGIGFILNTVAIFYGSLAAIPFGTMVVVFVIWAFISFPLALLGTVVGRNWSGAPNNPCRVKTIPRPIPEKKWYLTPSVVSLMGGLLPFGSIFIEMYFVFTSFWNYKVYYVYGFMLLVFLILIIVTVCVTIVGTYFLLNAENYHWQWTSFFSAASTAVYVYLYSVYYYFVKTKMSGFFQTSFYFGYTLMFCLGLGILCGAVGYLGSNLFVRRIYRNIKCD

SEQ ID NO: 8424 - protein, 595 aa, Hordeum vulgare
MLPSPRGSGRRSLVLVLSLTAVLAFASPHRASASESDHKYKSGDSVKLWVNKVGPYNNPQETYNYHSLPFCQPSENPGHKWGGLGEVLGGNELIDSQLDIKFLKNVERGSICTLELDSKKIQQFADAIESSYWFEFFIDDLPLWGFVGETDKNSENKHYLYTHKNILVKYNDNRIIHVNLTQESPKLLEAGKKLELTYSVKWVPTDVSFARRFEVYLDYPFFEHQIHWFSIFNSFMMVIFLTGLVSMILMRTLRNDYAKYARDDDDLESLERDVNEESGWKLVHGDVFRPPRSLTLLSALVGIGTQLAALILLVIVLAIVGMLYVGRGAIITTFIVCYALTSFISGYVSAGLYSRNGGKNWIKAMILTASLFPFLHFAIGFALNTIAIFYGSLAAIPFGTMVVMFVLWAFISFPLVLLGTVVGRNWSGAPNNPCRVKTIPRPIPERKWYLTPSVISLMGGLLPFGSIFIEMYFVFTSFWNYKVYYVYGFMLLVFVILLIVTICVTIVGTYFLLNAENYHWQWTSFFSAASTALYVYLYSIYYYHVKTKMSGFFQTSFYFGYTLMFCLGLGILCGAIGYVGSTLFVRRIYRNIKCD

SEQ ID NO: 8425 - protein, 593 aa, Humulus lupulus
MFSAVRSLPLFTFAYLFLLLLLSPVFASESDHKYKKEDAVTLWVNKVGPYNNPQETYNYYSLPFCHPAGSSATHKWGGLGEVLGGNELIESGIEIKFQQNVEKTVICTLQLNEAKVKHFKDAIENSYWFEFFMDDLPLWGFVGELHPDKNSDNGKHVLYTHKNINVQYNNDQIIHVNLSQESPKPLEVGRTLDLTYSVKWTPTNVTFARRFDVYLDYPFFEHQIHWFSIFNSFMMVIFLTGLVSMILMRTLRNDYAKYAREDDDLETLERDVSEESGWKLVHGDVFRPPRNLVILSAVVGTGAQLALLVLLVILLAIVGMLYVGRGAIVTTFIVCYALTSFISGYVSGGMYSRHGGKSWIKSMILTASLFPFMCFGIGFILNTIAIFYGSLAAIPFGTMVVVFVIWAFISFPLALLGTVVGRNWSGAPNNPCRVKTIPRPIPEKKWYLTPSVVSLMGGLLPFGSIFIEMYFVFTSFWNYKVYYVYGFMLLVFLILVIVTVCVTIVGTYFLLNAENYHWQWTSFFSAASTAVYVYLYSIYYYYVKTKMSGFFQTSFYFGYTMMFCLGLGILCGAVGYLGSNLFVRRIYRNIKCD

SEQ ID NO: 8426 - protein, 591 aa, Quercus alba
MSSTVRSLSFLSFLFFFLSLSSVSLASDSDHKYQQDDPVTLWVNKVGPYNNPQETYNYYSLPFCRPKGNAAHKWGGLGEVLGGNELIDSQIDIKFDKNVDKAVICQLELDEATVKHFKDAIENNYWFEFFVDDLPLWGFVGALHPDKNSDNGKHVLFTHKKIVVQFNKDQIIHVNLTQEGPKPLTVGKTLDMTYSVKWMPTNVTFARRFDVYLDYPFFEHQIHWFSIFNSFMMVIFLTGLVSMILMRTLRNDYAKYAREDDDLETLERDVSEESGWKLVHGDVFRPPRNLVLLSAVVGTGAQLALLVLLVILLAIVGMLYIGRGAIITTFIVCYALTSFISGYVSGGMYSRHGGKNWIKSMILTASLFPFMCFGIGFILNTVAIFYGSLAAIPFGTMVVVFVIWAFISFPLALLGTVVGRNWSGAPNNPCRVKTIPRPIPEKKWYLTPSVVSIMGGLLPFGSIFIEMYFVFTSFWNYKVYYVYGFMLLVFVILIIVTVCVTIVGTYFLLNAENYHWQWTSFFSAASTAVYVYLYSIYYYYVKTKMSGFFQTSFYFGYTLMFCLGLGILCGAVGYLGSNLFVRRIYRNIKCD

SEQ ID NO: 8427 - protein, 206 aa, Chelidonium majus
MVSTVFFFAFSLCILFVVHPTFASESDHKYQPEDPVTLWVNKVGPYNNPQETYNYYSLPFCQSPGNAAHKWGGLGEVLGGNELIDSQIDIKFQKNVDKSSICEINLDAAKVKHFKDAIENSYWFEFFMDDLPLWGFVGGPHSDKNSDNNKHLLYTHKNIVVKYNGEQIIHVNLTQESPRPLEVGKVLDMTYSIQWIPTNITFARSF

SEQ ID NO: 8428 - protein, 589 aa, Euonymus alatus
MSSAGRFVSLFALIFLFLFPAAFASESDHKYQVDDPVTLWVNKVGPYNNPQETYNYYSLPFCRPAGDPAHKWGGLGEVLGGNELIDSLIDIKFGKNVDKSLICQLDLTAEKVKQFKDAIESSYWFEFFMDDLPLWGFVGELHPDKNSDNRKHVLYTHKSVTVKYNNDQIIHVNLSQETPKPLEDGRTLDMTYSVKWIPTNITFGRRFDVYLDYPFFEHQIHWFSIFNSFMMVIFLTGLVSMILMRTLRNDYAKYAREDDDLETLERDVSEESGWKLVHGDVFRPPRNLVLLSAVVGNGAQLALLVLLVILLAIVGTLYVGRGAIVTTFIVCYALTSFISGYVSGGMYSRHGGKSWIKSMILTASLFPFMCFGIGFILNTVAIFYGSLAAIPFGTMVVVFVIWAFISFPLALLGTVVGRNWSGAPNNPCRVKTIPRPIPEKKWYLTPSVVSMMGGLLPFGSIFIEMYFVFTSFWNYKVYYVYGFMLLVFLILIIVSVCVTIVGTYFLLNAENYHWQWTSFFSAASTAVYVYFYSVYYYYVKTKMSGFFQTSFYFGYTLMFCLGLGILCGAVGYLGSNLFVRRIYRNIKCD

SEQ ID NO: 8429 - protein, 591 aa, Papaver somniferum
MHRFFYLFFLSPFLLHFISPNLASESDHKYSQDESVTLWVNKVGPYNNPQETYNYYSLPFCQLSGGNGNAAHKWGGLGEVLGGNELIDSQIDIKYRKNVDKSTICELELDAAKVKQFKDAIENTYWFEFFIDDLPLWGYVGELHPDKNNDNTKHVLYTHKSITFRYNEDQIIHVNLTQEDPKPLEAGKTLDMTYSVKWIPTNITFGRRFDVYLDYPFFEHQIHWFSIFNSFMMVIFLTGLVSMILMRTLRNDYAKYAREDDDLETLERDASEESGWKLVHGDVFRSPRNLVLLSAVVGTGAQLAMLVLLVILLAIIGMLYIGRGAIVTTFIVCYALTSFISGYVSGGLYSRSGGKSWIKSMILTASLFPFMCFGIGFALNTIAIFYGSLAAIPFGTMVVVFVIWAFISFPLALLGTVVGRNWSGAPNNPCRVKTIPRPIPEKKWYLTPSVVSLMGGLLPFGSIFIEMYFVFTSFWNYKVYYVYGFMLLVFLILVIVTVCVTIVGTYFLLNAENYHWQWTSFFSAASTAIYVYLYSIYYYYVKTRMSGFFQTSFYFGYTAMFCLGLGILCGAVGYLGSTLFVRRIYRNIKCD

SEQ ID NO: 8430 - protein, 591 aa, Papaver somniferum
MHRFFYLFFLSPFLLHFISPNLASESDHKYSQDESVTLWVNKVGPYNNPQETYNYYSLPFCQLSGGNGNAAHKWGGLGEVLGGNELIDSQIDIKYRKNVDKSTICELELDAAKVKQFKDAIENTYWFEFFIDDLPLWGYVGELHPDKNNDNTKHVLYTHKSITFRYNEDQIIHVNLTQENPKPLEAGKTLDMTYSVKWIPTNITFGRRFYVYLDYPFFEHQIHWFSIFNSFMMVIFLTGLVSMILMRTLRNDYAKYAREDDDLETLERDVSEESGWKLVHGDVFRSPRNLVLLSAVVGTGAQLAMLVLLVILLAIIGMLYIGRGAIVTTFIVCYALTSFISGYVSGGLYSRSGGKSWIKSMILTASLFPFMCFGIGFALNTIAIFYGSLAAIPFGTMVVVFVIWAFISFPLALLGTVVGRNWSGAPNNPCRVKTIPRPIPEKKWYLTPSVVSLMGGLLPFGSIFIEMYFVFTSFWNYKVYYVYGFMLLVFLILVIVTVCVTIVGTYFLLNAENYHWQWTSFFSAASTAIYVYLYSIYYYYVKTRMSGFFQTSFYFGYTAMFCLGLGILCGAVGYLGSTLFVRRIYRNIKCD

SEQ ID NO: 8431 - protein, 584 aa, Glycine max
MFVLFRFSLLPLFLSLVFASESDHRYQQDDPVTLWVNKVGPYNNPQETYNYYSLPFCRPPGNTAHKWGGLGEVLGGNELIDSQLEIKFLGNVEKTIFCRIELDEAKVKQFKDAIENNYWFEFFMDDLPLWGYVGELHPDKNGDNGKHVLYTHKNINVQYNKDQIIHVNLTNDNPRPLEVGKPLDMTYSVKWSPTNVTFGRRFDVYLDYPFFEHQIHWFSIFNSFMMVIFLTGLVSMILMRTLRNDYAKYAREDDDLETLERDVSEESGWKLVHGDVFRPPRSLVILSAIVGTGAQLALLVLLVILLAIVGMLYVGRGAIVTTFIVCYALTSFISGYVSGGMYSRNGGKNWIKSMILTASLFPFMCFGIGFILNTIAIFYGSLAAIPFGTMVVVFVIWAFISFPLALLGTVVGRNWSGAPNNPCRVKTIPRPIPEKKWYLTPSVVSLMGGLLPFGSIFIEMYFVFTSFWNYKVYYVYGFMLLVFLILIIVTVCVTIVGTYFLLNAENYHWQWTSFFSAASTAVYVYLYSVYYYYVKTKMSGFFQTSFYFGYTLMFCLGLGILCGAVGYLGSNLFVRRIYRNIKCD

SEQ ID NO: 8432 - protein, 567 aa, Panicum virgatum
MLSRGVLLLAAILLAVARLPHAYASEADHKYKAEEPVKLWVNKVGPYNNPQETYNYYSLPFCQPSENPTHKWGGLGEVLGGNELIDSQIDIKFLKNVDKGPICIIELDAQKVQQFSDAIESSYWFELFIDDLPLWGFVGETDKNNENKHYLYTHKNIVVKYNGNRIIHVNLTQESPKLLEAGKKLDMTYSVKWVQTNVAFARRFEVYLDYPFFEHQIHWFSIFNSFMMVIFLTGLVSMILMRTLRNDYAKYAREDDDLESLERDVNEESGWKLVHGDVFRPPRGLVFLSALVGIGTQLAALILLVIVLAIVGMLYVGRGAIITTFIVCYALTSFISGYVSGGLYSRNGGKNWIKSMILTASLFPFLCFSIGLVLNTIAIFYRSLAAIPFGTMVVIFVLWAFISFPLVLLGTVVGRNWIGAPNNPCRVKTIPRPIPEKKWYLTPSVISLMGGLLPFGSIFIEMYFVFTSFWNYKVYYVYGFMLLVFVILIIVTICVTIVGTYFLLNAENYHWQWTSFFSAASTALYVYLYSIYYYHVKTKMSGFFQTSFYFGYTLMFCLGLGILCGEL

SEQ ID NO: 8433 - protein, 592 aa, Citrullus lanatus
MSSTVRSTSVTFFFASLLISSLSTVFASESDHKYQADESVTLWVNKVGPYNNPQETYNYYSLPFCHPSGQSGHKWGGLGEVLGGNELIDSQIEIKFQKNVERTTICQLELDEQKVKQFKDAIENGYWFEFFMDDLPLWGFVGELHPDKNSNNIKHVLYTHKNIIIKYNKDQIIHVNLTQENLKPLEVGKTLDLTYAVKWIPTNVTFARRFDIYLDYPFFEHQIHWFSIFNSFMMVIFLTGLVSMILMRTLRNDYAKYAREDDDLETLERDVSEESGWKLVHGDVFRPPRNLVILSAVVGTGAQLALLVLLVILLAIVGMLYVGRGAIVTTFIVCYALTSSISGYVSAGMYSRNGGKNWIKSMIFTASLFPFLCFGIGFILNTIAIFYGSLAAIPFGTMVVVFVIWAFISFPLALLGTVIGRNWSGAPNNPCRVKTIPRPIPEKKWYLTPSVVSMMGGLLPFGSIFIEMYFVFTSFWNYKVYYVYGFMLLVFLILIIVTVCVTIVGTYFLLNAENYHWQWTSFFSAASTAVYVYFYSIYYYYVKTKMSGFFQTSFYFGYTLMFCLGLGILCGAVGYLGSNLFVRRIYRNIKCD

SEQ ID NO: 8434 - protein, 400 aa, Eschscholzia californica
MTYSVKWVPTNITFGRRFDVYLDYPFFEHQIHWFSIFNSFMMVIFLTGLVSMILMRTLRNDYAKYAREDDDLETLERDVSEESGWKLVHGDVFRSPRNLVILSAVVGTGAQLAMLVFLVIILAIIGMLYIGRGAIVTTFIVCYALTSFISGYVSGGLYSRSGGKSWIKSMILTASLFPFMCFGIGFILNTVAIFYGSLAAIPFGTMVVVFVIWAFISFPLALLGTVVGRNWSGAPNNPCRVKTIPRPIPEKKWYLTPSVVSLMGGLLPFGSIFIEMYFVFTSFWNYKVYYVYGFMLLVFVILVIVTVCVTIVGTYFLLNAENYHWQWTSFFSAASTAIYVYLYSIYYYYVKTKMSGFFQTSFYFGYTLMFCLGLGILCGAVGYLGSTLFVRRIYRNIKCD

SEQ ID NO: 8435 - protein, 597 aa, Manihot esculenta
MAMSASSTSVRSSIFPHFAFISLILLLSPVLASEADHKYQSDDPVTLWVNKVGPYNNPQETYNYYSLPFCHPSGSAGHKWGGLGEVLGGNELIDSKIDIKFLRNVDKGTICSLELDEAKVKQFKEAIENNYWFEFFMDDLPLWGFVGELHPDKNSDNGKHVLYTHKSINVKYNKDQIIHVNLTQDGPKPLEVGRIYDMTYSVRWISTNITFARRFDVYLDYPFFEHQIHWFSIFNSFMMVIFLTGLVSMILMRTLRNDYAKYAREDDDLESLERDVSEESGWKLVHGDVFRSPRNLVVLSAVVGTGAQLALLVLLVILLAIGGTLYVGRGAIVTTFIVCYALTSFISGYVSGGMYSRHGGKTWIKSMILTASLFPFMCFGIGFLLNTIAIFYGSLAAIPFGTMVVVFVIWAFISFPLALLGTVVGRNWSGAPNNPCRVKTIPRPIPEKKWYLTPSVVSLMGGLLPFGSIFIEMYFVFTSFWNYKVYYVYGFMLLVFLILIIVTVCVTIVGTYFLLNAENYHWQWTSFFSAASTAVYVYLYSIYYYCVKTKMSGFFQTSFYFGYTLMFCLGLGILCGAVGYLGSNLFVRRIYRNIKCD

SEQ ID NO: 8436 - protein, 588 aa, Valeriana officinalis
MWPTVRSSSLFAVILLLIVSPVFSSDSDHKYQPDDSVTLWVNKVGPYNNPQETYNYYSLPFCHSTGNAAHKWGGLGEVLGGNELIDSQIDIKYQKNVERSSICELELDEAKVKQFKDAIENSYWFEFFMDDLPLWGFVGEQHADRNSDNKLVLYTHKSVVVKYNKDQIIHVNLTQESPKPLEVGRILDMTYSIKWIPTNITFARRFDVYLDYPFFEHQIHWFSIFNSFMMVIFLTGLVSMILMRTLRNDYAKYAREDDDLETLERDVSEESGWKLVHGDVFRSPRNLVLLSAVVGMGAQLALLVLLVILCAIIGMLYIGRGAIVTTFIVCYTLTSFISGYVSGGMYSRNGGKHWIKSMILTASLFPFLCFGIGFILNTIAIFYGSLAAIPFGTMVVVFVIWGFISFPLGLLGTVVGRNWSGAPNNPCRVKTIPRPIPEKKWYLTPSVVSMMGGLLPFGSIFIEMYFVFTSFWNYKVYYVYGFMLLVFLILTIVTVCVTIVGTYFLLNAENYHWQWTSFFSAASTAVYVYLYSIYYYYVKTKMSGFFQTSFYFGYTLMFCLGLGILCGAVGYLGSNLFVRRIYRNIKCD

SEQ ID NO: 8437 - protein, 460 aa, Amorphophallus konjac
MDDLPLWGFVGEMRSDRNNENKHYLFTHKDIVVKYNGDQIIHVNLTQEGPKLLEVGRTLDMTYSVKWIKTNITFAKRFDVYLDYPFFEHQIHWFSIFNSFMMVLFLTGLVSMILMRTLRNDYAKYAREDDDLETLERDVTEESGWKLVHGDVFRPPRNLVLLSAVVGTGAQLTMLVLLVILLAIIGMLYVGRGAIVTTFIVCYALTSFISGYVSGGLYSRSGGKNWIKSMTLAASLFPFMCFGIGFILNTIAIFYGSLAAIPFGTMVVVFVIWAFISFPLTLLGTVVGRNWSGSPNNPCRVKTIPRPIPKKKWYLTPSIVSLMGGLLPFGSIFIEMYFVFTSFWNYKVYYVYGFMLLVFVILIIVTVCVTIVGTYFLLNAENYHWQWTSFFSAASTAVYVYLYSIYYYHVKTKMSGFFQISFYFGYTLMFCLGLGILCGAVGYLGSSLFVRRIYRNIKCD

SEQ ID NO: 8438 - protein, 584 aa, Gossypium raimondii
MLSSVRSFSLSAFIFFVFFSSLAFASESDHKYQPDDPITLWVNKVGPYNNPQETYNYYILPFCHPGVNPAHKWGGLGEVLGGNELIDSQIDIKFQKNVDKGTICQLELDEAKVKQFKDAIENNYWFEFFVGFVGELHPDKNSDNGKHVLYTHKNIVIKYNKDQIIHVNLTQGSPKPLEAGRVLDMTYSIKWLPTNVTFARRFDVYLDYPFFEHQIHWFSVFNSFMMVIFLTGLVSMILMRTLRNDYAKYAREDDDLETLERDVSEESGWKLVHGDVFRPPRGLVLLSAVVGTGAQLALLVLLVILLAIVGTLYVGRGAIVTTFILCYAFTSFISGYVSGGMYSRNGGKSWIKSMILSASLFPFLCFGIGFILNTIAIFYGSLAAIPFGTMVVVFVIWAFISFPLALLGTVVGRNWSGAPNNPCRVKTIPRPIPEKKWYLTPSVVSLMGGLLPFGSIFIEMYFVFTSFWNYKVYYVYGFMLLVFLILVIVTVCVTIVGTYFLLNAENYHWQWTSFFSAASTAVYVYMYSVYYYYVKTKMSGFFQTSFYFGYTLMFCLGLGILCGAVGYLGSNLFVRRIYRNIKCD

SEQ ID NO: 8439 - protein, 588 aa, Helianthus annuus
MCPAVRSPLLFIASFLLISSSVFASEYDHKYQSDEPITLWVNKVGPYNNPQETYNYYSLPFCRPSGNPGHKWGGLGEVLGGNELIDSQIDIKFQKNVDKTSICELDLDESKVKQFKEAIENNYWFEFFMDDLPLWGYVGELHTDRNSDSKHMLFTHKNITIQYNKDQIIHVNLTQENPRPLEAGKTLDMTYSVKWTETNISFAHRFDVYLDYHFFEHQIHWFSIFNSFMMVIFLTGLVSMILMRTLRNDYAKYAREDDDLESLERDVSEESGWKLVHGDVFRPPRHLVLLSAVVGTGAQLALLILLVILFAIVATLYIGRGAIVTTFIVCYALTSFVSGYVSGGMYSRHGGKNWIKSMILTASLFPFLCFGIGFVLNTVAIFYGSLAAIPFGTMVVVFVIWAFISFPLALLGTVVGRNWSGAPNNPCRVKTIPRPIPEKKWYLTPSVVSIMGGLLPFGSIFIEMYFVFTSFWNYKVYYVYGFMLLVFLILIIVTVCVTIVGTYFLLNAENYHWQWTSFFSAASTAIYVYLYSIYYYSVKTKMSGFFQTSFYFGYTAMFCLGLGILCGAVGYLGSNLFVRRIYRNIKCD

SEQ ID NO: 8440 - protein, 603 aa, Manihot esculenta
SFPPVFLFVQFYIFCVRLCFIRFSISLNSYIIFLLILLSYIFLQYQPDDPVTLWVNKVGPYNNPQETYNYYSLPFCHPSGTAAHKWGGLGEVLGGNELIDSKIDLKFQKNVDKRTICSLELDEAKVRQFKDAIENNYWFEFFMDDLPLWGFVGELHPDKNSDNGKHVLYTHKSIFVKYNKDQIIHVNLTQEGPKPLEAGRILDMTYSIKWIPTNITFARRFDVYLDYPFFEHQIHWFSIFNSFMMVIFLTGLVSMILMRTLRNDYAKYAREDDDLDSLERDVSEESGWKLVHGDVFRPPRYLVVLSAVVGTGAQLALLVLLVILLAIVGTLYIGRGAIVTTFIVCYALTSFISGYVSGGMYSRHGGKNWIKSMILTASLFPFMCFGIGFILNTIAIFYGSLAAIPFGTMVVVFIIWAFISFPLALLGTVVGRNWSGAPNNPCRVKTIPRPIPEKKWYLTPSVVSLMGGLLPFGSIFIEMYFVFTSFWNYKVYYVYGFMLLVFLILIIVTICVTIVGTYFLLNAENYHWQWTSFFSAASTAVYVYLYSIYYYYVKTKMFGFFQTSFYFGYTLMFCLGLGILCGAVGYLGSNLFVRRIYRNIKCD

SEQ ID NO: 8441 - protein, 562 aa, Panicum virgatum
YASLMQYKAEEPVKLWVNKVGPYNNPQETYNYYSLPFCQPSENPIHKWGGLGEVLGGNELIDSQLEMKFLRNEEKGFICTLELDSKKVQQFADAIENSYWFEFFIDDLPLWGFVGETDKNSENKHYLYTHKNILVKYNENRIIHVNLTQESPKLLEAGKKLDMTYSVKWIATDVSFARRFEVYLDYPFFEHQIHWFSIFNSFMMVIFLTGLVSMILMRTLRNDYAKYAREDDDLESLERDVNEESGWKLVHGDVFRPPQSLMFLSALVGIGTQLAALILLVIVLAIVGMLYIGRGAIITTFIVCYALTSFISGYVSGGLYSRNGGKNWIKAMVLTASLFPFLCFSIGFALNTIAIFYRSLAAIPFGTMVVMFVLWAFISFPLVLLGTVVGRNWSGAPNNPCRVKTIPRPIPEKKWYLTPSVISLMGGLLPFGSIFIEMYFVFTSFWNYKVYYVYGFMLLVFVILLIVTICVTIVGTYFLLNAENYNWQWTSFFSAASTALYVYLYSIYYYHVKTKMSGFFQTSFYFGYTLMFCLGLGILCGAIGYVGSTLFVRRIYRNIKCD

SEQ ID NO: 8442 - protein, 589 aa, Amsonia hubrichtii
MRLTVRSFALLSLLATFFLASPAFASEYDHKYQEEDKVTLWVNKVGPYNNPQETYNYYSLPFCKPEGVAAHKWGGLGEVLGGNELIDSLIDIKFKKKVEKTTFCELELDETKVKQFKNAIENSYWFEFFMDDLPLWGFVGEFHSDRNSDNKHVLYTHKSIDVKYNKDQIIHVNLSQESPKPLEIGRTLDMTYSVKWMPTNVTFAHRFDVYLDYPFFEHQIHWFSIFNSFMMVIFLTGLVSMILMRTLRNDYAKYAREDDDLETLERDVSEESGWKLVHGDVFRPPRNLVLLSALVGTGAQLAVLVLVVILSAIVGMLYVGRGTIGTAFIVCYVLTSIVSGYVSGGMYSRNGGKNWIKSMILTATLFPFMCFGIGFMLNTIAIFYGSLAAIPFGTMVVVLVIWTFISFPLALVGTVVGRNWSGAPNNPCRVKTIPRPIPEKKWYLTPSVVSLMGGLLPFGSIFIEMYFVFTSFWNYKVYYVYGFMLLVFLILIIVTVCVTIVGTYFLLNAENYHWQWTSFFSAASTAVYVYLYSVYYYHVKTKMSGFFQTSFYFGYTLMFCIGLGILCGAVGYLGSNLFVRRIYRNIKCD

SEQ ID NO: 8443 - protein, 593 aa, Flaveria ramosissima
MWPNLRSSHHLTALIFIASYLLISSPVFASEYDHKYQSDEPVTLWVNKVGPYNNPQETYNYYSLPFCRQSGNPSHKWGGLGEVLGGNELIDSQIDIKFQKNVDKATICELELDESKVKQFKEAIENGYWFEFFMDDLPLWGYVGELRTDRNSDSKHMLFTHKNITIQYNKDQIIHVNLTQENPKPLEAGKTLEMTYSVKWTETNTNFAHRFDVYLDYHFFEHQIHWFSIFNSFMMVIFLTGLVSMILMRTLRNDYAKYAREDDDLESLERDVSEESGWKLVHGDVFRPPRNLVLLSAVVGTGAQLALLILLVILFAIVATLYVGRGAIVTTFIVCYALTSFVSGYVSGGMYSRHGGKNWIKSMILTASLFPFLCFGIGFILNTIAIFYGSLAAIPFGTMVVVFVIWAFISFPLTLLGTVVGRNWSGAPNNPCRVKTIPRPIPEKKWYLTPSVVSIMGGLLPFGSIFIEMYFVFTSFWNYKVYYVYGFMLLVFLILVIVTVCVTIVGTYFLLNAENYHWQWTSFFSAASTAIYVYLYSIYYYYVKTKMSGFFQTSFYFGYTAMFCLGLGILCGAVGYLGSNLFVRRIYRNIKCD

SEQ ID NO: 8444 - protein, 596 aa, Populus trichocarpa
MSSAIRSLPLIAFISLLLLSPALAFDADHRYGQEEAVKLWVNKVGPYNNPQETYNYYSLPFCHPSSNDGTHKWGGLGEVLGGNELIDSQIDLKFAKNVDKAVICQLELDEAKVKQFKDAIENSYWFEFFIDDLPLWGFVGELRPDKNSDNGKHLLFTHKSITIKYNKDQHLRLQIIHVNLTQENPKPLEAGTVLEMTYSVKWSLTNVSFARRFDVYLDYPFFEHQIHWFSIFNSFMMVIFLTGLVSMILMRTLRNDYAKYARDDDDLVESLERDVSEETGWKLVHGDVFRPPRSLVVLSAVVGTGAQLAMLVLLVILMAIVGTLYVGRGAIVTTFIVCYALTSFIAGYVSGGMYSRHGGKSWIKSMILTACLFPCMCFGIGFILNTIAIFYGSLAAIPFGTMVVVFVIWAFISFPLALLGTVVGRNWSGAPNNPCRVKTIPRPIPEKKWYLTPSVVSMMGGLLPFGSIFIEMYFVFTSFWNYKVYYVYGFMLLVFLILIIVTVCVTIVGTYFLLNAENYHWQWTSFFSAASTAVYVYLYSIYYYSVKTKMSGFFQTSFYFGYTLMFCLGLGILCGAVGYLGSNLFVRRIYKNIKCD

SEQ ID NO: 8445 - protein, 593 aa, Cucumis melo
MSSTLRSTSVTFFFFSSLLISSLSIVLASESDHKYQQDELVTLWVNKVGPYNNPQETYNYYSLPFCHPSGHSAHKWGGLGEVLGGNELIDSQIEIKFQKNVERTTICQLELDESKVKQFKDAIENGYWFEFFMDDLPLWGFVGELHPDKNSNNVKHVLYTHKNIIIKYNKDQIIHVNLTQENLKPLEVGKTLDLTYAVKWISTNVTFARRFDIYLDYPFFEHQIHWFSIFNSFMMVIFLTGLVSMILMRTLRNDYAKYAREDDDLETLERDVSEESGWKLVHGDVFRPPRNLVILSAVVGTGAQLALLVLLVILLAIVGMLYVGRGAIVTTFIVCYALTSSISGYVSAGMYSRNGGKNWIKSMIFTASLFPFLCFGIGFILNTIAIFYGSLAAIPFGTMVVVFVIWAFISFPLALLGTVIGRNWSGAPNNPCRVKTIPRPIPEKKWYLTPSVVSMMGGLLPFGSIFIEMYFVFTSFWNYKVYYVYGFMLLVFLILIIVTVCVTIVGTYFLLNAENYHWQWTSFFSAASTAVYVYFYSIYYYYVKTKMSGFFQTSFYFGYTLMFCLGLGILCGAVGYLGSNLFVRRIYRNIKCD

SEQ ID NO: 8446 - protein, 307 aa, Flaveria ramosissima
MWPNLRSPHHLTALIFIASFLLISSPVSASEYDHKYQSDEPVTLWVNKVGPYNNPQETYNYYSLPFCRQSGNPSHKWGGLGEVLGGNELIDSQIDIKFQKNVDKATICELELDESKVKQFKEAIENNYWFEFFMDDLPLWGYVGDLRSDRNSDSKHMLFTHKNITIQYNKDQIIHVNLTQENPKPLEVGKSLEMTYSVKWTETNTNFAHRFDVYLDYHFFEHQIHWFSIFNSFMMVIFLTGLVSMILMRTLRNDYAKYAREDDDLESLERDVSEESGWKLVHGDVFRPLVIWFYCQQLLERVLNWRC

SEQ ID NO: 8447 - protein, 182 aa, Ambrosia trifida
MWAAVLFSAFFLLISSPVLASEYDHKYQTDEAINLWVNKVGPYNNPQETYNYYSLRFVVNLVTLGISGVAWVKYWAEMNLLIVNMTSSFKRMWRRLQFVSLNLMNRRLSSLKTPLRIIIGLNFSWMICHSGVLLGRYIPIRIAIASICYSPIRILLYTTTKIRSFMLISLKRTRNHWKLGKH

SEQ ID NO: 8448 - protein, 556 aa, Triticum aestivum
YKISEPVKLWVNKVGPYNNPQETYNYYSLPFCQPAENPAHKWGGLGEVLGGNELIDSQIDIQFLKNVDKGPICTIELDAKKVQQFTDAIESSYWFELFIDDLPLWGFVGETDKNNENKHYLYTHKNIVVKYNGNRVIHVNLTQESPKLLEAGRKLDMTYSVKWVQTNVAFARRFEVYLDYPFFEHQIHWFSIFNSFMMVIFLTGLVSMILMRTLRNDYAKYAREDDDLESLERDVSEESGWKLVHGDVFRPPRNLMFLSAVVGIGTQMAALILLVIVLAIVGMLYVGRGAIITTFIVCYALTSFISGYVSGGLYSRNGGKNWIKSMVLTASLFPFLCFSIGLVLNTIAIFYHSLAAIPFGTMVVIFVLWAFISFPLVLLGTVVGRNWSGAPNNPCRVKTIPRPIPEKKWYLTPSVISLMGGLLPFGSIFIEMYFVFTSFWNYKVYYVYGFMLLVFVILLIVTVCVTIVGTYFLLNAENYHWQWTSFFSAASTALYVYLYAIYYYHVKTKMSGFFQTSFYFGYTLMFCLGLGILCGAIGYLGSTLFVRRIYRNIKCD

SEQ ID NO: 8449 - protein, 562 aa, Hordeum vulgare
YVSYMQYKSGDSVKLWVNKVGPYNNPQETYNYHSLPFCQPSENPGHKWGGLGEVLGGNELIDSQLDIKFLKNVERGSICTLELDSKKIQQFADAIESSYWFEFFIDDLPLWGFVGETDKNSENKHYLYTHKNILVKYNDNRIIHVNLTQESPKLLEAGKKLELTYSVKWVPTDVSFARRFEVYLDYPFFEHQIHWFSIFNSFMMVIFLTGLVSMILMRTLRNDYAKYARDDDDLESLERDVNEESGWKLVHGDVFRPPRSLTLLSALVGIGTQLAALILLVIVLAIVGMLYVGRGAIITTFIVCYALTSFISGYVSAGLYSRNGGKNWIKAMILTASLFPFLHFAIGFALNTIAIFYGSLAAIPFGTMVVMFVLWAFISFPLVLLGTVVGRNWSGAPNNPCRVKTIPRPIPERKWYLTPSVISLMGGLLPFGSIFIEMYFVFTSFWNYKVYYVYGFMLLVFVILLIVTICVTIVGTYFLLNAENYHWQWTSFFSAASTALYVYLYSIYYYHVKTKMSGFFQTSFYFGYTLMFCLGLGILCGAIGYVGSTLFVRRIYRNIKCD

SEQ ID NO: 8450 - protein, 588 aa, Arabidopsis lyrata
MPSSSSAVVVFLLLVSLLTPTFASDSDHKYQADEQVTLWVNKVGPYNNPQETYNYYSLPFCRPSGNNVHKWGGLGEVLGGNELIDSEIAIKFLKNVDRNVICPLELDEAKVKHFKDAIESSYWFEFFMDDLPLWGFVGELHPDKNSENGKHVLYTHKNIVVKYNKDQIIHVNLTQDNPRPLEAGKKMDLTYSVQWIPTNVTFARRFDVYLDYPFFEHQIHWFSIFNSFMMVIFLTGLVSMILMRTLRNDYAKYAREDDDLESLERDVSEESGWKLVHGDVFRPASSLVLLSAVVGTGAQLALLVLLVILMAIVGTLYVGRGAIVTTFIVCYALTSFVSGYVSGGMYSRSGGKHWIKCMVLTASLFPFLCFGIGFLLNTIAIFYGSLAAIPFGTMVVVFVIWGFISFPLALLGTVVGRNWSGAPNNPCRVKTIPRPIPEKKWYLTPSVVSLMGGLLPFGSIFIEMYFVFTSFWNYKVYYVYGFMLLVFVILVIVTVCVTIVGTYFLLNAENYHWQWTSFFSAASTAVYVYLYSIYYYYVKTKMSGFFQTSFYFGYTMMFCLGLGILCGAVGYLGSNLFVRRIYRNIKCD

SEQ ID NO: 8451 - protein, 589 aa, Arabidopsis thaliana
MPSSSSAAVLVFLLLVSLLTPTFASDSDHKYQAEEQVTLWVNKVGPYNNPQETYNYYSLPFCRPSGNNVHKWGGLGEVLGGNELIDSEIAIKFMKNVERSVICPLELDEAKVKHFKDAIESSYWFEFFMDDLPLWGFVGELHPDKNSENGKHVLYTHKNIVVKYNKDQIIHVNLTQDNPRPLEAGKKMDLTYSVQWIPTNVTFARRFDVYLDYPFFEHQIHWFSIFNSFMMVIFLTGLVSMILMRTLRNDYAKYAREDDDLESLERDVSEESGWKLVHGDVFRPASSLVLLSAVVGTGAQLALLVLLVILMAIVGTLYVGRGAIVTTFIVCYALTSFVSGYVSGGMYSRSGGKHWIKCMVLTASLFPFLCFGIGFLLNTIAIFYGSLAAIPFGTMVVVFVIWGFISFPLALLGTVVGRNWSGAPNNPCRVKTIPRPIPEKKWYLTPSVVSLMGGLLPFGSIFIEMYFVFTSFWNYKVYYVYGFMLLVFVILVIVTVCVTIVGTYFLLNAENYHWQWTSFFSAASTAVYVYLYSIYYYYVKTKMSGFFQTSFYFGYTMMFCLGLGILCGAVGYLGSNLFVRRIYRNIKCD

SEQ ID NO: 8452 - protein, 593 aa, Cucumis sativus
MSSTLRSSSVTFFFFSSLLISSLSIVLASESDHKYLQDESVTLWVNKVGPYNNPQETYNYYSLPFCHPSGHSAHKWGGLGEVLGGNELIDSQIEIKFQKNVERTTICQLELDESKVKQFKDAIENGYWFEFFMDDLPLWGFVGELHPDKNSNNVKHVLYTHKNIIIKYNKDQIIHVNLTQENLKPLEVGKTLDLTYAVKWISTNVTFARRFDIYLDYPFFEHQIHWFSIFNSFMMVIFLTGLVSMILMRTLRNDYAKYAREDDDLETLERDVSEESGWKLVHGDVFRPPRNLVILSAVVGTGAQLALLVLLVILLAIVGMLYVGRGAIVTTFIVCYALTSSISGYVSAGMYSRNGGKNWIKSMIFTASLFPFLCFGIGFILNTIAIFYGSLAAIPFGTMVVVFVIWAFISFPLALLGTVIGRNWSGAPNNPCRVKTIPRPIPEKKWYLTPSVVSMMGGLLPFGSIFIEMYFVFTSFWNYKVYYVYGFMLLVFLILIIVTVCVTIVGTYFLLNAENYHWQWTSFFSAASTAVYVYFYSIYYYYVKTKMSGFFQTSFYFGYTLMFCLGLGILCGAVGYLGSNLFVRRIYRNIKCD

SEQ ID NO: 8453 - protein, 473 aa, Tripterygium wilfordii
MQLRTVIGLNFSWMTCHYGALSANYILIRTAITTSMFFTHIKALLLNTTTTRSFMLISLKKTPKPLEDGTTLDMTYSVKWVPTNITFGRRFDVYLDYPFFEHQIHWFSIFNSFMMVIFLTGLVSMILMRTLRNDYAKYAREDDDLETLERDVSEESGWKLVHGDVFRPPRNLVLLSAVVGTGAQLALLVLLVILLAIVAMLYVGRGAIVTTFIVCYALTSFISGYVSGGMYSRHGGKSWIKSMILTASLFPFMCFGIGFILNTIAIFYGSLAAIPFGTMVVVFVIWAFISFPLALLGTVVGRNWSGAPNNPCRVKTIPRPIPEKKWYLTPSVVSMMGGLLPFGSIFIEMYFVFTSFWNYKVYYVYGFMLLVFLILIIVSVCVTIVGTYFLLNAENYHWQWTSFFSAASTAVYVYFYSIYYYHVKTKMSGFFQTSFYFGYTLMFCLGLGILCGAVGYLGSNLFVRRIYRNIKCD

SEQ ID NO: 8454 - protein, 602 aa, Ricinus communis
MSSSSAFASITTVRIRSPAISLFAFISLILLLSPVLASESDHKYQQDESVTLWVNKIGPYNNPQETYNYYSLPFCHPSGSAGHKWGGLGEVLGGNELIDSKIDIKFQKNVERGTICSLELDEARVKIFKDAIENNYWFEFFMDDLPLWGFVGELRPDKNSDNGKHVLYTHKSITVRYNKDQIIHVNLTQDNPKPLETGRIVDMTYSVKWLPTNITFARRFDVYLDHPFFEHQIHWFSIFNSFMMVIFLTGLVSMILMRTLRNDYAKYAREDDDLETLERDVSEESGWKLVHGDVFRPPRNLVVLSAVVGTGAQLALLVLLVILLAIVGTLYVGRGSIVTTFIVCYALTSFISGYVSGGMYSRHGGKSWIKSMILTASLFPFMCFGIGFILNTIAIFYGSLAAIPFGTMVVVFVIWAFISFPLALLGTVVGRNWSGAPNNPCRVKTIPRPIPEKKWYLTPSVVSLMGGLLPFGSIFIEMYFVFTSFWNYKVYYVYGFMLLVFLILIIVTVCVTIVGTYFLLNAENYHWQWTSFFSAASTAVYVYLYSIYYYYVKTKMSGFFQTSFYFGYTLMFCLGLGILCGAVGYLGSNLFVRRIYRNIKCD

SEQ ID NO: 8455 - protein, 589 aa, Phalaenopsis aphrodite
MVVTARSLTHLAAGIAIVILTAWPASASESDHKYQPDDPVTLWVNKVGPYNNPQETYNYYSLPFCQPRENPPHKWGGLGEVLGGNELIDSQIELKFQKNIEKGSICSLELDDVKVNIFKDAIETSYWFEFFIDDLPLWAFVGETGKTDENKHYLFTHKNILVRYNGDQIIHVNITQEIPKLLEPGKTLELTYSVKWIATNVTFAHRFDVYLDYPFFEHQIHWFSIFNSFMMVIFLTGLVSMILMRTLRNDYAKYAREDDDLETLERDVSEESGWKLIHGDVFRPVRNLALLSAVVGTGAQLALLVLLVILLAIIGMLYVGRGSIQTTFILCYAFTSFISGYVSGGLYSRNGGKSWIKTMILTASLFPFLCFGIGFVLNTIAIFYRSLAAIPFGTMVVVFVIWAFISFPLTLLGTVVGRNWSGVPSNPCRVKTIPRPIPEKKWYLTPFIVSLMGGLLPFGSIFIEMYFVFTSFWNYKVYYVYGFMLLVFLILNIVAVCVTIVGTYFLLNAENYHWQWTSFFSAASTAAYVYLYSIYYFYVKTKMSGFFQTSFYFGYTLMFCLGLGILCGAVGFLGSSLFVRRIYRNIKCD

SEQ ID NO: 8456 - protein, 587 aa, Olea europaea
MRSTVRLSFLLLASFSLLSLAFASESDHKYQPDDPVTLWVNKVGPYNNPQETYNYYSLPFCRPSGNAAHKWGGLGEVLGGNELIDSLIDIKFRKPVDKTTICELELDEAKVKQFKDAIENSYWFEFFIDDLPLWGFVGELHSDKNNDNKHVLYTHKSITVNYNKDQIIHVNLTQGGAKPLEVGKTVDMTYSVKWIPTKTSFARRFDVYLDYPFFEHQIHWFSIFNSFMMVIFLTGLVSMILMRTLRNDYAKYAREDDDLETLERDVNEESGWKLVHGDVFRTPRGLVLLSALVGTGAQLALLVLIVVLFAIVGMLYIGRGAIVTTFIICYAFTSFISGYVSGGMYSRHGGKNWIKSMIFTASFFPFLCFGIGFVLNTIAIFYGSLAAIPFGTMVIVFVIWAFISFPLALLGTVVGRNWSGAPNNPCRVKTIPRPIPEKKWYLTPSVVSVMGGLLPFGSIFIEMYFVFTSFWNYKVYYVYGFMLLVFVILIIVTVCVTIVGTYFLLNAENYHWQWTSFFSAASTAIYVYLYSIYYYYVKTKMSGFFQMSFYFGYTLMFCLGLGILCGAVGYLGSNLFVRRIYRNIKID

SEQ ID NO: 8457 - protein, 294 aa, Distylium racemosum
MGHFNKKQQKPWLFLCLVLCLLQAFHTNLASEYDHKYRAGDSVTLWVNKVGPYNNPQETYNYYSLPFCQPKKNPVHKWGGLGEVLGGNELIDSQIDIKFGKPVERGTICELELDDAKVKQYKDAIENTYWFEFFMDDLPLWGFVGEQHPHKSDDQKYLLYTHKNIIVKFNNDQIIHVNLTQENPTPLVAGKTLEFTYSVKWVETNVTFARRFDVYLDYPFFEHQIHWFSIFNSFMMVIFLTGLVSMILMRTLRNDYAKYAREDDDLESLERDVSEESGWKLVHGDVSVHLETWS

SEQ ID NO: 8458 - protein, 594 aa, Gossypium raimondii
MSSSVVSTVRSTLSLFVVVFIFFSPVFASESDHKYQPDDPVTLWVNKVGPYNNPQETYNYYSLPFCHLGTNPAHKWGGLGEVLGGNELIDSQIDIKFQKNVEKSTICQLELDEAKVREFKDAIENSYWFEFFMEFNVNFLGFVGELHPDRNSDNGKHVLYTHKNIIIKYNKDQIIHVNLTQESPKPLEAGRIFDLTYSIKWIPTNVTFARRFDVYLDYPFFEHQIHWFSVFNSFMMVIFLTGLVSMILMRTLRNDYAKYAREDDDLETLERDVSEESGWKLVHGDVFRPPYNLVLLSAVVGTGAQLALLVLLVILLAIVGTLYVGRGAIVTTFILCYAFTSFISGYVSGGMYSRNGGKSWIKSMILTACLFPFMCFGIGFILNTVAIFYGSLAAIPFGTMVVVFVIWAFISFPLALLGTVVGRNWSGAPNNPCRVKTIPRPIPEKKWYLTPSVVSLMGGLLPFGSIFIEMYFIFTSFWNYKVYYVYGFMLLVFLILIIVTVCVTIVGTYFLLNAENYHWQWTSFFSAASTAVYVYLYSVYYYHVKTKMSGFFQTSFYFGYTLMFCLGLGILCGAVGYLGSNLFVRRIYRNIKCD

SEQ ID NO: 8459 - protein, 584 aa, Sequoia sempervirens
MGRELWLLCSVLYLFTTAFASEYDHKYGAGDPVTLWVNKVGPYNNPQETYNYYSLPFCHPGKNAVHKWGGLGEVLGGNELIDSQIEIKYRKTVERGTICELELDAAKVKQFKDAIENTYWFEFFMDDLPLWGFVGEQNAQKRDDQKYLLYTHKNIIVKTNKDQIIHVNLTQENPTPLTAGKPLELTYSVKWVETNITFARRFDVYLDYPFFEHQIHWFSIFNSFMMVIFLTGLVSMILMRTLRNDYAKYAREDDDLESLERDVSEESGWKLVHGDVFRTPRSLVMLSALVGTGAQLATLVLLVILLAIIGMLYIGRGAIVTTFIVCYALTSFISGYVSGGLYSRNDGKHWIKSMVLTASLFPFMCFSIGFILNTVAIFYGSLAAIPFGTMVVVFIMWAFISFPLALLGTVVGRNWSGAPNNPCRVKTIPRPIPEKKWYLTPAVVSLMGGLLPFGSIFIEMYFVFTSFWNYKVYYVYGFMLLVFLILIIVTICVTIVGTYFLLNAENYHWQWTSFFSAASTAAYVYLYSIYYYYMKTKMSGFFQTSFYFGYTLMFCLGLGILCGAVGYLGSTMFVRRIYRNIKCD

SEQ ID NO: 8460 - protein, 590 aa, Glycine max
MLFRFSLLLPLFLSTAFASESDHRYQQDDPVILWVNKVGPYNNPQETYNYYSLPFCRSPGNPAHKWGGLGEVLGGNELIDSQLEIKFLGNVEKTTFCRIELDEAKVKQFKDAIENNYWFEFFMDDLPLWGYVGELHPDKNGDNGKHVLYTHKNINVQYNKDQVRSISLQIIHVNLTYDNPRPLEVGKSLDMTYSVKWSPTNVTFGRRFDVYLDYPFFEHQIHWFSIFNSFMMVIFLTGLVSMILMRTLRNDYAKYAREDDDLETLERDVSEESGWKLVHGDVFRPPRSLVILSAVVGTGAQLALLVLLVILLAIIGMLYVGRGAIVTTFIVCYALTSFISGYVSGGMYSRNGGKNWIKSMILTASLFPFMCFGIGFILNTIAIFYGSLAAIPFGTMVVVFVIWAFISFPLALLGTVVGRNWSGAPNNPCRVKTIPRPIPEKKWYLTPSVVSLMGGLLPFGSIFIEMYFVFTSFWNYKVYYVYGFMLLVFLILTIVTVCVTIVGTYFLLNAENYHWQWTSFFSAASTAVYVYLYSVYYYYVKTKMSGFFQTSFYFGYTLMFCLGLGILCGAVGYLGSNLFVRRIYRNIKCD

SEQ ID NO: 8461 - protein, 592 aa, Helianthus annuus
MRPSVRSSAVAALFVTVLLFASPVFGSDYDHKYQSDEKVTLWVNKVGPYNNPQETYNFYSLPFCRKDDHAQAAHKWGGLGEVLGGNELIDSQMDVKFQKNVDKTTVCELELDDSKAMQFKQAIENNYWFELFMDDLPLWGFVGELHSDKNSDSKHMLFTHMNITIQYNKDQIIHVNLTQENPKPLEAGKTLDMTYSVKWTETNVTFARRFDVYLDYHFFEHQIHWFSIFNSFMMVIFLTGLVSMILMRTLRNDYAKYAREDDDLETLERDVNEESGWKLVHGDVFRPPRNLVLLSAVVGTGAQLALLILLVIVFAIIGMLYVGRGSIVTTFIVCYALTSFVSGYVSGGMYSRNGGKTWIKSMILTASLFPFLCFGIGFILNTIAIFYGSLAAIPFGTMVVVFVIWAFISFPLALLGTVVGRNWSGAPNNPCRVKTIPRPIPVKKWYLTPSVVSLMGGLLPFGSIFIEMYFVFTSFWNYKVYYVYGFMLLVFLILIIVTVCVTIVGTYFLLNAENYYWQWTSFFSAASTAIYVYLYSVYYYYVKTKMSGFFQTSFYFGYTAMFCLGLGILCGAVGHLGSNLFVRRIYRNIKCD

SEQ ID NO: 8462 - protein, 591 aa, Eutrema halophilum
MPSSSTVQSLFSVVACVFLLLSPALASESDHKYQADEQVTLWVNKVGPYNNPQETYNYYSLPFCRKTENSVHKWGGLGEVLGGNELIDSQIDIKFLKNVDRSVICQLELDEPKVKHFKDAIENSYWFELFMDDLPLWGFVGELPPGKNSENGKHVLYTHKNIIIKYNKDQIIHVNLTQDNPRPLEAGRTVDLTYSVNWIPTNVTFARRFDVYLDYPFFEHQIHWFSIFNSFMMVIFLTGLVSMILMRTLRNDYAKYAREDDDLESLERDVSEESGWKLVHGDVFRPPRSLVLLSAVVGTGAQLALLVLLVILMAIIGTLYVGRGAIVTTFIVCYALTSFISGYVSGGMYSRSGGKHWIKCMILTASLFPFLCFGIGFLLNTIAIFYGSLAAIPFGTMVVVFVIWGFISFPLALLGTVVGRNWSGAPNNPCRVKTIPRPIPEKKWYLTPSVVSLMGGLLPFGSIFIEMYFVFTSFWNYKVYYVYGFMLLVFLILVVVTVCVTIVGTYFLLNAENYHWQWTSFFSAASTAVYVYLYSIYYYYVKTKMFGFFQTSFYFGYTLMFCLGLGILCGAVGFLGSNLFVRRIYRNIKCD

SEQ ID NO: 8463 - protein, 593 aa, Populus trichocarpa
MSSATTARSLPLLAFISLLILSPALAFDADHRYGQEEPVKLWVNKVGPYNNPQETYNYYSLPFCHPSGDVATHKWGGLGEVLGGNELIDSQIDIKFGKNVDKGVICQLELDEAKVKQFKDAIENNYWLEFFVDDLPLWGFVGELRPDKNGENGKHFLFTHKSITIQYNKDQIIHVNLTQENAKPLESGRILDLTYSVKWSLTNVSFARRFDVYLDYPFFEHQIHWFSIFNSFMMVIFLTGLVSMILMRTLRNDYAKYAREDDDLVESLERDVSEETGWKLVHGDVFRPPRSMVLLSAVVGTGAQLALLVLLVILMAIVGTLYVGRGAIVTTFITCYALTSFIAGYVSGGMYSRHGGKNWIKSMILTACLFPFMCFGIGFILNTIAIFYGSLAAIPFGTIVVVFVIWAFISFPLALLGTVVGRNWSGAPNNPCRVKTIPRPIPEKKWYLTPSVVSMMGGLLPFGSIFIEMYFVFTSFWNYKVYYVYGFMLLVFLILIIVTVCVTIVGTYFLLNAENYHWQWTSFFSAASTAVYVYLYSIYYFYVKTKMSGFFQTSFYFGYTLMFCLGLGILCGAVGYLGSNLFVRRIYKNIKCD

SEQ ID NO: 8464 - protein, 405 aa, Brassica napus
MPSSTGAVLLLLVSLLAIALASDSDHKYQADEQVTLWVNKVGPYNNPQETYNYFSLPFCRPSQNDVHKWGGLGEVLGGNELIDSEIPIKFLKNVDRNVICKLELDEAKVKHFKDAIESSYWFEFFMDDLPLWGFVGELHSDKNGENAKHVLYTHKNIVVKYNKDQIIHVNLTQDNPRPLEAGRTVDLTYSVQWIPTDITFPRRFDVYLDYPFFEHQIHWFSIFNSFMMVIFLTGLVSMILMRTLRNDYAKYAREDDDLESLERDVNEESGWKLVHGDVFRPPWSLVLLSAVVGTGAQLALLVLLVILMAIVGTLYVGRGAIVTTFIVCYALTSFISGYVSGGMYSRSGGKHWIKCMVLTASLFPFLCFGIGFLLNTIAIFYGSLAAIPFGTMVVVFVIWVSFPSP

SEQ ID NO: 8465 - protein, 558 aa, Amborella trichopoda
TMCNVQYQEDEPVMLWVNKVGPYNNPQETYNYYSLPFCQPAGNPAHKWGGLGEVLGGNELIDSQIEIKFKRNVDKRSICELELDDAKAKLFKDAIENAYWFEFFMGYVGDIRSDKVNDNKHVLFTHKNIVVEYNGDQIIHVNLTQENPKTLEAGKSLDLTYSVKWISTNVTFARRFDVYLDYPFFEHQIHWFSIFNSFMMVIFLTGLVSMILMRTLRNDYAKYAREDDDLETLERDVSEESGWKLVHGDVFRPPRNLVILSAVVGTGAQLAMLVLLVILLAIVGMLYIGRGAIVTTFIVCYALTSFISGHVSGGLYSRNGGKNWIKSMILTASLFPFMCFGIGFILNTIAIFYGSLAAIPFGTMVVVFIIWAFISFPLALLGTVVGRNWSGAPNNPCRVKTIPRPIPEKKWYLTPSVVSLMGGLLPFGSIFIEMYFVFTSFWNYKVYYVYGFMLLVFLILIIVTVCVTIVGTYFLLNAENYHWQWTSFFSAASTAVYVYLYSIYYYYVKTKMSGFFQTGFYFGYTLMFCLGLGILCGAVGYLGSTLFVRRIYRNIKCD

SEQ ID NO: 8466 - protein, 589 aa, Phalaenopsis aphrodite
MFVRLRSSNLLAAVLVIVLLVAAPASASESDHKYQPNDPVTLWVNKVGPYNNPQETYNYYSLPFCQPGEKPSHKWGGLGEVLGGNELIDSQIELKYQKNVEKSFICSIELDDAKVKQFSDAIDASYWFEFFIDDLPLWAFVGETGKTDESKHYLFTHKNIIVRYNKDQIIHVNITQENPKLLEPGKKLDMTFSVTWTTTNITFARRFDVYLDYPFFEHQIHWFSIFNSFMMVIFLTGLVSMILMRTLRNDYAKYAREDDDLETLERDVSEESGWKLVHGDVFRPPRNLVLLSALVGTGAQLALLILLVILLAIVGMLYVGRGAIHTTFILCYAFTSFISGYVNGGLYSRSGGKSWIKSMILTASLFPFLCFGIGFALNTVAIFYRSLAAIPFGTMVVIFVIWAFISFPLTLLGTVVGRNWSGAPSNPCRVKTIPRPIPEKKWYLTPSIISLMGGLLPFGSIFIEMYFVFTSFWNYKVYYVYGFMLLVFLILIIVTVCVTIVGTYFLLNAENYHWQWTSFFSAASTAAYVYLYSIYYYSVKTKMTGFFQTSFYFGYTLMFCLGIGILCGAVGYLGSSLFVRRIYRNIKCD

SEQ ID NO: 8467 - protein, 455 aa, Brassica rapa
MPSSTGAVLLLLVSLLAIALASDSDHKYQADEQVTLWVNKVGPYNNPQETYNYFSLPFCRPSQNDVHKWGGLGEVLGGNELIDSEIPIKFLKNVDRNVICKLELDEAKVKHFKDAIESSYWFEFFMDDLPLWGFVGELHSDKNGENAKHVLYTHKNIVVKYNKDQIIHVNLTQDNPRPLEAGRTVDLTYSVQWIPTDITFPRRFDVYLDYPFFEHQIHWFSIFNSFMMVIFLTGLVSMILMRTLRNDYAKYAREDDDLESLERDVNEESGWKLVHGDVFRPPWSLVLLSAVVGTGAQLALLVLLVILMAIVGTLYVGRGAIVTTFIVCYALTSFISGYVSGGMYSRSGGKHWIKCMVLTASLFPFLCFGIGFLLNTIAIFYGSLAAIPFGTMVVVFVIWGFISFPLALLGTVVGRNWSGAPNNPCRVKTIPRPIPEKKWYLTPSVVSLMGGLLPF

SEQ ID NO: 8468 - protein, 438 aa, Brassica napus
MPSSSSSATAAVFLLLVSLLATSLASDSDHKYQADEQVTLWVNKVGPYNNPQETYNYYSLPFCRPSLNDVHKWGGLGEVLGGNELIDSEIPIKFLKNVDRNVICKLELDEPKVEHFKDAIESSYWFEFFMDDLPLWGFVGELQSDKNGENGKHVLYTHKNIIVKYNKDQIIHVNLTQDNPRPLEAGRTVDLTYSVQWIPTDVTFARRFDVYLDYPFFEHQIHWFSIFNSFMMVIFLTGLVSMILMRTLRNDYAKYAREDDDLESLERDVNEESGWKLVHGDVFRPPFSLVLLSAVVGTGAQLALLILLVILMAIVGTLYVGRGAIVTTFIVCYALTSFVSGYVSGGMYSRSGGKHWIKCMVLTASLFPFLCFGIGFILNTIAIFYGSLAAIPFGTMVVVFVIWVSFLPLSPPRDSRGKKLEWCSKQSMPCKDYSTSDP

SEQ ID NO: 8469 - protein, 583 aa, Cicer arietinum
MFFRFSLLLLLLISPVFASESDHKYQQDDPVTLWVNKVGPYNNPQETYNYYSLPFCRLPGNAAHKWGGLGEVLGGNELIDSQIEIKFLGNVERTTFCRLPLDDAKVKQFKDAIENNYWFEFFMDDLPLWGYVGELHPDKNSDSGKHVLYTHKNIIVKYNKDQIIHVNLTHDDPKPLEAGRSLDMTYSVKWIPTNVTFRHRFDVYLDYPFFEHQIHWFSIFNSFMMVIFLTGLVSMILMRTLRNDYAKYAREDDDLETLERDVSEESGWKLVHGDVFRPPRNLALLSAVVGTGAQLALLILLVILLAIVGMLYVGRGAIVTTFIVCYALTSFISGYVSGGMYSRNGGKSWIKSMILTASLFPFMCFGIGFVLNTIAIFYGSLAAIPFGTMVVVFVIWAFISFPLALLGTVVGRNWSGAPNNPCRVKTIPRPIPEKKWYLTPSVVSLMGGLLPFGSIFIEMYFVFTSFWNYKVYYVYGFMLLVFLILIVVTVCVTIVGTYFLLNAENYNWQWTSFLSAASTGVYVYLYSIYYYYVKTKMSGFFQTSFYFGYTMMFCLGLGILCGAVGHLGSNLFVRRIYRNIKCD

SEQ ID NO: 8470 - protein, 592 aa, Flaveria ramosissima
MPPSSAAALFATVLLLLLLISSPVLASDYDHKYQSDEKVTLWVNKVGPYNNPQETYNFYSLPFCRHDGHAQAAHKWGGLGEVLGGNELIDSQMDVKFQKNVEKTTVCELELDESKAMQFKQAIENNYWFELFMDDLPLWGFVGDLHSDKNSDSKHMLFTHMNITIQYNKDQIIHVNLTQENPKPLEVGKTLDMTYSVKWTETKVTFARRFDVYLDYHFFEHQIHWFSIFNSFMMVIFLTGLVSMILMRTLRNDYAKYAREDDDLETLERDVNEESGWKLVHGDVFRPPRNLVLLSAVVGTGAQLALLILLVIMFAIIGMLYVGRGSIVTTFIVCYALTSFVSGYVSGGMYSRNGGKTWIKSMILTASLFPFLCFGIGFILNTIAIFYGSLAAIPFGTMVVVFVIWAFISFPLALLGTVVGRNWSGAPNNPCRVKTIPRPIPKKKWYLTPSVVSLMGGLLPFGSIFIEMYFVFTSFWNYKVYYVYGFMLLVFLILIIVTVCVTIVGTYFLLNAENYYWQWTSFFSAASTAIYVYLYSVYYYYVKTKMSGFFQTSFYFGYTAMFCLGLGILCGAVGHLGSNLFVRRIYRNIKCD

SEQ ID NO: 8471 - protein, 583 aa, Plantago ovata
MRSAVRSRCVFIVFFLSLVSSTIGKYQAGEPVTLWVNKVGPYNNPQETYNYYALPFCHPRGDAPHKWGGLGEVLGGNELIDSQIEIKFQKDVERTTICEIELDGAKVEQFKHAIDHSYWFEFFMDDLPLWGFVGEVLPDRTRDNKHALWTHKNLVINYNGDQIIHVNLTQENLKPLEEGRVLDMTYSVKWLPTNITFARRFDVYLDYPFFEHQIHWFSVFNSFMMVIFLTGLVSMILMRTLRNDYAKYAREDDDLETLERDVNEESGWKLVHGDVFRPPQSLALLTAVVGTGAQLSTLVLLVIILAIVGMLYIGRGAIVTTFIICYAFTSFIAGYVSGGMYSRYGGKNWIKSMILTASLFPFMCFGIGFVLNTVAIFYGSLAAIPFGTMVVVFVIWGFISFPLALLGTVVGRNWSGAPNNPCRVKTIPRPIPEKKWYLTPSVISLMGGLLPFGSIFIEMYFVFTSFWNYKVYYVYGFMLLVFMILIIVTICVTIVGTYFLLNAENYHWQWTSFYSAASTALYVFLYSIYYYYVKTKMSGFFQTSFYFGYTLMFCLGLGILCGAVGYLGSNLFVRRIYRNIKCD

SEQ ID NO: 8472 - protein, 582 aa, Solanum lycopersicum
MLSTARSLVIFVIFSLFLAYPSLAKYQADEPVTLWVNKVGPYNNPQETYNYYSLPFCHPGDGGHKWGGLGEVLGGNELIDSRIDIKFKRDVEKSTICELVLDAAKVAQFKDAIESSYWFEFFMDDLPLWGFVGEVLPDRNRDNKHVLYTHKNFLIQYNKDQIIHVNLTQENPKPLEEGRLLGMTYSVKWVPTNITYERRFDVYLDYPFFEHQIHWFSVFNSFMMVIFLTGLVSMILMRTLRNDYAKYAREDDDLESLERDVNEESGWKLVHGDVFRPPQNLALLSAVVGTGAQLTTLVLLVIIFAIIGMLYIGRGAITTTFIVCYALTSFIAGYVSGGLYSRNGGKKWIKSMILTASLFPFMCFGIGFILNTIAIFYGSLAAIPFGTMVVVFVIWAFISFPLALLGTVVGRNWSGTPNNPCRVKTIPRPIPEKKWYLTTSVISLMGGLLPFGSIFIEMYFVFTSFWNYKVYYVYGFMLLVFIILIIVTVCVTIVGTYFLLNAENYHWRWTSFFSAASTALYVYLYAIYYYHVKTKMSGFFQTSFYFGYTMMFCLGLGILCGAVGYLGSNLFVRRIYRNIKCD

SEQ ID NO: 8473 - protein, 119 aa, Zostera marina
MLPNLPSTTILLLSLFLLVLSASAGESDHKYQPEDSVVLWVNKVGPYNNPQETYNYHSLPFCQPQENPVHRWGGLGEVLGGNELIDSQIEIKYQKPVDKVTICSIDLDETKVTQFKKCN

SEQ ID NO: 8474 - protein, 460 aa, Ambrosia trifida
MDDLPLWGYVGELHTDRNSDSKHMLFTHKNITIQYNKDQIIHVNLTQENPKPLEAGKTLDMTYSVKWTETNIGFAHRFDVYLDYHFFEHQIHWFSIFNSFMMVIFLTGLVSMILMRTLRNDYAKYAREDDDLESLERDVSEESGWKLVHGDVFRPPRHLVILSAVVGTGAQLALLILLVILFAIVATLYIGRGAIVTTFIVCYALTSFVSGYVSGGMYSRHGGKNWIKSMILTASLFPFLCFGIGFVLNTIAIFYGSLAAIPFGTMVVVFVIWAFISFPLALLGTVVGRNWSGAPNNPCRVKTIPRPIPEKKWYLTPSVVSIMGGLLPFGSIFIEMYFVFTSFWNYKVYYVYGFMLLVFLILIIVTVCVTIVGTYFLLNAENYHWQWTSFFSAASTAIYVYLYSIYYYSVKTKMSGFFQTSFYFGYTAMFCLGLGILCGAVGYLGSNLFVRRIYRNIKCD

SEQ ID NO: 8475 - protein, 119 aa, Zostera marina
MLPNLPSTTILLLSLFLLVLSASAGESDHKYQPEDSVVLWVNKVGPYNNPQETYNYHSLPFCQPQENPVHRWGGLGEVLGGNELIDSQIEIKYQKPVDKVTICSIDLDETKVTQFKNGN

SEQ ID NO: 8476 - protein, 588 aa, Abies balsamea
MGYKEGVWLRLTLYMVAALGAVFASEYDHKYRASDPVTLWVNKVGPYNNPQETYNYYSLPFCHPGKNPTHKWGGLGEVLGGNELIDSQVDIKFGKTIEKSPICEIELDATKVKQFKEAIENTYWFEFFMDDLPLWAFVGEMHQDKSDDQKHLLYTHKNIIVKINNDQIIHVNLTQENPKPLVAGKTLELTYSVNWVPTNITFARRFDVYLDYPFFEHQIHWFSIFNSFMMVIFLTGLVSMILMRTLRNDYAKYAREEDDLESLERDVSEESGWKLVHGDVFRTPRSLVLLSALVGTGAQLAMLVLLVILLAIVGMLYIGRGAIVTTFIVCYALTSFISGYVSGGLYSRNDGKHWIKSMVLTASLFPFMCFGIGFVLNIIAIFYGTLAAIPFGTMVVVFIIWAFISFPLALLGTVVGRNWSGAPNNPCRVKTIPRPIPEKKWYLTPTVVSLMGGLLPFGSIFIEMYFVFTSFWNYKVYYVYGFMLLVFLILVIVTICVTIVGTYFLLNAENYHWQWTSFFSAASTAAYVYLYSIYYYHMKTKMSGFFQTSFYFGYTLMFCLGLGILCGAVGYLGSTLFVRRIYRNIKCD

SEQ ID NO: 8477 - protein, 336 aa, Flaveria ramosissima
MLFTHKNITIQYNKDQIIHVNLTQENPKPLEAGKTLDMTYSVMWTETNTTFARRFDVYLDYHFFEHQIHWFSIFNSFMMVIFLTGLVSMILMRTLRNDYAKYAREDDDLDSLERDVSEESGWKLVHGDVFRPPRNLVLLSAVVGTGAQLALLILLVILFAIVATLYIGRGAIVTTFIVCYALTSFLSGYVSGGMYSRHGGKNWIKSMILTASLFPFLCFGIGFVLNTIAIFYGSLAAIPFGTLVVVFVIWAFISFPLALLGTVVGRNWSGAPNNPCRVKTIPRPIPEKKWYLTPSVVSIMGGLLPLAVFLSKCTLSSHPFGITRCTMFMGSCYLFF

SEQ ID NO: 8478 - protein, 589 aa, Phalaenopsis aphrodite
MFVRLRSSNLLAAVLVIVLLVAAPVSASESDHKYQPNDPVTLWVNKVGPYNNPQETYNYYSLPFCQPGEKPSHKWGGLGEVLGGNELIDSQIELKYQKNVEKSFICSIELDDAKVKQFSDAIDASYWFEFFIDDLPLWAFVGETGKTDESKHYLFTHKNIIVRYNKDQIIHVNITQENPKLLEPGKKLDMTFSVTWTTTNITFARRFDVYLDYPFFEHQIHWFSIFNSFMMVIFLTGLVSMILMRTLRNDYAKYAREDDDLETLERDVSEESGWKLVHGDVFRPPRNLVLLSALVGTGAQLALLILLVILLAIVGMLYVGRGAIHTTFILCYAFTSFISGYVNGGLYSRSGGKSWIKSMILTASLFPFLCFGIGFALNTVAIFYRSLAAIPFGTMVVIFVIWAFISFPLTLLGTVVGRNWSGAPSNPCRVKTIPRPIPEKKWYLTPSIISLMGGLLPFGSIFIEMYFVFTSFWNYKVYYVYGFMLLVFLILIIVTVCVTIVGTYFLLNAENYHWQWTSFFSAASTAAYVYLYSIYYYSVKTKMTGFFQTSFYFGYTLMFCLGIGILCGAVGYLGSSLFVRRIYRNIKCD

SEQ ID NO: 8479 - protein, 593 aa, Populus trichocarpa
MSSATTARSLPLLAFISLLILSPALAFDADHRYGQEEPVKLWVNKVGPYNNPQETYNYYSLPFCHPSGDVATHKWGGLGEVLGGNELIDSQIDIKFGKNVDKGVTCQLELDEAKVKQFKDAIENNYWLEFFVDDLPLWGFVGELRPDKNGENGKHFLFTHKSITIQYNKDQIIHVNLTQENAKPLESGRILDLTYSVKWSLTNVSFARRFDVYLDYPFFEHQIHWFSIFNSFMMVIFLTGLVSMILMRTLRNDYAKYAREDDDLVESLERDVSEETGWKLVHGDVFRPPRSMVLLSAVVGTGAQLALLVLLVILMAIVGTLYVGRGAIVTTFITCYALTSFIAGYVSGGMYSRHGGKNWIKSMILTACLFPFMCFGVGFILNTIAIFYGSLAAIPFGTIVVVFVIWAFISFPLALLGTVVGRNWSGAPNNPCRVKTIPRPIPEKKWYLTPSVVSMMGGLLPFGSIFIEMYFVFTSFWNYKVYYVYGFMLLVFLILIIVTVCVTIVGTYFLLNAENYHWQWTSFFSAASTAVYVYLYSIYYFYVKTKMSGFFQTSFYFGYTLMFCLGLGILCGAVGYLGSNLFVRRIYKNIKCD

SEQ ID NO: 8480 - protein, 590 aa, Glycine max
MFFESRSLLFPLLFSLFLASAFASESDHKYQHDEQVNLWVNKVGPYNNPQETYNYYSLPFCHPSSSASAAHKWGGLGEVLGGNELIDSQLEIKFQRNVDKTVFCQIDLDEAKVKQFKDAIENNYWFEFFMDDLPLWGYVGELHPDKNSDNGKHVIYTHKNIIVKYNNDQIIHVNLTQDIPKPLEVGKHLDMTYSVKWDSTNVTFGRRFDVYLDHPFFEHQIHWFSIFNSFMMVIFLTGLVSMILMRTLRNDYAKYAREDDDLESLERDVSEESGWKLVHGDVFRPPRNLVILSAVVGTGAQLALLVLLVVLLAIVGMLYVGRGAIVTTFIVCYALTSFISGYVSGGMYSRNGGKHWIKSMILTASLFPFMCFGIGFILNTIAIFYGSLAAIPFGTMVVVFVIWAFISFPLALLGTVVGRNWSGALNNPCRVKTIPRPIPEKKWYLTPSVVSLMGGLLPFGSIFIEMYFVFTSFWNYKVYYVYGFMLLVFLILIIVTVCVTIVGTYFLLNAENYHWQWTSFFSAASTAVYVYLYSIYYFYVKTKMSGFFQTSFYFGYTLMFSLGLGILCGAVGFLGSNLFVRRIYRNIKCD

SEQ ID NO: 8481 - protein, 214 aa, Eutrema parvulum
MPSSSPVAVFLLLVSLLATALASDSDHKYQADEQVTLWVNKVGPYNNPQETYNYYSLPFCRPSQNDVHKWGGLGEVLGGNELIDSEIPIKFLKNVERNVICQLELDDAKVKHFKDAIESSYWFEFFMDDLPLWGFVGELHPDKNSESGKHVLYTHKNIIVKYNKDQIIHVNLTQDNPRPLEAGRTVDLTYSVQWIPTNITFARRFDVYLDYPFF

SEQ ID NO: 8482 - protein, 93 aa, Vinca minor
MRLTVRSPLFLSLLIAAAFFLSSPAIASEYDHKYQDGDKVTLWVNKVGPYNNPQETYNYYSLPFVGQMALLLTSGVVLVKSLVEMNLLIVSLI

SEQ ID NO: 8483 - protein, 558 aa, Arnica chamissonis
YQSDDPIHLWVNKVGPYNNPQETYNYYSLPFCRQPGNPGHKWGGLGEVLGGNELIDSQIDIKFQKNVDKTTICELELDDSKVKQFKEAIENNYWFEFFMDDLPLWGYVGELHTDRNSDSKHMLFTHKNITIQYNKDQIIHVNLTQENPKPLEAGKTLDMTYSVKWTETNITFAHRFDVYLDYHFFEHQIHWFSIFNSFMMVIFLTGLVSMILMRTLRNDYAKYAREDDDLESLERDVSEESGWKLVHGDVFRPPRSLVLLSAVVGTGAQLALLILLVILFAIVATLYIGRGAIVTTFIVCYALTSFVSGYVSGGMYSRHGGKHWIKSMILTASLFPFLCFGIGFVLNTIAIFYGSLAAIPFGTLVVVFVIWAFISFPLALLGTVVGRNWSGAPNNPCRVKTIPRPIPEKKWYLTPSVVSIMGGLLPFGSIFIEMYFVFTSFWNYKVYYVYGFMLLVFLILIIVTVCVTIVGTYFLLNAENYHWQWTSFFSAASTAIYVYLYSIYYYYVKTKMSGFFQTSFYFGYTAMFCLGLGILCGAVGYLGSNLFVRRIYRNIKCD

SEQ ID NO: 8484 - protein, 586 aa, Artemisia annua
MSSALTSAVFLLVLLILSPVFASDYDHKYQPDDNVDLWVNKVGPYNNPQETYNYYILPFCRPPGHAGHKWGGLGEVLGGNELIDSQIDVKFQKNVEKTTICELELDEQKVLQFKQAIEDNYWFEFFMDDLPLWGFVGELHSDRNSDSKHTLFTHKNITIKYNKDQIIHVNLTQENPKPLEVGKKLDMTYSVEWSETNITFGRRFDVYLDYHFFEHQIHWFSIFNSFMMVIFLTGLVSMILMRTLRNDYAKYAREDDDLETLERDVNEESGWKLVHGDVFRPPRNMVLLSAVVGTGAQMALLILLVILLAIVGMLYVGRGAIVTTFIVCYALTSFVSGYVSGGMYSRNGGKNWIKSMILTASLFPFLCFGIGFFLNTIAIFYGSLAAIPFGTMVVVFVIWAFISFPLALLGTVVGRNWSGAPNNPCRVKTIPRPIPEKKWYLTPSVVSIMGGLLPFGSIFIEMYFVFTSFWNYKVYYVYGFMLLVFLILIIVTVCVTIVGTYFLLNAENYYWQWTSFFSAASTAIYVYLYSIYYYYVKTKMSGFFQTSFYFGYTAMFCLGLGILCGAVGHLGSNLFVRRIYRNIKCD

SEQ ID NO: 8485 - protein, 585 aa, Brassica napus
MPSSSAVFVLLVCLLATALASDSDHKYQADEKVTLWVNKVGPYNNPQETYNYYSLPFCRPSQNDVHKWGGLGEVLGGNELIDSEIPIKFLKNVDRNVICHLELDEAKVNHFKDAIESSYWFEFFMDDLPLWGFVGELHPDKNSEDGKQVLYTHKNIIVKYNKDQIIHVNLTQDNPTPLEAGRTVDLTYSVQWIPTDVTFARRFDVYLDYPFFEHQIHWFSIFNSFMMVIFLTGLVSMILMRTLRNDYAKYAREDDDLESLERDVNEESGWKLVHGDVFRPPWSLVLLSAVVGTGAQLALLVLLVILMAIVGTLYVGRGAIVTTFIVCYALTSFVSGYVSGGMYSRSGGKHWIKCMVLTASLFPFLCFGIGFLLNTIAIFYGSLAAIPFGTMVVMFVIWGFISFPLALLGTVVGRNWSGAPNNPCRVKTIPRPIPEKKWYLTPSVVSLMGGLLPFGSIFIEMYFVFTSFWNYKVYYVYGFMLLVFVILVIVTVCVTIVGTYFLLNAENYHWQWTSFFSAASTAVYVYLYSIYYYYVKTKMSGFFQTSFYFGYTMMFCLGLGILCGAVGFLGSNLFVRRIYRNIKCD

SEQ ID NO: 8486 - protein, 586 aa, Eutrema halophilum
MSSSSAVVFLLLVSLLASALGSDSDHKYQADEQVTLWVNKVGPYNNPQETYNYYSLPFCRPSKNDVHKWGGLGEVLGGNELIDSEIAIKFLKNVDRNVICQLELDEAKVKHFKDAIESSYWFEFFMDDLPLWGFVGELHPDKNSENGKHVLYTHKNIIVKYNKDQIIHVNLTQDNPRPLEAGRTVDLTYSVQWIPTNVTFARRFDVYLDYPFFEHQIHWFSIFNSFMMVIFLTGLVSMILMRTLRNDYAKYAREDDDLESLERDVSEESGWKLVHGDVFRPPYSLVLLSAVVGTGAQLALLVLLVILMAIVGTLYVGRGAIVTTFIVCYALTSFVSGYVSGGMYSRSGGKHWIKCMVLTASLFPFLCFGIGFLLNTIAIFYGSLAAIPFGTMVVVFVIWGFISFPLALLGTVVGRNWSGAPNNPCRVKTIPRPIPEKKWYLTPSVVSLMGGLLPFGSIFIEMYFVFTSFWNYKVYYVYGFMLLVFVILVIVTVCVTIVGTYFLLNAENYHWQWTSFFSAASTAVYVYLYSIYYYYVKTKMSGFFQTSFYFGYTMMFCLGLGILCGAVGFLGSNLFVRRIYRNIKCD

SEQ ID NO: 8487 - protein, 589 aa, Phaseolus coccineus
MFFQSRSLLFPLLISLFLSSAFASESDHKYHRDEPVTLWVNKLGPYNNPQETYNYYSLPFCHPLSNASAGHKWGGLGEVLGGNELIDSQIDIKFQKNVDKTVFCRIDLSEAKVKQFKDAIENNYWFEFFMDDLPLWGYVGELHPDKNGDGKHVLYTHKNINVKYNNDQIIHVNLTQDIPKPLEVGKHLDMTYSVKWDSTNVTFGHRFDVYLDHPFFEHQIHWFSIFNSFMMVIFLTGLVSMILMRTLRNDYAKYAREDDDLETLERDVSEESGWKLVHGDVFRPPRYLVILSAVVGTGAQLALLVLLVVLLAIIGMLYVGRGAIVTTFIVCYALTSFISGYVSGGMYSRNGGKNWIKSMILTASLFPFMCFGIGFILNTIAIFYGSLAAIPFGTIVVVFVIWAFISFPLALLGTVVGRNWSGALNNPCRVKTIPRPIPEKKWYLTPSVVSLMGGLLPFGSIFIEMYFVFTSFWNYKVYYVYGFMLLVFLILIIVTVCVTIVGTYFLLNAENYHWQWTSFFSAASTSVYVYLYSIYYYYMKTKMSGFFQTSFYFGYTLMFSLGLGILCGAVGFLGSNLFVRRIYRNIKCD

SEQ ID NO: 8488 - protein, 578 aa, Zostera marina
TLLSLFLLVLSASAGESDHKYQPEDLVVLWVNKVGPYNNPQETYNYHSLPFCQPQENPVHRWGGLGEVLGGNELIDSQIEIKYQKPVDKVTICSIDLDETKVTQFKNAIDSSYWFELFMDDLPLWGFVGEARTDKSNENKHFLFTHKDIIIKYNGFQIIHVNLTQDGAKLLEVGKTLDMTYSVKWIKTNIEFARRFDVYLDYPFFEHQIHWFSIFNSFMMVIFLTGLVSMILMRTLRNDYAKYAREDDDLETLERDVSEESGWKLVHGDVFRPPLNLIVLSAVVGTGAQFAMLVLMVILLAIIGMLYIGRGSIVTTFIVCYALTSSISGYVSGGMYSRNGGKNWIKSMIFSASLFPFMCFGIGFILNTIAIFYGSLAAIPFGTMMVVFIIWGFISLPLAFLGTLVGRNWSGYPNIPCRVKTIPRLIPEKKWYLTPSVISLMGGLLPFGSIFIEMYFVFTSFWNYKVYYVYGFMLLVFIILIIVTVCVTIVGTYFLLNAENYHWQWTSFFSAASTAGYVYLYSIYYYHSKTKMSGFFQTSFYFGYTLMFCLGLGILCGAVGYLGSTMFVRRIYRNIKCD

SEQ ID NO: 8489 - protein, 590 aa, Brassica rapa
MPSSSSSATAAVFLLLVSLLATSLASDSDHKYQADEQVTLWVNKVGPYNNPQETYNYYSLPFCRPSLNDVHKWGGLGEVLGGNELIDSEIPIKFLKNVDRNVICKLELDELKVEHFKDAIESSYWFEFFMDDLPLWGFVGELQSDKNGENGKHVLYTHKNIIVKYNKDQIIHVNLTQDNPRPLEAGRTVDLTYSVQWIPTDVTFARRFDVYLDYPFFEHQIHWFSIFNSCMMVIFLTGLVSMILMRTLRNDYAKYAREDDDLESLERDVNEESGWKLVHGDVFRPPFSLVLLSAVVGTGAQLALLILLVILMAIVGTLYVGRGAIVTTFIVCYALTSFVSGYVSGGMYSRSGGKHWIKCMVLTASLFPFLCFGIGFILNTIAIFYGSLAAIPFGTMVVVFVIWGFISFPLALLGTVVGRNWSGAPNNPCRVKTIPRPIPEKKWYLTPSVVSLMGGLLPFGSIFIEMYFVFTSFWNYKVYYVYGFMLLVFVILVIVTVCVTIVGTYFLLNAENYHWQWTSFFSAASTAVYVYLYSIYYYYVKTKMSGFFQTSFYFGYTMMFCLGLGILCGAVGFLGSNLFVRRIYRNIKCD

SEQ ID NO: 8490 - protein, 587 aa, Brassica napus
MPSSNTAAVFLLLVSLLATSLASDSDHKYQADEQVTLWVNKVGPYNNPQETYNYYSLPFCRPSQNDVHKWGGLGEVLGGNELIDSEIPIKFLKNVDRNVICKLELDQPKVEHFKDAIESSYWFEFFMDDLPLWGFVGELQSDKNGENGKHVLYTHKNIIVKYNKDQIIHVNLTQDNPRPLEAGRTVDLTYSVQWIPTDVTFARRFDVYLDYPFFEHQIHWFSIFNSFMMVIFLTGLVSMILMRTLRNDYAKYAREDDDLESLERDVNEESGWKLVHGDVFRPPFSLVLLSAVVGTGAQLALLILLVILMAIVGTLYVGRGAIVTTFIVCYALTSFVSGYVSGGMYSRSGGKHWIKCMVLTASLFPFLCFGIGFILNTIAIFYGSLAAIPFGTMVVVFVIWGFISFPLALLGTVVGRNWSGAPNNPCRVKTIPRPIPEKKWYLTPSVVSLMGGLLPFGSIFIEMYFVFTSFWNYKVYYVYGFMLLVFVILVIVTVCVTIVGTYFLLNAENYHWQWTSFFSAASTAVYVYLYSIYYYYVKTKMSGFFQTSFYFGYTMMFCLGLGILCGAVGFLGSNLFVRRIYRNIKCD

SEQ ID NO: 8491 - protein, 589 aa, Vitis vinifera
MVSTFRSSFLLLLLVSLFALLAFASESDHKYQTDEQVTLWVNKVGPYNNPQETYNYFSLPFCHPPGNAGHKWGGLGEVLGGNELIDSQIDMKFKKNVERTTICIIELDAAKVKQFRDAIGKSYWFEFFIDDLPLWGFIGEVHSDKKNDKIQHLLYTNKNIFVRYNGDQIIHVNLTQDSPKPLEEGKALDMTYSVQWIPTDVAFSRRFDIYLDHPFFEHQIHWFSIFNSFMMVIFLTGLVSMILMRTLRNDYAKYAREDDDLETLERDVSEESGWKLVHGDVFRSPRNMVLFSAVVGTGAQLAMLVLLVIILAIIGMLYIGRGAIVTTFIVCYALTSFISGYVSGGMYSRNGGKSWIKSMILTASLFPFMCFGIGFILNTIAIFYGSLAAIPFGTMVVVFVIWAFISFPLALLGTVVGRNWSGAPNNPCRVKTIPRPIPEKKWYLTPSVVSLMGGLLPFGSIFIEMYFVFTSFWNYKVYYVYGFMLLVFMILMIVTVCVTIVGTYFLLNAENYHWQWTSFFSAASTAFYVYFYSIYYYYMKTKMSGFFQTSFYFGYTLMLCLGLGILCGAVGFLGSNLFVRRIYRNIKCD

SEQ ID NO: 8492 - protein, 583 aa, Medicago truncatula
MLFRFSLLLLLLLSPAFASESDHKYQPDDPVTLWVNKVGPYNNPQETYNYYSLPFCRPPGNTAHKWGGLGEVLGGNELIDSQIEIKFLGNVERTTFCRLNLDEAKVKQFKDAIENNYWFEFFMDDLPLWGYVGELHPDKNSDSGKHVLYTHKNIIVKYNTDQIIHVNLTHDDPKPLEAGRSLDMTYSVKWIATNVTFRHRFDVYLDYPFFEHQIHWFSIFNSFMMVIFLTGLVSMILMRTLRNDYAKYAREDDDLETLERDVSEESGWKLVHGDVFRPPRSLALLSAVVGTGAQLALLILLVILLAIVGMLYVDRGAIVTTFIVCYALTSVISGYVSGGMYSRNGGKSWIKSMILTASLFPFLCFGIGFILNTVAIFYGSLAAIPFGTMVVVFVIWAFISFPLALLGTVVGRNWSGAPNNPCRVKTIPRPIPEKKWYLTPSVVSLMGGLLPFGSIFIEMYFVFTSFWNYKVYYVYGFMLLVFLILIVVTVCVTIVGTYFLLNAENYNWQWTSFLSAASTGVYVYLYSIYYYYVKTKMSGFFQTSFYFGYTAMFCLGLGILCGAVGHLGSNLFVRRIYRNIKCD

SEQ ID NO: 8493 - protein, 587 aa, Cajanus cajan
MSRSLVFPLLLSLFLSSALASESDHKYQRDEAVTLWVNKVGPYNNPQETYNYYSLPFCHPSSSASAAHKWGGLGEVLGGNELIDSQIEIKFQRNVEKTVFCQIDLDDAKVKQFKDAIENNYWLEFFMDDLPLWGYVGELHPDKNSDNGKHVLYTHKNIIVKYNNDQIIHVNLTQDIPKPLEVGKPLDMTYSVKWISTNVTFGRRFDVYLDHPFFEHQIHWFSVFNSFMMVIFLTGLVSMILMRTLRNDYAKYAREDDDLESLERDVSEESGWKLVHGDVFRPPRYLVILSAVVGTGAQLAMLVLLVILSAIVGMLYVGRGAIVTNFIVCYALTSFISGYVSGGMYSRNGGKNWIKSMILTASLFPFMCFGIGFILNTIAIFYGSLAAIPFGTIVVVFVIWAFISFPLALLGTVVGRNWSGALNNPCRVKTIPRPIPEKKWYLTPSVVSLMGGLLPFGSIFIEMYFVFTSFWNYKVYYVYGFMLLVFLILIIVTVCVTIVGTYFLLNAENYHWQWTSFFSAASTAVYVYLYSIYYYYVKTKMSGFFQTSFYFGYTLMFSLGLGILCGAVGFLGSNLFVRRIYRNIKCD

SEQ ID NO: 8494 - protein, 583 aa, Solanum phureja
MLSTARSLVIFVIFSLFLAYPSHAKYQADEPVTLWVNKVGPYNNPQETYNYYSLPFCHPGDGGHKWGGLGEVLGGNELIDSRIDIKFKRDVEKSTICELVLDAAKVAQFKDAIESSYWFEFFMDDLPLWGFVGEVLPDRNRDTKHVLYTHKNFLIQYNKDQIIHVNLTQETPKPLEEGRLLGMTYSVKWVPTNITYERRFDVYLDYPFFEHQIHWFSVFNSFMMVIFLTGLVSMILMRTLRNDYAKYAREDDDLESLERDVNEESGWKLVHGDVFRPPQNLALLSAVVGTGAQLTTLVLLVIVFAIIGMLYIGRGAITTTFIVCYALTSFIAGYVSGGLYSRNGGKKWIKSMILTASLFPFMCFGIGFILNTIAIFYGSLAAIPFGTMVVVLVIWAFISFPLALLGTVVGRNWSGTPNNPCRVKTIPRPIPEKKWYLTPSVISLMGGLLPFGSIFIEMYFVFTSFWNYKVYYVYGFMLLVFIILIIVTVCVTIVGTYFLLNAENYHWRRWTSFFSAASTALYVYLYAIYYYHVKTKMSGFFQTSFYFGYTMMFCLGLGILCGAVGYLGSNLFVRRIYRNIKCD

SEQ ID NO: 8495 - protein, 590 aa, Glycine max
MFFESRSLLFPLLFSLFLSSAFASDSDHKYQHDEPVNLWVNKVGPYNNPQETYNYYSLPFCHPSSSASAAHKWGGLGEVLGGNELIDSQIEIKFQRNVDKTVFCQIDLDEAKVKQFKDAIENNYWFEFFMDDLPLWGYVGELHPDKNSDNGKHVIYTHKNIIVKYNNDQIIHVNLTQDIPKPLEVGKHLDMTYSIKWDSTNVTFGRRFDVYLDHPFFEHQIHWFSIFNSFMMVIFLTGLVSMILMRTLRNDYAKYAREDDDLESLERDVSEESGWKLVHGDVFRPPRNLVILSAVVGTGAQLALLVLLVVLLAIVGMLYVGRGAIITTFIVCYALTSFISGYVSGGMYSRNGGKHWIKSMILTASLFPFMCFGIGFILNTIAIFYGSLAAIPFGTMVVVFVIWAFISFPLALLGTVVGRNWSGALNNPCRVKTIPRPIPEKKWYLTPSVVSLMGGLLPFGSIFIEMYFVFTSFWNYKVYYVYGFMLLVFVILIIVTICVTIVGTYFLLNAENYHWQWTSFFSAASTAVYVYLYSIYYFYVKTKMSGFFQTSFYFGYTLMFSLGLGILCGAVGFLGSNLFVRRIYRNIKCD

SEQ ID NO: 8496 - protein, 589 aa, Tabernaemontana elegans
MRLTVRSFALLSLFSSLLLVSPALASEYDHKYQEGDKVILWVNKVGPYNNPQETYNYYSLPFCKPEGIAAHKWGGLGEVLGGNELIDSLIDIKFKKNVEKTTFCDVELDEAKVKQFKDAIENNYWFEFFMDDLPLWGYIGELHADRNSDNKHVLYTHKSIDVKYNKDQIIHVNLTQVSPKPLEVGRRLDMTYSVKWTSTNVTFAHRFDVYLDYPFFEHQIHWFSIFNSFMMVIFLTGLVSMILMRTLRNDYAKYAREDDDLETLERDVSEESGWKLVHGDVFRPPRNLVLISALVGTGAQLAVLVLVVILCAIVGMLYVGRGTIGTAFIVCYALTSIVSGYVSGGMYSRNGGKNWIKSMILTATLFPFLCFGIGFILNTIAIFYGSLAAIPFGTMVVVLVIWTFISFPLALVGTVIGRNWSGAPNNPCRVKTIPRPIPEKKWYLTPSVVSLMGGLLPFGSIFIEMYFVFTSFWNYKVYYVYGFMLLVFLILIIVTVCVTIVGTYFLLNAENYHWQWTSFFSAASTAVYVYLYSVYYYYVKTKMSGFFQTSFYFGYTLMFCIGLGILCGAVGYLGSNLFVRRIYRNIKCD

SEQ ID NO: 8497 - protein, 165 aa, Sciadopitys verticillata
MGGLGEVLGGNELINSQIDIKFGKPVERGTICEFELDAAKVKQFKDAIENTYWFEFFMDDLPLWGFVGEQHPQKTDDQKYLLYTHKNIVVKTNNDQIIHVNLTQENPTLLVAGKTVELTYSVKWVETNVTFARRFDVYLDYPFFEHQIHWFSIFNSFMMVIFLRV

SEQ ID NO: 8498 - protein, 572 aa, Cedrus atlantica
VAAWGTVFASEYDHKYRASDPVTLWVNKVGPYNNPQETYNYYSLPFCHPAHPTHKWGGLGEVLGGNELIDSKIDIKFGKNVEKSSICEIELDATKVKQFKEAIENTYWFEFFMDDLPLWGFVGEMHQDKSDDQKHLLYTHKDIIVKINNDQIIHVNLTQENPKPLIAGKTLELTYSVNWVNTNVTFARRFDVYLDYPFFEHQIHWFSIFNSFMMVIFLTGLVSMILMRTLRNDYAKYAREEDDLESLERDVSEESGWKLVHGDVFRTPRNLVLLSALVGTGAQLAMLVLLVILLAIVGMLYIGRGAIVTTFIVCYALTSFISGYVSGGLYSRNDGKHWIKSMVLTASLFPFMCFGIGFVLNIIAIFYGSLAAIPFGTMVVVFIIWAFISFPLALLGTVVGRNWSGAPNNPCRVKTIPRPIPEKKWYLTPTVVSLMGGLLPFGSIFIEMYFVFTSFWNYKVYYVYGFMLLVFLILVIVTVCVTIVGTYFLLNAENYHWQWTSFFSAASTAAYVYLYSIYYYHMKTKMSGFFQTSFYFGYTLMFCLGLGILCGAVGYLGSTLFVRRIYRNIKCD

SEQ ID NO: 8499 - protein, 584 aa, Orobanche aegyptiaca
MLSAVRSSCIFIFFFLTFLVSSSFGKYQADEAVTLWVNKVGPYNNPQETYNYYSLPFCRPPGNTAHKWGGLGEVLGGNELIDSLIQIKFKRDVEKTKICEIELDAAKAKQFKDAIENSYWFEFFMDDLPLWGFVGEVLPDRNRDIKHVLWTHKNLVINYNGNQIIHVNLTQDNPKPLEEGRVLEMTYSVKWVPTNTTFARRFDVYLDYPFFEHQIHWFSVFNSFMMVIFLTGLVSMILMRTLRNDYAKYAREDDDIETLERDVSEESGWKLVHGDVFRPPQNLALLSAVVGTGAQLATLVLLVIILAIVGMLYIGRGAIVTTFIVCYAFTSFIAGYVSGGMYSRNGGKKWIKSMILTASLFPFLCFGIGFILNTVAIFYGSLAAIPFGTMMVVLVIWAFISFPLALLGTVVGRNWSGMPNNPCRVKTIPRPIPEKKWYLTPSIISLMGGLLPFGSIFIEMYFVFTSFWNYKVYYVYGFMLLVFVILIIVTVCVTIVGAYFLLNAENYHWQWTSFFSAASTALYVYFYSIYYYHVKTKMSGFFQTSFYFGYTLMFCLGLGILCGAVGYLGSNLFVRRIYRNIKCD

SEQ ID NO: 8500 - protein, 590 aa, Arachis hypogaea
MSFFQSRSIFFFFLSLFLSSAFASESDHKYQQDEQVTLWVNKVGPYNNPQETYNYYSLPFCHPSSTSEAAHKWGGLGEVLGGNELIDSQLEIKFQKHVEKTVFCQIALDEAKVKQFKDAIENNYWFEFFMDDLPLWGYVGELHPDKNSDNGKHVLYTHKNIIVKYNKDQIIHVNLTQDIPKPLEVGRHLDMTYAVKWIPTNITFGRRFDVYLDYPFFEHQIHWFSIFNSFMMVIFLTGLVSMILMRTLRNDYAKYAREDDDLETLERDVSEESGWKLVHGDVFRPPRGLVILSAVVGTGAQLALLVLLVILLAIVGMLYVGRGAIVTTFIVCYALTSFISGYVSGGMYSRNGGKSWIKSMILTASLFPFMCFGIGFILNTIAIFYGSLAAIPFGTMVVVFVIWAFISFPLALLGTVVGRNWSGVPNNPCRVKTIPRPIPEKKWYLTPSVVSMMGGLLPFGSIFIEMYFVFTSFWNYKVYYVYGFMLLVFLILMIVTVCVTIVGTYFLLNAENYHWQWTSFFSAASTAVYVYLYSIYYYYVKTKMSGFFQTSFYFGYTLMFSLGLGILCGAVGFLGSNLFVRRIYRNIKCD

SEQ ID NO: 8501 - protein, 345 aa, Ambrosia trifida
MRPTVRSSTVAALISTLLLFASPVFASDYDHKYQSDEKVTLWVNKVGPYNNPQETYNFYSLPFCRQDGHAQAAHKWGGLGEVLGGNELIDSQMDVKFQKNVDKTTVCELELDDSKAMQFKQAIENNYWFELFMDDLPLWGFVGELHSDKNSDNKHMLFTHMNITIQYNKDQIIHVNLSQENPKPLEVGKTLDMTYSVKWTETNVMFARRFDVYLDYHFFEHQIHWFSIFNSFMMVIFLTGLVSMILMRTLRNDYAKYAREDDDLETLERDVNEESGWKLVHGDVFRPPRNLVLLVCSCWDWCPIGTIDSSCHRFCNYWNAVCRTRINCNNVYSLLCSHFFCFWLC

SEQ ID NO: 8502 - protein, 461 aa, Cannabis sativa
MDDLPLWGFVGELHPDKNSDNGKHVLYTHKNINVQYNKDQIIHVNLSQESPKPLEVGRTLDLTYSVKWTPTNVTFARRFDVYLDYPFFEHQIHWFSIFNSFMMVIFLTGLVSMILMRTLRNDYAKYAREDDDLETLERDVSEESGWKLVHGDVFRPPRNLVILSAVVGTGAQLALLVLLVILLAIVGMLYVGRGAIVTTFIVCYALTSFISGYVSGGMYSRHGGKSWIKSMILTASLFPFMCFGIGFILNTIAIFYGSLAAIPFGTMVVVFVIWAFISFPLALLGTVVGRNWSGAPNNPCRVKTIPRPIPEKKWYLTPSVVSLMGGLLPFGSIFIEMYFVFTSFWNYKVYYVYGFMLLVFLILVIVTVCVTIVGTYFLLNAENYHWQWTSFFSAASTAVYVYLYSIYYYYVKTKMSGFFQTSFYFGYTMMFCLGLGILCGAVGYLGSNLFVRRIYRNIKCD

SEQ ID NO: 8503 - protein, 471 aa, Zostera marina
MQLIARIGLNYLWMICHFGALLERLELIKAMKITFSFTHKDIIIKYNGFQIIHVNLTQDGAKLLEVGKTLDMTYSVKWIKTNIEFARRFDVYLDYPFFEHQIHWFSIFNSFMMVIFLTGLVSMILMRTLRNDYAKYAREDDDLETLERDVSEESGWKLVHGDVFRPPLNLIVLSAVVGTGAQFAMLVLMVILLAIIGMLYIGRGSIVTTFIVCYALTSSISGYVSGGMYSRNGGKNWIKSMIFSASLFPFMCFGIGFILNTIAIFYGSLAAIPFGTMMVVFIIWGFISLPLAFLGTLVGRNWSGYPNIPCRVKTIPRLIPEKKWYLTPSVISLMGGLLPFGSIFIEMYFVFTSFWNYKVYYVYGFMLLVFIILIIVTVCVTIVGTYFLLNAENYHWQWTSFFSAASTAGYVYLYSIYYYHSKTKMSGFFQTSFYFGYTLMFCLGLGILCGAVGYLGSTMFVRRIYRNIKCD

SEQ ID NO: 8504 - protein, 588 aa, Pinus taeda
MGYKEGVWFCWMLYLIAALGTVFASEYDHKYRASDPVTLWVNKVGPYNNPQETYNYYSLPFCQPAKNPSHKWGGLGEVLGGNELIDSQVDIKFGKNVEKSPICTIELDATKVKQFKEAIENAYWFEFFMDDLPLWGFVGEIHLDKSDDQKHLLYTHKNIIVKINNDQIIHVNLTQENPKPLIAGKTLELTYSVHWVETNITFARRFDVYLDYPFFEHQIHWFSIFNSFMMVIFLTGLVSMILMRTLRNDYAKYAREEDDLESLERDVSEESGWKLVHGDVFRTPRNLVLLSALVGTGAQLAMLVLLVILLAIVGMLYIGRGAIVTTFIVCYALTSFISGYVSGGLYSRNDGKHWIKSMVLTASLFPFMCFGIGFVLNIIAIFYGSLAAIPFGTMVVVFVIWAFISFPLALLGTVVGRNWSGAPNNPCRVKTIPRPIPEKKWYLTPTVVSLMGGLLPFGSIFIEMYFVFTSFWNYKVYYVYGFMLLVFLILVIVTVCVTIVGTYFLLNAENYHWQWTSFFSAASTAAYVYLYSIYYYHMKTKMSGFFQTSFYFGYTLMFCLGLGILCGAVGYLGSTLFVRRIYRNIKCD

SEQ ID NO: 8505 - protein, 588 aa, Pseudotsuga menziesii
MGHKECVWLCLALYMVAALGAVFASEYDHKYRANDPVTLWVNKVGPYNNPQETYNYYSLPFCHSGKNPTHKWGGLGEVLGGNELIDSQTEIKFGKTVEKNSICTIELDATKVKQFKEAIENAYWFEFFMDDLPLWGFVGEFHPDKSDDQKHLLYTHKDIIVKTNNDQIIHVNLSQENPKPLVTGKTLELTYSVNWVATNVTFARRFDIYLDYPFFEHQIHWFSIFNSFMMVIFLTGLVSMILMRTLRNDYAKYAREEDDLESLERDVSEESGWKLVHGDVFRTPRNLVLLSALVGTGAQLAMLVLLVILLAIVGMLYIGRGAIVTTFIVCYALTSFISGYVSGGLYSRNDGKHWIKSMVLTASLFPFMCFGIGFVLNIIAIFYGSLAAIPFGTMVVVFIIWAFISFPLALLGTVVGRNWSGAPNNPCRVKTIPRPIPEKKWYLTPTVVSLMGGLLPFGSIFIEMYFVFTSFWNYKVYYVYGFMLLVFLILVIVTICVTIVGTYFLLNAENYHWQWTSFFSAASTAAYVYLYSIYYYHMKTKMSGFFQTSFYFGYTLMFCLGLGILCGAVGYLGSTLFVRRIYRNIKCD

SEQ ID NO: 8506 - protein, 583 aa, Trigonella foenum-graecum
MFFRFSLLLLLLLSPAFASESDHKYQPDDPVTLWVNKVGPYNNPQETYNYYSLPFCRPPGNAAHKWGGLGEVLGGNELIDSQIEIKFLVNVERTTFCRLNLDEAKVKQFKDAIENNYWFEFFMDDLPLWGYVGELHPDKNSDSGKHVLYTHKNIIVKYNKDQIIHVNLTHDDPKPLEAGRSLDMTYSVKWISTNVTFRHRFDVYLDYPFFEHQIHWFSIFNSFMMVIFLTGLVSMILMRTLRNDYAKYAREDDDLETLERDVSEESGWKLVHGDVFRPPRSLALLSAVVGTGAQLALLILLVILLAIVGMLYVGRGAIVTTFIVCYALTSVISGYVSGGMYSRNGGKSWIKSMILTASLFPFLCFGIGFMLNTVAIFYGSLAAIPFGTMVVVFVIWAFISFPLALLGTVVGRNWSGAPNNPCRVKTIPRPIPEKKWYLTPSVVSLMGGLLPFGSIFIEMYFVFTSFWNYKVYYVYGFMLLVFLILIVVTVCVTIVGTYFLLNAENYNWQWTSFLSAASTGVYVYFYSIYYYYMKTKMSGFFQTSFYFGYTMMFCLGLGILCGAVGHLGSNLFVRRIYRNIKCD

SEQ ID NO: 8507 - protein, 507 aa, Amborella trichopoda
MLPTFRSRSFFSDLFLFFLFITPSIASESDHKYQEDEPVMLWVNKVGPYNNPQETYNYYSLPFCQPAGNPAHKWGGLGEVLGGNELIDSQIEIKFKRNVDKRSICELELDDAKAKLFKDAIENAYWFEFFMDDLLLRGYVGDIRSDKVNDNKHVLFTHKNIVVEYNGDQIIHVNLTQENPKTLEAGKSLDLTYSVKWISTNVTFARRFDVYLDYPFFEHQIHWFSIFNSFMMVIFLTGLVSMILMRTLRNDYAKYAREDDDLETLERDVSEESGWKLVHGDVFRPPRNLVILSAVVGTGAQLAMLVLLVILLAIVGMLYIGRGAIVTTFIVCYALTSFISGHVSGGLYSRNGGKNWIKSMILTASLFPFMCFGIGFILNTIAIFYGSLAAIPFGTMVVVFIIWAFISFPLALLGTVVGRNWSGAPNNPCRVKTIPRPIPEKKWYLTPSVVSLMGGLLPFGSIFIEMYFVFTSFWNYKVYYVYGFMLLVFLILIIVTVCVTIVGTYSC

SEQ ID NO: 8508 - protein, 61 aa, Ambrosia trifida
MWAAVLFSAFFLLISSPVFASEYDHKYQTDEAINLWVNKVGPYNNPQETYNYYSLRFVVTW

SEQ ID NO: 8509 - protein, 592 aa, Euphorbia peplus
MSSSATAVRFLFLPIFVSFLLLSPVLSSESDHKYLADDSVTLWVNKVGPYNNPQETYNYYSLPFCHPAGSAAHKWGGLGEVLGGNELIDSKIHIKYQKNVEKAVICSLELDESKVKQFKDAIENNYWFEFFMDDLPLWGFVGELHPDKNSDNGKHVLYTHKTVTVRYNKDQIIHVNLTQDNPKPLEAGRILDMTYSVKWIPTNISFARRFDVYLDYPFFEHQIHWFSIFNSFMMVIFLTGLVSMILMRTLRNDYAKYAREDDDLESLERDVSEESGWKLVHGDVFRPPRNLVVLSAVVGTGAQLALLVLLVILMAIVGTLYVGRGAIVTTFIICYALTSFVAGYVSGGMYSRHGGKSWIKSMILTASLFPFMCFGIGFILNTIAIFYGSLAAIPFGTMVVVFVIWAFISFPLALLGTVVGRNWSGAPNNPCRVKTIPRPIPEKKWYLTPSVVSLMGGLLPFGSIFIEMYFVFTSFWNYKVYYVYGFMLLVFLILVIVTVCVTIVGTYFLLNAENYHWQWTSFFSAASTAVYVYLYSIYYYYVKTKMSGFFQTSFYFGYTLMFCLGLGILCGAVGYLGSNLFVRRIYRNIKCD

SEQ ID NO: 8510 - protein, 594 aa, Eutrema parvulum
MPSSSAVKSLFSVYSAVACVFLLLSPALATESDHKYQGDEQVTLWVNKVGPYNNPQETYNYYSLPFCRKTENSIHKWGGLGEVLGGNELIDSQIDIKFLKNVDRSVICQLELDEAKVKHFKDAIENSYWFELFMDDLPLWGFVGELPPGKNSENGKHVLYTHKNIIIKYNKDQIIHVNLTQDNPRPLEAGRTVDLTYSVNWIPTNVTFARRFDVYLDYPFFEHQIHWFSIFNSFMMVIFLTGLVSMILMRTLRNDYAKYAREDDDLESLERDVSEESGWKLVHGDVFRSPRSFVLLSAVVGTGAQLALLVLLVILMAIIGTLYVGRGAIVTTFIVCYALTSFISGYVSGGMYSRSGGKHWIKCMILTASLFPFLCFGIGFLLNTVAIFYGSLAAIPFGTMVVVFVIWGFISFPLALLGTVVGRNWSGAPNNPCRVKTIPRPIPEKKWYLTPSVVSLMGGLLPFGSIFIEMYFVFTSFWNYKVYYVYGFMLLVFLILVVVTVCVTIVGTYFLLNAENYHWQWTSFFSAASTAVYVYLYSIYYYYVKTKMFGFFQTSFYFGYTLMFCLGLGILCGAVGFLGSNLFVRRIYRNIKCD

SEQ ID NO: 8511 - protein, 583 aa, Triphysaria pusilla
MWPVFRFFIICICISSFLVSSTVGKYEDGEAVTLWVNKVGPYNNPQETYNYYSLPFCHAPGNLAHKWGGLGEVLGGNELIDSQIEIKYKRDVEKTSVCEIELEAAKVKQFKDAIDHSYWFEFFMDDLPLWGFIGEVVPDRSHDTKHVLWTHKNLVINYNGNQIIHVNLTQENPKPLEEGRVLDMTYSVKWVPTNITFARRFDVYLDYPFFEHQIHWFSVFNSFMMVIFLTGLVSMILMRTLRNDYAKYAREDDDLETLERDVSEESGWKLVHGDVFRPSQYLALHSAVVGTGAQLATLVLLVIIFAIVGMLYIGRGAIVTTFIVCYAFTSFIAGYVSGGMYSRHGGKTWIKSMILTASFFPFICFGIGFILNTIAIFYGSLAAIPFGTMVVVFVIWAFISFPLALLGTVVGRNWSGAPNNPCRVKTIPRPIPEKKWYLTPSVISLMGGLLPFGSIFIEMYFVFTSFWNYKVYYVYGFMLLVFVILIIVTVCVTIVGTYFLLNAENYHWQWTSFFSAASTSLYVYLYSIYYYYVKTKMSGFFQTSFYFGYTAMFCLGLGILCGAVGYLGSNLFVRRIYRNIKCD

SEQ ID NO: 8512 - protein, 581 aa, Orobanche aegyptiaca
MCSVFRFVCIFFLLFIVPSALGKYQAGETVTLWVNKVGPYNNPQETYNYYSLPFCRPPGNPSHKWGGLGEVLGGNELIDSQIGIKFKGNVEKTPICEIELEAAKVKQFKDAIDNSYWFEFFMDDLPLWGFIGEVVPDRAHDTKHVLWTHKNLVINYNGNQIIHVNLTQENPKPLEEGRVLDMTYSVKWVPTNITFARRFDVYLDYPFFEHQIHWFSVFNSFMMVIFLTGLVSMILMRTLRNDYAKYAREDDDLESLERDVSEESGWKLVHGDVFRPSQNLGLLSAVVGTGAQLATLVLLVIIFAIVGMLYIGRGAIVTTFIVCYAFTSFIAGYVSGGMYSRNGGKTWIKSMILTASLFPFICFGIGFVLNTVAIFYGSLAAIPFGTMVVVLVIWAFISFPLALLGTVVGRNWSGAPNNPCRVKTIPRPIPEKKWYLTPSIISLMGGLLPFGSIFIEMYFVFTSFWNYKVYYVYGFMLLVFVILIIVTVCVTIVGTYFLLNAENYHWQWTSFFSAASTALYVYLYSIYYYHVKTKMSGFFQTSFYFGYTLMFCLGLGILCGAVGYLGSNLFVRRIYRNIKCD

SEQ ID NO: 8513 - protein, 581 aa, Ambrosia trifida
ALIATLLFLASPVFASDYDHKYQSDEKVTLWVNKVGPYNNPQETYNFYSLPFCRQDGHAQAAHKWGGLGEVLGGNELIDSQMDVKFQKNVDKTSVCELELDDSKAMQFKQAIENNYWFELFMDDLPLWGFVGELHSDKNSDNKHTLFTHMNITIQYNKDQIIHVNLSQENPKPLEVGKTLDMTYSVKWTETNVPFARRFDVYLDYHFFEHQIHWFSIFNSFMMVIFLTGLVSMILMRTLRNDYAKYAREDDDLETLERDVNEESGWKLVHGDVFRPPRNLVLLSAVVGTGAQLALLILLVIVFAIIGMLYVGRGSIVTTFIVCYALTSFVSGYVSGGMYSRNGGKTWIKSMILTASLFPFLCFGIGFILNTIAIFYGSLAAIPFGTMVVVFVIWAFISFPLALLGTVVGRNWSGAPNNPCRVKTIPRPIPVKKWYLTPSVVSLMGGLLPFGSIFIEMYFVFTSFWNYKVYYVYGFMLLVFLILIIVTVCVTIVGTYFLLNAENYYWQWTSFFSAASTAIYVYLYSIYYYYVKTKMSGFFQTSFYFGYTAMFCLGLGILCGAVGHLGSNLFVRRIYRNIKCD

SEQ ID NO: 8514 - protein, 575 aa, Trigonella foenum-graecum
LFISSSFASDSDHKYQRDDPVNLWVNKVGPYNNPQETYNYYSLPFCHPSSTSTAAHKWGGLGEVLGGNELIDSQLEIKFLRNLDKTVFCQMDLDDAKVKQFKDAIENNYWFELFMDDLPLWGYVGELHPDKHSDNGKHVLYTHKNIIVKYNNDQIIHVNLTQDIPKTLEAGKHLDLTYSVKWVPTNVTFGRRFDVYLDYPFFEHQIHWFSIFNSFMMVIFLTGLVSMILMRTLRNDYAKYAREDDDLESLERDVSEESGWKLVHGDVFRPPRYLVILSAVVGTGAQLALLVLLVILLAIIGMLYVGRGAIVTTFIVCYALTSFISGYVSGGMYSRNGGKSWIKSMILTASLFPFMCFGIGFALNTIAIFYGSLAAIPFGTMVVVFVIWAFISFPLALLGTVVGRNWSGAPNNPCRVKTIPRPIPEKKWYLTPSVVSLMGGLLPFGSIFIEMYFVFTSFWNYKVYYVYGFMLLVFLILTIVTVCVTIVGTYFLLNAENYHWQWTSFCSAASTSVYVYLYSIYYYYVKTKMSGFFQTSFYFGYTLMFSLGLGILCGAVGFLGSNLFVRRIYRNIKCD

SEQ ID NO: 8515 - protein, 583 aa, Lotus japonicus
MFFRFSLLFLFLSAAAFASESDHRYQQDDPVTLWVNKVGPYNNPQETYNYYSLPFCRPPGSAGHKWGGLGEVLGGNELIDSQIEIKYLVNVDKTTFCRLSLNEANVKQFKDAIENNYWFEFFMDDLPLWGYVGELHPDKNSDNGKHVLYTHKNVIVKYNKDQIIHVNLTHEDPKSLEVGRSLDMTYSVKWIPTNITFRRRFDVYLDYPFFEHQIHWFSIFNSFMMVIFLTGLVSMILMRTLRNDYAKYAREDDDLETLERDVSEESGWKLVHGDVFRPPRYLILLSAVVGIGAQLATLVLLVILLAIVGMLYVGRGTIVTTFIVCYALTSFIAGYVSGGMYSRNGGKNWIKSMILTASLFPFLCFGIGFILNTIAIFYGSLAAIPFGTIVVVFVIWAFISFPLALLGTVVGRNWSGAPNNPCRVKTIPRPIPEKKWYLTPSVVSMMGGLLPFGSIFIEMYFVFTSFWNYKVYYVYGFMLLVFIILLIVTVCVTIVGTYFLLNAENYHWRWTSFFSAASTAVYVYLYSIYYYYVKTKMSGFFQTSFYFGYTLMLCLGLGILCGAVGYLGSNLFVRRIYRNIKCD

SEQ ID NO: 8516 - protein, 303 aa, Centaurea maculosa
  misc_feature (4)..(4): Xaa can be any naturally occurring amino acid
  misc_feature (8)..(8): Xaa can be any naturally occurring amino acid
  misc_feature (10)..(10): Xaa can be any naturally occurring amino acid
  misc_feature (27)..(27): Xaa can be any naturally occurring amino acid
  misc_feature (112)..(112): Xaa can be any naturally occurring amino acid
  misc_feature (262)..(262): Xaa can be any naturally occurring amino acid
  misc_feature (265)..(266): Xaa can be any naturally occurring amino acid
  misc_feature (269)..(270): Xaa can be any naturally occurring amino acid
  misc_feature (291)..(292): Xaa can be any naturally occurring amino acid
  misc_feature (296)..(297): Xaa can be any naturally occurring amino acid
  misc_feature (299)..(301): Xaa can be any naturally occurring amino acid
MRPXIVAXLXASFIFISSSPPVVFASXYDHKYQSDERVTLWVNKVGPYNNPQETYNFYSLPFCHKAGHAAHKWGGLGEVLGGNELIDSQIDVKFPKDVEKTTVCELELDEPXVMQFKQAIENSYWFELFMDDLPLWGFVGELHSDRNSDSKHTLFTHMNITIQYNKDQIIHVNLSQENPKPLEVGRTLDMTYSVKWTETNITFLRRFDVYLDYHFFEHQIHWFSIFNSFMMVIFLTGLVSMILMRTLRNDYAKYAREDDDLXTLXXDVXXESGWKLVHGDVFRPPRNLVFXXQLLXXVXXXHY

SEQ ID NO: 8517 - protein, 82 aa, Vaccinium corymbosum
MLRTITGSGLHFSLLPQRLSMCICIQYITTLLRLRCRASSRPASIFGYTLMFCLGLGILCGAVGYLGSNLFVRRIYRNIKCD

SEQ ID NO: 8518 - protein, 589 aa, Vigna unguiculata
MFVLYRSLLFPLFISLFLSSAFASESDHKYQRDEPVNLWVNKLGPYNNPQETYNYYSLPFCHPSSNATAAHKWGGLGEVLGGNELIDSQIDIKFQRNVDKTVFCQIDLNEAKVKQFKDAIENNYWFEFFMDDLPLWGYVGEIRPDKNGDGKHVLYTHKNIIVRYNNDQIIHVNLTQDIPKPLEVGKHLDMTYSVKWDSTNVTFGHRFDVYLDHPFFEHQIHWFSIFNSFMMVIFLTGLVSMILMRTLRNDYAKYAREDDDLESLERDVSEESGWKLVHGDVFRPPRNLVILSAVVGTGAQLALLVLLVVLLAIVGMLYVGRGAIVTTFIVCYALTSFISGYVSGGMYSRNGGKSWIKSMILTASLFPFLCFGIGFILNTIAIFYGSLAAIPFGTIVIVFVIWAFISFPLALLGTVVGRNWSGALNNPCRVKTIPRPIPEKKWYLTPSVVSLMGGLLPFGSIFIEMYFVFTSFWNYKVYYVYGFMLLVFLILIIVTVCVTIVGTYFLLNAENYHWQWTSFFSAASTAVYVYLYSIYYYYMKTKMSGFFQTSFYFGYTLMFSLGLGILCGAVGFLGSNLFVRRIYRNIKCD

SEQ ID NO: 8519 - protein, 583 aa, Mimulus guttatus
MGYAVRFFCTFAFFFLFFVSSTLGKYQDDEAVTLWVNKVGPYNNPQETYNYYSLPFCHPPGNAAHKWGGLGEVIGGNELIDSQIEIKFKRDVTKAKICEIELEAANVKQFKDAIDNSYWFEFFMDDLPLWGFVGEVLPDKAHDSKHVLLTHKNLVINYNGDQIIHINLTQENPRPLEEGRVLDMTYSVKWVRTNVTFARRFDVYLDYPFFEHQIHWFSVFNSFMMVIFLTGLVSMILMRTLRNDYAKYAREDDDLETLERDVSEESGWKLVHGDVFRPSKNLALLSAVVGTGAQLATLVLLVIILAIVGMLYIGRGAIVTTFIVCYAFTSFIAGYVSGGMYSRHGGKTWIKSMILTASLFPFMCFGIGFILNTIAIFYGSLAAIPFGTMVVVLVIWAFISFPLALLGTVVGRNWSGAPNNPCRVKTIPRPIPEKKWYLTPSVVSLMGGLLPFGSIFIEMYFVFTSFWNYKVYYVYGFMLLVFVILIIVTVCVTIVGTYFLLNAENYHWQWTSFFSAASTSLYVYLYSIYYYYVKTKMSGFFQTSFYFGYTLMFCMGLGILCGAVGYLGSNLFVRRIYRNIKCD

SEQ ID NO: 8520 - protein, 180 aa, Ambrosia trifida
GSSALIAYPSFPCHRRCLTSDYDHKYQSDEKVTLWVNKVGPYNNPQETYNFYSLPFCRQDGHAQAAHKWGGLGEVLGGNELIDSQMDVKFQKNVDKTSVCELELDDSKAMQFKQAIENNYWFELFMDDLPLWGFVGELHSDKNSDNKHTLFTHMNITIQYNKDQIIHVNLSQETKTFRSW

SEQ ID NO: 8521 - protein, 588 aa, Amorphophallus konjac
MRPAARSAPLLALLLVAASGSASASESDHKYQVDEPVTLWVNKVGPYYNPQETYNYYSLPFCQPAGNPVHKWGGLGEVLGGNELIDSQIEIKYKKMVDKASICAIEFDAAKVKQFKDAIENSYWLEFFMDRLPLWGFVGEVRSDKNNENKHYLFTHKDIVVRYNGDQIIRVNLTQGAPKPLEVGRTLDMTYSVRWIKIDITFARRFDVYLDYPFFEHQIHWFSIFNSFMMVIFLAGLVSMILMRTLRNDYAKYAREDGDLETMERDVSEESGWKLVHGDVFRPPCSLVLLSALVGIGAQLALLVLLVILLTISGMLYIGRGEIITTFIVCYALTSFISGYVSGGLYSRNVGKNWIKTMVLTASLFPFMCFGIGFVLNMVAIFYGSLAAIPFGTMLVLFIIWAFISFPLALLGTVVGRNWSGSPNNPCRVKTIPRPIPEKKWYLTPSVVSLMGGLLPFGSIFIEMYFVFTSFWNYKVYYVYGFMLFVFLILIVVTICVTIVGIYFLLNAENYHWQWTSFFSAASTAAYAYLYSIYYYYMKTKMSGFFQTSFYFGYTLMFCLGLGILSGAVGYLGSSLFVRRIYGNIKCD

SEQ ID NO: 8522 - protein, 585 aa, Brassica rapa
MPSSSAVLLLLVPLLATALASDSDHKYQADEQVTLWVNKVGPYNNPQETYNYYSLPFCRPSQNDVHKWGGLGEVLGGNELIDSEIPIKFLKNVDRNVICHLELDEAKVNHFKDAIESSYWFEFFMDDLPLWGFVGELPLDKNSGNGKHVLYTHKSIIVKYNKDQIIHVNLTQDNPRPLEAGRTVDLTYSVQWIPTDVTFARRFDVYLDYPFFEHQIHWFSIFNSFMMVIFLTGLVSMILMRTLRNDYAKYAREDDDLESLERDVNEESGWKLVHGDVFRPPWSLVLLSAVVGTGAQLALLVLLVILMAIVGTLYVGRGAIVTTFIVCYALTSFVSGYVSGGMYSRSGGKHWIKCMVLTASLFPFLCFGIGFLLNTIAIFYGSLAAIPFGTMVVMFVIWGFISFPLALLGTVVGRNWSGVPNNPCRVKTIPRPIPEKKWYLTPSVVSLMGGLLPFGSIFIEMYFVFTSFWNYKVYYVYGFMLLVFVILVIVTVCVTIVGTYFLLNAENYHWQWTSFFSAASTAVYVYLYSIYYYYVKTKMSGFFQTSFYFGYTMMFCLGLGILCGAVGFLGSNLFVRRIYRNIKCD

SEQ ID NO: 8523 - protein, 473 aa, Brassica napus
MPSKIVTGLSYLWMICLCGVLWASCLLGKKSENGKHALYTHKSINVKYNKDQIIHVNLTQDNLIPLEAGRTVDLTYSVNWIPTDVTFARRFDVYLDYPFFEHQIHWFSIFNSFMMVIFLTGLVSMILMRTLRNDYAKYAREDDDLESLERDVNEESGWKLVHGDVFRPPSSLVLLSAVVGTGAQLALLVLLVILMAIIGTLYVGRGAIVTTFIVCYALTSFISGYVSGGMYSRSGGKHWIKCMILTASLFPFLCFGIGFVLNTIAIFYGSLAAIPFGTMVVVFVIWGFISFPLALLGTVVGRNWSGAPNNPCRVKTIPRPIPEKKWYLTPSVVSLMGGLLPFGSIFIEMYFVFTSFWNYKVYYVYGFMLLVFLILLVVTVCVTIVGTYFLLNAENYHWQWTSFFSAASTAVYVYLYSIYYYYVKTKMFGFFQTSFYFGYTLMFCLGLGILCGAVGFLGSNLFVRRIYRNIKCD

SEQ ID NO: 8524 - protein, 570 aa, Cirsium arvense
SSPVFASEYDHKYQPDDPINLWVNKVGPYNNPQETYNYYSLPFCRRLGNPGHKWGGLGEVLGGNELIDSQIDVKFQKNVEKTTICELELDEAKVKQFTEAIENNYWFEFFMDDLPLWGFVGELHSDRNSDSKHMLFTHKNITIQYNKDQIIHVNLSQENPKPLEVGRTVDMTYSVKWTETNITFARRFDVYLDYHFFEHQIHWFSIFNSFMMVIFLTGLVSMILMRTLRNDYAKYAREDDDLESLERDVNEESGWKLVHGDVFRPARNLVLLSAVVGTGAQLALLILLVILFAIVATLYIGRGAIVTTFIVCYALTSFVSGYVSGGMYSRNGGKHWIKSMILTASLFPFLCFGIGFFLNTIAIFYGSLAAIPFGTMVVVFVIWAFISFPLALLGTVVGRNWSGAPNNPCRVKTIPRPIPEKKWYLTPSVVSIMGGLLPFGSIFIEMYFVFTSFWNYKVYYVYGFMLLVFLILIIVTVCVTIVGTYFLLNAENYHWQWTSFFSAASTAIYVYLYSIYYYYVKTKMSGFFQTSFYFGYTAMFCLGLGILCGAVGYLGSNLFVRRIYRNIKCD

SEQ ID NO: 8525 - protein, 589 aa, Medicago truncatula
MSFQSRSIFFLFFSLFISSTFASESDHKYQRDDPVNLWVNKVGPYNNPQETYNYYSLPFCHPSSTSAAAHKWGGLGEVLGGNELIDSQIEIKFLRNVEKTVFCQMVLDDAKVKQFKHAIENNYWFEFFMDDLPLWGYVGELHPDKHSDNGKHVLYTHKNIIVKYNNDQIIHVNLTQDVPKPLEAGKHLDLTYSVKWVPTNITFGRRFDVYLDYPFFEHQIHWFSIFNSFMMVIFLTGLVSMILMRTLRNDYAKYAREDDDLESLERDVSEESGWKLVHGDVFRPPRYLVIISAVVGTGAQLALLVLLVILLAIIGMLYIGRGAIVTTFIVCYALTSFISGYVSGGMYSRNGGKSWIKSMILTASLFPFMCFGIGFALNTIAIFYGSLAAIPFGTMVVVFVIWAFISFPLALLGTVVGRNWSGAPNNPCRVKTIPRPIPEKKWYLTPSVVSLMGGLLPFGSIFIEMYFVFTSFWNYKVYYVYGFMLLVFLILTIVTVCVTIVGTYFLLNAENYHWQWTSFFSAASTSVYVYLYSIYYYYVKTKMSGFFQTSFYFGYTLMFSLGLGILCGAVGFLGSNLFVRRIYRNIKCD

SEQ ID NO: 8526 - protein, 233 aa, Hordeum vulgare
MAAAGALVVYRAVFAALGCLMVGTLVYTCITDGSPFRIELLTPWIVTTLVDFYVNIAAISTWVVYKEGNWISSIFWVVLLICFGSATTCAYIVSKLFEITSSGLSQNPLDLLLLRQDNLPERKCSFVVIGRTIFSILGILMAALVTYTVITDGLPFRKDLLTPWMAATLIDFYINVFAISVWVVHRESTWISAVIWICLLICFGSITTCGYIVVQLLQVSYQDPVYHLLLNSP

SEQ ID NO: 8527 - protein, 242 aa, Setaria italica
MAAQGSLVAWRVVFAALGLLMVGTLVYTCATDGSPFRPELLTPWMNATLIDFYVNVIAIAAWVIYKEANWISSAVWVVLLFCFGSAATCAYIVTKLFEVTPGGPSHDPLDLLFIRQGNLSQRKCSYVIIGRIMFSILGIFMAAVVTYTVITDGLPFRKELLTPWMAATLIDFYINVFAISVWVAHKESSWISTTIWIVLLICFGSITTCGYIALQLFQVSYQDPIYHVLLNSHSKYGTATSL

SEQ ID NO: 8528 - protein, 242 aa, Panicum virgatum
MAAQGSLVAWRAVFAALGVLMVGTLVYTCATDGSPFRSELLTPWMVATLVDFYVNVIAISAWVIYKEASWVSSAVWVVLLFCFGSAATCAYIVMKLFEVTPTGPSQDPLDLLFIRQGNPSQRKCSYVIIGRIIFSILGIFMATVVIYTVITDGLPFRKELLTPWMAATLIDFYINIFAISVWVAHKESSWISTTIWIVLLICFGSITTCGYIVLQLLQVSYQDPIYHVLLNSHSKYGIATSL

SEQ ID NO: 8529 - protein, 237 aa, Zea mays
MAAQGSLVMWRAVFAALGLLMVATLVYTLATDGSPFRLELFTPWMVATLADFYVNVIAISAWVIYKEANWVSSAVWVVLLFCFGSAVTCAYIVKKLLEVTSAGSSQDPLDLLFIRQGNLSQRKCSYVVIGRVIFSILGIFMAAVVTYTVITDGLPFRKELLTPWMAATLIDFYINVFAISVWVAHKESSWISTTIWIVLLICFGSITTCGYIVIQLFKVSYQDPIYHVLLNSHSKKI

SEQ ID NO: 8530 - protein, 242 aa, Eragrostis curvula
MAAPGSLVVWRAVFAALGTFMVGTLVYTCATDGSPFRPELLTPWLVATLVDFYVNVIAISAWVIYKETNWISSAIWVVLLFCFGSAATCAYIVKKLFEVTPTGPSQDPLDLLLLRQGNPSQRNCSCVTAERIIFSILGIFMAAVATYTVITDGLPFRAELLTPWMAATLIDFYINIFAISVWVAHKESSWISTAIWICLLICFGSMTTCGYIVIQLFQVSYQDPIYHVLLNCHSKYGTVTSP

SEQ ID NO: 8531 - protein, 242 aa, Panicum virgatum
MAAQGSLVAWRAVFAALGVLMVSTLVYTCATDGSPFRSELLTPWMVATLVDFYVNVIAISAWVIYKEASWVSSAVWVVLLFCFGSAATCAYIVMKLFEVTPTGPSQDPLDLLFIRQGNPSQRKCSYVIIGRIIFSILGIFMATVVIYTVITDGLPFRKELLTPWMAATLIDFYINIFAISVWVAHKESSWISTTIWIVLLICFGSITTCGYIVLQLLQVSYQDPIYHVLLNSHSKYGIATSL

SEQ ID NO: 8532 - protein, 930 aa, Oryza sativa
MLVRLGVVVVASVAALTLKRANSGNRDGQARKGKDKTRYSEHGEKEEEKEEVKTISGIINSALSDDDDMLSEIESLLSGEIDIPLPSDRFDVKERSWYNSVNSELERLRGLVRELEEREVKLEGELLEYYGLKEQETDVVELHRQLKIKMVEIDMLKMTINSLQEERKKLQDDVARGTGAKRELEAARNKIKELQRQIQMEANQTKGQLMLLKNQVIALKSKEEEAAIKDAEVQRKLKKLKELEVEVVELRRKNKELLYEKRDLIVKLDAAQGKITESDVVSHAREEINKLRHVNEDLTKQVEGLQMNRFSEVEELVYLRWVNACLRYELRNYQAPSEKISARYLNKTLSPKSRERAKLLMLEYAGSERGQGDTDLETASSAPSSPRSEDLDNVSVDSSSSRYSFFGKRPNLMQKLKKWGRGKDDESRLASPTQFFTSDSPKSASQKPKGPLEALMLRNAGDGVGITTFGKREQDPSDIMDEANVASSFHLMSKTVQGFADDKYPAYKDRHKLATEREKVIKEKAEKARVQRYGGVNSSGIVPSPRSALPPKLAQIKEKAPTANAESSDQPSDNQNNPLVVTQLKLANIEKRAPRVPRPPPAPSATANTASALSPPPPRPPGAPPPPPPPGKPGGPPPPPPPPGSLPRNLAGGDKVHRAPEVVEFYQSLMKREAKKDTTSLGSTTSSAFDVRSNMIGEIENRSTFLLAVKADVETQGDFVESLANEVRAASFVNIDDVVAFVNWLDEELSFLVDERAVLKHFDWPESKTDALREAAFEYQDLLKLEHKVSSFTDDPKLACEEALKKMYSLLEKVEQSVYALLRTRDMAISRYREYGLPVDWLSGSGVVGKIKLASVQLAKKYMKRVATELDALQGTEKEPNREFLLLQGVRFAFRVHQFAGGFDEESMKAFEELRSKMSTQTSAPQISDV

SEQ ID NO: 8533 - protein, 936 aa, Brachypodium distachyon
MLVRLGFVVVASVAAFTLKRGRGPNKDNGQARKRKDKARSSEHGEKEEEKEEVKTISGIINSVEDDDDDMFSEIESLLSGEIDIPIPSDRFDVKERSRYNAHMANNGAEMERLRGLVRELEEREVKLEGELLEYYGLKEQETDVTELQKQLKIKTVEVDMLNITISSLQAERKKLQDDVVRGAATKKELEASRSRIRELQRQIQMEANQTKGQLMLLKQQVMGLKAKEEEVAKKDAEIEQKLKKLKELEVEVLELRRKNKELLYEKRDLIVKLDAAQGKITESDVVAHAREEISNLRHTNEDLTKQVEGLQMNRFSEVEELVYLRWVNACLRFELRNYQTPSGKISARDLNRTLSPKSQARAKQLMLEYGSERGQGDTDLDSASSAPSSPRSEDFDTVSIDSSSSRYSFLSKRPNLMQKLKKWGRSKDDSSNLSSPTQSLTSGSPKRSQKPKGPLESLMLRNAGDGMSITTFGKREQDSSDILDEANVASSFQLMSKNVEGFADEKYPAYKDRHKLATEREKAIKEKAEQARAQRFGGGYSSALVPSPKAALPPKLAQIKEKKVPAVNAESGDQSSDNQNNPLAVTQLKLAQIEKRAPRVPRPPPTASAIASGPTNTASGAPPPPRPPGAPPPPPPPGKPGGPPPPPPPPGSLSRSLAGGEKVHRAPEVVEFYQSLMKREAKNTTSLGSKTSSVSDNRSNMIGEIENRSTFLLAVKADVETQGDFVESLASEVRAARFVNIDDVVAFVHWLDEELAFLVDERAVLKHFDWPESKTDALREAAFEYQDLLKLENKATSFADDPKLPCEEALKKMYSLLEKVEQTVYALLRTRDMTTSRYKEYGIPVDWLSDSGKVGKIKLASVQLAKKYMERVASELDALEGTEKEPNREFLLLQGVRFAFRVHQFAGGFDADSMKVFEELRSKMTTQTSGPPASDT

SEQ ID NO: 8534 - protein, 934 aa, Setaria italica
MLVRLGFVVVASVAALTLKRVNSGGRHNKDNGQARERKDKTHHSEHGEKEEEKEEVKTISGIINSARSLDDDDDDMLSEIESLLSGDIDIPIPSDRFDVNGRSQYNAHMANEAAEIDRLRSLVREMEEREVKLEGELLEYYGMKEMETDVTELQKQLKTKTAEINMLNNTINSMQAERKKLQDEVARGAVAKKELEAATSKIKELQRQMQLEAGQTKGQLMLLKQQVIGLKAKEEEAAKKEAEVQRKLKKLKELEVEVIELRRKNKELLYEKRDLIVKLDAAEGKITESDVVANAREEINKLRHTNEDLTKQVEGLQMNRFSEVEELVYLRWVNACLRFELRNYQMPSGKVSARDLNKTLSPKSQERAKQLMLEYAGSERGQGDTDLESVSSMPSSPGSEDFDNVSIDSSSSRYSFLSKRPNLMQKLKRWGRSKDDSSSLASSISGSPRRKPRGPLEALMLKNAGDGTAITTFGQRDPNDILDEENVASSFQLMSKTVEGFADEKYPAYKDRHKLATERENAIKEKAGQVRAQRFGGGHSSALISSPKGALPPKLAQIKERAPAANAASSEQSSDNQNNILVVSQLKLANIEKRATRVPRPPPPRSTTASGATNTASGVQTPRPPGAPPPPPPPPGKTGGPPPPPPPPGALPRSVAGSDKVHRAPEIVEFYQSLMKREAKKETSLGSVSSNVSDARSNMIGEIENRSTFLLAVKADVETQGEFVESLASEVRAASFVNIDDVVAFVNWLDEELSFLVDERAVLKHFDWPESKTDAIREASFEYQDLIKLQNKVSSFTDDRQLACEEALNKMYSLLEKVEQSVYALLRTRDMAVSRYKEYGIPVDWLSDSGVVGKIKLASVQLANKYMKRVASELDALQGTEKEPNREFLLLQGVRFAFRVHQFAGGFDAESMKAFEELRSKMTTQTPAPQISEV

SEQ ID NO: 8535 - protein, 941 aa, Avena sativa
MLLRLGFVVVATFAAFTLKRGKGPNKGNGQANKKKDKAWDSEHGEKEEEAEEVKTISGIINSALSLDDEDDDDMFSEIESLLGGEVDIPIPSDRFDVKERSRYNAHMAGNAAEMERLRGLVRELEEREVKLEGELLEYYGLKEQETDVTELQKQLKIKTVEVDMLNITINSLQAERKKLQEDVVRGAAAKKELEASRTRIKELQRQIQMEANQTKGQLMLLKQQVMGLKAKEEEVAKKDAEIEQKLKKLKNLEVEVLELRRKNKELLYEKRDLMVKLDAAQGKITESDVVAHAREEINNLRHTNEDLTKQVEGLQMNRFSEVEELVYLRWVNACLRFELRNYQIPSGKMSARDLNRTLSPKSQERAKQLMLEYGSERGQGDTDLDSAPSSAPSSPRSEDFDTMSIDSSSSRYSFLSKRPNLMQKLKKWGRSKDDSSYLASPTRSLTSGSPKRSQKPKGPLESLMIRNAGDGISITTFGKREQDSGEIDDANVTSSFQLMSKSVEGFADEKYPAYKDRHKLATEREKAIKEKAEQARAQRFGGGFSSALVPSPRAALPPKLAQIKEKKVPAINAETGEQTSDNQNNPLAVTQLKLAQIEKRAPRVPRPPPTASAVASGATNTAGGAPLPPRPPGGPPPPPPPPGRPGGPPPPPPPPGSLSKSPAGGDKVHRAPEVVEFYQSLMKREAKNTTSLGSKTSNVSDNRSNMIGEIENRSTFLLAVKADVETQGDFVESLAGEVRAARFVNIDDVVAFVHWLDEELSFLVDERAVLKHFDWPESKTDALREAAFEYTDLQKLENKATSFADDPKIPCEEALKKMYSLLEKVEQSVYALLRTRDMTTARYKEYGIPVDWLSDSGKVGKIKLASVQLARKYMERVASELDAMQGTEKEHNREFLLLQGVRFAFRVHQFAGGFDADSMKVFEELRSKMSTQTPAPPTSET

SEQ ID NO: 8536 - protein, 933 aa, Panicum virgatum
MLVRLGFVVVASVAALTLNRANSRGRHHRDNGQARERKDKTRNSEHGEKEEEKEEVKTISGMINSDRSLDDDDDDMLSEIESLLSGDIDIPIPRDRFDVNGRSGYDAHMANEAAEIDRLRILVREMEEREVKLEGELLEYYGMKEMETDVAELQKQLKTKAVEINILNNTINSMQAERKKLQDEVARGEVAKEELEKARSKIKELQRQIQLEAGQTKGQLMLLKQQVIGLKAKEEEAAKKEAEVQRKLKKLKELELEVVELRRKNKELLYEKRDLIVKLDAAEGKITESDVVAHAREEINKLRHTNEDLTKQVEGLQMNRFSEVEELVYLRWVNACLRFELRNYQTPSGKASARDLNRTLSPKSQERAKQLMLEYAGSERGQGDTDLESASSMPSTPGSEDFDNVSIDSSSSRYSFLSKKSNLMQKLKKWGSRKDDSSTLASPINGSPMRKPKGPLEALMLKNAGDGTAITTFGQRDPNDILDEENVASSFQLMSKTVEGFADEKYPAYKDRHKLATEREKAVKEKAGQARAQRFGGGHSSALVSSPEGALPPKLAQIKERAPAANAASSEQSSDNQNNTLVVSQLKLTNIEKRATRVPRPPPTRSTAASGATNTSSGVQTPRPPGAPPPPPPPPGKGGPPPPPPPPGALPRSLAGGDKVHRAPEIVEFYQSLMKREAKKETSLGSVSSNVSDARSNMIGEIENRSTFLLAVKADVETQGEFVESLASEVRAASFVNIDVVVEFVNWLDEELSFLVDERAVLKHFDWPESKTDAIREAAFEYQDLIKLQNKVSSFTDDPHLPCEEALKKMYSLLEKVEQSVYALLRTRDMAISRYKEYGIPVDWLSDSGVVGKIKLASVQLANKFMKRVASELDALQGTEKEPNREFLLLQGVRFAFRVHQFAGGFDAESMKAFEELRSKMAAQPSAPQITEA

SEQ ID NO: 8537 - protein, 933 aa, Panicum virgatum
MLVRLGFVVVASVAALTINRANNRGRHHKENGQARERKDKTHHSEHGEKEEKEEVKTISSMINSARSLDDDDDDMLSEIESLLSGDIDIPIPRDRFDVNGRSGYNAHMANEAAEIDRLRSLVREMEEREVKLEGELLEYYGMKEMETDVAELQKQLKSKTVEINILNNTINSMQAERKKLQDEVARGAVAKEELDKARSKIKELQRQIQLEAGQTKGQLMLLKQQVIGLKAKEEEAAKKEAEVQRKLKKLKELELEVVELRRKNKELLYEKRDLIVKLDAAEGKITESDVVAHAREKINKLRHTNEDLIKQVEGLQMNRFSEVEELVYLRWVNACLRFELRNYQTPSGKVSARDLNRTLSPKSQERAKQLMLEYAGSERGQGDTDLESVSSMPSTPGSEDFDNVSIDSSSSRYSFLSKRPNLMQKFKKWGSRKDDSSTLASPISGSPMRKPKGPLEALMLKNAGDGTAITTFGQRDPSDILDEENVASSFQLMSKTVEGFADEKYPAYKDRHKLATEREKAIKEKAGQARAQKFGGGHSSALVSSPEGALPPKLAQIKERAPAANAASSEQSSDNQNNTLVVSQLKLANIEKRATRVPRPPPTRSTAASGATNTSSGVQTPRPPGAPPPPPPPPGKAGGPPPPPPPPGALPRSLAGGDKVHRAPEIVEFYQSLMKREAKKETSLGSVSSNVSDARSNMIGEIENRSTFLLAVKADVETQGEFVESLASEVRGASFVNIDVVVAFVNWLDEELSFLVDERAVLKHFDWPESKTDAIREAAFEYQDLIKLQNKVSSFTDDPQLSCEEALKKMYSLLEKVEQSVYALLRTRDMAISRYKEYGIPVDWLSDSGVVGKIKLASVQLANKYMKRVASELDALQGTEKEPNREFLLLQGVRFAFRVHQFAGGFDAESMKAFEELRSKMATQPSAAQITEA

SEQ ID NO: 8538 - protein, 944 aa, Triticum aestivum
MLVRLGFVVLATFAAFTLKRGKGPKKDNGQAGKRKEKARHTGHGEKEDEEEEVKTISGIINSAPSVDDDDEDDMFSEIESLLGGEVDIPIPGDRYDVKERSRYNAHMANNAAEMERLRGLVRELEEREVKLEGELLEYYGLKEQETDVSELQKQLKIKTVEVDMLNLTISSLQAERKKLQEDVARGAAAKKELDASRSRIKELQRQIQMEANQTKGQLMLLKQQVMGLRAKEEEVAKKDAEIEQKLKKLKNLEVEVLELRRKNKELLYEKRDLMVKLDAAQGKITESDVVAHAREEINNLRHTNEDLTKQVEGLQMNRFSEVEELVYLRWVNACLRFELRNYQTPSGKISARDLSTKLSPRSQERAKQMMLEFGSERGQGDTDLDSVSSAPSSPRSEDFDTASIDSSSSRYSFLSKRPNLMQKLKKWGRSKDDGSYLSSPSSRSLTSSSPKRSQKPKGPLESLMIRNAGDGMSITTFGKRDQESGDADDANVASSFQLMSKNVEGFADEKYPAYKDRHKLATEREKAIKEKAEQARAQRFGGGYSSVLVPSPRAALPPKLAQIKEKKAPAVNSEPGEQSSDIPNNPLAVTQLKLAQIEKRAPRVPRPPPTASAAAASGATSTASGAPPMPPRPPGAPPPPPPPGRPGGPPPPPPPPGSLSKSLAGGDKVHRAPEVVEFYQSLMKREAKKDTTSLGSKTSNVSDNRSNMIGEIENRSTFLLAVKADVETQGEFVESLASEVRAARFANIDDVVAFVHWLDEELSFLVDERAVLKHFDWPESKTDALREAAFEYQDLVKLENKATSFVDDPKLPCEEALKRMYSLLEKVEQSVYALLRTRDMTTARYKEYGIPVDWLSDSGKVGKIKLASVQLAKKYMERVTSELDALQGTEKEPNREFLLLQGVRFAFRVHQFAGGFDADSMKVFEELRSKMSSTQTPAPPASDT

SEQ ID NO: 8539 - protein, 939 aa, Hordeum vulgare
MLVRLGFVVLATFAAFTLKRGKGPPNKDNGQAKKKEKARGTAHGEKEEEEEEVKTISGIINSAPSVDDDEDDMFSEIESLLGGEIDIPIPGDRFERSRYNAHMANNAAEMERLRGLVRELEEREVKLEGELLEYYGLKEQETDVSELQKQLKIKTVEVDMLNITISSLQAERKKLQEDVARGAAAKKELDASRSRIKELQRQIQMEANQTKGQLMLLKQQVMGLRAKEEEVAKKDAEIEQKLKKLKNLEVEVLELRRKNKELLYEKRDLMVKLDAAQGKITESDVVAHAREEINNLRHTNEDLTKQVEGLQMNRFSEVEELVYLRWVNACLRFELRNYQTPSGKISARDLSTKLSPKSQERAKQMMLEFGSERGQGDTDLDSVSSAPSSPRSEDFDTASIDSSSSRYSFLSKRPNLMQKLKKWGRSKDDGSYLSSPSSRSLTSSSPKRSQKPKGPLESLMIRNAGDGMSITTFGKKDQESGDIDDANVASSFQLMSKNVEGFADEKYPAYKDRHKLATEREKAIKEKAEQARAQRFGGGYSSALAPSPRAALPPKLAQIKEKKAPAVNAESGEQSSDIPNNPLAVTQLKLAQIEKRAPRVPRPPPTSSAAASGATNTASGGPPMPPRPPGAPPPPPPPGRPGGPPPPPPPPGSLSKSLAGGDKVHRAPEVVEFYQSLMKREAKKDTTSLGSKTSNVSDNRSNMIGEIENRSTFLLAVKADVETQGEFVESLAGEVRAARFANIDDVVAFVHWLDEELSFLVDERAVLKHFDWPESKTDALREAAFEYQDLVKLENKATSFVDDPKLPCEEALKRMYSLLEKVEQSVYALLRTRDMTTARYKEYGIPVDWLSDSGKVGKIKLASVQLARKYMERVTSELDALQGTDKEPNREFLLLQGVRFAFRVHQFAGGFDADSMKVFEELRSKMSSTQAPAPPTSDT

SEQ ID NO: 8540 - protein, 936 aa, Zea mays
MLVRLGFVVVASVAALTLQRANSGARHSKDYVQARKRKDKANNSEHGEKEEEKEEVKTISGIINSARSLGDDDDDMLSEIESLLSGDIDIPIPSDRFDVNGRSRYNNAYMANEASEIEKLRSLVREMEEREAKLEGELLEYYGMKEMETDIAELQKQLKIKTAEINMLNDTINSLQAERKKLQDDVACGEVANKELEAARGKIKELQRQIQLEAGQTKGQLMLLKQQVIGLKAKEEEAGKKEAEVQRKLKKLRELEVEVLELRRKNKELLYEKRDLIVKLDAAEGKITESDVVANAREEINKLRHTNEDLTKQVEGLQMNRFSEVEELVYLRWVNACLRFELRNYQTPSGKVSARDLNRTLSPKSQERAKQLMLEYAGSERGQGDTDLESVVSSMPSSPGSEDFDNMSIDSSSSRYSFLSKRSNLMQKFKRWGRSKDDSSSLASSISGSPRRKPKGPLEALMLKNAGDGTAITTYGKRDPNDVLDDENVASSFQLMSKTVEGFADEKYPAYKDRHKLATEREKAIKEKAGQARAQRFGGGHSSALISSPKGALPPKLAQIKERSPAANAESSEQSSDNQNNTLVVSQMKLANVEKRATRVPRPPPPRSTAASGATSIASGVQTPRAPGAPPPPPPPPGKVGGPPPPPPPPGALPRNLGGGDKVHRAPEIVEFYQSLMKREAKRETSLGSISSNVSDARSNMIGEIENRSTFLLAVKADVETQGEFVESLANEVRAASFINIDDVVAFVNWLDEELSFLVDERAVLKHFDWPESKTDAIREAAFEYQDLIKLQNRVSTFTDDPQLACEEALKKMYSLLEKVEQSVYALLRTRDMTVSRYKEYGIPFDWLSDSGVVGKIKVASVQLANKYMKRVASELDALEGTEKEPNREFLLLQGVRFAFRVHQFAGGFDAESMKAFEELRSKMTTQASAPPISQG

SEQ ID NO: 8541 - protein, 280 aa, Sorghum bicolor
MARAFRAASPLPLPSSRSGAATAVTNGGGRGNFPWLTKKSSSKPAAPSGGSQESKGDEPEGANTTPAAAATGSVEQSPSPPSSSSRKRADALARLRAAFLAAITHRRRRRQLGSCVTGTIFGRRRGRVHVALQTDPRSAPVLLVEMAAYSTGALVREMSSGLVRLALECEKTPLAAGEKRRGLLEEPTWRAYCNGRKCGFAVRRECGADEWRVLGAVEPVSVGAGVLPDDVAGAGAVEGDLMYMRARFERVVGSRDSEAFYMMNPDGSGGPELSIYLLRV

SEQ ID NO: 8542 - protein, 519 aa, Setaria italica
MEKERKQGFFAALKEEVVRGLSPARSRGKSPAPPRSASPARMLIPRRRKSAAPPQPPPEKVLQQYLGEQLIARSGSLRPGGEALAPLIEGPDAERLAAGDPDAEDSGRREGFGNWVRGHLTRTPSMASAAAGPGGSGASFRRSDLRLLLGVMGAPLAPIPSKLAEPLPLLSIKGTPIESSSAQYILHQYTAASGGYKLLQSVRNAYAMGKVRMVASEFETATRVVKNRGPTGRGAAAVEQGGFVLWQMAPDMWYVELAVGGSKVHAGSNGRLVWRHTPWLGAHAAKGPVRPLRRVLQGLDPLTTAGLFAEARCVGEKKVNGEDCFILKLTADPQTLKLRSEGPAEIIRHVLFGYFSQRTGLIVQIEDSHLTRIQPHAGGDAVYWETTISSALEDYRPVEGVMIAHSGRSAVTLFRFGEAAMSHTKTRMEEAWSIEEVAFNVPGLSVDCFIPPADIRSGSVGEACELPSQSHGERARAGAVHPSRVAAVERAHAHYPHSANAGAAGAGGRGEKVMWRVEV

SEQ ID NO: 8543 - protein, 522 aa, Sorghum bicolor
MEKERKQGFFATLKEEVVRGLSPARSRGKSPAPPRSASPARMLIPRRRKAPAAPPPPPPEKVLQQYLGEQLVSRSGSLRPGGEALAPLIEGPDAERLAAGDPDAEDSGRREGFGHWVRGHLTRTPSMASSAAAGGGGPGGSSGSFRRSDLRLLLGVMGAPLAPMSSKPAEPLPLLSIKGTPIESSSAQYILHQYTAASGGYRLLQSVRNAYAMGKVRMVASEFETATRVVKNRGPSGRGAAAVEQGGFVLWQMAPDMWYVELAVGGSKVHAGSNGRLVWRHTPWLGAHAAKGPVRPLRRVLQGLDPLTTAGLFAEARCVGEKKVNGEDCFILKLTADPQTLKLRSEGPAEIIRHVLFGYFSQRTGLIVHIEDSHLTRIQPHAGGDAVYWETTISSALEDYRAVEGIMIAHSGRSAVTLFRFGEAAMSHTKTRMEEAWSIEEVAFNVPGLSVDCFIPPADIRSGSVGEACELPSQSQSHGERAKTGAVHPSRVAAVERAHAHSANAGAGAAGRGEKIMWRVEV

SEQ ID NO: 8544 - protein, 507 aa, Hordeum vulgare
MDKERKQGFFAALKEEVVRGLSPARSRGKTPARSASPARMLIPRRRKAQPPPPDKQQQQQYLPEQLIPRSGSLRPGGEVLEPLIEGPDADRLAAGDFVGEDSGRREGFGHWVRGHLTRTPSMASASAGPGGSSGSFRHSDLRLLLGVMGAPLAPISSNLADPLPLLSIKGTPIESSSAQYILQQYMAASGGYKMLQSVRNAYAMGKVRMVASEFETATRVVKNRGPSGRGTAAVEQGGFVLWTMAPGMWYVELAVGGSKVHAGCNGRLVWRHTPWLGAHAAKGPVRPLRRVLQGLDPLTTAGLFAEARCVGEKKVNGEDCFILKLSADPQTLKLRSEGPAEIIRHVLFGYFSQRTGLIVHIEDSHLTRIQPHSGGDAVYWETTISSCLEDYRAVEGIVIAHAGRSAVTLFRFGEAAMSHTKTRMEEAWSIEEVAFNVPGLSVDCFIPPADIRSGSVGEACELPPHGDRAKSIAVHPARVAAAAERAHAHGGAGAGGRGEKIVWRVEV

SEQ ID NO: 8545 - protein, 516 aa, Zea mays
MDKERKQGFFAALKEEVVRGLSPSRSRGKSPAPPRSASPARMLIPRRRKAPAAPPPPPPEKVLEQYLGEQLVARSGSLRPGGEALAPLIEGPDAERLAAGDPDAEDSGRREGFGHWVRGHLTRTPSMASSAAGGGGGPGGSSGSFRRSDLRLLLGVMGAPLAPIPSKTAEPLPLLSIKGTPIESSSAQYILHQYTAASGGYKLLQSVRNAYAMGKVRMVASEFETATRVVKNRGPSGRGAAAVEQGGFVLWQMAPDMWYVELAVGGSKVHAGSNGRLVWRHTPWLGAHAAKGPVRPLRRVLQGLDPLTTAGLFAEARCVGEKKVNGEDCFILKLSADPQTLKLRSEGPAEIIRHVLFGYFSQRTGLMVQMEDSHLTRIQPHAGGDAVYWETTISSALEDYRAVEGVMVAHAGRSAVTLFRFGEAAMSHTKTRMEEAWSIEEVAFNVPGLSVDCFIPPADIRSGSVGEACELPSQPHGERARTGAAVHPSRVAAVERAGTAAGAGGRGEKVMWRVQV

SEQ ID NO: 8546 - protein, 522 aa, Brachypodium distachyon
MEKERKQGFFSALKDEVVRGLSPARSRGKTPARSSSPARMLIPRRRKAPPPSEKQMRQEQQQQQYIPEQLIPRSGSLRPGGEALEPLIEGPDADRLAAGDFVGEDSGRRGEGFGQWVRGHLTRTPSMASAGPGGSSGSFRHSDLRLLLGVMGAPLAPISSNLADPLPLLSIKGTPIESSSAQYILQQYMAASGGHRLLQSVRNAYAMGKVRMVASEFETATRVVKNRGPSGRGAAAIEQGGFVLWTMAPGMWYVELAVGGSKVHAGCNGRLVWRHTPWLGAHAAKGPVRPLRRVLQGLDPLTTAGLFAEARCVGEKKVNGEDCFILKLSADPQTLKLRSEGPAEIIRHVLFGYFSQRTGLIVHIEDSHLTRIQPHSGGDAVYWETTISSSLEDYRAVEGIVIAHAGRSAVTLFRFGEAAMSHTKTRMEEAWSIEEVAFNVPGLSPDCFIPPADIRSGSVGEACELPPTHGGGDRAANKGGAVHPARVAAVERSSHGHNGAVGVNVGAAAGGRGEKIVWRVQV

SEQ ID NO: 8547 - protein, 505 aa, Zea mays
MEKERKQGFFAALKEEVVRGLSPARTRGKSPAPRSASPARMLIPRRRKAPAAPPPPPPPPEKVLQQYLGEQLVARSGSLLRPGGEALAPLIEGPDAERLAAGDPDEEDSGHREGFGHWVRGHLTRAPSMAAAGGPDGSFRRSDLRLLLGVMGAPLAPIPSKPAEPLPLLSIKGTTIESSSAQYILHQYTAASGGYKLLQSVRNAYAMGKVRMVASEFETATRVVKNRGPSGRGAAAVEQGGFVLWQMARDMWYVELAVGGSKVHAGSNGRLVWRHTPWLGAHAAKGPVRPLRRVLQGLDPLTTAGLFAEARCVGEKKVNGEECFILKLAADPRTLKLRSEGPAEIIRHVLFGYFSQRTGLMVHIEDSHLTRIQPHAGGDAVYWETTTSSALEDYRAVEGVMVAHSGRSAVTLFRFGEAAMSHTKTRMEEAWSIEEVAFNVPGLSADCFIPPADIQSGPVGEACELPSSQSRAKAVAVHPSRVAAVDRATAAAACRGRKTTWRVEV

SEQ ID NO: 8548 - protein, 257 aa, Saccharum officinarum
MAPKRGGKAPVPAKKKAVVTNPLFEKRPKQFGIGGALPPKKDLHRFVKWPKVVRIQRQRRILKQRLKVPPALNQFTRTLDKNLATNLFKMLLKYRPEDKAAKKERLLKRAQAENEGKTVEAKKPIVVKYGLNHVTYLIEQSKAQLVVIAHDVDPIELVVWLPALCRKMEVPYCIVKGKARLGSIVHKKTASVLCLTTVKNEDKLEFSKILEAIKANFNDKFDEVRKKWGGGIMGSKSQAKTKAREKLLAKEAAQRMT

SEQ ID NO: 8549 - protein, 89 aa, Setaria italica
MAPKRGGKAPVPAKKKTVCGNEPSVREEAEAVRYWRCASAQEGPAPVRQVAQGCAHPAPAPHPQAAPQGAAGAQPVHPDSRQEPRYQPV

SEQ ID NO: 8550 - protein, 257 aa, Setaria italica
MAPKRGGKAPVPAKKKTVVTNPLFEKRPKQFGIGGALPPKKDLHRFVKWPKVVRIQRQRRILKQRLKVPPALNQFTRTLDKNLATNLFKMLLKYRPEDKAAKKERLLKRAQAETEGKTVEAKKPIVVKYGLNHVTYLIEQSKAQLVVIAHDVDPIELVVWLPALCRKMEVPYCIVKGKARLGSIVHKKTASVLCLTTVKNEDKLEFSKILEAIKANFNDKFDEVRKKWGGGIMGSKSQAKTKAREKLLAKEAAQRMT

SEQ ID NO: 8551 - protein, 257 aa, Pennisetum glaucum
MAPKRGGKAPVPAKKKQVVTNPLFEKRPKQFGIGGALPPKKDLHRFVKWPKVVRIQRQRRILKQRLKVPPALNQFTRTLDKNLATNLFKMLLKYRPEDKAAKKERLLKRAQAEAEGKTVEAKKPIVVKYGLNHVTYLIEQNKAQLVVIAHDVDPIELVVWLPALCRKMEVPYCIVKGKARLGSIVHKKTASVLCLTTVKNEDKLEFSKILEAIKANFNDKFDEVRKKWGGGIMGSKSQAKTKAREKLLAKEAAQRMT

SEQ ID NO: 8552 - protein, 257 aa, Panicum virgatum
MAPKRGGKAPVPAKKKTVVTNPLFEKRPKQFGIGGALPPKKDLHRFVKWPKVVRIQRQRRILKQRLKVPPALNQFTRTLDKNLATNLFKMLLKYRPEDKAAKKERLLKRAQAENEGKTVEAKKPIVVKYGLNHVTYLIEQSKAQLVVIAHDVDPIELVVWLPALCRKMEVPYCIVKGKARLGSIVHKKTASVLCLTTVKNEDKLEFSKILEAIKANFNDKFDEVRKKWGGGIMGSKSQAKTKAREKLLAKEAAQRMT

SEQ ID NO: 8553 - protein, 257 aa, Zea mays
MAPKRGGRAPVPAKKKAVVTNPLFEKRPKQFGIGGALPPKKDLHRFVKWPKVVRIQRQRRILKQRLKVPPALNQFTRTLDKNLATNLFKMLLKYRPEDKAAKKERLLKRAQAENEGKTVESKKPIVVKYGLNHVTYLIEQSKAQLVVIAHDVDPIELVVWLPALCRKMEVPYCIVKGKARLGSIVHKKTASVLCLTTVKNEDKLEFSKILEAIKANFNDKFDEVRKKWGGGIMGSKSQAKTKAREKLLAKEAAQRMT

SEQ ID NO: 8554 - protein, 257 aa, Pennisetum glaucum
MAPKRGGKAPVPAKKKPVVTNPLFEKRPKQFGIGGALPPKKDLHRFVKWPKVVRIQRQRRILKQRLKVPPALNQFTRTLDKNLATNLFKMLLKYRPEDKAAKKERLLKRAQAETEGKTVEAKKPIVVKYGLNHVTYLIEQSKAQLVVIAHDVDPIELVVWLPALCRKMEVPYCIVKGKARLGSIVHKKTASVLCLTTVKNEDKLEFSKILEAIKANFNDKFDEVRKKWGGGVMGSKSQAKTKAREKLLAKEAAQRMT

SEQ ID NO: 8555 - protein, 258 aa, Oryza sativa
MAPKRGGRAPVPAKKKTEKVTNPLFEKRPKQFGIGGALPPKKDLHRFVKWPKVVRIQRQRRILKQRLKVPPALNQFTRTLDKNLATNLFKMLLKYRPEDKAAKKERLLKRAQAEAEGKTVEAKKPIVVKYGLNHVTYLIEQSKAQLVVIAHDVDPIELVVWLPALCRKMEVPYCIVKGKARLGSIVHKKTASVLCLTTVKNEDKLEFSKILEAIKANFNDKFDEVRKKWGGGVMGSKSQAKTKAREKLLAKEAAQRMT

SEQ ID NO: 8556 - protein, 258 aa, Saccharum officinarum
MAPKRGGRAPVPAKKKTDKVVNPLFEKRPKQFGIGGALPPKKDLHRFVKWPKVVRIQRQRRILKQRLKVPPALNQFTRTLDKNLATNLFKMLLKYRPEDKAAKKERLLKRAQAENEGKTVEAKKPIVVKYGLNHVTYLIEQNKAQLVVIAHDVDPIELVVWLPALCRKMEVPYCIVKGKARLGSIVHKKTASVLCLTTVKNEDKLEFSKILEAIKANFNDKFDEVRKKWGGGIMGSKSQAKTKAREKLLAKEAAQRMT

SEQ ID NO: 8557 - protein, 258 aa, Panicum virgatum
MAPKRGGKAPVPAKKKTEKVTNPLFEKRPKQFGIGGALPPKKDLHRFVKWPKVVRIQRQRRILKQRLKVPPALNQFTRTLDKNLATNLFKMLLKYRPEDKAAKKERLLKRAQAENEGKTVEAKKPIVVKYGLNHVTYLIEQNKAQLVVIAHDVDPIELVVWLPALCRKMEVPYCIVKGKARLGSIVHKKTASVLCLTTVKNEDKLEFSKILEAIKANFNDKFDEVRKKWGGGIMGSKSQAKTKAREKLLAKEAAQRMT

SEQ ID NO: 8558 - protein, 258 aa, Panicum virgatum
MAPKRGGKAPVPAKKKTEKITNPLFEKRPKQFGIGGALPPKKDLHRFVKWPKVVRIQRQRRILKQRLKVPPALNQFTRTLDKNLATNLFKMLLKYRPEDKAAKKERLLKRAQAENEGKTVEAKKPIVVKYGLNHVTYLIEQNKAQLVVIAHDVDPIELVVWLPALCRKMEVPYCIVKGKARLGSIVHKKTASVLCLTTVKNEDKLEFSKILEAIKANFNDKFDEVRKKWGGGIMGSKSQAKTKAREKLLAKEAAQRMT

SEQ ID NO: 8559 - protein, 259 aa, Unknown
  Sequence found in Organisms: Hordeum vulgare, Leymus cinereus x Leymus triticoides
MAPKRGGKAPVPAKKKAADKVVNPLFEKRPKQFGIGGALPPKKDLHRFVKWPKVVRIQRQRRILKQRLKVPPALHQFTRTLDKNLATNLFKMLLKYRPEDKAAKKERLLKRAQAEAEGKTVEAKKPIVVKYGLNHVTYLIEQSKAQLVVIAHDVDPIELVVWLPALCRKMEVPYCIVKGKSRLGSIVHKKTASVLCLTTVKNEDKLEFSKILEAIKANFNDKFDEVRKKWGGGVMGSKSQAKTKARERLIAKEAAQRMN

SEQ ID NO: 8560 - protein, 257 aa, Cenchrus ciliaris
MAPKRGGKAPVPAKKKPTVTNPLFEKRPKQFGIGGALPPKKDLHRFVKWPKVVRIQRQRRILKQRLKVPPALNQFTRTLDKNLATNLFKMLLKYRPEDKAAKKERLLKRAQAEAEGKTVEAKKPIVVKYGLNHVTYLIEQNKAQLVVIAHDVDPIELVVWLPALCRKMEVPYCIVKGKARLGSIVHKKTASVLCLTTVKNEDKLEFSKVLEAIKANFNDKFDEVRKKWGGGVMGSKSQAKTKAREKLLAKEAAQRMT

SEQ ID NO: 8561 - protein, 257 aa, Cenchrus ciliaris
  misc_feature (77)..(77): Xaa can be any naturally occurring amino acid
  misc_feature (105)..(105): Xaa can be any naturally occurring amino acid
MAPKRGGKAPVPAKKKPVVTNPLFEKRPKQFGIGGALPPKKDLHRFVKWPKVVRIQRQRRILKQRLKVPPALNQFTXTLDKNLATNLFKMLLKYRPEDKAAKKEXLLKRAQAENEGKTVEAKKPIVVKYGLNHVTYLIEQSKAQLVVIAHDVDPIELVVWLPALCRKMEVPYCIVKGKARLGSIVHKKTASVLCLTTVKNEDKLEFSKILEAIKANFNDKFDEVRKKWGGGIMGSKSQAKTKAREKLLAKEAAQRMT

SEQ ID NO: 8562 - protein, 258 aa, Setaria italica
MAPKRGGKAPVPAKKKPEKVTNPLFEKRPKQFGIGGALPPKKDLHRFVKWPKVVRIQRQRRILKQRLKVPPALNQFTRTLDKNLATNLFKMLLKYRPEDKAAKKERLLKRAQAEAEGKTVEAKKPIVVKYGLNHVTYLIEQNKAQLVVIAHDVDPIELVVWLPALCRKMEVPYCIVKGKARLGSIVHKKTASVLCLTTVKNEDKLEFSKVLEAIKANFNDKFDEVRKKWGGGVMGSKSQAKTKAREKLLAKEAAQRMT

SEQ ID NO: 8563 - protein, 258 aa, Sorghum bicolor
MAPKRGGRAPVPAKKKTDKVVNPLFEKRPKQFGIGGALPPKKDLHRFVKWPKVVRIQRQRRILKQRLKVPPALNQFTRTLDKNLATNLFKMLLKYRPEDKAAKKERLLKRAQAETEGKTVEAKKPIVVKYGLNHVTYLIEQNKAQLVVIAHDVDPIELVVWLPALCRKMEVPYCIVKGKARLGSIVHKKTASVLCLTTVKNEDKLEFSKILEAIKANFNDKFDEVRKKWGGGIMGSKSQAKTKAREKLIAKEAAQRMT

SEQ ID NO: 8564 - protein, 72 aa, Panicum virgatum
MAPKRGGKAPVPAKKKTEKVTNPLFEKRPKQFGIGGALPPKKDLHRFVKWPRSCASSASAVSSSSASRCRRR

SEQ ID NO: 8565 - protein, 259 aa, Unknown
  Sequence found in Organisms: Hordeum vulgare, Secale cereale, Triticum aestivum
MAPKRGGKAPVPAKKKAADKVVNPLFEKRPKQFGIGGALPPKKDLHRFVKWPKVVRIQRQRRILKQRLKVPPALHQFTRTLDKNLATNLFKMLLKYRPEDKVAKKERLLKRAQAEAEGKTVEAKKPIVVKYGLNHVTYLIEQSKAQLVVIAHDVDPIELVVWLPALCRKMEVPYCIVKGKSRLGSIVHKKTASVLCLTTVKNEDKLEFSKILEAIKANFNDKFDEVRKKWGGGVMGSKSQAKTKARERLIAKEAAQRMN

SEQ ID NO: 8566 - protein, 258 aa, Zea mays
MAPKRGGRAPVPAKKKTDKVTNPLFEKRPKQFGIGGALPPKKDLHRFVKWPKVVRIQRQRRILKQRLKVPPALNQFTRTLDKNLATNLFKMLLKYRPEDKAAKKERLLKRAQAENEGKTVESKKPIVVKYGLNHVTYLIEQNKAQLVVIAHDVDPIELVVWLPALCRKMEVPYCIVKGKARLGSIVHKKTASVLCLTTVKNEDKLEFSKILEAIKANFNDKFDEVRKKWGGGIMGSKSQAKTKAREKLLAKEAAQRMT

SEQ ID NO: 8567 - protein, 258 aa, Zea mays
MAPKRGGRAPVPAKKKTDKVTNPLFEKRPKQFGIGGALPPKKDLHRFVKWPKVVRIQRQRRILKQRLKVPPALNQFTRTLDKNLATNLFKMLLKYRPEDKAAKKERLLKRAQAENEGKTVESKKPIVVKYGLNHVTYLIEQNKAQLVVIAHDVDPIELVVWLPALCRKMEVPYCIVKGKARLGSIVHKKNASVLCLTTVKNEDKLEFSKILEAIKANFNDKFDEVRKKWGGGIMGSKSQAKTKAREKLLAKEAAQRMT

SEQ ID NO: 8568 - protein, 168 aa, Secale cereale
MLLKYRPEDKVAKKERLLKRAQAEAEGKTVEAKKPIVVKYGLNHVTYLIEQSKAQLVVIAHDVDPIELVVWLPALCRKMEVPYCIVKGKSRLGSIVHKKTASVLCLTTVKNEDKLEFSKILEAIKANFNDKFDEVRKKWGGGVMGSKSQAKTKARERLIAKEAAQRMN

SEQ ID NO: 8569 - protein, 257 aa, Secale cereale
PKRGGKAPVPAKKKAADKVVNPLFEKRPKQFGIGGALPPKKDLHRFVKWPKVVRIQRQRRILKQRLKVPPALHQFTRTLDKNLATNLFKMLLKYRPEDKVAKKERLLKRAQAEAEGKTVEAKKPIVVKYGLNHVTYLIEQSKAQLVVIAHDVDPIELVVWLPALCRKMEVPYCIVKGKSRLGSIVHKKTASVLCLTTVKNEDKLEFSKILEAIKANFNDKFDEVRKKWGGGVMGSKSQAKTKARERLIAKEAAQRMN

SEQ ID NO: 8570 - protein, 258 aa, Festuca arundinacea
  misc_feature (222)..(222): Xaa can be any naturally occurring amino acid
MAPKRGGKAPVPAKKKPAQVTNPLFEKRPKQFGIGGALPPKKDLHRFVKWPKVVRIQRQRRILKQRLKVPPALHQFTRTLDKNLATNLFKMLLKYRPEDKAAKKERLLKRAQAEAEGKTVEAKKPIVVKYGLNHVTYLIEQSKAQLVVIAHDVDPIELVVWLPALCRKMEVPYCIVKGKSRLGSIVHKKTASVLCLTTVKNEDKLEFSKILEAIKANFNDKXDEVRKKWGGGVMGSKSQAKTKARERLIAKEAAQRLT

SEQ ID NO: 8571 - protein, 258 aa, Unknown
  Sequence found in Organisms: Leymus cinereus x Leymus triticoides, Pseudoroegneria spicata
MAPKRGGKAPVPAKKKTEKVTNPLFEKRPKQFGIGGALPPKKDLHRFVKWPKVVRIQRQRRILKQRLKVPPALHQFTRTLDKNLATNLFKMLLKYRPEDKAAKKERLLKRAQAEAEGKTVEAKKPIVVKYGLNHVTYLIEQSKAQLVVIAHDVDPIELVVWLPALCRKMEVPYCIVKGKSRLGSIVHKKTASVLCLTTVKNEDKLEFSKILEAIKANFNDKFDEVRKKWGGGVMGSKSQAKTKARERLIAKEAAQRMN

SEQ ID NO: 8572 - protein, 258 aa, Triticum aestivum
MAPKRGGKAPVPAKKKTDKVTNPLFEKRPKQFGIGGALPPKKDLHRFVKWPKVVRIQRQRRILKQRLKVPPALHQFTRTLDKNLATNLFKMLLKYRPEDKAAKKERLLKRAQAEAEGKTVEAKKPIVVKYGLNHVTYLIEQSKAQLVVIAHDVDPIELVVWLPALCRKMEVPYCIVKGKSRLGSIVHKKTASVLCLTTVKNEDKLEFSKILEAIKANFNDKFDEVRKKWGGGVMGSKSQAKTKARERLIAKEAAQRMN

SEQ ID NO: 8573 - protein, 258 aa, Unknown
  Sequence found in Organisms: Hordeum vulgare, Secale cereale, Triticum aestivum
MAPKRGGKAPVPAKKKTEKVTNPLFEKRPKQFGIGGALPPKKDLHRFVKWPKVVRIQRQRRILKQRLKVPPALHQFTRTLDKNLATNLFKMLLKYRPEDKVAKKERLLKRAQAEAEGKTVEAKKPIVVKYGLNHVTYLIEQSKAQLVVIAHDVDPIELVVWLPALCRKMEVPYCIVKGKSRLGSIVHKKTASVLCLTTVKNEDKLEFSKILEAIKANFNDKFDEVRKKWGGGVMGSKSQAKTKARERLIAKEAAQRMN

SEQ ID NO: 8574 - protein, 258 aa, Avena sativa
MAPKRGGKAPVPAKKKTAQVTNPLFEKRPKQFGIGGALPPKKDLHRFVKWPKVVRIQRQRRILKQRLKVPPALHQFTRTLDKNLATNLFKMLLKYRPEDKVAKKERLLKRAQAEAEGKTVEAKKPIVVKYGLNHVTYLIEQSKAQLVVIAHDVDPIELVVWLPALCRKMEVPYCIVKGKSRLGSIVHKKTSSVLCLTTVKNEDKLEFSKILEAIKANFNDKFDEVRKKWGGGVMGSKSQAKTKARERLIAKEAAQRLT

SEQ ID NO: 8575 - protein, 258 aa, Avena sativa
MAPKRGGKAPVPAKKKTVQVTNPLFEKRPKQFGIGGALPPKKDLHRFVKWPKVVRIQRQRRILKQRLKVPPALHQFTRTLDKNLATNLFKMLLKYRPEDKAAKKERLLKRAQAEAEGKTVEAKKPIVVKYGLNHVTYLIEQSKAQLVVIAHDVDPIELVVWLPALCRKMEVPYCIVKGKSRLGSIVHKKTASVLCLTTVKNEDKLEFSKVLEAIKANFNDKFDEVRKKWGGGVMGSKSQAKTKARERLIAKEAAQRLT

SEQ ID NO: 8576 - protein, 258 aa, Musa acuminata
MAPKRGGKAAVPAKKKPEKVVNPLFEKRPKQFGIGGALPPKKDLHRFVKWPKVVRIQRQKRILKQRLKVPPALNQFTRTLDKNLATNLFKMLLKYRPEDRAAKKERLLKRAQAEAEGKTVEVKKPIVVKYGLNHVTYLIEQNKAQLVVIAHDVDPIELVVWLPALCRKMEIPYCIVKGKARLGAIVHKKTASVLCLTTVKNEDKLEFSKILEAIKANFNDKFDEIRRKWGGGIMGSKSQAKAKAREKLLAKEAAQRMS

SEQ ID NO: 8577 - protein, 258 aa, Musa acuminata
MAPKRGVKVPVPGKKKPEKVVNPLFEKRPKQFGIGGALPPKKDLHRFVKWPKVVRIQRQRRILKQRLKVPPALNQFTRTLDKNLATNLFKMLLKYRPEDRAAKKERLLKRAQAEAEGKTVEVKKPIVVKYGLNHVTYLIEQNKAQLVVIAHDVDPIELVVWLPALCRKMEIPYCIVKGKARLGAIVHKKTASVLCLTTVKNEDKLEFSKILEAIKANFNDKFDEVRRKWGGGIMGTKSQAKSKAREKLLAKEAAQRLT

SEQ ID NO: 8578 - protein, 258 aa, Elaeis guineensis
MAPKRGGKAAVPAKKKPEKVANPLFEKRPKQFGIGGALPPKKDLHRFVRWPKVVRIQRQRRILKQRLKVPPALNQFTRTLDKNLASSLFKMLLKYRPEDRAAKKERLLKRAQAEAEGRTVEVKKPIVVKYGLNHVTYLIEQKKAQLVVIAHDVDPIELVVWLPALCRKMEIPYCIVKGKARLGAIVHKKTATVLCLTTVKNEDKLEFSKILEAIKANFNDKFDEIRKKWGGGIMGSKSQAKMKAREKLLAKEAAQRMS

SEQ ID NO: 8579 - protein, 258 aa, Brachypodium distachyon
MAPKRGGRAPVPAKKKAEKVTNPLFEKRPKQFGIGGALPPKKDLHRFVKWPKVVRIQRQRRILKQRLKVPPALHQFTRTLDKNLATNLFKMLLKYRPEDKAAKKERLLKRAQAETEGKTVEAKKPIVVKYGLNHVTYLIEQGKAQLVVIAHDVDPIELVVWLPALCRKMEVPYCIVKGKSRLGSIVHKKTSSVLCLTTVKNEDKLDFSKILEAIKANFNDKFDEVRKKWGGGVMGSKSQAKTKARERLIAKEAAQRMT

SEQ ID NO: 8580 - protein, 258 aa, Musa acuminata
MAPKRSGKAPVPAKKKPEKVVNPLFEKRPKQFGIGGALPPKRDLHRFVKWPKVVRIQRQRRILKQRLKVPPALNQFTRTLDKNLATNLFKMLLKYRPEDRAAKKERLLKRAQAEAEGKTIELKKPIVVKYGLNHVTYLIEQNKAQLVVIAHDVDPIELVVWLPALCRKMEIPYCIVKGKARLGAIVHKKTASVLCLTTMKNEDKLEFSKILEAIKANFNDKFDEVRRKWGGGIMGSKSLAKSKAREKVLAKEAAQRMT

SEQ ID NO: 8581 - protein, 253 aa, Secale cereale
GKAPVPAKKKAADKVVNPLFEKRPKQFGIGGALPPKKDLHRFVKWPKVVRIQRQRRILKQRLKVPPALHQFTRTLDKNLATNLFKMLLKYRPEDKVAKKERLLKRAQAEAEGKTVEAKKPIVVKYGLNHVTYLIEQSKAQLVVIAHDVDPIELVVWLPALCRKMEVPYCIVKGKSRLGSIVHKKTASVLCLTTVKNEDKLEFSKILEAIKANFNDKFDEVRKKWGGGVMGSKSQAKTKARERLIAKEAAQRMN

SEQ ID NO: 8582 - protein, 258 aa, Amorphophallus konjac
MAPKRGGKAPLPVKKKPEKVVNPLFEKRPKQFGIGGALPPKRDLHRFVKWPKVVRIQRQRRILKQRLKVPPALNQFTRTLDKNLATNLFKMLLKYRPEDKAAKKERLLKRAQAETEGKTIEVKKPIVVKYGLNHVTYLIEQNKAQLVVIAHDVDPIELVVWLPALCRKMEIPYCIVKGKARLGSIVHKKTASVLCLTSVKNEDKLEFSKILEAIKANFNDKFDEIRKKWGGGIMGSKSQAKTRAKEKLLAKEAAQRMS

SEQ ID NO: 8583 - protein, 258 aa, Elaeis guineensis
MAPKRGGKAAVPAKKKPEKVVNPLFEKRPKQFGIGGALPPKKDLHRFVKWPKVVRIQRQRRILKQRLKVPPALNQFTRTLDKNLASSLFKMLLKYRPEDRAAKKERLLKRAQAEAEGKPVEVKKPIVVKYGLNHVTYLIEQNKAQLVVIAHDVDPVELVVWLPALCRKMEIPYCIVKGKARLGAIVHKKTAAVLCLTTVKNEDKLEFSKILEAIKANFNDKFDEVRRKWGGGIMGTKSQAKTKAREKLLAKEAAQRMS

SEQ ID NO: 8584 - protein, 251 aa, Secale cereale
APVPAKKKAADKVVNPLFEKRPKQFGIGGALPPKKDLHRFVKWPKVVRIQRQRRILKQRLKVPPALHQFTRTLDKNLATNLFKMLLKYRPEDKVAKKERLLKRAQAEAEGKTVEAKKPIVVKYGLNHVTYLIEQSKAQLVVIAHDVDPIELVVWLPALCRKMEVPYCIVKGKSRLGSIVHKKTASVLCLTTVKNEDKLEFSKILEAIKANFNDKFDEVRKKWGGGVMGSKSQAKTKARERLIAKEAAQRMN

SEQ ID NO: 8585 - protein, 259 aa, Platanus occidentalis
MAPKRGGKAPAAPAKKKPEKVVNPLFEKRPKQFGIGGALPPKRDLHRFVKWPKVVRIQRQRRILKQRLKVPPALNQFTKTLDKNLATNLFKMLLKYRPEDKAAKKERLLKRAQAEAEGKTVEVKKPIVVKYGLNHVTYLIEQNKAQLVVIAHDVDPIELVVWLPALCRKMEIPYCIVKGKARLGAIVHKKTAAVLCLTTVKNEDKLEFSRILEAIKANFNDKYDEYRKKWGGGIMGSKSQAKTKAKERLLAKEAAQRMT

SEQ ID NO: 8586 - protein, 258 aa, Amborella trichopoda
MAPKRGGKAPVPAKKKAEKVVNPLFEKRPKQFGIGGALPPKRDLHRFVKWPKVVRIQRQRRILKQRLKVPPALNQFTKTLDKNLATNLFKMLLKYRPEDKAAKKERLLKRAQAEAEGKTVESKKPIVVKYGLNHVTYLIEQNKAQLVIIAHDVDPIELVVWLPALCRKMEIPYAIVKGKARLGTIVHKKTASTLCLTSVKNEDKLEFSKIVEAIKANFNDKYDEYRKKWGGGIMGSKSLAKTKARERLLAKEAAQRMT

SEQ ID NO: 8587 - protein, 258 aa, Musa acuminata
MGPKRGGKAPVPAKKKPEKVVNPLFEKRPKQFGIGGALPPKRDLHRFVKWPKVVRIQRQRRILKQRLKVPPALHQFTRTLDKNLATNLFKMLLKYRPEDRAAKKERLLKRAQAEAEGKTVEVKKPIVVKYGLNHVTYLIEQNKAQLVVIAHDVDPIELVVWLPALCRKMEIPYCIVKGKARLGAVVHKKTASVLCLTTVKNEDKLEFSKILEAIKANFNDKFDEIRRKWGGGVMGSKSQAKSKSREKLLAKEAAQRMS

SEQ ID NO: 8588 - protein, 258 aa, Elaeis guineensis
MAPKRGVKAAVPAKKKPEKVVNPLFEKRPKQFGIGGALPPKKDLHRFVKWPKVVRIQRQRRILKQRLKVPPALNQFTRTLDKNLASSLFKMLLKYRPEDRAAKKERLLKRAQAEAEGKPVEVKRPIVVKYGLNHVTYLIEQNKAQLVVIAHDVDPVELVVWLPALCRKMEIPYCIVKGKARLGAIVHKKTAAVLCLTTVKNEDKLEFSKILEAIKANFNDKFDEVRRKWGGGIMGSKSQAKAKAREKLLAKEAAQRMS

SEQ ID NO: 8589 - protein, 258 aa, Phalaenopsis aphrodite
MAPKRGGKAPVAGKKKTEKVVNPLFEKRPKQFGIGGALPPKRDLHRFVKWPKVVRIQRQRRILKQRLKVPPAINQFTRTLDKNLATNLFKMLLKYRPEDKAAKKERLLKRAQAETEGKTIESKKPIVVKYGLNHVTYLIEQNKAQLVVIAHDVDPIELVVWLPALCRKMEIPYCIVKGKARLGTIVHKKTAAVLCLTTVKNEDKLEFSKILEAIKANFNDKFDEIRKKWGGGIMGSKSQAKSKAKEKLMAKEAAQRMS

SEQ ID NO: 8590 - protein, 214 aa, Musa acuminata
MAPKRSAKAPVPAKKKPEKVVNPLFEKRPKQFGIGGALPPKRDLHRFVKWPKVVRIQRQRRILKQRLKVPPALNQFTRTLDKNLATNLFKMLLKYRPEDRAAKKERLLKRAQAEAEGKTVELKKPIVVKYGLNHVTYLIEQNKAQLVVIAHDVDPIELVVWLPALCRKMEIPYCIVKGKARLGAIVHKKTASVFVSDHCEERGQTRIQQNPGSD

SEQ ID NO: 8591 - protein, 258 aa, Liriodendron tulipifera
MAPKRGGKAPVPAKKKPEKVVNPLFEKRPKQFGIGGALPPKRDLHRFVKWPKVVRIQRQRRILKQRLKVPPALNQFTKTLDKNLATSLFKMLLKYRPEDKAAKKERLLKRAQAEAEGKTAEVKKPIVVKYGLNHVTYLIEQNKAQLVVIAHDVDPIELVVWLPALCRKMEIPYCIVKGKARLGAIVHMKTAAALCLTTVKNEDKLEFSKILEAIKANFNDKYDEYRKKWGGGIMGSKSQAKTKAKERLLAKEAAQRMN

SEQ ID NO: 8592 - protein, 254 aa, Amorphophallus konjac
ERSQGARASEEEAGEGGEPFVREAPETVRDRWGFASEKGPAPVREMAEGGPHPEAEEDSEAAAEGSPGLNQFTRTLDKNLATTLFKMLLKYRPEDKAAKKERLLKRALAESEGKTVEVKKPIVVKYGLNHVTYLIEQNKAQLVVIAHDVDPIELVVWLPALCRKMEIPYCIVKGKARLGTIVHKKTASVLCLTSVKNEDKLEFSKILEAIKANFNDKFDEIRKKWGGGIMGSKSQAKTKAKEKLLAKEAAQRMS

SEQ ID NO: 8593 - protein, 261 aa, Musa acuminata
FVFQAPKKGGKAPVPAKKKPEKVVNPLFEKRPKQFGIGGALPPKRDLHRFVKWPKVVRIQRQKRILKQRLKVPPALNQFTRTLDKNLATNLFKMLLKYRPEDRAAKKERLLKRAQAEAEGKTVEVKKPIVVKYGLNHVTYLIEQNKAQLVVIAHDVDPIELVVWLPALCRKMEIPYCIVKGKARLGAIVHKKTASVLCLTTVKNEDKLEFSKILEAIKANFNDKFDEIRRKWGGGIMGSKSLAKSKAKEKLLAKEAAQRLT

SEQ ID NO: 8594 - protein, 261 aa, Unknown
  Sequence found in Organisms: Castanea mollissima, Quercus alba
MAPKRGGKAPVPAAASKKKTEKVLNPLFEKRPKQFGIGGALPPKRDLTRFVKWPKTVQLQRKKRILKQRLKVPPALNQFTKTLDKNLATNLFKMLLKYRPEDKAAKRERLLKRAQAESEGKTVEAKKPIVVKYGLNHVTYLIEQNKAQLVVIAHDVDPIELVVWLPALCRKMEIPYCIVKGKARLGSIVHKKTASVLCLTTVKNEDKLEFSKILEAIKANFNDKYDEYRKKWGGGIMGSKSQAKTKAKERLLAKEAAQRMT

SEQ ID NO: 8595 - protein, 257 aa, Persea americana
MAPKRGGKAPVPAKKKPEKVVNPLFEKRPKQFGIGGALPPKRDLHRFVKWPKVVRIQRQRRILKQRLKVPPALNQFTKTLDKNLATNLFKMLLKYRPEDRAAKKERLLKRAQAEAEGKAVEVKKPIVVKYGLNHITYLIEQNKAQLVVIAHDVDPIELVVWLPALCRKMEIPYCIVKGKARLGAIVHKKTAAVLCLTTVKNEDKLEFSKILEAIKANFNDKYEEYRKKWGGGIMGSKSQAKTRAKEKVLSKEAAQRM

SEQ ID NO: 8596 - protein, 258 aa, Nuphar advena
MAPKRGGKAPVPAKKKAEKVVNPLFEKRPKQFGIGGALPPKRDLHRFVKWPKVVRIQRQRRILKQRLKVPPALNQFTKTLDKNVATNLFKMLLKYRPEDKAAKKERLLKRAQAEAEGKPVEVKKPIVVKYGINHVTYLIEQNKAQLVVIAHDVDPIELVVWLPALCRKMEIPYCIVKGKARLGAIVHKKTATALCLTSVKNEDKLEFSKIIEAVKANFNDKYDEHRKKWGGGIMGSKSLAKTKAKEKLLAKEAAQRMS

SEQ ID NO: 8597 - protein, 259 aa, Unknown
  Sequence found in Organisms: Citrus clementina, Citrus sinensis
MAPKRGGKVAAAPAKKKPEKVVNPLFEKRPKQFGIGGALPPKKDLHRYVKWPKAIRIQRQRRILRQRLKVPPALNQFTKTLDKNLASSLFKLLLKYRPEDRAAKKERLLKRAQAEAEGKTVEAKKPIVVKYGLNHVTYLIEQNKAQLVVIAHDVDPIELVVWLPALCRKMEIPYCIVKGKSRLGSIVHKKTASVLCLTTVKNEDKMEFSKILEAIKANFNDKYEELRKKWGGGIMGSKSQAKTKAKEKLLAKEAAQRLT

SEQ ID NO: 8598 - protein, 258 aa, Prunus mume
MAPKRGVKAPVAAKKKTEKVVNPLFEKRPKQFGIGGALPPKRDLTRFVKWPKVVQVQRKKRILKQRLKVPPALNQFTKTLDKNLATSLFKMLLKYRPEDKAAKKERLLKRAQAESEGKTVEAKKPIVVKYGLNHVTYLIEQNKAQLVVIAHDVDPIELVVWLPALCRKMEIPYCIVKGKARLGSIVHKKTASVLCLTTVKNEDKLEFSKVLEAIKANFNDKYDEYRKKWGGGIMGSKSQAKTRAKERLLAKEAAQRMN

SEQ ID NO: 8599 - protein, 258 aa, Zostera marina
MAPKRGVKPSAPAKKKVEKVVNPLFEKRPKQFGIGGALPPKRDLHRFVRWPQVVRIQRQRRILKQRLKVPPALNQFTRTLDKNLATNLFKMLLKYRPEDKAAKKERLLSRAQAEAEGKTVELKKPIVVKYGLNHVTYLIEQKKAQLVVIAHDVDPIELVVWLPALCRKLEIPYCIVKGKSRLGAVVHQKTSAVLCLTTVKNEDKLEFSKILEAIKANFNDKFDEVRKKWGGGIMGSKSQAKTKAKERLIAKEAAQRMN

SEQ ID NO: 8600 - protein, 245 aa, Secale cereale
KKAADKVVNPLFEKRPKQFGIGGALPPKKDLHRFVKWPKVVRIQRQRRILKQRLKVPPALHQFTRTLDKNLATNLFKMLLKYRPEDKVAKKERLLKRAQAEAEGKTVEAKKPIVVKYGLNHVTYLIEQSKAQLVVIAHDVDPIELVVWLPALCRKMEVPYCIVKGKSRLGSIVHKKTASVLCLTTVKNEDKLEFSKILEAIKANFNDKFDEVRKKWGGGVMGSKSQAKTKARERLIAKEAAQRMN

SEQ ID NO: 8601 - protein, 258 aa, Phalaenopsis aphrodite
MAPKRAGKAPAAVKKKTEKVVNPLFEKRPKQFGIGGALPPKRDLHRFVKWPKVVRIQRQRRILKQRLKVPPAINQFTRTLDKNLATNLFKMLLKYRPEDSAAKKERLLKRAQAETEGKVVESKKPIVVKYGLNHVTYLIEQNKAQLVVIAHDVDPIELVVWLPALCRKMEIPYCIVKGKARLGAIVHKKTAAVLCLTTVKNEDKLEFSKILEAIKANFNDKFDEIRKKWGGGIMGSKSQAKSKAKEKLMAKEAAQRMS

SEQ ID NO: 8602 - protein, 258 aa, Eschscholzia californica
MAPKRGVKAPVPAKKKTDKVVNPLFEKRPKQFGIGGALPPKKDLHRFVKWPKVVRIQRQRRILKQRLKVPPALNQFTKTLDKNLATNLFKMLLKYRPEDKAAKKERLLKRAQAESEGKTVESKKPIVVKYGLNHITYLIEQNKAQLVVIAHDVDPIELVVWLPALCRKMEIPYAIVKGKARLGAIVHKKTASALCLTSVKNEDKMEFSKVVEAIKANFNDKFDEHRKKWGGGIMGSKSQAKTKAKDRVLAKEAAQRLT

SEQ ID NO: 8603 - protein, 258 aa, Eschscholzia californica
MAPKRGVKAPVPAKKKTDKVVNPLFEKRPKQFGIGGALPPKKDLHRFVKWPKVVRIQRQRRILKQRLKVPPALNQFTKTLDKNLATNLFKMLLKYRPEDKAAKKERLLKRAQAESEGKTVESKKPIVVKYGLNHITYLIEQNKAQLVVIAHDVDPIELVVWLPALCRKMEIPYAIVKGKARLGAIVHKKTASALCLTSVKNEDKMDFSKIVEAIKANFNDKFDEHRKKWGGGIMGSKSQAKTKAKDRVLAKEAAQRLT

SEQ ID NO: 8604 - protein, 263 aa, Amborella trichopoda
MNYGLQAPKRGGKAPVPAKKKAEKVVNPLFEKRPKQFGIGGALPPKRDLHRFVKWPKVVRIQRQRRILKQRLKVPPALNQFTKTLDKNLATNLFKMLLKYRPEDKAAKKERLLKRAQAEAEGKTVESKKPIVVKYGLNHVTYLIEQNKAQLVIIAHDVDPIELVVWLPALCRKMEIPYAIVKGKARLGTIVHKKTASTLCLTSVKNEDKLEFSKIVEAIKANFNDKYDEYRKKWGGGIMGSKSLAKTKARERLLAKEAAQRMT

SEQ ID NO: 8605 - protein, 262 aa, Secale cereale
RRRNGPEARRQGAGAAKKKAADKVVNPLFEKRPKQFGIGGALPPKKDLHRFVKWPKVVRIQRQRRILKQRLKVPPALHQFTRTLDKNLATNLFKMLLKYRPEDKVAKKERLLKRAQAEAEGKTVEAKKPIVVKYGLNHVTYLIEQSKAQLVVIAHDVDPIELVVWLPALCRKMEVPYCIVKGKSRLGSIVHKKTASVLCLTTVKNEDKLEFSKILEAIKANFNDKFDEVRKKWGGGVMGSKSQAKTKARERLIAKEAAQRMN

SEQ ID NO: 8606 - protein, 259 aa, Castanea mollissima
MAPKRGGKVAAAPAKKKTEKVLNPLFEKRSKQFGIGGALPPKRDLHRFVKWPVVVRLQRKKRILKQRLKVPPALNQFTKTLDKNLATNLFKLLLKYRPEDKSAKKERLLKRAQAEAEGKTVEAKKPIVVKYGLNHVTYLIEQNKAQLVVIAHDVDPIELVVWLPALCRKMEIPYCIVKGKSRLGSIVHKKTASVLCLTTVKNEDKLEFSKILEAIKANFNDKYDEYRKKWGGGIMGSKSQAKTKAKERLLAKEAAQRMT

SEQ ID NO: 8607 - protein, 196 aa, Thalictrum flavum
MAPKKGVRAPAAAAKKKPEKVVNPLFEKRPKQFGIGGALPPKKDLHRFVKWPKVVRIQRQRRILKQRLKVPPALNQFTKTLDKSLATNLFKMLLKYRPEDKAAKKERLLKRAQAESEGKTIEAKKPIVVKYGLNHITYLIEQNKAQLVVIAHDVDPIELVVWLPALCRKMEIPYCIVKGKARLGSMFTRRQHQFYV

SEQ ID NO: 8608 - protein, 259 aa, Arachis hypogaea
MAPKRGVKAPVPAAKKKPEKVTNPLFEKRPKQFGIGGALPPKRDLTRFVKWPKTVQIQRKKRILKQRLKVPPALNQFTKTLDKNLATSLFKILLKYRPEDKAEKKERLLKRAQAETEGKTVEAKKPIVVKYGLNHVTYLIEQNKAQLVVIAHDVDPIELVVWLPALCRKMEIPYCIVKGKARLGSIVHKKTASVLCLTSVKNEDKLEFSRVLEAIKANFNDKFDEYRKKWGGGIMGSKSQAKTKAKERLLAKEAAQRMS

SEQ ID NO: 8609 - protein, 258 aa, Unknown
  Sequence found in Organisms: Gossypium hirsutum, Gossypium raimondii
MAPKRGGKVVVPAKKKQEKVVNPLFEKRPKQFGIGGALPPKKDLHRFVKWPKVVRIQRKKRILKQRLKVPPALNQFTKTLDKNLATSLFKLLLKYRPEDKAAKKERLLKKAQAEAEGKAPESKKPIVVKYGLNHVTYLIEQNKAQLVVIAHDVDPIELVVWLPALCRKMEVPYCIVKGKSRLGSIVHKKTASVLCLTTVKNEDKLDFSKILEAIKANFNDKYDEYRKKWGGGIMGSKSQARTKAKEKLLAKEAAQRMT

SEQ ID NO: 8610 - protein, 259 aa, Chelidonium majus
MAPKRGVKAPVPAKKKTAEKVVNPLFEKRPKQFGIGGALPPKKDLHRFVKWPKVVRIQRQRRILKQRLKVPPALNQFTKTLDKNLATNVFKMLLKYRPEDKAAKKERLLKRAQAESEGKTVESKKPIVVKYGLNHITYLIEQNKAQLVLIAHDVDPIELVVWLPALCRQMKIPYAIVKGKARLGAIVHKKTAAALCLTSVKNEDKMEFSKIVEAIKANFNDKFDEHRKKWGGGIMGSKSQAKTKAKERLIAKEAAQRMT

SEQ ID NO: 8611 - protein, 258 aa, Platanus occidentalis
MAPKRGVKAPLPAKKKPEKVANPLFEKRPKQFGIGGALPPKRDLHRFVKWPKVVRIQRQRRILKQRLKVPPALNQFTKTLDKNLATNLFKMLLKYRPEDKAAKKERLLKRAQAEAEGKPVESKKPIVVKYGLNHITYLIEQNKAQLVVIAHDVDPIELVVWLPALCRKMEIPYAIVKGKARLGAIVHKKTATALCLTSVKNEDKMEFSRIVEAIKANFNDKFEENRKKWGGGIMGSKSQAKTKAKERLLAKEAAQRMT

SEQ ID NO: 8612 - protein, 258 aa, Papaver somniferum
MAPKRGVKAPVASKKKTEKVVNPLFEKRPKQFGIGGALPPKKDLHRFVKWPKVVRIQRQRRILKQRLKVPPALNQFTKTLDKNLATNLFKMLLKYRPEDKAAKKERLLKRAQAETEGKTVEAKKPIVVKYGLNHITYLIEQNKAQLVVIAHDVDPIELVVWLPALCRKMEIPYAIVKGKARLGAIVHKKTASALCLTSVKNEDKMDFSKIVEAVKANFNDKFDEHRKKWGGGIMGSKSQAKTKAKERVLAKEAAQRLN

SEQ ID NO: 8613 - protein, 258 aa, Aristolochia fimbriata
MAPKRGGKAPAAAKKKPEKVVNPLFEKRPKQFGIGGALPPKRDLHRFVKWPKVVRIQRQKRILKQRLKVPPTLNQFTKTLDKNLATNLFKMLLKYRPEDKAAKKERLLKRAQAETEGKTVEAKKPIVVKYGLNHITYLIEQQKAQLVVIAHDVDPIELVVWLPALCRKMEVPYCIVKGKARLGAIVHKKTATALCLTSVKNEDKLEFSKILEAVKANFNDKFDEHRKKWGGGIMGSKSQAKTKAKERVLAKEAAQRMS

SEQ ID NO: 8614 - protein, 258 aa, Eschscholzia californica
MAPKRGVKAPVAAKKKTDKVVNPLFEKRPKQFGIGGALPPKKDLHRFVKWPKVVRIQRQRRILKQRLKVPPALNQFTKTLDKNLATNLFKMLLKYRPEDKAAKKERLLKRAQAESEGKTVESKKPIVVKYGLNHITYLIEQNKAQLVVIAHDVDPIELVVWLPALCRKMEIPYAIVKGKARLGAIVHKKTASALCLTSVKNEDKMDFSKIVEAIKANFNDKFDEHRKKWGGGIMGSKSQAKTKAKDRVLAKEQAQRMS

SEQ ID NO: 8615 - protein, 259 aa, Arachis hypogaea
MAPKRGGKAPVPASKKKPEKVTNPLFEKRPKQFGIGGALPPKRDLTRFVKWPKTVQIQRKKRILKQRLKVPPALNQFTKTLDKNLATSLFKILLKYRPEDKAEKKERLLKRAQAETEGKTVEAKKPIVVKYGLNHVTYLIEQNKAQLVVIAHDVDPIELVVWLPALCRKMEIPYCIVKGKARLGSIVHKKTASVLCLTSVKNEDKLEFSRVLEAIKANFNDKYDEYRKKWGGGIMGSKSQAKTKAKERLLAKEAAQRMS

SEQ ID NO: 8616 - protein, 259 aa, Prunus persica
MQAPKRGVKAPVAAKKKTEKVVNPLFEKRPKQFGIGGALPPKRDLTRFVKWPKVVQVQRKKRILKQRLKVPPALNQFTKTLDKNLATSLFKMLLKYRPEDKAAKKERLLKRAQAESEGKTVEAKKPIVVKYGLNHVTYLIEQNKAQLVVIAHDVDPIELVVWLPALCRKMEIPYCIVKGKARLGSIVHKKTASVLCLTTVKNEDKLEFSKVLEAIKANFNDKYDEYRKKWGGGIMGSKSQAKTRAKERLLAKEAAQRMN

SEQ ID NO: 8617 - protein, 258 aa, Gossypium hirsutum
MGPKRGGKVAVPAKKKQEKVVNPLFEKRPKQFGIGGALPPKKDLHRFVKWPKVVRIQRKKRILKQRLKVPPALNQFTKTLDKNLATSLFKLLLKYRPEDKAAKKERLLKKAQAEAEGKAPESKKPIVVKYGLNHVTYLIEQNKAQLVVIAHDVDPIELVVWLPALCRKMEVPYCIVKGKSRLGSIVHKKTASVLCLTTVKNEDKLDFSKILEAIKANFNDKYDEYRKKWGGGIMGSKSQARTKAKEKLLAKEAAQRMT

SEQ ID NO: 8618 - protein, 258 aa, Gossypium hirsutum
MAPKRGVKVAAPAKKKQEKVVNPLFEKRPKQFGIGGALPPKKDLHRFVKWPKVVRIQRKKRILKQRLKVPPALNQFTKTLDKNLATSLFKLLLKYRPEDKAAKKERLLKKAQAEAEGKASESKKPIVVKYGLNHVTYLIEQNKAQLVVIAHDVDPIELVVWLPALCRKMEVPYCIVKGKARLGSIVYKKTASVLCLTTVKNEDKMEFSKILEAIKANFNDKYDEYRKKWGGGIMGSKSQARTKAKEKLLAKEAAQRMT

SEQ ID NO: 8619 - protein, 258 aa, Gossypium raimondii
MAPKRGVKVAAPAKKKQEKVVNPLFEKRPKQFGIGGALPPKKDLHRFVKWPKVVRIQRKKRILKQRLKVPPALNQFTKTLDKNLATSLFKLLLKYRPEDKAAKKERLLKKAQAEAEGKASESKKPIVVKYGLNHVTYLIEQNKAQLVVIAHDVDPIELVVWLPALCRKMEVPYCIVKGKARLGSIVHKKTASVLCLTTVKNEDKMEFSKILEAIKANFNDKYDEYRKKWGGGIMGSKSQARSKAKEKLLAKEAAQRMT

SEQ ID NO: 8620 - protein, 258 aa, Aristolochia fimbriata
MAPKRGGKAPVPTKKKPEKVVNPLFEKRPKQFGIGGALPPKQDLHRFVKWPKVVRIQRQKRILKQRLKVPPALNQFTKTLDKNLATNLFKTLLKYRPEDKAAKKERLLRRAQAETEGKTVEAKKPIVVKYGLNHITYLIEQQKAQLVVIAHDVDPIELVVWLPALCRKMEVPYCIVKGKARLGAIVHKKTATALCLTSVKNEDKLEFSKILEAVKANFNDKFDEHRKKWGGGIMGSKSQAKTKAKERVLAKEAAQRMS

SEQ ID NO: 8621 - protein, 258 aa, Tropaeolum majus
MAPKKGGKAVAPAKKKTDKVVNPLFEKRPKQFGIGGALPPKKDLHRFVKWPKAIRIQRQRRILKQRLKVPPALNQFTKTLDKNLATNLFKLLLKYRPEDKAAKKERLLNKAQAEAEGKTVETKKPIVVKYGLNHVTYLIEQNKAQLVVIAHDVDPIELVVWLPALCRKMEIPYCIVKGKSRLGAIVHKKTASALCLTTVKNEDKMDFSKILEAIKANFNDKYDEYRKKWGGGIMGSKSQAKTKAKERVLAKEAAQRMN

SEQ ID NO: 8622 - protein, 258 aa, Picea glauca
MAPKRGVKAPVAAKKKVPKVVNPLFEKRPKQFGIGGALPPKKDLHRFVKWPKVVRIQRQRRVLKQRLKVPPALNQFTKTLDKNLAANLFKMLLKYRPEDKAAKKERLLKKAQAEAEGKTVEVKKPIVVKYGINHVTYLIEQSKAQLVVIAHDVDPIELVVWLPALCRKMNIPYAIVKGKARLGAIVHKKTATALCLTSVKNEDKMEFSKIVEAIKGNFNDKFDEYRRQWGGGIMGTKSQAKTKAKEKVLAKEAAQRLT

SEQ ID NO: 8623 - protein, 283 aa, Amborella trichopoda
MYVHELSLLLPEQGAFLAHSPLFIFQAPKRGGKAPARAKKKAEKVVNPLFEKRPKQFGIGGALPPKRDLHRFVKWPKVIRIQRQRRILKQRLKVPPALNQFTKTLDKNLATNLFKMLLKYRPEDKAEKKERLLKRAQAEAEGKTVESKKPIVVKYGLNHVTYLIEQNKAQLVIIAHDVDPIELVVWLPALCRKMEIPYAIVKGKARLGTIVHKKTAAVLCLTSVKNEDKLDFSKIVEAIKANFNDKYDEYRKRWGGGIMGSKSLAKTKARERLLAKEAAQRMT

SEQ ID NO: 8624 - protein, 259 aa, Theobroma cacao
MAPKRGVKAPVVAAKKKTDKVVNPLFEKRPKQFGIGGDLPPKKDLTRFVKFPKTVRIQRQKRILKQRLKVPPALNQFTKTLDKNLASNLFKMLLKYRPEDKAAKKERLLKKAQSEAEGKPAEAKKPIVVKYGLNHVTYLIEQNKAQLVIIAHDVDPIELVVWLPALCRKMEIPYCIVKGKARLGAIVHKKSASVLCLTTVKNEDKLEFSRILEAIKANFNDKYDEYRKKWGGGIMGTKSQARTKAKEKLLAKEAAQRMT

SEQ ID NO: 8625 - protein, 258 aa, Chelidonium majus
MAPKRGVKAPVPAKKKTENVVNPLFEKRPKQFGIGGALPPKKDLHRFVKWPKVVRIQRQRRILKQRLKVPPALNQFTKTLDKNLATNLFKMLLKYRPEDKAAKKERLLKRAQAESEGKTVESKKPIVVKYGLNHITYLIEQSKAQLVIIAHDVDPIELVVWLPALCRQKQIPYAIVKGKARLGAIVHKKTAAALCLTSVKNEDKMDFSKIVEAIKANFNDKFDEHRKKWGGGIMGSKSQAKTKAKERLIAKEAAQRMN

SEQ ID NO: 8626 - protein, 260 aa, Cicer arietinum
MAPKRGGKAPVVAAKKKQPEKVTNPLFEKRPKQFGIGGALPPKRDLTRFVKWPKTVQIQRKKRILKQRLKVPPALNQFTKTLDKNLATNLFKMLLKYRPEDKAEKKERLLKRAQAESEGKTVETKKPIVVKYGLNHVTYLIEQNKAQLVVIAHDVDPIELVVWLPALCRKMEIPYCIVKGKARLGTIVHKKTAAVLCLTTVKNEDKMEFSRILEAIKANFNDKFDENRKKWGGGIMGSKSQAKTKAKERLIAKEAAQRMT

SEQ ID NO: 8627 - protein, 259 aa, Eschscholzia californica
MAPKRGVKAPAPAKKKTPEKVVNPLFEKRPKQFGIGGALPPKKDLHRFVKWPKVVRIQRQRRILKQRLKVPPALNQFTKTLDKNLATNLFKMMLKYRPEDKAAKKERLLKRAQAESEGKTVESKKPIVVKYGLNHITYLIEQNKAQLVVIAHDVDPIELVVWLPALCRKMEIPYAIVKGKARLGAIVHKKTASALCLTSVKNEDKMDFSKIVEAIKANFNDKFDEHRKKWGGGIMGSKSQAKTKAKDRVLAKEAAQRLN

SEQ ID NO: 8628 - protein, 259 aa, Vitis vinifera
MAPKKGVKAPAALAKKKQEKVVNPLFEKRPKQFGIGGALPPKRDLSRFVKFPKHVQIQRKRRILKQRLKVPPALNQFTKTLDKNLATSLFKMLLKYRPEDKAAKKERLLKRAQAEAEGKTAETKKPIVVKYGLNHVTYLIEQNKAQLVVIAHDVDPIELVVWLPALCRKMEIPYCIVKGKSRLGSIVHKKTASVLCLTTVKNEDKLEFSKILEAIKANFNDKYDENRKKWGGGIMGSKSQARTKAKERLVAKEAAQRMT

SEQ ID NO: 8629 - protein, 259 aa, Carpinus betulus
MGPKKGGKAPVVAAKKKPEKVTNPLFEKRPKQFGIGGALPPKRDLTRFVKWPKTVQIQRKKRILRQRLKVPPALNQFTKTLDKNLATNLFKMLLKYRPEDKAAKKERLLKRAQAESEGKPVEAKKPIVVKYGLNHVTYLIEQNKAQLVVIAHDVDPIELVVWLPALCRKMEIPYCIVKGKARLGAVVHKKTASVLCLTTVKNEDKLEFSKILEAIKANFNDKYDEYRKKWGGGIMGSKSQAKTKAKERLLAKEAAQRMS

SEQ ID NO: 8630 - protein, 258 aa, Tropaeolum majus
MAPKKGGKAVAPAKKKTDKVVNPLFEKRPKQFGIGGALPPKKDLHRFVKWPKAIRIQRQRRILKQRLKVPPALNQFTKTLDKNLATNLFKLLLKYRPEDKAAKKERLLKKAQAEAEGKTAESKKPIVVKYGLNHVTYLIEQNKAQMVVIAHDVDPIELVVWLPALCRKMEIPYCIVKGKSRLGAIVHKKTASVLCLTTVKNEDKMEFSKILEAIKANFNDKYEEYRKKWGGGIMGSKSQAKTKAKERVLAKEAAQRLN

SEQ ID NO: 8631 - protein, 258 aa, Papaver somniferum
MAPKRGVKAPVAAKKKIEKVANPCFEKRPKQFGIGGALPPKKDLHRFVKWPKVVRIQRQRRILKQRLKVPPALNQFTKTLDKNLATNLFKMLLKYRPEDKAAKKERLLKRAQAESEGKTVEAKKPIVVKYGLNHITYLIEQNKAQMVIIAHDVDPIELVVWLPALCRKMEIPYAIVKGKARLGAIVHKKTASALCLTSVKNEDKMEFSKIVEAVKANFNDKFDEHRKKWGGGIMGSKSQAKTKAKERVLAKEAAQRLN

SEQ ID NO: 8632 - protein, 258 aa, Zostera marina
MAPKKGVKATVASKKKPEKVTNPLFEKRPKQFGIGGALPPKRDLHRFVRWPQVVRIQRQRRILKQRLKVPPALNQFTRTLDKNLATNLFKMLLKYRPEDKVAKKERLLSRAQAEAEGKTVELKKPIVVKYGLNHVTYLIEQKKAQLVVIAHDVDPIELVVWLPALCRKLEVPYCIVKGKSRLGAVVHQKTSAVLCLTTVKNEDKLEFSKILEAIKANFNDKFDEVRKKWGGGIMGSKSQAKTKAKERLIAKEAAQRMN

SEQ ID NO: 8633 - protein, 259 aa, Cajanus cajan
MAPKRGGKAPVLASKKKPEKVTNPLFEKRPKQFGIGGALPPKRDLTRFVKWPKTVQIQRKKRILKQRLKVPPALNQFTKTLDKNLATSLFKILLKYRPEDKAEKKERLLKRAQAEAEGKTVEAKKPIVVKYGLNHVTYLIEQNKAQLVVIAHDVDPIELVVWLPALCRKMEIPYCIVKGKARLGTVVHKKTASVLCLTTVKNEDKLEFSRVLEAIKANFNDKYDEYRKKWGGGIMGSKSQAKTRAKEKLLAKEAAQRMS

SEQ ID NO: 8634 - protein, 259 aa, Glycine max
MAPKRGGKAPALAAKKKPEKVTNPLFEKRPKQFGIGGALPPKRDLTRFVKWPKNVQIQRKKRILKQRLKVPPALNQFTKTLDKNLATSLFKLLLKYRPEDKAEKKERLLKRAQAEAEGKTVEAKKPIVVKYGLNHVTYLIEQNKAQLVVIAHDVDPIELVVWLPALCRKMEIPYCIVKGKARLGTVVHKKTASVLCLTTVKNEDKLEFSRVLEAIKANFNDKYDEYRKKWGGGIMGSKSQAKTRAKEKLLAKEAAQRMT

SEQ ID NO: 8635 - protein, 258 aa, Theobroma cacao
MGPKRGGKVAAPAKKKQEKVANPLFEKRPKQFGIGGALPPKKDLHRFVKWPKVVRIQRKKRILKQRLKVPPALNQFTKTLDKNLATSLFKLLLKYRPEDKAAKKERLLKKAQAEAEGKAPESKKPIVVKYGLNHVTYLIEQNKAQLVVIAHDVDPIELVVWLPALCRKMEVPYCIVKGKSRLGSIVHKKTAAVLCLTTVKNEDKLEFSKILEAIKANFNDKYDEYRKKWGGGIMGSKSQARTKAKEKLLAKEAAQRMT

SEQ ID NO: 8636 - protein, 258 aa, Unknown
  Sequence found in Organisms: Gossypium hirsutum, Gossypium raimondii
MGPKRGGKVAVPAKKKQEKVVNPLFEKRPKQFGIGGALPPKKDLHRFVKWPKVVRIQRKKRILKQRLKVPPALNQFTKTLDKNLATSLFKLLLKYRPEDKAAKKERLLKKAQAEAEGKAPESKKPIVVKYGLNHVTYLIEQNKAQLVVIAHDVDPIELVVWLPALCRKVEVPYCIVKGKSRLGSIVHKKTASVLCLTTVKNEDKLDFSKILEAIKANFNDKYDEYRKKWGGGIMGSKSQARTKAKEKLLAKEAAQRMT

SEQ ID NO: 8637 - protein, 258 aa, Gossypium raimondii
MGPKKGGKVAVPAKKKQEKVVNPLFEKRPKQFGIGGALPPKKDLHRFVKWPKVVRIQRKKRILKQRLKVPPALNQFTKTLDKNLATSLFKLLLKYRPEDKAAKKERLLKKAQAEAEGKAPESKKPIVVKYGLNHVTYLIEQNKAQLVVIAHDVDPIELVVWLPALCRKMEVPYCIVKGKSRLGSIVHKKTASVLCLTTVKNEDKLEFSKVLEAIKANFNDKYDEYRKKWGGGIMGSKSQARTKAKEKLLAKEAAQRMT

SEQ ID NO: 8638 - protein, 259 aa, Rosa hybrid cultivar
MGPKKGGKAPVAASKKKPEKVVNPLFEKRPKQFGIGGALPPKRDLTRFVKWPKAVQIQRKKRILKQRLKVPPALNQFTKTLDKNLATTLFKMLLKYRPEDKAEKKERLLKRAQAETEGKTVEAKKPIVVKYGLNHVTYLIEQNKAQLVVIAHDVDPIELVVWLPALCRKMEIPYCIVKGKARLGAIVHQKTASVLCLTTVKNEDKMEFSKVLEAIKANFNDKYEENRKKWGGGIMGSKSQAKTKAKERLLAKEAAQRMT

SEQ ID NO: 8639 - protein, 259 aa, Fragaria vesca
MGPKKGAKLPVAASKKKPEKVVNPLFEKRPKQFGIGGALPPKRDLTRFVKWPKAVQIQRKKRILKQRLKVPPALNQFTKTLDKNLATSLFKMLLKYRPEDKAEKKERLLKRAQAETEGKTVENKKPIVVKYGLNHVTYLIEQNKAQLVVIAHDVDPIELVVWLPALCRKMEIPYCIVKGKARLGAIVHKKTASVLCLTTVKNEDKMEFSKVLEAIKANFNDKYEEYRKKWGGGIMGSKSQAKTKAKERLLAKEAAQRMT

SEQ ID NO: 8640 - protein, 168 aa, Malus domestica
MLLKYRPEDKAAKKERLLKRAQAETEGKSVEAKKPIVVKYGLNHVTYLIEQNKAQLVVIAHDVDPIELVVWLPALCRKMEVPYCIVKGKARLGSIVHKKTASVLCLTTVKNEDKLEFSKVLEAIKANFNDKYEEYRKKWGGGIMGSKSQAKTRAKEKLLAKEAAQRLN

SEQ ID NO: 8641 - protein, 258 aa, Abies balsamea
MAPKRGVKAPVAAKKKVPKVVNPLFEKRTKQFGIGGALPPKKDLHRFVKWPKVVRIQRQRRVLKQRLKVPPALNQFTKTLDKNLAANLFKMLLKYRPEDKAAKKERLLKKAQAEAEGKTVEVKKPIVVKYGINHVTYLIEQSKAQLVVIAHDVDPIELVVWLPALCRKMNIPYAIVKGKARLGAIVHKKTATALCLTSVKNEDKMEFSKIVEAVKANFNDKFDEYRRQWGGGIMGTKSQAKTKAKEKLVAKEAAQRLT

SEQ ID NO: 8642 - protein, 258 aa, Vaccinium corymbosum
MAPKKGVKPVVAAKKKPEKVVNPLFEKRPKQFGIGGALPPKKDLHRFVKWPKVVQIQRKKRILNQRLKVPPPLNQFTKTLDKNLATSLFKMLLKYRPEDKAAKKERLLKRAQAETEGKTIEAKKPIVVKYGLNHVTYLIEQNKAQLVVIAHDVDPIELVVWLPALCRKMEIPYCIVKGKARLGTIVHQKTAAVLCLTTVKNEDKLEFSKILEAIKANFNDKYDEYRKKWGGGIMGSKSQAKTKAKERLLAKEVAQRMG

SEQ ID NO: 8643 - protein, 258 aa, Cedrus atlantica
MAPKRGVKTPVAAKKKVPKVVNPLFEKRPKQFGIGGALPPKKDLHRFVKWPKVVRIQRQRRVLKQRLKVPPALNQFTKTLDKNLAANLFKMLLKYRPEDKAAKKERLLKKAQAEAEGKTVEVKKPIVVKYGINHVTYLIEQSKAQLVVIAHDVDPIELVVWLPALCRKMNIPYAIVKGKARLGAIVHKKTATALCLTSVKNEDKMEFSKIVEAVKANFNDKFDEYRRQWGGGIMGTKSQAKTKAKEKLMAKEAAQRLT

SEQ ID NO: 8644 - protein, 258 aa, Eschscholzia californica
MAPKKGVKTSVPAKKKTEKVVNPLFEKRPKQFGIGGALPPKKDLHRFVKWPKVVRIQRQRRILKQRLKVPPALNQFTKTLDKNLATNLFKTLLKYRPEDKAAKKERLLKRAQAESEGKTVESKKPIVVKYGLNHITYLIEQNKAQLVVIAHDVDPIELVVWLPALCRKMEIPYAIVKGKARLGAIVHKKTASALCLTSVKNEDKMEFSKIVEAIKANFNDKFDEHRKKWGGGIMGSKSQAKTKAKERVIAKETAQRMN

SEQ ID NO: 8645 - protein, 258 aa, Eucalyptus grandis
MGPKRGGKAAVAGKKKQEKVTNPLFEKRPKQFGIGGALPPKRDLTRFVKFPKTVQIQRKRRILRQRLKVPPALNQFTKTLDKNLATNLFKMLLKYRPEDKAAKKERLLKEAQAKAEGKTVEAKKPIVVKYGLNHVTYLIEQNKAQLVVIAHDVDPIELVVWLPALCRKMEIPYCIVKGKARLGTIVHKKTASALCLTTVKNEDKLEFSKILEAIKANFNDKYDEYRKKWGGGIMGSKSQAKTKAKERVLAKEAAQRMN

SEQ ID NO: 8646 - protein, 258 aa, Euonymus alatus
MAPKRGVKAPSAAKKKQENVANPLFEKRPKQFGIGGALPPKRDLTRFVKWPKVVQIQRRKRILKMRLKVPPALNQFTKTLDKNLASNLFKMLLKYRPEDKASKKERLLKKAQAEAEGKSAEAKKPIVVKYGLNHVTYLIEQNKAQLVVIAHDVDPIELVVWLPALCRKMEIPYCIVKGKSRLGSIVHKKTASVLCLTTVKNEDKLEFSRILEAIKANFNDKYDEYRKKWGGGIMGSKSQAKSKAKEKVLAKEAAQRMT

SEQ ID NO: 8647 - protein, 258 aa, Vitis vinifera
MAPKKGGKVLAQTKKKPEKVVNPLFEKRPKQFGIGGALPPKRDLHRFVKWPHVVRIQRKRRILKQRLKVPPALNQFTKTLDKNLATSLFKMLLKYRPEDKAAKKERLLKRAQSEAEGKTIEVKKPIVVKYGLNHVTYLIEQNKAQLVVIAHDVDPIELVVWLPALCRKMEIPYCIVKGKSRLGAIVHKKTAAVLCLTTVKNEDKLEFSKILEAIKANFNDKYDENRKKWGGGIMGSKSQAKTKAKEKLLAKEAAQRMS

SEQ ID NO: 8648 - protein, 259 aa, Carpinus betulus
MAPKRGVKVAAAPAKKKPEKVANPLFEKRSKQFGIGGALPPKRDLHRFVKWPKVVRIQRKKRILRQRLKVPPALNQFTKTLDKNLATNLFKLLLKYRPEDRAAKKERLLKRAQAESEGKTVEAKKPIVVKYGLNHITYLIEQNKAQLVVIAHDVDPIELVVWLPALCRKMEIPYCIVKGKSRLGAIVHKKTASALCLTTVKNEDKLEFSKILEAIKANFNDKYDEYRKKWGGGIMGSKSQAKTKAKEKLLAKEAAQRLS

SEQ ID NO: 8649 - protein, 259 aa, Ipomoea nil
MAPKKGVKLPAAAAKKKPEKVVNPLFEKRPKQFGIGGALPPKKDLTRFVKWPQVVRIQRKRRILKQRLKVPPALNQFSKTLDKNLATNLFKMLLKYRPEDKAAKKERLLKRAQAESEGKTPELKKPIVVKYGLKHVTYLIEQNKAQLVVIAHDVDPIELVVWLPALCRKMEIPYCIVKGKARLGSIVHKKTASVLCLTSVKNEDKLEFSKILEAIKANFNDKYEENRKKWGGGIMGSKSQARTKAKERLLQKEAAQRMS

SEQ ID NO: 8650 - protein, 258 aa, Actinidia deliciosa
MAPKKGVKPVAAAKKKPEKVVNPLFEKRPKQFGIGGALPPKKDLHRFVKWPKVVQIQRKRRILNQRLKVPPPLNQFTKTLDKNLATSLFKMLLKYRPEDRAAKKERLLKRAQAEAEGKPVEAKKPIVVKYGLNHVTYLIEQNKAQLVVIAHDVDPIELVVWLPALCRKMEIPYCIVKGKSRLGTIVHQKTAAVLCLTTVKNEDKLEFSKILEAIKANFNDKYDEYRKKWGGGIMGSKSQAKTKAKERVLAKEAAQRMN

SEQ ID NO: 8651 - protein, 258 aa, Tropaeolum majus
MAPKKGGKAVALAKKKTDKVVNPLFEKRPKQFGIGGALPPKKDLHRFVKWPKAIRIQRQRRILKQRLKVPPALNQFTKTLDKNLATSLFKLLLKYRPEDKAAKKERLLKKAQAEAEGKTVESKKPIVVKYGLNHVTYLIEQNKAQLVIIAHDVDPIELVVWLPALCRKMEIPYCIVKGKSRLGAIVHKKTASALCLTTVKNEDKMDFSKILEAIKANFNDKYDEYRKKWGGGIMGSKSQAKTKAKERVLAKEAAQRMN

SEQ ID NO: 8652 - protein, 259 aa, Cajanus cajan
MAPKRGAKPVVAAAKKKPEKVTNPLFEKRPKQFGIGGALPPKRDLTRFVKWPKTVQIQRKKRILKQRLKVPPALNQFTKTLDKNLATNLFKMLLKYRPEDKAEKKERLLKRAQAEADGKPVEARKPIVVKYGLNHVTYLIEQNKAQLVVIAHDVDPIELVVWLPALCRKMEIPYCIVKGKARLGTVVHKKTASVLCLTTVKNEDKLEFSRILEAIKANFNDKYDEYRKKWGGGIMGSKSQAKTRAKEKLLAKEAAQRMS

SEQ ID NO: 8653 - protein, 258 aa, Papaver somniferum
MAPKRGVKAPVAVKNKTDKVVNPCFEKRPKQFGIGGALPPKKDLHRFVKWPKVVRIQRQRRILKQRLKVPPALNQFTKTLDKNLATNLFKLLLKYRPEDKAAKKERLLKRAQAESEGKTVEAKKPIVVKYGLNHITYLIEQNKAQLVVIAHDVDPIELVVWLPALCRKMEIPYAIVKGKARLGAIVHKKTASALCLTSVKNEDKMDFSKIVEAIKANFNDKFDEHRKKWGGGIMGSKSQAKTKAKERVLAKEAAQRLN

SEQ ID NO: 8654 - protein, 258 aa, Papaver somniferum
MAPKRGVKAPVAVKKKTDKVLNPCFEKRPKQFGIGGALPPKKDLHRFVKWPKVVRIQRQRRILKQRLKVPPALNQFTKTLDKNLATNLFKMLLKYRPEDKAAKKERLLKRAQAESEGKTVEAKKPIVVKYGLNHITYLIEQNKAQLVIIAHDVDPIELVVWLPALCRKMEIPYAIVKGKARLGAIVHKKTASALCLTSVKNEDKMDFSKIVEAIKANFNDKFDEHRKKWGGGIMGSKSQAKTKAKERVLAKEAAQRLN

SEQ ID NO: 8655 - protein, 258 aa, Papaver somniferum
MAPKRGVKAPVAAKKKTLKVVNPCFEKRTKQFGIGGALPPKKDLHRFVKWPKVVRIQRQRRILKQRLKVPPALNQFTKTLDKNLATNLFKMLLKYRPEDKAAKKERLLKRAQAESEGKTVEAKKPIVVKYGLNHITYLIEQNKAQMVIIAHDVDPIELVVWLPALCRKMEIPYAIVKGKARLGAIVHKKTASALCLTSVKNEDKMEFSKIVEAVKANFNDKFDEHRKKWGGGIMGSKSQAKTKAKERVLAKEAAQRLN

SEQ ID NO: 8656 - protein, 259 aa, Rosa hybrid cultivar
MGPKKGGKLPVAASKKKPEKVVNPLFEKRPKQFGIGGALPPKRDLTRFVKWPKAVQIQRKKRILKQRLKVPPALNQFTKTLDKNLATSLFKMLLKYRPEDKAEKKERLLKRAQAETEGKTVEAKKPIVVKYGLNHVTYLIEQNKAQLVVIAHDVDPIELVVWLPALCRKMEIPYCIVKGKARLGAIVHQKTASVLCLTTVKNEDKMEFSKVLEAIKANFNDKYEEYRKKWGGGIMGSKSQAKTKAKERLLAKEAAQRMT

SEQ ID NO: 8657 - protein, 258 aa, Manihot esculenta
MAPKRGVKAPVLSKKKPEKVVNPLFEKRPKQFGIGGALPPKKDLTRFVKWPHVVRIQRQRRILKQRLKVPPAVNQFTKTLDKNLATQLFKLLLKYRPEDKAAKKERLLKRAQAEAEGKTVESKKPIVVKYGLNHVTYLIEQNKAQLVVIAHDVDPIELVVWLPALCRKMEVPYAIVKGKSRLGAIVHKKTAAALCLTSVKNEDKLEFSKILEAVKANFNDKFDEHRKRWGGGIMGSKSQAKTKAKEKLLAKEAAQRMS

SEQ ID NO: 8658 - protein, 258 aa, Gossypium hirsutum
MGPKKGGKVAVPAKKKQEKVVNPLFEKRPKQFGIGGALPPKKDLHRFVKWPKVVRIQRKKRILKQRLKVPPALNQFTKTLDKNLATSLFKLLLKYRPEDKVAKKERLLKKAQAEAEGKAPESKKPIVVKYGLNHVTYLIEQNKAQLVVIAHDVDPIELVVWLPALCRKMEVPYCIVKGKSRLGSIVHKKTASVLCLTTVKNEDKLEFSKVLEAIKANFNDKYDEYRKKWGGGIMGSKSQARTKAKEKLLAKEAAQRMT

SEQ ID NO: 8659 - protein, 258 aa, Gossypium hirsutum
MAPKRGVKVAAPAKKKQEKVVNPLFEKRPKQFGIGGALPPKKDLHRFVKWPKVVRIQRKKRILKQRLKVPPALNQFTKTLDKNLATSLFKLLLKYRPEGKAAKKERLLKKAQAEAKGKAPESKKPIVVKYGLNHVTYLIEQNKAQLVVIAHDVDPIELVVWLPALCRKMEVPYCIVKGKARLGSIVHKKTASVLCLTTVKNEDKMEFSKILEAIKANFNDKYDEYRKKWGGGIMGSKSQARSKAKEKLLAKEAAQRMT

SEQ ID NO: 8660 - protein, 259 aa, Glycine max
MAPKRGGKAPALAAKKKPEKVSNPLFEKRPKQFGIGGALPPKRDLTRFVKWPKNVQIQRKKRILKQRLKVPPALNQFTKTLDKNLATSLFKLLLKYRPEDKAEKKERLLKRAQAEAEGKTVEAKKPIVVKYGLNHVTYLIEQNKAQLVVIAHDVDPIELVVWLPALCRKMEIPYCIVKGKARLGTVVHKKTASVLCLTTVKNEDKLEFSRVLEAIKANFNDKYDEYRKKWGGGIMGSKSQAKTRAKEKLLAKEAAQRMN

SEQ ID NO: 8661 - protein, 89 aa, Vaccinium corymbosum
MAPKKGVKPVVAAKKKPEKVVNPLFEKRPKQFGIGGALPPKKDLHRFVKWPKVVQIQRKKRILNQRLKVPPPLNQFTKTLDKKPCNESV

SEQ ID NO: 8662 - protein, 168 aa, Cajanus cajan
MLLKYRPEDKAEKKERLLKRAQSEADGKPVEAKKPIVVKYGLNHVTYLIEQNKAQLVVIAHDVDPIELVVWLPALCRKMEIPYCIVKGKARLGTVVHKKTASVLCLTTVKNEDKLEFSRILEAIKANFNDKYDEYRKKWGGGIMGSKSQAKTRAKEKLLAKEAAQRMS

SEQ ID NO: 8663 - protein, 113 aa, Picea glauca
MAPKRGVKAPAAAKKKVPKVVNPLFEKRQKQFGIGGALPPKKDLHRFVKWPKVVRIQRQRRVLKQRLKVPPALNQFTKTLDKNLAANLFKMLLKYRPEDKAAKKEKASEESSG

SEQ ID NO: 8664 - protein, 260 aa, Trifolium pratense
MAPKRGGKAPVAAAKKKQPEKVVNPLFEKRPKQFGIGGALPPKRDLTRFVKWPKNVQIQRKKRILKQRLKVPPALNQFTKTLDKNLATNLFKMLLKYRPEDKAEKKERLLKKAQAETEGKTVETKKPINVKYGLNHVTYLIEQNKAQLVVIAHDVDPIELVVWLPALCRKMEIPYCIVKGKARLGTIVHKKTAAVLCLTTVKNEDKMEFSRILEAIKANFNDKYDEYRKKWGGGIMGSKSQAKTKAKERLIAKEAAQRMT

SEQ ID NO: 8665 - protein, 260 aa, Glycine max
MAPKKGAKGGVVAAKKKVQEKVTNPLFEKRPKQFGIGGALPPKRDLTRFVKWPKNVQIQRKKRILKQRLKVPPALNQFTKTLDKNLATNLFKMLLKYRPEDKAEKKERLLKRAQAEADGKPVEAKKPIVVKYGLNHVTYLIEQNKAQLVVIAHDVDPIELVVWLPALCRKMEIPYCIVKGKARLGTIVHKKTASVLCLTTVKNEDKMEFSRILEAIKANFNDKYDEYRKKWGGGIMGSKSQAKTRAKEKLLAKEAAQRMN

SEQ ID NO: 8666 - protein, 259 aa, Unknown
  Sequence found in Organisms: Citrus clementina, Citrus sinensis
MAPKRGVKALVAASKRKTEKVVNPLFEKRPKQFGIGGALPPKKDLTRFVRWPTQVNIQRKKKILKLRLKVPPALNQFTKTLDKNLASNLFKMLLKYRPEDRAAKKERLLKKAQAEAEGKTVESKKPIVVKYGLNHVTYLIEQNKAQLVVIAHDVDPVELVVWLPALCRKMEIPYCIVKGKARLGVIVHKKTASVLCLTTVKNEDKMEFSRILEAIKANFNDKYDEHRKKWGGGIMGSKSQAKTKAKEKLLAKEAAQRMS

SEQ ID NO: 8667 - protein, 258 aa, Distylium racemosum
MAPKRGVKAPVPAKKKAPKVVNPLFEKRPKQFGIGGALPPKKDLHRFVKWPKVIRIQRQRRILKQRLKVPPALNQFTKTLDKNLASNLFKMLLKYRPEDKAAKKERLLKKAQAEAEGKTVEVKKPIVVKYGINHITYLIEQSKAQLVIIAHDVDPIELVVWLPALCRKMNIPYCIVKGKSRLGAIVHMKNAAALCLTSVKNEDKMEFSRIVEAVKANFNDKFDEYRRQWGGGIMGSKSQAKTKAREKLLAKEAAQRLT

SEQ ID NO: 8668 - protein, 258 aa, Euonymus alatus
MAPKRGVKAPSAAKKNQEKVANPLFEKRPKQFGIGGALPPKRDLTRFVKWPKVVQIQRRKRILKMRLKVPPALNQFTKTLDKNLASNLFKMLLKYRPEDKASKKERLLKKAQAEAEGKSAEAKKPIVVKYGLNHVTYLIEQNKAQLVVIAHDVDPIELVVWLPALCRKMEIPYCIVKGKSRLGSIVHKKTASVLCLTTVKNEDKLEFSRILEAIKANFNDKYDEYRKKWGGGIMGSKSQAKSKAKEKVLAKEAAQRMT

SEQ ID NO: 8669 - protein, 258 aa, Zingiber officinale
MAPKRAGNAPVPAKKKRENVVNPLFEKRPKQFGIGGALPPKKDLRRFVKWPKVVRIQRQKRILKQRLKVPPALNQFTRTLDKNLATNLFKLLLKYRPEDRAAKRERLLKRAQAEAEGKTLEVKKPIVVKFGLNHITYLIEQNKAQLVVIAHDVDPVELVVWLPALCRKMEIPYCIVKGKSRLGAIVHKKTATALCLTTVKNEDKLDFSKILEAIKANFNDKFDEIRRKWGGGIMGSKSQAKAKAKEKLLAKETAQRMT

SEQ ID NO: 8670 - protein, 259 aa, Ipomoea nil
MAPKKGVKLSAAAAKKKPEKVVNPLFEKRPKQFGIGGALPPKKDLTRFVKWPQVVRIQRKRRILKQRLKVPPALNQFSKTLDKNLATNLFKMLLKYRPEDKAAKKERLLKRAQAESEGKTPELKKPIVVKYGLKHVTYLIEQNKAQLVVIAHDVDPIELVVWLPALCRKMEIPYCIVKGKARLGSIVHKKTASVLCLTSVKNEDKLEFSKILEAIKANFNDKYEENRKKWGGGIMGSKSQARTKAKERLLQKEAAQRMS

SEQ ID NO: 8671 - protein, 257 aa, Actinidia deliciosa
MAPKKGVKPVVAKKKPEKVVNPLFEKRPKQFGIGGALPPKKDLHRFVKWPKVVQIQRKRRILNQRLKVPPPLNQFTKTLDKNLATSLFKMLLKYRPEDRAAKKERLLKRAQAEAEGKPVEAKKPIVVKYGLNHVTYLIEQNKAQLVVIAHDVDPIELVVWLPALCRKMEIPYCIVKGKSRLGTIVHQKTAAVLCLTTVKNEDKMEFSKILEAIKANFNDKYDEYRKKWGGGIMGSKSQAKTKAKERVLAKEAAQRMS

SEQ ID NO: 8672 - protein, 258 aa, Pinus pinaster
MAPKRGVKAPAAAKKKVPKVVNPLFEKRTKQFGIGGALPPKKDLHRFVKWPKVVRIQRQRRVLKQRLKVPPALNQFTKTLDKNLASNLFKMLLKYRPEDKAAKKERLLKKAQAEAEGKTVEVKKPIVVKYGINHVTYLIEQSKAQLVVVAHDVDPIELVVWLPALCRKMNIPYAIVKGKARLGSIVHKKTATALCLTSVKNEDKMEFSKIVEAVKANFNDKFDEYRRQWGGGIMGTKSQAKTKAKEKLVAKEAAQRLT

SEQ ID NO: 8673 - protein, 90 aa, Tropaeolum majus
MEIPYCIVKGKSRLGAIVHKKTASALCLTTVKNEDKMDFSKILEAIKANFNDKYDEYRKKWGGGIMGSKSQAKTKAKERVLAKEAAQRMN

SEQ ID NO: 8674 - protein, 258 aa, Pinus taeda
MAPKRGVKAPAAAKKKVPKVVNPLFEKRPKQFGIGGALPPKKDLHRFVKWPKIVRIQRQRRVLKQRLKVPPALNQFTKTLDKNLAANLFKMLLKYRPEDKAAKKERLLKKAQAEAEGKTVEVKKPIVVKYGINHVTYLIEQSKAQLVVIAHDVDPIELIVWLPALCRKMNIPYAIVKGKARLGAIVHKKTATALCLTSVKNEDKMEFSKIVEAVKANFNDKFDEYRRQWGGGIMGTKSQAKTKAKEKLVAKEAAQRLT

SEQ ID NO: 8675 - protein, 258 aa, Pinus taeda
MAPKRGVKAPAAAKKKVPKVVNPLFEKRTKQFGIGGALPPKKDLHRFVKWPKVVRIQRQRRVLKQRLKVPPALNQFTKTLDKNLAANLFKMLLKYRPEDKAAKKERLLKKAQAEAEGKTVEVKKPIVVKYGINHVTYLIEQSKAQLVVVAHDVDPIELVVWLPALCRKMNIPYAIVKGKARLGSIVHKKTATALCLTSVKNEDKMEFSKIVEAVKANFNDKFDEYRRQWGGGIMGTKSQAKTKAKEKLVAKEAAQRLT

SEQ ID NO: 8676 - protein, 258 aa, Papaver somniferum
MAPKKGVKTPVAAKKKSEKVVNPLFERRPKQFGIGGALPPKKDLHRFVKWPKVVRIQRQRRILKQRLKVPPALNQFTKTLDKNLATNLFKMLLKYRPEDKAAKKERLLKRAQAESEGKTVEAKKPIVVKYGLNHITYLIEQNKAQMVVIAHDVDPIELVVWLPALCRKMEIPYAIVKGKARLGAIVHKKTASALCLTSVKNEDKMDFSKIVEAIKANFNDKFDEHRKKWGGGIMGSKSQAKTKAKERVLAKEQAQRNN

SEQ ID NO: 8677 - protein, 258 aa, Primula obconica
MAPKKGIKPAAAAKKKQVKVVNPLFEKRSKQFGIGGALPPKKDLHRFVKWPKVVQIQRKRRILNQRLKVPPPLNQFTKTLDKNLATSLFKMLLKYRPEDRAAKKERLLKRAQAEAEGKTVEAKKPIVVKYGLNHVTYLIEQNKAQLVVIAHDVDPIELVVWLPALCRKMEIPYCIVKGKARLGTIVHQKTASVLCLTTVKNEDKMDFSKILEAIKANFNDKYDEYRKKWGGGIMGSKSQAKTKAKERVLAKEAAQRMN

SEQ ID NO: 8678 - protein, 258 aa, Unknown
  Sequence found in Organisms: Prunus persica, Prunus mume
MAPKRGVKPAAAAKKKTEKVVNPLFEKRTKQFGIGGALPPKRDLHRFVKWPKVVRIQRKKRILKQRLKVPPALNQFTKTLDKNLATSLFKLLLKYRPEDKAAKKERLLKRAQAETEGKTVEAKKPIVVKYGLNHVTYLIEQNKAQLVVIAHDVDPIELVVWLPALCRKMEIPYCIVKGKSRLGAILHKKTAAALCLTTVKNEDKLEFSKILEAIKANFNDKYDEYRKKWGGGIMGSKSQARTKAKEKLLAKEAAQRLN

SEQ ID NO: 8679 - protein, 258 aa, Sciadopitys verticillata
MAPKRGVKAPAGAKKKAPKVVNPLFEKRPKQFGIGGALPPKKDLHRFVKWPKIIRIQRQRRILKQRLKVPPALNQFTKTLDKNLASNLFKMLLKYRPEDKAAKKERLLKRAQAEAEGKAIEVKKPIVVKYGINHVTYLIEQSKAQLVVIAHDVDPIELVVWLPALCRKMNIPYCIVKGKARLGTIVHKKTATALCLTSVKNEDKMEFSRIVEAVKANFNDKFDEYRRQWGGGVMGSKSQAKTKAREKLMAKEAAQRLT

SEQ ID NO: 8680 - protein, 258 aa, Sequoia sempervirens
MAPKRGVKPPVAAKKKVAKVVNPLFEKRPKQFGIGGALPPKKDLHRFVKWPKIIRIQRQRRILKQRLKVPPALNQFTKTLDKNLASNLFKMLLKYRPEDKAAKKERLLKKAQAEAEGKPIEVKKPIVVKYGINHVTYLIEQSKAQLVVIAHDVDPIELVVWLPALCRKMNVPYCIVKGKARLGTIVHKKTATALCLTSVKNEDKMEFSRIVEAIKANFNDKFDEYRRQWGGGIMGTKSQAKTKAREKLLAKEAAQRLT

SEQ ID NO: 8681 - protein, 258 aa, Sequoia sempervirens
MAPKRGVKPAAPAKKKVAKVVNPLFEKRPKQFGIGGALPPKKDLHRFVKWPKIIRIQRQRRILKQRLKVPPALNQFTKTLDKNLASNLFKMLLKYRPEDKAAKKERLLKKAQSEAEGKPIEVKKPIVVKYGINHVTYLIEQSKAQLVVIAHDVDPIELVVWLPALCRKMNIPYCIVKGKARLGTIVHKKTATALCLTSVKNEDKMEFSRIVEAIKANFNDKFDEYRRQWGGGIMGSKSQAKSKAREKLLAKEAAQRMT

SEQ ID NO: 8682 - protein, 68 aa, Picea glauca
WKEVAGQLAKRSIAREQIDSSNGSEERVKAPAAAKKKVPKVVNPLFEKRQNSLGLVELCRQRRICTGL

SEQ ID NO: 8683 - protein, 258 aa, Picea glauca
MAPKRGVKAPAAAKKKVPKVVNPLFEKRQKQFGIGGALPPKKDLHRFVKWPKVVRIQRQRRVLKQRLKVPPALNQFTKTLDKNLAANLFKMLLKYRPEDKAAKKERLLKKAQAEAEGKTVEVKKPIVVKYGINHVTYLIEQSKAQLVVIAHDVDPIELVVWLPALCRKMNIPYAIVKGKARLGAIVHKKTATALCLTSVKNEDKMEFSKIVEAVKANFNDKFDEYRRQWGGGIMGTKSQAKTKAKEKLVAKEAAQRLT

SEQ ID NO: 8684 - protein, 287 aa, Picea glauca
MAPKRGVKAPAAAKKKVPKVVNPLFEKRQKQFGIGGALPPKKDLHRFVKWPKVVRIQRQRRVLKQRLKVPPALNQFTKTLDKNLAANLFKMLLKYRPEDKAAKKERLLKKAQAEAEGKTVEVKKPIVVKYGINHVTYLIEQSKAQLVVIAHDVDPIELVVWLPALCRKMNIPYAIVKGKARLGAIVHKKTATALCLTSVKNEDKMEFSKIVEAIKGNFNDKFDEYRRQWGGGIMGTKSQAKTRPRKKSWQRKQHKGSHRNNIMEDFSHLEEFIAVFFGICCEFDLEV

SEQ ID NO: 8685 - protein, 259 aa, Juglans hindsii x Juglans regia
  misc_feature (15)..(15): Xaa can be any naturally occurring amino acid
  misc_feature (36)..(36): Xaa can be any naturally occurring amino acid
  misc_feature (158)..(158): Xaa can be any naturally occurring amino acid
  misc_feature (171)..(171): Xaa can be any naturally occurring amino acid
MAPKRGGKAPVAAAXKKTEKVTNPLFEKRPKQFGIXGALPPKRDLTRFVKWPKTVQIQRKKRILRQRLKAPPALNQFTKTLDKNLATNLFKMLLKYRPEDKAAKKERLLKRAQAEAEGKPVEAKKPIVVKYGLNHVTYLIEQNKAQLVVIAHDVDPIXLVVWLPALCRKMXIPYCIVKGKARLGAVVHKKTASVLCLTTVKNEDKLEFSKILEAIKANFNDKYDEYRKKWGGGIMGSKSQAKTKAKERLLAKEAAQRMS

SEQ ID NO: 8686 - protein, 248 aa, Persea americana
MAPKRGGKAPVPAKKKPEKIVNPLFEKRPKQFGIGGALPPKRDLHRFVKWPKVVRIQRQRRILKQRLKVPPALNQFTKTLDKNLATNLFKMLLKYRPEDKAAKKERLLKRAQAETEGKTVEVKKPIVVKYGLNHVTYLIEQNKAQLVVIAHDVDPIELVVWLPALCRKMEIPYCIVKGKARLGAIVHKKTAAVLCLTTVKNEDKLEFSKILEAIKANFNDKYEEYRKKWGGGIMGSKSQAKSKAKEKD

SEQ ID NO: 8687 - protein, 258 aa, Hevea brasiliensis
MAPKRGVKAPVLSKKKPEKVVNPLFEKRPKQFGIGGALPPKKDLTRFVKWPHVVRIQRQRRILKQRLKVPPAVNQFTKTLDKNLATQLFKLSLKYRPEDKAAKKERLLKRAQAEAEGKTVESKKPIVVKYGLNHVTYLIEQNKAQLVVIAHDVDPIELVVWLPALCRKMEVPYAIVKGKSRLGAIVHKKTAAALCLTSVKNEDKLEFSKILEAVKANFNDKFDEHRKRWGGGIMGSKSQAKTKAKEKLLAKEAAQRMS

SEQ ID NO: 8688 - protein, 259 aa, Fagus grandifolia
MGPKKGGKVAAAPAKKKPEKVLNPLFEKRPKQFGIGGALPPKRDLHRFVKWPKVVRIQRKKRILKQRLKVPPALNQFTKTLDKNLATNLFKLLLKYRPEDKLEKKMRLVKRAEAEAEGKTVEAKKPIVVKYGLNHVTYLIEQNKAQLVVIAHDVDPIELVVWLPALCRKMEIPYCIVKGKSRLGAIVHKKTASVLCLTTVKNEDKLEFSKILEAIKANFNDKYDEYRKKWGGGIMGSKSQAKTKAKERLLAKEAAQRMS

SEQ ID NO: 8689 - protein, 260 aa, Glycine max
MAPKKGVKGSVVAAKKKVQEKVTNPLFEKRPKQFGIGGALPPKRDLTRFVKWPKNVQIQRKKRILKQRLKVPPALNQFTKTLDKNLATNLFKMLLKYRPEDKAEKKERLLKRAQAEADGKPVEAKKPIVVKYGLNHVTYLIEQNKAQLVVIAHDVDPIELVVWLPALCRKMEIPYCIVKGKARLGTIVHKKTASVLCLTTVKNEDKMEFSRILEAIKANFNDKYDEYRKKWGGGIMGSKSQAKTRAKEKLLAKEAAQRMN

SEQ ID NO: 8690 - protein, 260 aa, Trigonella foenum-graecum
MAPKRGGKAPVAAAKKKTAEKVVNPLFEKRPKQFGIGGALPPKRDLTRFVKWPKNVQVQRKKRILKQRLKVPPALNQFTKTLDKNLATNLFKMLLKYRPEDKAEKKERLLKRAQAESDGKTVETKKPIVVKYGLNHVTYLIEQNKAQLVVIAHDVDPIELVVWLPALCRKMEIPYCIVKGKARLGTIVHKKTAAVLCLTTVKNEDKMEFSRILEAIKANFNDKFEEYRKKWGGGIMGSKSQAKTKAKERLIAKEAAQRLP

SEQ ID NO: 8691 - protein, 175 aa, Chelidonium majus
MATNVFKMLLKYRPEDKAAKKERLLKRAQAESEGKTVESKKPIVVKYGLNHITYLIEQQKAQLVLIAHDVDPIELVVWLPALCRKQEVPYAIVKGKARLGAIVHKKTASVLCLTSVKNEDKMEFSKIVEAVKANFNDKFDEHRKKWGGGIMGSKSQAKTKAKERLIAKEAAQRMN

SEQ ID NO: 8692 - protein, 257 aa, Flaveria ramosissima
MAPKKGVKAVATKKKTEKVVNPLFEKRPKQFGIGGALPPKKGSSQVCKMASSCSNSKEEEDPQAAFEGPPALNQFTKTLDKNLATTLFKMLLKYRPEDKAAKKERLLKRAQAESEGKTVEAKKPIVVKYGLNHVTYLIEQNKAQLVIIAHDVDPIELVVWLPALCRKMEIPYCIVKGKSRLGAIVHQKTAAALCLTTVKNEDKMEFSRILEAIKANFNDKYDEYRKKWGGGIMGSKSQAKTKAKERVLAKEAAQRMN

SEQ ID NO: 8693 - protein, 92 aa, Papaver somniferum
MAPKRGVKAPVAAKKKTEQVANPCFEKRPKQFGIGGALPPKKDLHRFVKWPKVTRIQRQRRILKQRLKVPPALNQFTKTLDKNLATNLSRCC

SEQ ID NO: 8694 - protein, 190 aa, Picea glauca
MLLKYRPEDKAAKKERLLKKAQAEAEGKTVEVKKPIVVKYGINHVTYLIEQSKAQLVVIAHDVDPIELVVWLPALCRKMNIPYAIVKGKARLGAIVHKKTATALCLTSVKNEDKMEFSKIVEAVKANFNDKFDEYRRQWGGGIMGTKSQAKTKAKENLWPRKRHRGSLKNNSLEYIFMLKFYWIVFCNLL

SEQ ID NO: 8695 - protein, 259 aa, Phaseolus coccineus
MAPKRGVKAAAVAAKKKPEKVTNPLFEKRPKQFGIGGALPPKRDLTRFVKWPKTVQIQRKKRILKQRLKVPPALNQFTKTLDKNLATNLFKMLLKYRPEDKAEKKERLLKRAQAEADGKSVEAKKPIVVKYGLNHVTYLIEQNKAQLVVIAHDVDPIELVVWLPALCRKMEIPYCIVKGKARLGTVVHKKTASVLCLTTVKNEDKMEFSRILEAIKANFNDKYDEYRKKWGGGIMGSKSQAKTRAKERLLAKEAAQRMS

SEQ ID NO: 8696 - protein, 253 aa, Fagus grandifolia
GKLAAAPAKKKPEKVLNPLFEKRPKQFGIGGALPPKRDLHRFVKWPKVVRIQRKKRILKQRLKVPPALNQFTKTLDKNLATNLFKLLLKYRPEDKAAKKERLLKRAQAENEGKTVEAKKPIVVKYGLNHVTYLIEQNKAQLVVIAHDVDPIELVVWLPALCRKMEIPYCIVKGKSRLGAIVHQKTASVLCLTTVKNEDKLEFSKILEAIKANFNDKYDEYRKKWGGGIMGSKSQAKTKAKERLLAKEAAQRMV

SEQ ID NO: 8697 - protein, 258 aa, Manihot esculenta
MAPKRGVKAPALAKKKPEKVVNPLFEKRPKQFGIGGALPPKKDLTRFVKWPHVVRIQRQRRILKQRLKVPPAVNQFTKTLDKNLATQLFKLFLKYRPEDKAAKKERLLKRAQAEAEGKTVESKKPIVVKYGLNHVTYLIEQNKAQLVVIAHDVDPIELVVWLPALCRKMEVPYAIVKGKSRLGAIVHKKTAAALCLTSVKNEDKLEFSKILEAVKANFNDKFDEHRKRWGGGIMGSKSQAKTKAKERLLAKEAAQRMS

SEQ ID NO: 8698 - protein, 258 aa, Manihot esculenta
MAPKRGVKAPVLAKKKPEKVVNPLFEKRPKQFGIGGALPPKKDLTRFVKWPHVVRIQRQRRILKQRLKVPPAVNQFTKTLDKNLATQLFKLLLKYRPEDKAAKKERILKRAQAEAEGKTIESKKPIVVKYGLNHVTYLIEQNKAQLVVIAHDVDPIELVVWLPALCRKMEVPYAIVKGKSRLGAIVHKKTAAALCLTSVKNEDKLEFSKILEAVKANFNDKFDEHRKRWGGGIMGSKSQAKTKAKERLLAKEAAQRMS

SEQ ID NO: 8699 - protein, 258 aa, Manihot esculenta
MAPKRGIKAPVLAKKKPEKVVNPLFEKRPKQFGIGGALPPKKDLTRFVKWPHVVRIQRQRRILKQRLKVPPAVNQFTKTLDKNLATQLFKLLLKYRPEDKAAKKERLVKRAQAEAEGKTVESKKPIVVKYGLNHVTYLVEQNKAQLVVIAHDVDPIELVVWLPALCRKMEVPYAIVKGKSRLGAIVHKKTAAALCLTSVKNEDKLEFSKILEAVKANFNDKFDEHRKRWGGGIMGSKSQAKTKAKERLLAKEAAQRMS

SEQ ID NO: 8700 - protein, 259 aa, Catharanthus roseus
MAPKKGAKLPVSAAKKKPEKVVNPLFEKRPKQFGIGGALPPKKDLTRFVKWPQNVRIQRKKRILRMRLKVPPAINQFAKTLDKNLATSLFKMLLKYRPEDNAAKKERLLKRAQAEADGKTADAKKPIVVKYGLKHVTYLIEQNKAQLVVIAHDVDPIELVVWLPHLCRKMEIPYCIVKGKARLGSIVHKKTASVLCLTSVKNEDKLEFSKILEAIKANFNDKFDEQRKKWGGGVMGSKSQAKTKAKERLLAKEAAQRMS

SEQ ID NO: 8701 - protein, 257 aa, Cucumis sativus
MAPKKAVGKVSAKKKLDKVVNPLFEKRPKQFGIGGALPPKRDLTRFVKWPKVVQIQRKKRILKQRLKVPPALNQFTKTLDKNLATNLFKMLLKYRPEDKTQKRERLLKRAQEEAEGKTLDAKKPIVVKYGLNHVTYLIEQNKAQLVVIAHDVDPIELVVWLPALCRKMEIPYCIVKGKARLGSIVHKKTASVLCLTTVKNEDKLEFSRILEAIKANFNDKYDEYRKKWGGGIMGSKSQAKTKAKERLLAKEAAQRMS

SEQ ID NO: 8702 - protein, 256 aa, Flaveria ramosissima
MAPKKGVKVATKKKTEKVVNPLFEKRPKQFGIGGALPPKKDLHRFVRWPQVVRIQRKRRILKQRLKVPPALNQFTKTLDKNLATNLFKMLLKYRPEDKAAKKERLLKKAQAESEGKTVEAKKPIVVKYGLNHVTYLIEQNKAQLVIIAHDVDPIELVVWLPALCRKMEIPYCIVKGKSRLGAIVHQKTAAALCLTTVKNEDKMEFSRILEAIKANFNDKYDEYRKKWGGGIMGSKSQAKTKAKERVLAKEAAQRMN

SEQ ID NO: 8703 - protein, 257 aa, Flaveria ramosissima
MAPKKGGKPVATKKKTEKVVNPLFEKRPKQFGIGGALPPKKDLHRFVRWPQVVRIQRKRRILKQRLKVPPALNQFTKTLDKNLATTLFKMLLKYRPEDKAAKKDRLQKRAQAESEGKTVEAKKPIVVKYGLNHVTYLIEQNKAQLVIIAHDVDPIELVVWLPALCRKMEIPYCIVKGKSRLGAIVHQKTAAALCLTTVKNEDKMEFSRILEAIKANFNDKYDEYRKKWGGGIMGSKSQAKTKAKERVLAKEAAQRLT

SEQ ID NO: 8704 - protein, 257 aa, Flaveria ramosissima
MAPKKGGKPVATKKKTEKVVNPLFEKRPKQFGIGGALPPKKDLHRFVRWPQVVRIQRKRRILKQRLKVPPALNQFTKTLDKNLATNLFKMLLKYRPEDKAAKKERLQKRAAAEDEGKTVEAKKPIVVKYGLNHVTYLIEQNKAQLVIIAHDVDPIELVVWLPALCRKMEIPYCIVKGKSRLGAIVHQKTAAALCLTTVKNEDKMEFSRILEAIKANFNDKYDEYRKKWGGGIMGSKSQAKTKAKERVLAKEAAQRLN

SEQ ID NO: 8705 - protein, 259 aa, Ipomoea batatas
MVPKKGVKLPVGASKKKPEKVVNPLFEKRPKQFGIGGALPPKRDLTRFVKWPQVVRIQRKRRILKQRLKVPPTLNQFSKTLDKNLATNLFKMLLKYRPEDKAAKKERLLKRAQAESEGKTPEIKKPIVVKYGLKHVTYLVEQNKAQLVVIAHDVDPIELVVWLPALCRKMEIPYCIVKGKARLGSIVHKKTASVLCLTSVKNEDKLEFSKILEAIKANFNDKYDENRKKWGGGIMGSKSQARTKAKERVLAKEAAQRMS

SEQ ID NO: 8706 - protein, 257 aa, Actinidia deliciosa
MAPKKGVKPVVAKKKPDKVVNPLFEKRPKQFGIGGALPPKKDLHRFVKWPKVVQIQRKRRILNQRLKVPPPLNQFTKTLDKNLATSLFKMLLKYRPEDRAAKKERLLKRAQAEAEGKPVEAKKPIVVKYGLNHVTYLIEQNKAQLVVVAHDVDPIELVVWLPALCRKMEIPYCIVKGKSRLGTIVHQKTAAVLCLTTVKNEDKMEFSKILEAIKANFNDKYDEYRKKWGGGIMGSKSQAKTKAKERVLAKEAAQRMS

SEQ ID NO: 8707 - protein, 258 aa, Lactuca sativa
MAPKKGGKAVATKKKTAEKVVNPLFEKRPKQFGIGGALPPKKDLHRFVRWPQVVRIQRKRRILKQRLKVPPALNQFTKTLDKNLATTLFKMLLKYRPEDKAAKKERLLKRAQAETEGKTVEAKKPIVVKYGLNHITYLIEQNKAQLVVIAHDVDPIELVVWLPALCRKMEIPYCIVKGKSRLGTIVHQKTAAALCLTTVKNEDKMEFSRILEAIKANFNDKYEEYRKKWGGGIMGSKSQAKTKAKERVLAKEAAQRLN

SEQ ID NO: 8708 - protein, 258 aa, Papaver somniferum
MAPKKGVKTPVAAKKKSEKVVNPLFERRPKQFGIGGALPPKKDLHRFVKWPKVVRIQRQRRILKQRLKVPPALNQFTKTLDKNLATNLFKMLLKYRPEDKAAKKERLLKRAQAESEGKTVEAKKPIVVKYGLNHITYLIEQNKAQMVVIAHDVDPIELVVWLPALCRKMEIPYAIVKGKARLGAIVHKKTASALCLTSVKNEDKMDFSKIVEAIKANFNDKFDEHRKKWGGGIMGSKSQAKSKAKERVLAKEQAQRNN

SEQ ID NO: 8709 - protein, 258 aa, Primula obconica
MAPKKGIKPAAAAKRKTVKVVNPLFEKRPKQFGIGGALPPKKDLHRFVKWPKVVQIQRKRRILNQRLKVPPPLNQFTKTLDKNLATSLFKMLLKYRPEDRAAKKERLLKRAQAETEGKTVEAKKPIVVKYGLNHVTYLIEQNKAQLVVIAHDVDPIELVVWLPALCRKMEIPYCIVKGKARLGTIVHQKTASVLCLTTVKNEDKMDFSKILEAIKANFNDKYDEYRKKWGGGIMGSKSQAKTKAKERVLAKEAAQRMN

SEQ ID NO: 8710 - protein, 258 aa, Pseudotsuga menziesii
MAPKRGVKAPVAAKKKVPKVVNPLFEKRTKQFGIGGSLPPKRDLHRFVKWPKVVRIQRQRRVLKQRLKVPPALNQFTKTLDKNLASNLFKMLLKYRPEDKAAKKERLLKKAQAEAEGKTVEVKKPIVVKYGINHITYLIEQSKAQLVVIAHDVDPIELVVWLPALCRKMNIPYAIVKGKARLGAIVHKKTATALCLTSVKNEDKMEFSKIVEAIKANFNDKFDEYRRQWGGGIMGTKSQAKTKAKEKVLAKEAAQRLT

SEQ ID NO: 8711 - protein, 258 aa, Valeriana officinalis
MAPKRGVKQPVAAAKKKSDKIVNPLFEKRPKQFGIGGALPPKKDLHRYVKWPQVVRIQRKRRILKQRLKVPPALNQFTKTLDKNLATSLFKMLLKYRPEDKAAKKERLIKRAQAESEGKAPEAKKPIVVKYGLNHVTYLIEQNKAQLVVIAHDVDPIELVVWLPALCRKMEIPYCIVKGKARLGAIVHQKTASVLCLTTVKNEDKMDFSKILEAIKANFNDKYEENRKKWGGGIMGSKSQAKTKAKERVLAKEAAQRA

SEQ ID NO: 8712 - protein, 259 aa, Coffea canephora
MAPKRGARAPAAVARRKTEKVANPLFEKRPKQFGIGGALPPKKDLTRFVKWPLNVRIQRKKRILRQRLKVPPALNQFSKTLDKNLATNLFKMLLKYRPEDKAAKKERLLKRAQAEAEGKASDAKKPIVVKYGLKHVTYLVEQNKAQLVVIAHDVDPIELVVWLPALCRKMEIPYCIVKGKSRLGAIVHKKTASVLCLTSVKNEDKLEFSKILEAIKANFNDKYEEYRKKWGGGVMGSKSQAKTKAKEKLLQKEAAQRMS

SEQ ID NO: 8713 - protein, 139 aa, Papaver somniferum
MAPKKGVKTPVAAKKKSEKVANPLFERRPRQYGIGGALPPKKDLHRFVKWPKVVRIQRQRRILKQRLKVPPALNQFTKTLDKNLATNLFKMLLKYRPEDKAAKKERLLKRAQAESEGKTVEAKKPIVVKYGLNHIYLPH

SEQ ID NO: 8714 - protein, 259 aa, Amsonia hubrichtii
MAPKKGAKLPVSAAKKKPEKVVNPLFEKRPKQFGIGGALPPKKDLTRFVKWPQNVRIQRKKRILKMRLKVPPALNQFSKTLDKNLATSLFKMLLKYRPEDNAVKKERLLKRAQAEAEGKTSDVKKPIVVKYGLKHVTYLVEQNKAQLVVIAHDVDPIELVVWLPLLCRKMEIPYCIVKGKARLGSIVHKKTASVLCLTSVKNEDKLEFSKILEAIKANFNDKFDEQRKKWGGGVMGSKSLAKTKAKERLLAKEAAQRMS

SEQ ID NO: 8715 - protein, 257 aa, Aquilegia formosa
MAPKKGAKAVATKKKPEKVVNPLFEKRPKQFGIGGALPPKKDLHRFVKWPKVVRIQRQRRILKQRLKVPPALNQFTKTLDKSLATTLFKMLLKYRPEDKAAKKERLVKRAQAEAEGKTIESKKPIVVKYGLNHITYLIEQNKAQLVVIAHDVDPIELVVWLPALCRKMEIPYVIVKGKARLGAVVHKKTAAALCLTSVKNEDKMEFSRIVEAIKANFNDKYDENRKKWGGGIMGSKSQAKTKAKERLLAKEAAQRMN

SEQ ID NO: 8716 - protein, 258 aa, Ocimum basilicum
MAPKKGAKLPVAAKKKVEKVVNPLFEKRPKQFGIGGALPPKKDLHRFVRWPQVVRIQRKKMILKQRLKVPPPIHQFSKTLDKNLATSLFKMLLKYRPEDRAQKKERLLKRAQAEAEGKTPETKKPIVVKYGLNHVTYLIEQNKAQLVVIAHDVDPIELVVWLPALCRKMEIPYCIVKGKARLGSIVHKKTASVLCLTSVKNEDKMEFSKILEAIKANFNDKYDETRKKWGGGVMGSKSQARTKAKERVLAKEAAQRMT

SEQ ID NO: 8717 - protein, 259 aa, Phaseolus coccineus
MAPKRGGKAPALAAKKKPEKVTNPLFEKRPKQFGIGGALPPKRDLTRFVKWPKTVQIQRKKRILKQRLKVPPALNQFTKTLDKNLATSLFKILLKYRPEDKAEKKERLLKRAQAEAEGKTIEAKKPINVKYGLNHVTYLIEQNKAQLVVIAHDVDPIELVVWLPALCRKMEIPYCIVKGKARLGTVVHKKTASVLCLTTVKNEDKLEFSRVLEAIKANFNDKYDEYRKKWGGGIMGSKSQAKTRAKERLLAKEAAQRMS

SEQ ID NO: 8718 - protein, 257 aa, Cucurbita pepo
MAPKKAVGKVSAKKKPVKVVNPLFEKRPKQFGIGGALPPKRDLTRFVKWPKAVQIQRKKRILKQRLKVPPALNQFTKTLDKNLATNLFKMLLKYRPEDKAQKRERLLKRAQEEAEGKSHDAKKPIVVKYGLNHVTYLIEQNKAQLVVIAHDVDPIELVVWLPALCRKMEIPYCIVKGKARLGAIVHQKTASVLCLTTVKNEDKLEFSRILEAIKANFNDKYDEYRKKWGGGIMGSKSQAKTKAKERLLAKEAAQRMS

SEQ ID NO: 8719 - protein, 258 aa, Eucalyptus grandis
MGPKKGGKAPVAAKKKQEKVTNPLFEKRQKQFGIGGALPPKRDLTRFVKFPKTVQIQRKRRILRQRLKVPPALNQFTKTLDKNLATSLFKMLLKYRPEDKAAKKERLLKKAQVEAEGKSVEAKKPIVVKYGLNHVTYLIEQNKAQLVVIAHDVDPIELVVWLPALCRKMEIPYCIVKGKARLGTIVHKKTASVLCLTTVKNEDKLEFSKILEAIKANFNDKYDEYRKKWGGGIMGSKSQAKTKAKERVIAKEVAQRMT

SEQ ID NO: 8720 - protein, 256 aa, Flaveria ramosissima
MAPKKGGKPVATKKKTEKVVNPLFEKRPKQFGIGGALPPKKDLHRFVRWPQVVRIQRKRRILKQRLKVPPALNQFTKTLDKNLATNLFKMLLKYRPEDKAAKKERLQKRAAAENDGKTVEAKKPIVVKYGLNHVTYLIEQNKAQLVIIAHDVDPIELVVWLPALCRKMEIPYCIVKGKSRLGAIVHQKTAAALCLTTVKNEDKMEFSRILEAIKANFNDKYDEYRKKWGGGIMGSKSQAKTKAKERVLAKEAAQRL

SEQ ID NO: 8721 - protein, 256 aa, Flaveria ramosissima
MAPKKGVKVATKKKTEKVVNPLFEKRPKQFGIGGALPPKKDLHRFVRWPQVVRIQRKRRILKQRLKVPPALNQFTKTLDKNLATTLFKMLLKYRPEDKAAKKERLLKRAQAESEGKTAEAKKPIVVKYGLNHVTYLIEQNKAQLVIIAHDVDPIELVVWLPALCRKMEIPYCIVKGKSRLGAIVHQKTAAALCLTTVKNEDKMEFSRILEAIKANFNDKYDEYRKKWGGGIMGSKSQAKTKAKERVLAKEAAQRMN

SEQ ID NO: 8722 - protein, 257 aa, Flaveria ramosissima
MAPKKGGKPVATKKKTEKVVNPLFERRPKQFGIGGALPPKKDLHRFVRWPQVVRIQRKRRILKQRLKVPPALNQFTKTLDKNLATTLFKMLLKYRPEDKAAKKDRLQKRAQAESEGKTVEAKKPIVVKYGLNHVTYLIEQNKAQLVIIAHDVDPIELVVWLPALCRKMEIPYCIVKGKSRLGTIVHQKTAAALCLTTVKNEDKMEFSRILEAIKANFNDKYDEYRKKWGGGIMGSKSQAKTKAKERVLAKEAAQRLT

SEQ ID NO: 8723 - protein, 256 aa, Flaveria ramosissima
MAPKKGGKPVATKKKTKVVNPLFEKRPKQFGIGGALPPKKDLHRFVRWPQVVRIQRKRRILKQRLKVPPALNQFTKTLDKNLATNLFKMLLKYRPEDKAAKKERLQKRAAAENEGKTVEAKKPIVVKYGLNHVTYLIEQNKAQLVIIAHDVDPIELVVWLPALCRKMEIPYCIVKGKSRLGAIVHQKTAAALCLTTVKNEDKMEFSRILEAIKANFNDKYDEYRKKWGGGIMGSKSQAKTKAKERVLAKEAAQRLN

SEQ ID NO: 8724 - protein, 257 aa, Lactuca sativa
MAPKKGGKAVATKKKTEKVANPLFEKRPKQFGIGGALPPKKDLHRFVRWPQVVRIQRKRRILKQRLKVPPALNQFTKTLDKNLATTLFKMLLKYRPEDKAAKKERLLKRAQAESEGKTVEAKKPIVVKYGLNHITYLIEQNKAQLVIIAHDVDPIELVVWLPALCRKMEIPYCIVKGKSRLGTIVHQKTAAALCLTTVKNEDKMEFSRILEAIKANFNDKYEEYRKKWGGGIMGSKSQAKTKAKERVLAKEAAQRLT

SEQ ID NO: 8725 - protein, 258 aa, Podocarpus macrophillus
MAPKRGVKAPVAAKKKVPKVVNPLFEKRPKQFGIGGALPPKKDLHRFVKWPKVVRIQRQRRILKQRLKVPPALNQFTKTLDKNLASNLFKMLLKYRPEDKAAKRERLLKRAQTEASGGTVEVKKPIVVKYGINHVTYLIEQSKAQLVVIAHDVDPIELVVWLPALCRKMNIPYCIVKGKARLGTIVHKKNATALCLTSVKNEDKMEFSRIVEAVKANFNDKFDEYRRQWGGGIMGTKSQAKTKAREKLLAREAAQRLT

SEQ ID NO: 8726 - protein, 258 aa, Populus trichocarpa
MAPKRGVKAPLAAKKKPEKVVNPLFEKRPKQFGIGGALPPKKDLTRFVKWPHVVRIQRQRRILKQRLKVPPAVNQFTKTLDKNLATQLFKLLLKYRPEDKAAKKERLLKRAQAAEEGKTVESKKPIVVKYGLNHVTYLIEQNKAQLVVIAHDVDPIELVVWLPALCRKMEVPYAIVKGKSRLGAIVHKKTASVLCLTSVKNEDKLEFSKVLEAVKANFNDKFDEHRKKWGGGIMGSKSLAKTKAKERVLAKEAAQRMS

SEQ ID NO: 8727 - protein, 259 aa, Populus trichocarpa
MAPKRGGKGPVVAGKKKPEKVPNPLFEKRPKQFGIGGALPPKRDLSRFVKMPKMVQIQRQRRILKMRLKVPPTVNQFTKTLDKNLASNLFKMLLKYRPEDKAAKKERLLRKAQAETEGKTVEAKKPIVVKYGLNHVTYLIEQKKAQLVVIAHDVDPIELVVWLPALCRKMEIPYCIVKGKSRLGAIVHKKTASVLCLTTVKNEDKLEFSRILEAIKANFNDKYDEYRKKWGGGIMGSKSQAKSKAKDKVLAKEAAQRMT

SEQ ID NO: 8728 - protein, 256 aa, Helianthus annuus
MAPKKGVKLATKKKTEKVVNPLFEKRPKQFGIGGALPPKKDVHRFVRWPQVVRIQRKRRILKQRLKVPPALNQFTKTLDKNLATNLFKMLLKYRPEDKAAKKERLLKKAQAESEGKTVEAKKPIVVKYGLNHVTYLIEQNKAQLVIIAHDVDPIELVVWLPALCRKMEIPYCIVKGKSRLGAIVHQKTAAALCLTTVKNEDKMEFSRILEAIKANFNDKYDEYRKKWGGGIMGSKSQAKTKAKERVLAKEAAQRMN

SEQ ID NO: 8729 - protein, 255 aa, Helianthus annuus
MAPKKGVKLATKKKTEKVVNPLFEKRPKQFGIGGALPPKKDVHRFVRWPQVVRIQRKRRILKQRLKVPPALNQFTKTLDKNLATNLFKMLLKYRPEDKAAKKERLLKKAQAESEGKTVEAKKPIVVKYGLNHVTYLIEQNKAQLVIIAHDVDPIELVVWLPALCRKMEIPYCIVKGKSRLGAIVHQKTAAALCLTTVKNEDKMEFSRILEAIKANFNDKYDEYRKKWGGGIMGSKSQAKTKAKERVLAKEAAQRM

SEQ ID NO: 8730 - protein, 259 aa, Tabernaemontana elegans
MAPKKGAKLPASVAKKKTEKVVNPLFEKRPKQFGIGGALPPKKDLTRFIKWPQVVRIQRKRRILRQRLKVPPAINQFSKTLDKNLATNLFKMLLKYRPEDKAAKKERLLKRAQAEAEGKTSEVKKPIVVKYGLKHVTYLVEQNKAQLVVIAHDVDPIELVIWLPHLCRKMEIPYCIVKGKSRLGAIVHKKTASVLCLTSVKNEDKLEFSKILEAIKANFNDKFDENRKKWGGGIMGSKSQAKTKAKERLLAKEAAQRMS

SEQ ID NO: 8731 - protein, 257 aa, Tragopogon dubius
MAPKKGGKPIATKKKTEKVVNPLFEKRPKQFGIGGALPPKKDLHRFVRWPQVVRIQRKRRILKQRLKVPPALNQFTKTLDKNLATTLFKMLLKYRPEDKAAKKERLLKRAQAESEGKTTEAKKPIVVKYGLNHVTYLIEQNKAQLVIIAHDVDPIELVVWLPALCRKMEIPYCIVKGKSRLGTIVHQKTAAALCLTTVKNEDKMEFSRILEAIKANFNDKYEEYRKKWGGGIMGSKSQAKTKAKERVLAKEAAQRMN

SEQ ID NO: 8732 - protein, 257 aa, Tragopogon dubius
MAPKKGGKAVATKKKTEKVVNPLFEKRPKQFGIGGALPPKKDLHRFVRWPQVVRIQRKRRILKQRLKVPPALNQFTKTLDKNLATTLFKMLLKYRPEDKAAKKERLLKRAQAESEGKTAESKKPIVVKYGLNHVTYLIEQNKAQLVVIAHDVDPIELVVWLPALCRKMEIPYCIVKGKSRLGTIVHQKTAAALCLTTVKNEDKMEFSRILEAIKANFNDKYEEYRKKWGGGIMGSKSQAKTKAKERVLAKEAAQRMN

SEQ ID NO: 8733 - protein, 259 aa, Tripterygium wilfordii
MAPKRGGKLAATSAKKKTEKVVNPLFEKRPKQFGIGGALPPKKDLTRFVKWPKVVRIQRKKRILKQRLKVPPALNQFTKTLDKNLASSLFKLLLKYRPEDKAAKKERLLKKAQAEAEGKTVEAKKPIVVKYGLNHVTYLIEQNKAQLVVIAHDVDPVELVVWLPALCRKMEIPYCIVKGKSRLGTIVHKKTAAALCLTTVKNEDKLEFSKILEAIKANFNDKYDEYRKKWGGGIMGSKSQAKSKAKERLLAKEAAQRMN

SEQ ID NO: 8734 - protein, 345 aa, Ricinus communis
MSFSFFKPSRPKTPLEVVKAMKDSLMALDTKTVVEVKALEKALEEVEKNVVAMRCLLCGDGEVEPNTDQVSQLVLEVCKEDVLALMIHKLPNLGWEARKDLVHCWSVLLKQKVDSKYCSVEYIENHFELLDFLVVCYDNKEIALNCGLMLRECIKFSSLAKYILESASFELFFKFVELPNFDVASDAFSTFKDLLIKHDTVVAEYLTAHYDEFFDLYEKLLTSPNYVTRRQSLKLLSDFLLEPPNSHIMKRYILEVRYLKVMMTLLKDSSKNIQISAFHIFKVFVANPNKPREVKVILAKNNERLVELLNDLSVGKGAEDEQFEEEKELIIKEIKRLSRQPGADS

SEQ ID NO: 8735 - protein, 114 aa, Catharanthus roseus
MAPKKGAKLPVSAAKKKPEKVVNPLFEKRPKQFGIGGALPPKKDLTRFVKWPQNVRIQRKKRILRMRLKVPPAINQFSKTLDKNLASSLFKMLLKYRPEDNAAKKERLLEKSSS

SEQ ID NO: 8736 - protein, 86 aa, Lippia dulcis
MAPKKGAKLPVAAKKKVEKVVNPLFEKRPKQFGIGGALPPKKDLHRFVRWPQVVRIQRKKMILKQRLKVPPPIHQFSKNIGQEFGD

SEQ ID NO: 8737 - protein, 155 aa, Sarracenia psittacina
MAPKKGVKPVAAAKKKPEKVVNPLFEKRPKQFGIGGALPPKKDLHRFVKWPKVVQIQRKRRILCQRLKVPPSLNQFTKTLDKNLATNLFKMLLKYRPEDKAAKKERLLKAAQAQAEGNLSSLKSLLLLNMVSTMSPTSLSRIKHSWLSLLTMWTQ

SEQ ID NO: 8738 - protein, 72 aa, Sorghum bicolor
MGSKSQDKPRPGKSCAADDLSHALLNLSCTPCELRSCAILVVVRSSFESFAPETDLARKTSCKNSKFLFFTT

SEQ ID NO: 8739 - protein, 168 aa, Tragopogon dubius
MLLKYRPEDKAAKKERLLKRAQAESEGKTAESKKPIVVKYGLNHITYLIEQNKAQLVIIAHDVDPIELVVWLPALCRKMEIPYCIVKGKSRLGTIVHQKTAAALCLTTVKNEDKMEFSRILEAIKANFNDKYEEYRKKWGGGIMGSKSQAKTKAKERVLAKEAAQRMT

SEQ ID NO: 8740 - protein, 257 aa, Ambrosia trifida
MAPKKGGKPVATKKKTEKVVNPLFEKRPKQFGIGGALPPKKDVHRFVRWPQVVRIQRKRRILKQRLKVPPALNQFTKTLDKNLATNLFKMLLKYRPEDKAAKKERLVKKAQAESEGKTIETKKPIVVKYGLNHVTYLIEQNKAQLVIIAHDVDPIELVVWLPALCRKMEIPYCIVKGKSRLGAIVHQKTAAALCLTTVKNEDKMEFSRILEAIKANFNDKYDEYRKKWGGGIMGSKSQAKTKAKERVLAKEAAQRMN

SEQ ID NO: 8741 - protein, 259 aa, Amsonia hubrichtii
MAPKKGAKLPASAAKKKPEKVVNPLFEKRPKQFGIGGALPPKKDLTRFVKWPQVVRIQRKRRILRQRLKVPPAINQFSKTLDKNLATSLFKMLLKYRPEDKAAKKERLLKRAQAEAEGKTPEAKKPIVVKYGLKHVTYLVEQNKAQLVVIAHDVDPIELVVWLPHLCRKMEIPYCIVKGKSRLGAIVHQKTASVLCLTSVKNEDKMEFSKILEAIKANFNDKFDENRKKWGGGIMGSKSQAKSKAKERVLAKEAAQRMS

SEQ ID NO: 8742 - protein, 257 aa, Arnica chamissonis
MAPKKGGKPVVTKKKTEKVVNPLFEKRPKQFGIGGALPPKKDVHRFVRWPQVVRIQRKRRILKQRLKVPPALNQFTKTLDKNLATNLFKMLLKYRPEDKAAKKDRLQKKALAESEGKTVEAKKPIVVKYGLNHVTYLIEQNKAQLVIIAHDVDPIELVVWLPALCRKMEIPYCIVKGKSRLGAIVHQKTASALCLTTVKNEDKMEFSRILEAIKANFNDKYDEYRKKWGGGIMGSKSQAKTKAKERVLAKEASQRMT

SEQ ID NO: 8743 - protein, 258 aa, Vaccinium corymbosum
MAPKKGIKPAAAAKKKPEKVVNPVYEKRPKQFGIGGALPPKRDLHRFVKWPKVVQIQRKKRILNQRLKVPPPLNQFTKTLDKNLATSLFKMLLKYRPEDKAAKKERLLKRAQAETEGKPIEAKKPIVVKYGLNHVTYLIEQNKAQLVVIAHDVDPIELVVWLPALCRKMEIPYCIVKGKARLGSIVHQKTAAVLCLTTVKNEDKLEFSKILEAIKANFNDKYDEYRKKWGGGIMGSKSQAKTKAKERLLAKEVAQRMG

SEQ ID NO: 8744 - protein, 258 aa, Ricinus communis
MAPKRGVKAPVLAKKKPEKVVNPLFEKRPKQFGIGGALPPKKDLTRFVKWPHVVRIQRQRRILKQRLKVPPAVNQFTKALDKNLATQLFKLLLKYRPEDKAAKKERLLQRAQAEAEGKSVESKKPIVVKYGLNHITYLIEQNKAQLVVIAHDVDPIELVVWLPALCRKMEVPYAIVKGKSRLGAIVHKKTAAALCLTSVKNEDKLEFSKILEAVKANFNDKFDEHRKRWGGGIMGSKSQAKTKAKERVLAKEAAQRMT

SEQ ID NO: 8745 - protein, 258 aa, Cephalotaxus harringtonia
MAPKRGVKAPTAAKKKIAKVVSPLFEKRPKQFGIGGALPPKKDLHRFVKWPKIIRIQRQRRILKQRLKVPPALNQFTKTLDKNLASNLFKMLLKYRPEDKAAKKERLLKKAQAEAEGKPIEVKKPIVVKYGINHVTYLVEQSKAQLVVIAHDVDPIELVVWLPALCRKMNIPYCIIKGKARLGAIVHKKTATALCLTSVKNEDKMEFSRIVEAIKANFNDKFDEYRRQWGGGLMGSKSQAKTKAKEKLLAKEAAQRLT

SEQ ID NO: 8746 - protein, 257 aa, Cichorium intybus
MAPKKGGKAVATKKKTEKVVNPLFEKRPKQFGIGGALPPKKDLHRFVRWPQVVRIQRKRRILKQRLKVPPALNQFTKTLDKNLATTLFKMLLKYRPEDKAAKKERLIKRAQAESEGKTAEAKKPIVVKYGLNHITYLIEQNKAQLVVIAHDVDPIELVVWLPALCRKMEIPYCIVKGKSRLGTIVHQKTAAALCLTTVKNEDKMEFSRILEAIKANFNDKYDEYRKKWGGGIMGSKSQAKTKAKERVLAKEAAQRLN

SEQ ID NO: 8747 - protein, 259 aa, Unknown
  Sequence found in Organisms: Gossypium hirsutum, Gossypium raimondii
MGPKRGGKVVALAKKKQPEKDVNPLFEKRPKQFGIGGALPPKKDLHRFVKWPKVVRIQRKKRILKQRLKVPPALNQFTKTLDKNLATSLFKLLLKYRPEDKAAKKERLLKKAQAEAEGKSAESKKPIVVKYGLNHVTYLIEQNKAQLVVIAHDVDPIELVVWLPALCRKMEVPYCIVKGKSRLGSIVHKKTAAVLCLTTVKNEDKLEFSRVLEAIKANFNDKYEENRKKWGGGVMGSKSQARTKAKEKLLAKEAAQRMT

SEQ ID NO: 8748 - protein, 259 aa, Vigna unguiculata
MAPKRGGKAPVLASKKKPEKVTNPLFEKRPKQFGIGGALPPKRDLTRFVKWPKTVQIQRKKRILKQRLKVPPALNQFTKTLDKNLATSLFKILLKYRPEDKAEKKERLLKRAQAEAEGKTIEAKKPINVKYGLNHVTYLIERSGARLVVIAHDVDPIELVVWLPALCRKMEIPYCIVKGKARLGTVVHKKTASVLCLTTVKNEDKLEFSRVLEAIKANFNDKYDEYRKKWGGGIMGSKSQAKTRAKEKLIAKEAAQRMS

SEQ ID NO: 8749 - protein, 257 aa, Cucurbita pepo
MAPKKAVGKALAKKKPEKVVNPLFEKRPKQFGIGGALPPKRDLTRFVKWPKAVQIQRKKRILKQRLKVPPALNQFTKTLDKNLATNLFKMLLKYRPEDKAQKRERLLKRAQEEAEGKAHDAKKPIVVKYGLNHVTYLIEQNKAQLVVIAHDVDPIELVVWLPALCRKMEIPYCIVKGKARLGAIVHQKTASVLCLTTVKNEDKLEFSRILEAIKANFNDKYDEYRKKWGGGIMGSKSQAKTKAKERLLAKEAAQRMS

SEQ ID NO: 8750 - protein, 257 aa, Cucurbita pepo
MAPKKAVGKALAKKKAEKVVNPLFEKRPKQFGIGGALPPKRDLTRFVKWPKAVQIQRKKRILKQRLKVPPALNQFTKTLDKNLATNLFKMLLKYRPEDKAQKRERLIKRAQEEAEGKPHDAKKPIVVKYGLNHVTYLIEQNKAQLVVIAHDVDPIELVVWLPALCRKMEIPYCIVKGKARLGAIVHQKTASVLCLTTVKNEDKLEFSRILEAIKANFNDKYDEYRKKWGGGIMGSKSQAKTKAKERLLAKEAAQRMS

SEQ ID NO: 8751 - protein, 257 aa, Cynara scolymus
MGPKKAGKPVATKKKTEKVVNPLFEKRPKQFGIGGALPPKKDVHRFVRWPQVVRIQRKRRILKQRLKVPPALNQFTKTLDKNLATTLFKMLLKYRPEDKAAKKERLLKRAQAESEGKTAEAKKPIVVKYGLNHVTYLIEQNKAQLVVIAHDVDPIELVVWLPALCRKMEIPYCIVKGKSRLGAIVHQKTAAALCLTTVKNEDKMEFSRILEAIKANFNDKYEEYRKKWGGGIMGSKSQAKTKAKERVLAKEAAQRLT

SEQ ID NO: 8752 - protein, 259 aa, Euonymus alatus
MAPKRGGKLAATSAKKKTEKVVNPLFEKRPKQFGIGGALPPKKDLTRFVKWPKVVRIQRKKRILKQRLKVPPALNQFTKTLDKNLASSLFKLLLKYRPEDKAAKKERLLKKAQAEAEGKTVEAKKPIVVKYGLNHVTYLIEQNKAQLVVIAHDVDPVELVVWLPALCRKMEIPYCIVKGKSRLGTIVHKKTAAALCLTTVKNEDKLEFSKILEAIKANFNDKYDEYRKKWGGGIMGSKSQAKSKAKERLIAKEAAQRMN

SEQ ID NO: 8753 - protein, 258 aa, Linum usitatissimum
MAPKRGVKAPVASKKKTEKVVNPLFEKRPKQFGIGGALPPKRDLTRFVKWPHVVRIQRQRRILKQRLKVPPAVNQFTKALDKNLATQLFKLLLKYRPEDKAAKKERLLKKAQAEAEGKTVESKKPIVVKYGLNHVTYLIEQNKAQLVIIAHDVDPIELVVWLPALCRKMEVPYAIVKGKSRLGAIVHKKTAAALCLTSVKNEDKMEFSKILEAVKANFNDKFDEHRKRWGGGIMGSKSQAKTKAKERLLAKEAAQRMT

SEQ ID NO: 8754 - protein, 258 aa, Actinidia deliciosa
MAPKKGVKTVAAAKKKPEKVVNPLFEKRPKQFGIGGALPPKKDLHRFVKWPKVVQIQRKRRILNQRLKVPPPLNQFTKTLDKNLATSLFKMLLKYRPEDRAAKKERLLKRAQAEAEGKPIEAKKPIVVKYGLNHVTYLIEQNKAQLVIIAHDVDPIELVVWLPALCRKMEIPYCIVKGKSRLGTIVHQKTAAVLCMTTVKNEDKLEFSKILEAIKANFNDKYDEYRKKWGGGIMGSKSQAKTKAKERVLAKEAAQRMN

SEQ ID NO: 8755 - protein, 258 aa, Populus trichocarpa
MAPKRGVKAPLAAKKKPEKVVNPLFEKRPKQFGIGGALPPKKDLTRFVKWPHVVRIQRQRRILKQRLKVPPAVNQFTKTLDKNLATQLFKLFLKYRPEDKAAKKERLLKRAQAEAEGKTVETKKPIVIKYGLNHVTYLIEQNKAQLVVIAHDVDPIELVVWLPALCRKMEVPYAIVKGKSRLGAIVHKKTASVLCLTSVKNEDKLEFSKVLEAVKANFNDKFDEHRKKWGGGIMGSKSLAKTKAKERVIAKEAAQRMS

SEQ ID NO: 8756 - protein, 258 aa, Populus trichocarpa
MAPKRGVKAPLAAKKKPEKVVNPLFEKRPKQFGIGGALPPKKDLTRFVKWPHVVRIQRQRRILKQRLKVPPAVNQFTKTLDKNLATQLFKLLLKYRPEDKAAKKERLLKRAQAAEEGKTVESKKPIVVKYGLNHVTYLIEQNKAQLVVIAHDVDPIELVVWLPALCRKMEVPYAIVKGKSRLGAIVHKKTASVLCLTSVKNEDKLEFSKVLEAVKANFNDKFDEHRKKWGGGIMGSKSLAKTKAKERVIAKEAAQRMS

SEQ ID NO: 8757 - protein, 258 aa, Sesamum indicum
MAPKKGAKLPAAAKKKVEKVVNPLFEKRPKQFGIGGALPPKKDLHRFVKWPQVVRIQRKKMILKQRLKVPPPIHQFSKTLDKNLATSLFKMLLKYRPEDRAQKKERLLKRAQAEAEGKTPEVKKPIVVKYGLNHVTYLIEQNKAQLVVIAHDVDPIELVVWLPALCRKMEIPYCIVKGKARLGTIVHKKTASVLCLTSVKNEDKLEFSKILEAIKANFNDKYDEMRKKWGGGVMGSKSQAKTKAKERLLAKEAAQRMS

SEQ ID NO: 8758 - protein, 257 aa, Helianthus annuus
MAPKKGVKAVATKKKTEKVVNPLFEKRPKQFGIGGALPPKKDVHRFVRWPQVVRIQRKRRILKQRLKVPPALNQFTKTLDKNLATTLFKMLLKYRPEDKAAKKERLLKRAQAESDGKTVEAKKPIVVKYGLNHITYLIEQNKAQLVIIAHDVDPIELVVWLPALCRKMEIPYCIVKGKSRLGAIVHQKTAAALCLTTVKNEDKMEFSRILEAIKANFNDKYDEYRKKWGGGIMGSKSQAKTKAKERVLAKEAAQRMN

SEQ ID NO: 8759 - protein, 256 aa, Helianthus annuus
MAPKKGVKLATKKKTEKVVNPLFEKRPKQFGIGGALPPKKDVHRFVRWPQVVRIQRKRRILKQRLKVPPALNQFTKTLDKNLATNLFKMLLKYRPEDKAAKKERLLKKAQAESEGKTVEAKKPIVVKYGLNHVTYLIEQNKAQLVIIAHDVDPIELVVWLPALCRKMEIPYCIVKGKSRLGAIVHQKTAAALCLTTVKNEDKMEFSRILEAIKANFNDKYDEYRKKWGGGIMGSKSQAKTKAKERVLAKEVAQRMN

SEQ ID NO: 8760 - protein, 259 aa, Tabernaemontana elegans
MAPKKGAKLPVSAAKKKPEKVVNPLFEKRPRQFGIGGALPPKKDLTRFVKWPQNVRIQRKKRILRMRLKVPPALNQFSKTLDKNLATSLFKMLLKYRPEDTAAKKERLLKRAQAEAEGKTSDVKKPIVVKYGLKHVTYLVEQNKAQLVVIAHDVDPIELVVWLPHLCRKMEIPYCIVKGKARLGSIVHKKTASVLCLTSVKNEDKLEFSKILEAIKANFNDKFDEQRKKWGGGVMGSKSQARTKAKERLLAKEAAQRMS

SEQ ID NO: 8761 - protein, 258 aa, Tripterygium wilfordii
MAPKRGVKAPSAAKKKQETVANPLFEKRPKQFGIGGALPPKRDLTRFVKWPKVVQIQRRKRILKMRLKVPPALNQFTKTLDKNLASNLFKMLLKYRPEDKTSKKERLLKKAQAEAEGKSAETKKPIVVKYGLNHVTYLVEQNKAQLVVIAHDVDPIELVVWLPALCRKMEIPYCIVKGKSRLGSIVHKKTASVLCLTTVKNEDKLEFSRILEAIKANFNDKYDEYRKKWGGGIMGSKSQAKSKAKERVLAKEAAQRMT

SEQ ID NO: 8762 - protein, 258 aa, Valeriana officinalis
MAPKKGVKLSAVAAKKKLDKVVNPLFEKRPKQFGIGGALPPKKDLHRFVKWPQVVRIQRKRRILKQRLKVPPALNQFTKTLDKNLATSLFKMLLKYRPEDKAAKKERLIKRAQAESEGKAPEAKKPIVVKYGLNHVTYLIEQNKAQLVVIAHDVDPIELVVWLPALCRKMEIPYCIVKGKARLGAIVHQKTASVLCLTTVKNEDKMDFSRILEAIKANFNDKYEENRKKWGGGIMGSKSQAKTKAKEKILAKEAAQRA

SEQ ID NO: 8763 - protein, 257 aa, Valeriana officinalis
APKRGVKQPVAAAKKKSDKIVNPLFEKRPKQFGIGGALPPKKDLHRYVKWPQVVRIQRKRRILKQRLKVPPALNQFTKTLDKNLATSLFKMLLKYRPEDKAAKKERLIKRAQAESEGKAPEAKKPIVVKYGLNHVTYLIEQNKAQLVVIAHDVDPIELVVWLPALCRKMEIPYCIVKGKARLGAIVHQKTASVLCLTTVKNEDKMDFSRILEAIKANFNDKYEENRKKWGGGIMGSKSQAKTKAKERVLAKEAAQRA

SEQ ID NO: 8764 - protein, 168 aa, Nicotiana benthamiana
MLLKYRPEDKAAKKERLLKRAQAEAEGKTPETKKPIIVKYGLKHITYLIEQNKAQLVVIAHDVDPIELVVWLPALCRKMEIPYCIVKGKARLGSIVHKKTASALCLTTLKNEDKMEFSRILEAIKANFNDKFEENRKKWGGGVMGSKSQARTKAKERVLAKEAAQRMN

SEQ ID NO: 8765 - protein, 256 aa, Ambrosia trifida
MAPKKGGKPVATKKKTEKVVNPLFEKRPKQFGIGGALPPKKDVHRFVRWPQVVRIQRKRRILKQRLKVPPALNQFTKTLDKNLATNLFKMLLKYRPEDKAAKKERLLKKAQAESEGKTVETKKPIVVKYGLNHVTYLIEQNKAQLVIIAHDVDPIELVVWLPALCRKMEIPYCIVKGKSRLGAIVHQKTAAALCLTTVKNEDKMEFSRILEAIKANFNDKYDEYRKKWGGGIMGSKSQAKQRRRAGLAKEAAQRMN

SEQ ID NO: 8766 - protein, 257 aa, Ambrosia trifida
MAPKKGVKTVATKKKTEKVVNPLFEKRPKQFGIGGALPPKKDVHRFVRWPQVVRIQRKRRILKQRLKVPPALNQFTKTLDKNLATTLFKMLLKYRPEDKTAKKERLQKRAQAESEGKTVETKKPIVVKYGLNHVTYLIEQNKAQLVIIAHDVDPIELVVWLPALCRKMEIPYCIVKGKSRLGAIVHQKTAAALCLTTVKNEDKMEFSRILEAIKANFNDKYDEYRKKWGGGIMGSKSQAKTKAKERVLAKEAAQRMT

SEQ ID NO: 8767 - protein, 259 aa, Ricinus communis
MAPKRGVKVSAAPAKKKPEKVQNPLFEKRPKQFGIGGALPPKKDLHRFVKWPKVVQIQRKRRILRQRLKVPPALNQFTKTLDKNLATSLFKLLLKYRPEDRAAKRERLVQRAQAEAEGKTVEAKKPIVVKYGLNHVTYLIEQKKAQLVVIAHDVDPVELVVWLPALCRKMEVPYCIVKGKSRLGSVVHKKTAAVLCLTTVKNEDKLEFSKILEAIKANFNDKYDELRKKWGGGIMGSKSQAKTKAKERVLAKEAAQRMS

SEQ ID NO: 8768 - protein, 257 aa, Cichorium intybus
MAPKKGGKPIAVKKKTEKVVNPLFEKRPKQFGIGGALPPKKDLHRFVRWPQVVRIQRKRRILKQRLKVPPALNQFTKTLDKNLATTLFKMLLKYRPEDKAAKKERLLKRAQAESEGKTAEAKKPIVVKYGLNHITYLIEQNKAQLVIIAHDVDPIELVVWLPALCRKMEIPYCIVKGKSRLGTIVHQKTAAALCLTTVKNEDKMEFSRILEAIKANFNDKYDEYRKKWGGGIMGSKSQAKTKAKERVLAKEAAQRLN

SEQ ID NO: 8769 - protein, 257 aa, Cirsium arvense
MAPKKGGKPIATKKKTEKVVNPLFEKRPKQFGIGGALPPKKDVHRFVRWPQVVRIQRKRRILKQRLKVPPALNQFTKTLDKNLATTLFKMLLKYRPEDKAAKKERLLKRAQAESEGKTAEAKKPIVVKYGLNHVTYLIEQNKAQLVIIAHDVDPIELVVWLPALCRKMEIPYCIVKGKSRLGTIVHQKTAAALCLTTVKNEDKMEFSRILEAIKANFNDKYEEYRKKWGGGIMGSKSQAKTKAKERVLAKEAAQRLN

SEQ ID NO: 8770 - protein, 257 aa, Cirsium arvense
MAPKKGGKPVVTKKKTEKVVNPLFEKRPKQFGIGGALPPKKDVHRFVRWPQVVRIQRKRRILKQRLKVPPALNQFTKTLDKNLATTLFKMLLKYRPEDKAAKKERLLKRAQAESEGKTAEAKKPIVVKYGLNHITYLIEQNKAQLVVIAHDVDPIELVVWLPALCRKMEIPYCIVKGKSRLGAIVHQKTAAALCLTTVKNEDKMEFSRILEAIKANFNDKYEEYRKKWGGGIMGSKSQAKTKAKERVLAKEAAQRLN

SEQ ID NO: 8771 - protein, 258 aa, Cryptomeria japonica
  misc_feature (12)..(12): Xaa can be any naturally occurring amino acid
  misc_feature (200)..(200): Xaa can be any naturally occurring amino acid
MAPKRGVKPAAXAKKKVAKVVNPLFEKRPKQFGIGGALPPKKDLHRFVKWPKIIRIQRQRRILKQRLKVPPALNQFTKTLDKNLASNLFKMLLKYRPEDKAAKKERLLKKAQSEAEGKPIEVKKPIVVKYGINHVTYLIEQSKAQLVVIAHDVDPIELVVWLPALCRKMNIPYCIVKGKARLGTIVHKKNATALCLTSVXNEDKMEFSRIVEAIKANFNDKFDEYRRQWGGGIMGTKSQAKTKAREKLLAKEAAQRLT

SEQ ID NO: 8772 - protein, 257 aa, Cucumis sativus
MAPKKAVGKVSAKKKTEKVVNPLFEKRPKQFGIGGALPPKRDLTRFVKWPKVVQIQRKKRILKQRLKVPPALNQFTKTLDKNLATNLFKMLLKYRPEDKTQKKERLLKRAQEEAEGKSHDAKKPIVVKYGLNHVTYLIEQNKAQLVVIAHDVDPIELVVWLPALCRKMEIPYCIVKGKARLGAVVHQKTASVLCLTTVKNEDKMEFSRILEAIKANFNDKYDEYRKKWGGGIMGSKSQAKTKAKEKLLAKEAAQRMS

SEQ ID NO: 8773 - protein, 257 aa, Cucurbita pepo
MAPKKAVGKALAKKKPEKVVNPLFEKRPKQFGIGGALPPKRDLTRFVKWPKAVQIQRKKRILKQRLKVPPALNQFTKTLDKNLATNLFKMLLKYRPEDKAQKRERLLKRAQEEAEGKSHDAKKPIVVKYGLNHVTYLIEQNKAQLVVIAHDVDPIELVVWLPALCRKMEIPYCIVKGKARLGAIVHQKTASVLCLTTVKNEDKMEFSRILEAIKANFNDKYDEYRKKWGGGIMGSKSQAKTKAKERLLAKEAAQRMS

SEQ ID NO: 8774 - protein, 258 aa, Linum usitatissimum
MAPKRGVKAPVASKKKTEKVVNPLFEKRPKQFGIGGALPPKRDLTRFVKWPHVVRIQRQRRILKQRLKVPPAVNQFTKALDKNLATQLFKLLLKYRPEDKAAKKERLIKKAQAEAEGKTVESKKPIVVKYGLNHVTYLIEQNKAQLVIIAHDVDPIELVVWLPALCRKMEVPYAIVKGKSRLGAIVHKKTAAALCLTSVKNEDKMEFSKILEAVKANFNDKFDEHRKRWGGGIMGSKSQAKTKAKERLLAKEAAQRMT

SEQ ID NO: 8775 - protein, 258 aa, Vitis vinifera
MGPKKGGKAAVPAKKKTEKVVNPLFEKRPKQFGIGGALPPKKDLTRFVKWPHVVRIQRKRRILRQRLKVPPALNQFTKTLDKNLATNLFKMLLKYRPEDKAAKKERLLKRAQAEAEGKTAESKKPIVVKYGLNHITYLIEQNKAQLVVIAHDVDPIELVVWLPALCRKMEVPYAIVKGKSRLGAIVHKKTATALCLTSVKNEDKLEFSKIVEAVKANFNDKYDEYRKRWGGGIMGSKSQAKTKAKEKLIAKEAAQRMS

SEQ ID NO: 8776 - protein, 259 aa, Lotus japonicus
MAPKKGGKAPVAASKKKTEKVTNPLFEKRPKQFGIGGALPPKRDLTRFVKWPKTVQIQRKKRILKQRLKVPPALNQFTKTLDKNLATSLFKILLKYRPEDKAEKKDRLVKRAQAEAENKTVETKKPIVVKYGLNHVTYLIEQNKAQLVVIAHDVDPIELVVWLPALCRKMEIPYCIVKGKARLGSIVHKKTASVLCLTSVKNEDKLEFSRVLEAIKANFNDKYEEYRKKWGGGIMGSKSQAKTKAKERVLAKEAAQRMN

SEQ ID NO: 8777 - protein, 257 aa, Cucumis melo
MAPKKAVGKVSAKKKLEKVVNPLFEKRPKQFGIGGALPPKRDLTRFVKWPKVVQIQRKKRILKQRLKVPPALNQFTKTLDKNLATNLFKMLLKYRPEDRTQKRERLLKRAQEEAEGKSLDAKKPIVVKYGLNHVTYLIEQNKAQLVVIAHDVDPIELVVWLPALCRKMEIPYCIVKGKARLGSIVHKKTASVLCLTTVKNEDKLEFSRILEAIKANFNDKYEEYRKKWGGGIMGSKSQAKTKAKERLLAKEAAQRMS

SEQ ID NO: 8778 - protein, 259 aa, Momordica charantia
MAPKKAVGKALAAAKKKPEKVVNPLFEKRPKQFGIGGALPPKRDLTRFVKWPKAVQIQRKKRILKQRLKVPPALNQFTKTLDKNLATNLFKMLLKYRPEDKAQKRERLLKRAQEEAEGKSHDAKKPIVVKYGLNHVTYLIEQNKAQLVVIAHDVDPIELVVWLPALCRKMEIPYCIVKGKARMGAIVHKKTASVLSLTTVKNEDKLEFSRILEAIKANFNDKYDEYRKKWGGGIMGSKSQAKTKAKEKLLAKEAAQRMS

SEQ ID NO: 8779 - protein, 256 aa, Lippia dulcis
MAPKKGAKLPAKKKTEKVVNPLFEKRPKQFGIGGALPPKKDLHRFVKWPQVVRIQRKKMILKQRLKVPPPIHQFSKTLDKNLATSLFKMLLKYRPEDKAQKKERLLKRAQAEAEGKTPESKKPIVVKYGLNHVTYLIEQNKAQLVVIAHDVDPIELVVWLPALCRKMEIPYCIVKGKARLGTVVHKKTASVLCLTSVKNEDKMEFSKILEAIKANFNDKYDEMRKKWGGGVMGSKSQARTKAKERLLAKEAAQRMT

SEQ ID NO: 8780 - protein, 258 aa, Lippia dulcis
MAPKKGAKLPAAAKKKTEKVVNPLFEKRPKQFGIGGALPPKKDLHRFVKWPQVVRIQRKKMILKQRLKVPPPIHQFSKTLDKNLATSLFKMLLKYRPEDKAQKKERLLKRAQAEAEGKTPESKKPIVVKYGLNHVTYLIEQNKAQLVVIAHDVDPIELVVWLPALCRKMEIPYCIVKGKARLGTIVHKKTASALCLTSVKNEDKMEFSKILEAIKANFNDKYDETRKKWGGGVMGSKSQARTKAKERLLAKEAAQRMT

SEQ ID NO: 8781 - protein, 258 aa, Podocarpus macrophillus
MAPKRGVKAPVAAKKKAPKVVNPLFEKRPKQFGIGGAIPPKKDLHRFVKWPKVVRIQRQRRILKQRLKVPPALNQFTKTLDKNLASNLFKMLLKYRPEDKASKRERLLKKAQIEASGGTVEVKKPIVVKYGINHVTYLIEQSKAQLVVIAHDVDPIELVVWLPALCRKMNIPYCIVKGKARLGTIVHKKNATALCLTSVKNEDKMEFSRIVEAVKANFNDKFDEYRRQWGGGIMGTKSQAKTKAREKLLAKEAAQRLN

SEQ ID NO: 8782 - protein, 258 aa, Populus trichocarpa
MAPKRGVKGPLAAKKKPEKVVNPLFEKRPKQFGIGGALPPKKDLTRFVKWPHVVRIQRQRRILKQRLKVPPAVNQFTKTLDKNLATQLFKLFLKYRPEDKAAKKERLLKRAQAEAEGKTVETKKPIVIKYGLNHVTYLIEQNKAQLVVIAHDVDPIELVVWLPALCRKMEVPYAIVKGKSRLGAIVHKKTASVLCLTSVKNEDKLEFSKVLEAVKANFNDKFDEHRKKWGGGIMGSKSLAKSKAKERVLAKEAAQRMS

SEQ ID NO: 8783 - protein, 258 aa, Pseudotsuga menziesii
MAPKRGVKAPVAAKKKVPKIVNPLFEKRTRQFGIGGALPPKKDLHRFVKWPKVVRIQRQRRVLKQRLKVPPALNQFTKTLDKNLASNLFKMLLKYRPEDKAAKKERLLKKAQSEAEGKTVEVKKPIVVKYGINHITYLIEQSKAQLVVIAHDVDPIELVVWLPALCRKMNIPYAIVKGKARLGAIVHKKTATALCLTSVKNEDKMEFSKIVEAVKANFNDKFDEYRRQWGGGIMGTKSQAKTKAKEKVMAKEAAQRLN

SEQ ID NO: 8784 - protein, 233 aa, Secale cereale
EKRPKQFGIGGALPPKKDLHRFVKWPKVVRIQRQRRILKQRLKVPPALHQFTRTLDKNLATNLFKMLLKYRPEDKVAKKERLLKRAQAEAEGKTVEAKKPIVVKYGLNHVTYLIEQSKAQLVVIAHDVDPIELVVWLPALCRKMEVPYCIVKGKSRLGSIVHKKTASVLCLTTVKNEDKLEFSKILEAIKANFNDKFDEVRKKWGGGVMGSKSQAKTKARERLIAKEAAQRMN

SEQ ID NO: 8785 - protein, 257 aa, Thalictrum flavum
MAPKKGVKAVVTKKKPEKVANPLFEKRPKQFGIGGALPPKKDLHRFVKWPKVVRIQRQRRILKQRLKVPPALNQFTKTVDKSLATTLFKMLLKYRPEDKAAKKERLVKRAQAEAEGKTIESKKPIVVKYGLNHITYLIEQNKAQLVVIAHDVDPIELVVWLPALCRKMEIPYVIVKGKARLGAVVHKKTAAALCLTSVKNEDKMEFSRIVEAIKANFNDKYDENRKKWGGGIMGSKSQAKTKAKERLLAKEAAQRMN

SEQ ID NO: 8786 - protein, 258 aa, Nicotiana tabacum
MAPKKGVAVAAKKKPVQAKVVNPLFEKRPKQFGIGGALPPKKDLTRFVRWPQVVRIQRKRRILKQRLKVPPSLNQFSKTLDKNLATNLFKMLLKYRPEDKAAKKERLLKRAQAEAEGKTPETKKPIIVKYGLKHITYLIEQNKAQLVVIAHDVDPIELVVWLPALCRKMEIPYCIVKGKARLGSIVHKKTASALCLTTVKNEDKMEFSRILEAIKANFNDKYEENRKKWGGGVMGSKSQARTKAKERVLAKEAAQRMN

SEQ ID NO: 8787 - protein, 258 aa, Valeriana officinalis
MAPKRGVKQPVAAAKKKSDKIVNPLFEKRPKQFGIGGSLPPKKDLHRYVKWPQVVRIQRKRRILKQRLKVPPALNQFTKTLDKNLATSLFRMLLKYRPEDKAAKKERLIKRAQAESEGKAPEAKKPIVVKYGLNHVTYLIEQNKAQLVVIAHDVDPIELVVWLPALCRKMEIPYCIVKGKARLGAIVHQKTASVLCLTTVKNEDKMDFSRILEAIKANFNDKYEENRKKWGGGIMGSKSQAKTKAKERVLAKEAAQRA

SEQ ID NO: 8788 - protein, 259 aa, Vinca minor
MAPKKGAKPPPSAAKKKSDKVVNPLFEKRPKQFGIGGALPPKKDLTRFVKWPKVVQLQRKRRILRQRLKVPPAINQFSKTLDKNLATNLFKMLLKYRPEDKAAKKERLLKRAQAESEGKTSEVKKPIVVKYGLKHVTYLVEQNKAQLVVIAHDVDPIELVVWLPHLCRKMEIPYCIVKGKARLGSIVHKKTASVLCLTSVKNEDKMEFSRVLEAIKANFNDKFDENRKKWGGGIMGSKSQAKTKAKERVLAKEQAQRMS

SEQ ID NO: 8789 - protein, 256 aa, Citrullus lanatus
APKKAVGKVSTKKKPEKVVNPLFEKRPKQFGIGGALPPKRDLTRFVKWPKVVQIQRKKRILKQRLKVPPALNQFTKTLDKNLATNLFKMLLKYRPEDKTQKRERLLKRAQEEAEGKSHDAKKPIVVKYGLNHVTYLIEQNKAQLVVIAHDVDPIELVVWLPALCRKMEIPYCIVKGKARLGAIVHKKTASVLCLTTVKNEDKLEFSRILEAIKANFNDKYDEYRKKWGGGIMGSKSQAKTKAKEKLLAKEAAQRMS

SEQ ID NO: 8790 - protein, 103 aa, Arnica chamissonis
KKGGKPVATKKKTEKVVNPLFEKRPKQFGIGGALPPKKDVHRFVRWPQVVRIQRKRRILKQRLKVPPALNQFTKTLDKNLATNLFKMLLKYRPEDKAAKKRTS

SEQ ID NO: 8791 - protein, 331 aa, Cirsium arvense
KLRSGEALPEAVDWREKGAVTAVKDQGSCGSCWAFSTTGSVEGISQIVTGDLISVSEQELVDCDTSYNQGCNGGLMDYAFQFIIKNGGIDTEEDYPYTGRDGKCDTYRKNAKVVTIDGYEDVPVNDESALQKAAANQPIAVAIEAGGRDFQFYTSGIFTGQCGTALDHGVLVVGYGSENGKDYWIVKNSWGAAWGESGYLKMERNIKENVGKCGIAMEASYAVKTGQNPPNPGPSPPSPVSPETVCDEYSTCPEGTTCCCIYEYYGYCFAWGCCPLEGASCCEDHYSCCPHDYPICDVRRGTCSKSKNSPLEMKAIQRILATPTKAKRSSA

SEQ ID NO: 8792 - protein, 217 aa, Flaveria ramosissima
MAPKKGVKVATKKKTEKVVNPLFEKRPKQFGIGGALPPKKDLHRFVRWPQVVRIQRKRRILKQRLKVPPALNQFTKTLDKNLATTLFKMLLKYRPEDKAAKKERLLKKAQAESEGKTVEAKKPIVVKYGLNHVTYLIEQNKAQLVIIAHDVDPIELVVWLPALCRKMEIPYCIVKGKSRLGAIVHQKTAAALCLTTVKNEDKMEFSRILEAIKANFK

SEQ ID NO: 8793 - protein, 112 aa, Lippia dulcis
MAPKKGVKPVAAKKKVEKVVNPLFEKRPKQFGIGGALPPKKDLHRFVRWPQVVRIQRKKMILKQRLKVPPPIHQFSKTLDKNLATSLFKMVLKYRPEDRAQKERQAFEESSS

SEQ ID NO: 8794 - protein, 90 aa, Thalictrum flavum
MEIPYVIVKGKARLGAVVHKKTAAALCLTSVKNEDKMEFSRIVEAIKANFNDKYDENRKKWGGGIMGSKSQAKTKAKERLLAKEAAQRMN

SEQ ID NO: 8795 - protein, 257 aa, Ambrosia trifida
MAPKKGVKTVATKKKTEKVVNPLFEKRPKQFGIGGALPPKKDVHRFVRWPQVVRIQRKRRILKQRLKVPPALNQFTKTLDKNLATTLFKMLLKYRPEDKAAKKERLLKRAQAESDGKTVESKKPIVVKYGLNHVTYLIEQNKAQLVIIAHDVDPIELVVWLPALCRKMEIPYCIVKGKSRLGAIVHQKTAAALCLTTVKNEDKMEFSRILEAVKANFNDKYDEYRKKWGGGIMGSKSQAKTKAKERVLAKEAAQRMN

SEQ ID NO: 8796 - protein, 264 aa, Aquilegia formosa
FSLFVLQAPKKGVRTAAAAKKKPEKVVNPLFEKRPKQFGIGGALPPKKDLHRFVKWPKVVRIQRQRRILKQRLKVPPALNQFTKTLDKSLATNLFKMLLKYRPEDKAAKKERLLKRAQAESEGKTIEAKKPIVVKYGLNHITYLIEQNKAQLVVIAHDVDPIELVVWLPALCRKMEIPYCIVKGKARLGSIVHKKTASVLCLTSVKNEDKMDFSKILEAIKANFNDKYDEYRKKWGGGIMGSKSQAKTKAKERLIAKEAAQRLN

SEQ ID NO: 8797 - protein, 257 aa, Arnica chamissonis
MAPKKGVKAVATKKKTEKVVNPLFEKRPKQFGIGGALPPKKDVHRFVRWPQVVRIQRKRRILKQRLKVPPALNQFTKTLDKNLATTLFKMLLKYRPEDKAEKKERLLKRAQAESEGKTVEAKKPIVVKYGLNHITYLIEQNKAQLVIIAHDVDPIELVVWLPALCRKMEIPYCIVKGKSRLGTIVHQKTAAALCLTTVKNEDKMEFSRVLEAIKANFNDKYEEYRKKWGGGIMGSKSQAKTKAKERVLAKEAAQRMN

SEQ ID NO: 8798 - protein, 259 aa, Catharanthus roseus
MAPKKGAKLPVSAAKKKPEKVVNPLFEKRPKQFGIGGALPPKKDLTRFVKWPQNVRIQRKKRILRMRLKVPPAINQFAKTLDKNLASSLFKMLLKYRPEDNVTKKERLLKRAQAEADGKTADAKKPIVVKYGLKHVTYLIEQNKAQLVVIAHDVDPIELVVWLPHLCRKMEIPYCIVKGKARLGSIVHKKTASVLCLTSVKNEDKLDFSKILEAIKANFNDKFDEQRKKWGGGVMGSKSQAKTKAKERLLAKEAAQRMS

SEQ ID NO: 8799 - protein, 257 aa, Unknown
  Sequence found in Organisms: Centaurea maculosa, Cirsium arvense, Carthamus tinctorius
MGPKKGGKPIATKKKTEKVVNPLFEKRPKQFGIGGALPPKKDVHRFVRWPQVVRIQRKRRILKQRLKVPPALNQFTKTLDKNLATTLFKMLLKYRPEDKAAKKERLLKRAQAESEGKTAEAKKPIVVKYGLNHVTYLIEQNKAQLVIIAHDVDPIELVVWLPALCRKMEIPYCIVKGKSRLGTIVHQKTAAALCLTTVKNEDKMEFSRILEAIKANFNDKYEEYRKKWGGGIMGSKSQAKTKAKERVLAKEAAQRLN

SEQ ID NO: 8800 - protein, 257 aa, Unknown
  Sequence found in Organisms: Centaurea maculosa, Cirsium arvense, Carthamus tinctorius
MGPKKGGKAVATKKKTEKVVNPLFEKRPKQFGIGGALPPKKDVHRFVRWPQVVRIQRKRRILKQRLKVPPALNQFTKTLDKNLATTLFKMLLKYRPEDKAAKKERLLKRAQAESEGKTAEAKKPIVVKYGLNHVTYLIEQNKAQLVIIAHDVDPIELVVWLPALCRKMEIPYCIVKGKSRLGTIVHQKTAAALCLTTVKNEDKMEFSRILEAIKANFNDKYEEYRKKWGGGIMGSKSQAKTKAKERVLAKEAAQRLN

SEQ ID NO: 8801 - protein, 259 aa, Cicer arietinum
MAPKKGGKAPVLASKKKPEKVTNPLFEKRPKQFGIGGALPPKRDLTRFVKWPKTVQIQRKKRILKQRLKVPPALNQFTKTLDKNLATSLFKILLKYRPEDKAEKKERLLKRAQAEAEGKTIETKKPINVKYGLNHVTYLIEQNKAQLVVIAHDVDPIELVVWLPALCRKMEIPYCIVKGKARLGTVVHKKTASVLCLTTVKNEDKMEFSRVLEAIKANFNDKYDENRKKWGGGVMGSKSQAKTKAKERLIAKEAAQRMN

SEQ ID NO: 8802 - protein, 257 aa, Taraxacum officinale
MAPKKGGKAVATKKKTEKVANPLFEKRTKQFGIGGALPPKKDVHRFVRWPQVVRIQRKRRILKQRLKVPPALNQFTKTLDKNLATTLFKMLLKYRPEDKAAKKERLIKRAQAESEGKTAEAKKPIVVKYGLNHVTYLIEQNKAQLVVIAHDVDPIELVVWLPALCRKMEIPYCIVKGKSRLGTIVHQKTAAALCLTTVKNEDKMEFSRILEAIKANFNDKYEEYRKKWGGGIMGSKSQAKTKAKERVLAKEAAQRLN

SEQ ID NO: 8803 - protein, 257 aa, Taraxacum officinale
MAPKKGGKAAAAKKKTVAVVNPLFEKRPKQFGIGGALPPKKDVHRFVRWPQVVRIQRKRRILKQRLKVPPALNQFTKTLDKNLATTLFKMLLKYRPEDKASKKERLLKRAQAESEGKTAESKKPIVVKYGLNHITYLIEQNKAQLVIIAHDVDPIELVVWLPALCRKMEIPYCIVKGKSRLGTIVHQKTAAALCLTTVKNEDKMEFSRILEAIKANFNDKYEEYRKKWGGGIMGSKSQAKTKAKERVLAKEAAQRLT

SEQ ID NO: 8804 - protein, 259 aa, Medicago truncatula
MAPKKGVKAPVAASKKKPEKVTNPLFEKRPKQFGIGGALPPKRDLTRFVKWPKNVQVQRKKRILKQRLKVPPALNQFTKTLDKNLATSLFKILLKYRPEDKAEKKERLLKRAQAEAEGKTVETKKPINVKYGLNHVTYLIEQNKAQLVVIAHDVDPIELVVWLPALCRKMEIPYCIVKGKARLGTVVHKKTAAVLCLTTVKNEDKMEFSRVLEAIKANFNDKYEEYRKKWGGGIMGSKSQAKTKAKERLIAKEAAQRMT

SEQ ID NO: 8805 - protein, 258 aa, Mimulus guttatus
MAPKKGAKLPVAAKKKTEKVVNPLFEKRPKQFGIGGALPPKKDLHRFVKWPQVVRIQRKKMILKQRLKVPPPIHQFSKTLDKNLATSLFKMLLKYRPEDKAEKKDRLLKRAQAEAEGKSPETKKPIVVKYGLNHVTYLIEQNKAQLVVIAHDVDPIELVVWLPALCRKMEIPYCIVKGKARLGTIVHKKTASVLCLTSVKNEDKMDFSKILEAIKANFNDKYDETRKKWGGGVMGSKSQAKTKAKERVLAKEAAQRMT

SEQ ID NO: 8806 - protein, 258 aa, Nicotiana benthamiana
MAPKKGVAVASKKKPAQAKVVNPLFEKRPKQFGIGGALPPKKDLTRFVKWPQVVRIQRKRRILKQRLKVPPALNQFSKTLDKNLATNLFKMLLKYRPEDKAAKKERLVKRAQAEAEGKTPETKKPIIVKYGLKHITYLIEQNKAQLVVIAHDVDPIELVVWLPALCRKMEIPYCIVKGKARLGSIVHKKTASALCLTTVKNEDKMEFSRILEAIKANFNDKYEENRKKWGGGVMGSKSQARTKAKERVLAKEAAQRMN

SEQ ID NO: 8807 - protein, 256 aa, Unknown
  Sequence found in Organisms: Nicotiana benthamiana, Nicotiana tabacum
APKKGVAVAAKKKPVAKVVNPLFEKRPKQFGIGGALPPKKDLTRFVKWPQVVRIQRKRRILKQRLKVPPALNQFSKTLDKNLATNLFKMLLKYRPEDKAAKKERLVKRAQAEAEGKTPETKKPIIVKYGLKHITYLIEQNKAQLVVIAHDVDPIELVVWLPALCRKMEIPYCIVKGKARLGSIVHKKTASALCLTTVKNEDKMEFSRILEAIKANFNDKYEENRKKWGGGVMGSKSQARTKAKERVLAKEAAQRMN

SEQ ID NO: 8808 - protein, 257 aa, Nicotiana benthamiana
MAPKKGVAVAAKKKPVAKVVNPLFEKRPKQFGIGGALPPKKDLTRFVKWPQVVRIQRKRRILKQRLKVPPALNQFSKTLDKNLATNLFKMLLKYRPEDKAAKKERLIKKAQAEAEGKTPETKKPIIVKYGLKHITYLIEQNKAQLVVIAHDVDPIELVVWLPALCRKMEIPYCIVKGKARLGSIVHKKTASALCLTTVKNEDKMEFSRILEAIKANFNDKYEENRKKWGGGVMGSKSQARTKAKERVLAKEAAQRMN

SEQ ID NO: 8809 - protein, 258 aa, Salvia sclarea
MPPKKGAKLPAAAKKKAEKVVNPLFEKRPKQFGIGGALPPKKDLHRFVRWPQVVRIQRKKMILKQRLKVPPPIHQFSKTLDKNLATSLFKMLLKYRPEDRAQKKDRLLKRAQAEAEGKTPETKKPIVVKYGLNHVTYLIEQNKAQLVVIAHDVDPIELVVWLPALCRKMEIPYCIVKGKARLGSIVHKKTASVLCLTSVKNEDKMEFSKILEAIKANFNDKYDETRKKWGGGVMGSKSQAKTKAKERVLAKEAAQRII

SEQ ID NO: 8810 - protein, 258 aa, Euphorbia esula
MAPKKGVKAPVAAKKKTEKVVNPLIEKRPKQFGIGGALPPKKDLTRFVKWPHVVRIQRQRRILKQRLKVPPAVNQFTKTLDKNLATQLFKLLLKYRPEDKAAKKERLLQRAQAEAEGKTVESKKPIVVKYGLNHVTYLIEQNKAQLVVIAHDVDPIELVVWLPALCRKMEVPYAIVKGKSRLGAIVHKKTAAALCITSVKNEDKMEFSKILEAVKANFNDKFDEHRKKWGGGIMGSKSQAKSKAKERVLAKEAAQRMN

SEQ ID NO: 8811 - protein, 257 aa, Helianthus annuus
MAPKKGVKTVATKKKTEKVVNPLFEKRPKQFGIGGALPPKKDVHRFVRWPQVVRIQRKRRILKQRLKVPPALNQFTKTLDKNLATTLFKMLLKYRPEDKAAKKERLLKRAQAESDGKTVEAKKPIVVKYGLNHVTYLIEQNKAQLVIIAHDVDPIELVVWLPALCRKMEIPYCIVKGKSRLGAIVHQKTAAALCLTTVKNEDKMEFSRILEAVKANFNDKYEEYRKKWGGGIMGSKSQAKTKAKERVLAKEAAQRMN

SEQ ID NO: 8812 - protein, 257 aa, Helianthus annuus
MAPKKGVKAVATKKKTEKVVNPLFEKRPKQFGIGGALPPKKDVHRFVRWPQVVRIQRKRRILKQRLKVPPALNQFTKTLDKNLATTLFKMLLKYRPEDKAAKRERLQKRAQAESEGKTVEAKKPIVVKYGLNHITYLIEQNKAQLVIIAHDVDPIELVVWLPALCRKMEIPYCIVKGKSRLGAIVHQKTAAALCLTTVKNEDKMEFSRVLEAIKANFNDKYEEYRKKWGGGIMGSKSQAKTKAKERVLAKEAAQRMT

SEQ ID NO: 8813 - protein, 255 aa, Helianthus annuus
MAPKKKTVATKKKTEKVVNPLFEKRPKQFGIGGALPPKKDVHRFVRWPQVVRIQRKRRILKQRLKVPPALNQFTKTLDKNLATTLFKMLLKYRPEDKAAKKERLKKRAEAEVDGKTVEAKKPIVVKYGLNHVTYLIEQNKAQLVIIAHDVDPIELVVWLPALCRKMEIPYCIVKGKSRLGAIVHQKTASALCLTTVKNEDKMEFSRILEAIKANFNDKYEEYRKKWGGGIMGSKSQAKTKAKERVLAKEAAQRMN

SEQ ID NO: 8814 - protein, 257 aa, Helianthus annuus
MAPKKGVKTVATKKKTEKVVNPLFEKRPKQFGIGGALPPKKDVHRFVRWPQVVRIQRKRRILKQRLKVPPALNQFTKTLDKNLATTLFKMLLKYRPEDKAAKKERLLKRAQAESDGKTVEAKKPIVVKYGLNHVTYLIEQNKAQLVIIAHDVDPIELVVWLPALCRKMEIPYCIVKGKSRLGAIVHQKTAAALCLTTVKNEDKMEFSRILEAVKANFNDKYEEYRKKWGGGIMGSKSQAKTKAKERVLAKEAAQRMS

SEQ ID NO: 8815 - protein, 259 aa, Vinca minor
MAPKKGVKLPASAAKKKTDKVVNPLFEKRPKQFGIGGALPPKKDLTRFVKWPKVVQLQRKRRILRQRLKVPPAINQFSKTLDKNLATNLFKMLLKYRPEDKAAKKERLLKRAQAESEGKTSEVKKPIVVKYGLKHVTYLVEQNKAQLVVIAHDVDPIELVVWLPHLCRKMEIPYCIVKGKARLGSIVHKKTASVLCLTSVKNEDKMEFSRVLEAIKANFNDKFDENRKKWGGGIMGSKSQAKTKAKERVLAKEQAQRMS

SEQ ID NO: 8816 - protein, 259 aa, Vinca minor
MAPKKGAKLPASAAKKKTDKVVNPLFEKRPKQFGIGGALPPKKDLTRFVKWPKVVQLQRKRRILRQRLKVPPAINQFSKTLDKNLATNLFKMLLKYRPEDKAAKKERLLKRAQAESEGKTSEVKKPIVVKYGLKHVTYLVEQNKAQLVVIAHDVDPIELVVWLPHLCRKMEIPYCIVKGKARLGSIVHQKTASVLCLTSVKNEDKMEFSRVLEAIKANFNDKFDENRKKWGGGIMGSKSQAKTKAKERVLAKEQAQRMS

SEQ ID NO: 8817 - protein, 168 aa, Ambrosia trifida
MLLKYRPEDKAAKKERLVKKAQAESEGKTIETKKPIVVKYGLNHVTYLIEQNKAQLVIIAHDVDPIELVVWLPALCRKMEIPYCIVKGKSRLGAIVHQKTAAALCLTTVKNEDKMEFSRILEAIKANFNDKYDEYRKKWGGGIMGSKSQAKTKAKERVLAKEAAQRMN

SEQ ID NO: 8818 - protein, 150 aa, Zingiber officinale
MRAQAEAEGKTVESKKPIVVKYGLNHVTYLIEQNKAQLVVIAHDVDPIELVVWLPALCRKMEIPYCIIKGKSRLGAIVHKKTASVLCLTTVKNEDKLEFSKILEAIKANFNDKFDEIRRKWGGGVMGSKSQAKAKAKEKLLAKEAVQRMT

SEQ ID NO: 8819 - protein, 126 aa, Guizotia abyssinica
MAPKKGGKPVATKKKTEKVVNPLFEKRPKQFGIGGALPPKKDLHRFVRWPQVVRIQRKRRILKQRLKVPPALNQFSKTLDKNLAANLFKMLLKYRPEDKAAKKEGLQKKALLNQKENLWKQRSLLS

SEQ ID NO: 8820 - protein, 262 aa, Epimedium sagittatum
MAPKKGVKLSAVAAKKKKEATVVNPLFEKRPKQFGIGGALPPKRDLHRFVKWPKVVRIQRQRRILKQRLKVPPALNQFTKTLDKNLATSLFKMLLKYRPEDKAQKKERLLKRAQAEADGKTSSSDAKKPVVVKYGLNHVTYLIEQKKAQLVVIAHDVDPIELVVWLPALCRKMEIPYCIVKGKARLGSIVHMKTAAALCFTSVKNEDNLEFSRILEAIKANFNDKYDEYRKKWGGGIMGSKSQAKTKAKDRVLAKEAAQRMN

SEQ ID NO: 8821 - protein, 258 aa, Malus domestica
MAPKRGVKPAALAKKKTEKVVNPLFEKRTKQFGIGGALPPKRDLHRFVKWPKVVRIQRKKRILKQRLKVPPALNQFTKTLDKNLATSLFKLLLKYRPEDKAAKRERLLKRAQEESEGKTVEAKKPIVLKYGLNHVTYLIEQNKAQLVVIAHDVDPIELVVWLPALCRKMEIPYCIVKGKSRLGALLHKKTAAALCLTTVKNEDKLEFSKILEAIKANFNDKYEELRKKWGGGIMGAKSQAKTKAKEKLLAKEAAQRLN

SEQ ID NO: 8822 - protein, 257 aa, Artemisia annua
MAPKKGGKPVVTKKKTEKVVNPLFEKRPKLFGIGGALPPKKDVHRFVRWPQVVRIQRKRRILKQRLKVPPALNQFTKTLDKNLATTLFKMLLKYRPEDKAAKKERLVKRAQAESEGKTVEAKKPIVVKYGLNHITYLIEQNKAQLVIIAHDVDPIELVVWLPALCRKMEIPYCIVKGKSRLGTIVHQKTAAALCLTTVKNEDKMEFSRVLEAIKANFNDKYEEYRKKWGGGIMGSKSQAKTRAKEKVLAKEAAQRMN

SEQ ID NO: 8823 - protein, 258 aa, Bupleurum chinense
MAPKKGVKLPVAAKKKTDKVMNPLFEKRPKQFGIGGAIPPKRDMHRYVKWPKVVQIQRKRMILKQRLKVPPALNQFTKTLDKNLATNVFKMLLKYRPEDKAAKKERLLKKAQAETEGKSIESKKPIVVKYGLNHVTYLIEQNKAQLVVIAHDVDPIELVVWLPALCRKMEVPYCIVKGKARLGSIVHKKTASVLCLTTVKNEDKMEFSKILEAIKANFNDKYEEYRKKWGGGIMGSKSQAKTRAKERVLAKEAAQRMN

SEQ ID NO: 8824 - protein, 257 aa, Cephalotaxus harringtonia
MAPKRGVKAPSAKKKVEKVVNPLFEKRPKQFGIGGALPPKKDLHRFVKWPKPVRIQRQRRILKQRLKVPPALNQFTKTLDKNLASNLFKMLLKYRPEDKASKKDRLLKRAQAEAEGKTIEVKKPIAVKYGINHVTYLIEQSKAQLVVIAHDVDPIELVVWLPALCRKMNIPYAIVKGKSRLGVIVHKKTATALCLTSVKNEDKMEFSRIVEAIKANFNDKFDEYRRQWGGGIMGSKSQAKTKAKERLLAKEASQRLI

SEQ ID NO: 8825 - protein, 256 aa, Cleome spinosa
MAPKKGVKVAAKKKPEKVTNPLFEKRPKQFGIGGALPPKKDLSRYIKWPKAIRLQRQKRILKQRLKVPPAVNQFTKTLDKNLATSLFKLLLKYRPEDKAAKKERLLKKAQSEAEGKPVESKKPIVVKYGLNHVTYLIEQNKAQLVVIAHDVDPIELVVWLPALCRKMEVPYCIVKGKSRLGAIVHKKTASCLCLTTVKNEDKLEFSKILEAIKANFNDKYDEYRKKWGGGIMGSKSQAKTKAKERVLAKEAAQRMS

SEQ ID NO: 8826 - protein, 257 aa, Cucumis sativus
MAPKKAVGKALAKKKPEKVVNPLFEKRPKQFGIGGAIPPKRDLTRFVKWPKVVQIQRKKRILKQRLKVPPALNQFTKTLDKNLATNLFKMLLKYRPEDRSQKRERLLKRAQEEADGKPHDAKKPIVVKYGLNHVTYLIEQNKAQLVVIAHDVDPIELVVWLPALCRKMEIPYCIVKGKARLGSIVHKKTASVLCLTTVKNEDKMEFSRILEAIKANFNDKYDEYRKKWGGGIMGSKSQAKTKAKEKLLAKEAAQRMS

SEQ ID NO: 8827 - protein, 258 aa, Euphorbia peplus
MAPKRGVKAAAPAKKKPEKDVNPLIEKRPKQFGIGGALPPKKDLTRFVKWPHVVRIQRQRRILKQRLKVPPAVNQFTKTLDKNLATQLFKLLLKYRPEDKAAKKERLLQRAQAEAEGKTVESKKPIVVKYGLNHVTYLIEQNKAQLVVIAHDVDPIELVVWLPALCRKMEVPYAIVKGKSRLGAIVHQKTAAALCITSVKNEDKMEFSKILEAVKANFNDKFDEHRKKWGGGIMGSKSQAKSKAKERVLAKEAAQRMN

SEQ ID NO: 8828 - protein, 259 aa, Fagopyrum esculentum
MAPKRGVKTVTTTKKKTEKAVNPLYEKRPKQFGIGGALPPKKDMRRFVKWPKVVQLQRKKRILKQRLKVPPALNQFTKTLDKNLATSLFKMLLKYRPEDKAAKKERLLNKAQADAAGKEAAAAKKPIVVKYGLKHVTYLIEQNKAQLVVIAHDVDPIELVVWLPALCRKMEIPYCIVKGKARLGSIVHKKNASVLCLTTVKNEDKLDFSKILEAIKANFNDKYEEYRKKWGGGIMGSKSQAKTKAKERVLAKEAAQRMT

SEQ ID NO: 8829 - protein, 258 aa, Linum usitatissimum
MAPKRGVKAPVATKKKTDKVVNPLFEKRPKQFGIGGALPPKRDLTRFVKWPHVVRIQRQRRILKQRLKVPPAVNQFTKALDKNLATQMFKLLLKYRPEDKAAKKERLIKKAQAEAEGKTVESKKPIVVKYGLNHVTYLIEQNKAQLVIIAHDVDPIELVVWLPALCRKMEVPYAIVKGKSRLGAIVHKKTAAALCLTSVKNEDKMEFSKILEAVKANFNDKFDEHRKRWGGGIMGSKSQAKTKAKERLLAKEAAQRMS

SEQ ID NO: 8830 - protein, 256 aa, Fraxinus spp
MAPKKGAKLPAKKKAEKVVNPLFEKRPKQFGIGGALPPKKDLHRFVKWPQVVRIQRKKMILKQRLKVPPPIHQFSKTLDKNLATSLFKMLLKYRPEDRAEKKERLLKRAQAEAEGKTPEVKKPIIVKYGLNHITYLIEQNKAQLVVIAHDVDPIELVVWLPALCRKMEIPYCIVKGKARLGTIVHKKTASALCLTSVKNEDKLEFSKILEAIKANFNDKYDETRKKWGGGVMGSKSQAKAKAKEKILAKEAAQRMS

SEQ ID NO: 8831 - protein, 258 aa, Nicotiana benthamiana
MAPKKGVAVASKKKPAQAKVVNPLFEKRPKQFGIGGALPPKKDLTRFVKWPQVVRIQRKRRILKQRLKVPPALNQFSKTLDKNLATNLFKMLLKYRPEDKSAKKERLVKRAEAEAEGKTPETKKPIVVKYGLKHITYLIEQNKAQLVVIAHDVDPIELVVWLPALCRKMEIPYCIVKGKARLGSIVHKKTASALCLTTVKNEDKMEFSRILEAIKANFNDKYEENRKKWGGGVMGSKSQARTKAKERVLAKEAAQRMN

SEQ ID NO: 8832 - protein, 255 aa, Helianthus annuus
MAPKKKTVATKKKTEKVVNPLFEKRPKQFGIGGALPPKKDVHRFVRWPQVVRIQRKRRILKQRLKVPPALNQFTKTLDKNLATTLFKMLLKYRPEDKAAKKERLKKRAEAEVDGKTVEAKKPIVVKYGLNHVTYLIEQNKAQLVIIAHDVDPIELVVWLPALCRKMEIPYCIVKGKSRLGAIVHQKTASALCLTTVKNEDKMEFSRILEAIKANFIDKYEEYRKKWGGGIMGSKSQAKTKAKERVLAKEAAQRMN

SEQ ID NO: 8833 - protein, 258 aa, Taxus baccata
MAPKRGVKTPAASKKKVEKVVNPLFEKRPKQFGIGGALPPKKDLHRFVKWPKIIRIQRQRRILKQRLKVPPALHQFTKTLDKNLASNLFKMLLKYRPEDKAAKKERLLKKAQAEAEAKPIEVKKPVVVKYGINHVTYLIEQSKAQLVVIAHDVDPIELVVWLPALCRKMNIPYCIVKGKSRIGAIVHKKTATALCLTSVKNEDKMEFSRIVEAIKANFNDKFDEYRKQWGGGVMGSKSQAKTKAKEKLLAKEAAQRLT

SEQ ID NO: 8834 - protein, 257 aa, Taxus baccata
MAPKRGVKAPAAKKKVEKVVNPLFEKRPKQFGIGGALPPKKDLHRFVKWPKAVRIQRQRRILKQRLKVPPALNQFTKTLDKNLASNLFKMLLKYRPEDKAAKKDRLLKKAQAEAEGKTIEAKKPIAVKYGINHVTYLIEQSKAQLVVIAHDVDPIELVVWLPTLCRKMNIPYAIVKGKSRLGAIVHKKTATALCLTSVKNEDKMEFSRIVEAIKANFNDKYDEYRRQWGGGIMGSKSQAKTKAKERLVAKEASQRLI

SEQ ID NO: 8835 - protein, 257 aa, Citrullus lanatus
KAPKKAVGKALAKKKPEKVVNPLFEKRPKQFGIGGAIPPKRDLTRFVKWPKVVQIQRKKRILKQRLKVPPALNQFTKTLDKNLATNLFKMLLKYRPEDKSQKRERLLKRAQEEAEGKPHDAKKPIVVKYGLNHVTYLIEQNKAQLVVIAHDVDPIELVVWLPALCRKMEIPYCIVKGKARLGAIVHKKTASVLCLTTVKNEDKLECSRILEAIKANFNDKYDEYRKKWGGGIMGSKSQAKTKAKEKLLAKEAAQRMS

SEQ ID NO: 8836 - protein, 65 aa, Ambrosia trifida
MAPKKGVKTVATKKKTEKVVNPLFEKRPKQFGIGGALPPKRMYTGLSDGRKLSEFRGRGGSSSSV

SEQ ID NO: 8837 - protein, 209 aa, Bruguiera gymnorhiza
MAPKRPVGKAPVAAKKKPEKVVNPLFEKRPKQFGIGGALPPKKDLTRFVKWPHVVRIQRQRRILKQRLKVPPAVNQFTKTLDKNLASQLFKLLLKYRPEDKAAKKERLLKRAQAEAEGKSVESKKPIVVKYGLNHVTYLIEQNKAQLVVIAHDVDPIELVVWLPALCRKMEVPYAIVKGKSRLGAIVHKKTAAALCLTSVKNEDKFEFS

SEQ ID NO: 8838 - protein, 258 aa, Solanum melongena
MAPKKGVAVAAKKKPEKAKVVNPLFEKRPKQFGIGGALPPKKDVTRNVRWPKNVILQRKKRILKMRLKVPPALNQFTKTLDKNLATNLFKMLLKYRPEDKAAKKERLVKRAQAEAEGKTAETKKPIIVKYGLKHITYLIEQNKAQLVVIAHDVDPIELVVWLPALCRKMEIPYCIVKGKARLGSIVHKKTASALCLTTVKNEDKMEFSRILEAIKANFNDKYEENRKKWGGGIMGSKSQARTKAKERVLAKEAAQRLT

SEQ ID NO: 8839 - protein, 106 aa, Fagopyrum esculentum
MAPKRGVKAVTTKKKTEKAVNPLYEKRPKQFGIGGALPPKKDMRRFVKWPKVVQLQRKKRILKQRLKVPPALNQFTKTLDKNLATSLFKMLLKYRPEDKAAKKDAF

SEQ ID NO: 8840 - protein, 257 aa, Arnica chamissonis
MAPRKVVKTAATKKKTEKVVNPLFEKRPKQFGIGGALPPKKDVHRFVRWPQVVRIQRKRRILKQRLKVPPALNQFTKTLDKNLATTLFKMLLKYRPEDKAEKRERLLKRAQAESDGKTVESKKPIVVKYGLNHVTYLIEQNKAQLVIIAHDVDPIELVVWLPALCRKMEIPYCIVKGKSRLGTIVHQKTASALCLTTVKNEDKMEFSRILEAIKANFNDKYDEYRKKWGGGIMGSKSQAKTKAKERVLAKEAAQRMN

SEQ ID NO: 8841 - protein, 257 aa, Artemisia annua
MAPKKGGKPIVTKKKTEKVVNPLFEKRPKLFGIGGALPPKKDVHRFVRWPQVVRIQRKRRILKQRLKVPPALNQFTKTLDKNLATTLFKMLLKYRPEDKAAKKERLIKRAQAESEGKTVEAKKPIVVKYGLNHITYLIEQNKAQLVIIAHDVDPIELVVWLPALCRKMEIPYCIVKGKSRLGTIVHQKTAAALCLTTVKNEDKMEFSRVLEAIKANFNDKYEEYRKKWGGGIMGSKSQAKTRAKEKVLAKEAAQRMN

SEQ ID NO: 8842 - protein, 258 aa, Unknown
  Sequence found in Organisms: Cannabis sativa, Humulus lupulus
MPPKKTGKASALSKKKPEKVVNPLFEKRPKQFGIGGALPPKRDLHRFVKWPKAVQLQRKKRILKQRLKVPPQLNQFTKTLDKNLATSLFKLLLKYRPEDKAEKKERLVKRAQAEAEGKTAETKKPIVVKYGLNHVTYLIEQNKAQLVVIAHDVDPIELVVWLPALCRKMEIPYCIVKGKSRLGSIVHQKTAAALCLTTVKNEDKMEFSKILEAIKANFNDKFDEFRKKWGGGIMGSKSQAKTKAKERVLAKEAAQRMN

SEQ ID NO: 8843 - protein, 257 aa, Cirsium arvense
MAPKKGGKPITTKKKTEKVVNPLFEKRPKQFGIGGALPPKKDVHRFVRWPQVVRIQRKRRILKQRLKVPPALNQFTKTLDKNLATTLFKMLLKYRPEDKAAKKERLMKRAQAESEGKTAEAKKPIVVKYGLNHITYLIEQNKAQLVIIAHDVDPIELVVWLPALCRKMEIPYCIVKGKSRLGTIVHQKTAAALCLTTVKNEDKMEFSRILEAIKANFNDKYEEYRKKWGGGIMGSKSQAKTKAKERVLAKEAAQRLN

SEQ ID NO: 8844 - protein, 258 aa, Euonymus alatus
MAPKRGGKAPVPAKKKTEKVVNPLFEKRPKQFGIGGALPPKKDLTRFVKWPHVVRIQRKRRILKQRLKVPPAINQFTKALDKNLATNLFKLLLKYRPEDKAAKRERLLKKAQAEAEGKTVESKKPIVVKYGLNHVTYLIEQNKPQLVIIAHDVDPIELVVWLPALCRKMEVPYAIVKGKSRLGTIVHKKTAAVLCLTSVKNEDKMEFSRIVEAVKANFNDKYDEHRKKWGGGIMGSKSQAKMKAKERVLAKEAAQRMS

SEQ ID NO: 8845 - protein, 258 aa, Euphorbia peplus
MAPKKGVKAPVAAKKKTDKVVNPLIEKRPKQFGIGGALPPKKDLTRFVKWPHVVRIQRQRRILKQRLKVPPAVNQFTKTLDKNLATQLFKLLLKYRPEDKAAKKERLLQRAQAETEGKTVESKKPIVVKYGLNHVTYLIEQNKAQLVVIAHDVDPIELVVWLPALCRKMEVPYAIVKGKSRLGAIVHQKTAAALCITSVKNEDKMEFSKILEAVKANFNDKFDEHRKKWGGGIMGSKSQAKSKAKERVLAKEAAQRMN

SEQ ID NO: 8846 - protein, 257 aa, Cucumis melo
MAPKKAVGKALAKKKPEKVVNPLFEKRPKQFGIGGAIPPKRDLTRFVKWPKVVQIQRKKRILKQRLKVPPALNQFTKTLDKNLATNLFKMLLKYRPEDRSQKRERLLKRAQEEADGKPHDAKKPIVVKYGLNHVTYLIEQNKAQLVVIAHDVDPIELVVWLPALCRKMEIPYCIVKGKARLGSIVHKKTASVLCLTTVKNEDKMEFSRILEAIKANFNDKYEEYRKKWGGGIMGSKSQAKTKAKEKLLAKEAAQRMS

SEQ ID NO: 8847 - protein, 256 aa, Orobanche aegyptiaca
MAPKKGAKPPAKKKPEKVVNPLLEKRPKQFGIGGALPPKRDLHRFVKWPQVVRIQRKKMILKQRLKVPPPIHQFSKTLDKNLATSLFKMLLKYRPEDRAQKKERLLKRAQAEAEGKTPEFKKPIVVKYGLNHVTYLIEQNKAQLVVIAHDVDPIELVVWLPALCRKMEIPYCIVKGKARLGTIVHKKTSAVLCLTSVKNEDKLDFSKILEAIKANFNDKYDETRKKWGGGVMGSKSQAKTKAKERVLAKEAAQRMT

SEQ ID NO: 8848 - protein, 85 aa, Secale cereale
PLFEKRPKQFGIGGALPPKKDLHRFVKWPKVVRIQRQRRILKQRLKVPPASTSSPAPSTRTSPPTCLRCFSSTALRTRWLRRRGF

SEQ ID NO: 8849 - protein, 258 aa, Senecio madagascariensis
MAPKKGGKPVVTKKKTVEKVVNPLFEKRPKQFGIGGALPPKKDLHRFVRWPQVVRIQRKRRILKQRLKVPPALNQFTKTLDKNLATTLFKMMLKYRPEDKAAKKERLKTRALAESEGKTVEAKKPIVVKYGLNHITYLIEQNKAQLVIIAHDVDPIELVVWLPALCRKMEIPYCIVKGKSRLGAIVHQKTAAALCLTTVKNEDKMEFSRILEAIKANFNDKYEEYRKKWGGGIMGSKSQAKTKAKERVLAKEAAQRLN

SEQ ID NO: 8850 - protein, 259 aa, Trigonella foenum-graecum
MAPKKGVKAPVAASKKKPEKVTNPLFEKRPKQFGIGGALPPKRDLTRFVKWPKTVQIQRKKRILKQRLKVPPALNQFTKTLDKNLATSLFKILLKYRPEDKAEKKERLLKRAQAEADGKTVETKKPINVKYGLNHVTYLIEQNKAQLVVIAHDVDPIELVVWLPALCRKMEIPYCIVKGKARLGTVVHKKTAAVLCLTTVKNEDKMEFSRVLEAIKANFNDKYEEYRKKWGGGIMGSKSQAKTKAKERLIAKEAAQRLP

SEQ ID NO: 8851 - protein, 256 aa, Triphysaria pusilla
MAPKKGAKPAAKKKVEKVVNPLFEKRPKQFGIGGALPPKKDLHRFVKWPQVVRIQRKKMILKQRLKVPPPIHQFSKTLDKNLATSLFKMLLKYRPEDKAQKKERLLKRAQAETEGKTPEVKKPIVVKYGLNHVTYLIEQNKAQLVVIAHDVDPIELVVWLPALCRKMEIPYCIVKGKARLGTIVHKKTASVLCLTSVKNEDKMDFSKILEAIKANFNDKYDETRKKWGGGVMGSKSQAKTKAKERVLAKETAQRMN

SEQ ID NO: 8852 - protein, 259 aa, Gnetum gnemon
MAPKKFVGKITTPAKKKAPKVVNPLFEKRPKQFTIGGDLPPKRDLHRFVRWPRVVRLQRQRRILKQRLKVPPALNQFTKTLDKNLASNLFKLLLKYRPEDKAAKKERLLKKAEAEAEGKTVEAKKPIVVKYGINHITYLIEQSKAQLVVIAHDVDPIELVVWLPALCRKMNVPYAIVKGKARLGSIVHKKTATALCLTSVKNEDKMEFSKIVEAIKANFNDKFDEYRRQWGGGIMGSKSQARTKAKEKLMAKEAAQRLT

SEQ ID NO: 8853 - protein, 253 aa, Ambrosia trifida
MAPKKKIVATKKKTEKVVNPLFEKRPKQFGIGGALPPKKDVHRFVRWPQVVRIQRKRRILKQRLKVPPALNQFTKTLDKNLATTLFKMLLKYRPEDKAAKKERLQKRAEAEVDGKTVETKKPIVVKYGLNHVTYLIEQNKAQLVIIAHDVDPIELVVWLPALCRKMEIPYCIVKGKSRLGAIVHQKTASALCLTTVKNEDKMEFSRILEAIKANFNDKYDEYRKKWGGGIMGSKSQAKQRQRKGYWRKKLLRG

SEQ ID NO: 8854 - protein, 252 aa, Flaveria ramosissima
KKGVKVATKKKTEKVVNPLFEKRPKQFGIGGALPPKKDLHRFVRWPQVVRIQRKRRILKQRLKVPPALNQFTKTLAKILQLLCSRCYLSTDQRIKLQRKNVFEKGPGRVRGETVEAKKPIVVKYGLNHVTYLIEQNKAQLVIIAHDVDPIELVVWLPALCRKMEIPYCIVKGKSRLGAIVHQKTAAALCLTTVKNEDKMEFSRILEAIKTNFNDKYDEYRKKWGGGIMGSKSQAKTKAKERVLAKEAAQRMN

SEQ ID NO: 8855 - protein, 280 aa, Lotus japonicus
MAPKKGGKPVAASKKKTEKVTNPLFEKRPKQFGIGGALPPKRDLTRFVKWPKVVQIQRKKRILKQRLKVPPALNQFTKTLDKNLATSLFKILLKYRPEDKAEKKERLLKRAQAEAENKTVKTEKPINVKYGLNHVTYLIEQNKAQLVVIAHDVDPIELVVWLPALCRKMEIPYCIVKGKARLGSIVHKKTASVLCLTSVKNEDKLEFSRVLEAIKANFNDKYEEYRKKWGGGIMGSKSQAKTKAKERVLAKEAAQKDELGVQHCFVALCLFFWLFNVLLT

SEQ ID NO: 8856 - protein, 270 aa, Utricularia gibba
RSSCFLVVVGGKWLPKRGVKPAAAAKKKAEKVVNPLFEKRPKQFGIGGALPPKRDLHRFVKWPQVVQIQRKKMILKQRLKVPPPIHQFSKTLDKNLATSLFKVLLKYRPEDKAEKKERLLKRAQAEAEGKTPELKRPIVVKYGLNHVTYLIEQNKAQLVVIAHDVDPIELVVWLPALCRKMEIPYCIVKGKARLGTIVHKKTASVLCLTSVKNEDKMEFSKILEAIKANFNDKFDETRKKWGGGVMGSKSRAKTKAKERLMAKEAAQRMT

SEQ ID NO: 8857 - protein, 256 aa, Cleome spinosa
MAPKKGVKVATKKKPEKVTNPLFEKRPKQFGIGGALPPKKDLSRYIKWPKAIRLQRQKRILKQRLKVPPALNQFTKTLDKNLATSLFKLLLKYRPEDKAAKKERLLKKAQSEAEGKPSDAKKPIVVKYGLNHVTYLIEQNKAQLVVIAHDVDPIELVVWLPALCRKMEVPYCIVKGKSRLGAVVHKKTASCLCLTTVKNEDKLEFSKILEAIKANFNDKYDEYRKKWGGGIMGSKSQAKTKAKERVLAKEAAQRMS

SEQ ID NO: 8858 - protein, 256 aa, Cleome spinosa
MAPKKGMKVAAKKKPEKVTNPLFEKRPKQFGIGGALPPKKDLSRYIKWPKAIRLQRQKRILKQRLKVPPAVNQFTKTLDKNLATSLFKLLLKYRPEDKAAKKERLLKKAQSETEGKTVETKKPIVAKYGLNHVTYLIEQNKAQLVVIAHDVDPIELVVWLPALCRKMEVPYCIVKGKSRLGAIVHKKTASCLCLTTVKNEDKMEFSKVLEAIKANFNDKFDENRKKWGGGIMGSKSQAKTKAKERVLAKEAAQRMS

SEQ ID NO: 8859 - protein, 257 aa, Taraxacum officinale
MAPKKGGKAVATKKKTEKVANPLFEKRPKQFGIGGALPPKKDVHRFVRWPQVVRLQRKRRILKQRLKVPPALNQFTKTLDKNLATTLFKMLLKYRPEDKAAKKERLLNRAKAESEGKTVEAKKPIVVKYGLNHVTYLIEQNKAQLVIIAHDVDPIELVVWLPALCRKMEIPYCIVKGKSRLGTIVHQKTAAALCLTTVKNEDKMEFSRVLEAIKANFNDKYEEYRKKWGGGIMGSKSQAKTKAKERVYAKEAAQRLK

SEQ ID NO: 8860 - protein, 259 aa, Olea europaea
MAPKKGAKLPAGVAKKKAEKVVNPLFEKRPKQFGIGGALPPKKDLHRFVKWPQVVRIQRKKMILKQRLKVPPPIHQFSKTLDKNLATSLFKMLLKYRPEDKAQKKERLLKRAQAEAEGKTPEIKKPIIVKYGLNHVTYLIEQNKAQLVIIAHDVDPIELVVWLPALCRKMEIPYCIVKGKARLGTIVHKKTASVLCLTSVKNEDKMDFSRILEAIKANFNDKYDETRKKWGGGVMGSKSLAKTKAKERLMAKEAAQRMT

SEQ ID NO: 8861 - protein, 256 aa, Olea europaea
MAPKKGAKLPAKKKVEKVVNPLFEKRPKQFGIGGALPPKKDLHRFVKWPQVVRIQRKKMILKQRLKVPPPIHQFSKTLDKNLATSLFKMLLKYRPEDRAEKKERLLKRAQAEAEGKTPEVKKPIIVKYGLNHITYLIEQNKAQLVVIAHDVDPIELVVWLPALCRKMEIPYCIVKGKARLGTIVHKKTASALCLTSVKNEDKLEFSKILEAIKANFNDKYDETRKKWGGGVMGSKSQAKAKAKERILAKEAAQRMS

SEQ ID NO: 8862 - protein, 259 aa, Olea europaea
MAPKKGAKLPAGVAKKKAEKVVNPLFEKRPKQFGIGGALPPKKDLHRFVKWPQVVRIQRKKMILKQRLKVPPPIHQFSKTLDKNLATSLFKMLLKYRPEDKAQKKERLLKRAQAEAEGKTPEVKKPIIVKYGLNHVTYLIEQNKAQLVIIAHDVDPIELVVWLPALCRKMEIPYCIVKGKARLGTIVHKKTASVLCLTSVKNEDKMDFSRILEAIKANFNDKYDETRKKWGGGVMGSKSLAKTKAKERLMAKEAAQRMT

SEQ ID NO: 8863 - protein, 257 aa, Triphysaria pusilla
MAPKKGARPVAAAKKKTEKVANPLFEKRPKQFGIGGALPPKKDLHRFVKWPQVVRIQRKKMILKQRLKVPPPIHQFSKTLDKNLATSLFKMLLKYRPEDKAQKKERLLKRAQAETEGKTPEFKKPIVVKYGLNHVTYLIEQNKAQLVVIAHDVDPIELVVWLPALCRKMEIPYCIVKGKARLGTIVHKKTASVLCLTSVKNEDKMDFSKILEAIKANFNDKYDETRKKWGGGVMGSKSQAKTKAKERVIAKEAAQRM

SEQ ID NO: 8864 - protein, 258 aa, Tripterygium wilfordii
MAPKRGGKAPVAAKKKTEKIVNPLFEKRTKQFGIGGALPPKKDLTRFVKWPHVVRIQRKRRILKQRLKVPPAINQFTKALDKNLATNLFKLLLKYRPEDKAAKRERLLKKAQAEAEGKSVESKKPIVVKYGLNHVTYLIEQNKAQLVLIAHDVDPIELVVWLPALCRKMEVPYAIVKGKSRLGTIVHKKTAAVLCLTSVKNEDKMEFSRIVEAVKANFNDKYDEHRKKWGGGIMGSKSQAKMKAKERVLAKEAAQRMT

SEQ ID NO: 8865 - protein, 260 aa, Fagopyrum esculentum
MAPKRGGKVSSGITKKKTEKVVNPLYEKRPKQFGIGGALPPKKDMRRFVKWPKVVQLQRKKRILKQRLKVPPALNQFTKTLDKNLATSLFKMLLKYRPEDKAAKKERLLNKAQADTAGKEAAAAKKPIVVKYGLKHVTYLIEQNKAQLVVIAHDVDPIELVVWLPALCRKMEIPYCIVKGKARLGSIVHKKNASVLCLTTVKNEDKLDFSKILEAIKANFNDKYEEFRKKWGGGIMGSKSQAKTKAKERVLAKEAAQRMT

SEQ ID NO: 8866 - protein, 258 aa, Solanum lycopersicum
MAPKKGVAVAAKKKPEKAKAVNPLFEKRPKQFGIGGALPPKKDVTRNVRWPRNVVLQRKKRILKMRLKVPPALNQFTKTLDKNPATTLFKMLLKYRPEDKAAKKERLVKRAQAEAEGKTPETKKPIVVKYGLKHITYLIEQNKAQLVVIAHDVDPIELVVWLPALCRKMEIPYCIVKGKARLGSIVHKKTASALCLTTVKNEDKMEFSRILEAIKANFNDKYEENRKKWGGGIMGSKSQARTKAKERVLAKEAAQRLN

SEQ ID NO: 8867 - protein, 200 aa, Fagopyrum esculentum
MAPKRGGKVSSGPTKKKTEKTVNPLYEKRPKQFGIGGALPPKKDMRRFVKWPKVVQLQRKKRILKQRLKVPPALNQFTKTLDKNLATSLFKMLLKYRPEDKAAKKERLLNKAQADAAGKEAAAAKKPIVVKYGLKHVTYLIEQNKAQLVVIAHDVDPIELVVWLPALCRKMEIPYCIVKGKARLGSIVHRKMHLCCVSPL

SEQ ID NO: 8868 - protein, 90 aa, Utricularia gibba
MEIPYCIVKGKARLGTIVHKKTASVLCLTSVKNEDKMEFSKVLEAIKANFNDKFDETRKKWGGGVMGTKSQAKTKAKERLLAKEAAQRMT

SEQ ID NO: 8869 - protein, 107 aa, Triticum aestivum
MAPKRGGRAPVPAKKKTDKVTNPLFEKRPKQFGIGGALPPKKDLHRFVKWPKVVRIQRQRRILKQRLKVPPALNQFTRTLDKNLATNLFKMLLKYRPEDKAAKKESF

SEQ ID NO: 8870 - protein, 259 aa, Olea europaea
MAPKKGAKLPAGVAKKKAEKVVNPLFEKRPKQFGIGGALPPKKDLHRFVKWPQVVRIQRKKMILKQRLKVPPPIHQFSKTLDKNLATSLFKMLLKYRPEDKAQKKERLLKRAQAEAEGRTPEIKKPIIVKYGLNHVTYLIEQNKAQLVIIAHDVDPIELVVWLPALCRKMEIPYCIVKGKARLGTIVHKKTASVLCLTSVKNEDKMDFSRILEAIKANFNDKYDETRKKWGGGVMGSKSLAKTKAKERLMAKEAAQRMT

SEQ ID NO: 8871 - protein, 258 aa, Orobanche aegyptiaca
MAPKKGVKPAAAAKKKTEKVVNPLLEKRPKQFGIGGALPPKRDLHRFVKWPQVVRIQRKKMILKQRLKVPPPIHQFSKTLDKNLATSLFKMLLKYRPEDRAQKKERLLKRAQAEAEGKTPEFKKPIVVKYGLNHVTYLIEQNKAQLVVIAHDVDPIELVVWLPALCRKMEIPYCIVKGKARLGTIVHKKTSAVLCLTSVKNEDKLDFSKILEAIKANFNDKYDETRKKWGGGVMGSKSQAKTKAKERVLAKEAAQRMT

SEQ ID NO: 8872 - protein, 255 aa, Eutrema parvulum
APKKGVKVATKKKPEKVTNPLFERRPKQFGIGGALPPKKDLTRYIKWPKSIRLQRQKRILKQRLKVPPALNQFTKTLDKNLATNLFKVLLKYRPEDTAAKKDRLLKKAQAEAEGKPSESKKPIVVKYGLNHVTYLIEQNKAQLVVIAHDVDPIELVVWLPALCRKMEVPYCIVKGKSRLGSIVHQKTASCLCLTTVKNEDKLEFSKILEAIKANFNDKYDEYRKKWGGGIMGSKSQAKTKAKERVLAKEAAQRMT

SEQ ID NO: 8873 - protein, 258 aa, Tripterygium wilfordii
MAPKRGGKAPVTAKKKTEKVVNPLFEKRPKQFGIGGALPPKKDLTRFVKWPHVVRIQRKRRILKQRLKVPPAINQFTKALDKNLATNLFKLLLKYRPEDKAAKRERLFKKAQAEAEGKSVESKRPIVVKYGLNHVTYLIEQNKAQLVIIAHDVDPIELVVWLPALCRKMEVPYAIVKGKSRLGTIVHKKTAAVLCLTSVKNEDKMEFSRIVEAVKANFNDKYDEHRKKWGGGIMGSKSQAKMKAKERLLAKEAAQRMS

SEQ ID NO: 8874 - protein, 261 aa, Fagopyrum esculentum
MAPKRGGKLAASAPSKKKPEKAVNPLYEKRPKQFGIGGALPPKRDMKRFVKWPKVVQLQRKKRILKQRLKVPPALNQFTKTLDKNLATSLFKMLLKYRPEDKAAKKERLINKAQADAAGKEAATAKKPIVIKYGLKHVTYLIEQNKAQLVVIAHDVDPIELVVWLPALCRKMEIPYCIVKGKARLGSIVHKKNASVLCLTTVKNEDKLDFSKILEAIKANFNDKYEEFRKKWGGGIMGSKSQAKTKAKERVLAKEAAQRMT

SEQ ID NO: 8875 - protein, 261 aa, Fagopyrum esculentum
MAPKRGGKLATSASAKKKPEKTVNPLYEKRPKQFGIGGALPPKRDMKRFVKWPKVVQLQRKKRILKQRLKVPPALNQFTKTLDKNLATSLFKMLLKYRPEDKAAKKERLINKAQADAAGKEAAAAKKPIVVKYGLKHVTYLIEQNKAQLVVIAHDVDPIELVVWLPALCRKMEIPYCIVKGKARLGSIVHKKNASVLCLTTVKNEDKLDFSKILEAIKANFNDKYEEFRKKWGGGIMGSKSQAKTKAKERVLAKEAAQRMT

SEQ ID NO: 8876 - protein, 262 aa, Adiantum capillus-veneris
MAPKRGTKLPVPAAADKKKTPEKVQNPLFEKRPKQFGIGGALPPKKDLHRFVKWPKYVRLQRQRRVLNQRLKVPPALNQFTKTLDKNLASSLFKMLIKYRPEDKAAKKERLLKKAQAEAEGKTIESKKPIVVKYGINHVTYLIEQGKAQLVVIAHDVDPIELVIWLPALCRKMGIPYAIVKGKARLGQIVHSKTATALCLTSVKNEDKLEFSKIVEAIKANFNDRFDDLRRQWGGGIMGVKSQAKTKAKEKVLAKEAAQRMS

SEQ ID NO: 8877 - protein, 244 aa, Glycyrrhiza uralensis
MAPKRGGKAPVVAAKKKQPEKVVNPLFEKRPKQFGIGGALPPKRDLTRFVKWPKTVQLQRKKRILKQRLKVPPALNQFTKTLDKNLATNLFKMLLKYRPEDKAEKKERLLKRAQAEADGKPVEAKKPIVVKYGLNHVTYLIEQNKAQLVVIAHDVDPIELVVWLPALCRKMEIPYCIVKGKARLGTIVHKKTASVLCLTTVKNEDKLEFSRILEAIKANFNDKYDEYRKKWGGGIMGSKSQAKT

SEQ ID NO: 8878 - protein, 263 aa, Nicotiana benthamiana
VGNWLQAPKKGVAVAAKKKPVQAKVVNPLFEKRPKQFGIGGALPPKKDLTRFVRWPQVVRIQRKRRILKQRLKVPPALNQFSKTLDKNLATNLFKMLLKYRPEDKAAKKERLVKRAQAETEGKTPETKKPIIVKYGLKHITYLIEQNKAQLVVIAHDVDPIELVVWLPALCRKMEIPYCIVKGKARLGSIVHKKTASALCLTTVKNEDKMEFSRILEAIKANFNDKYEENRKKWGGGVMGSKSQARTKAKERVLAKEAAQRMN

SEQ ID NO: 8879 - protein, 258 aa, Solanum tuberosum
MAPKKGVAVAAKKKPEKAKVVNPLFEKRPKQFGIGGALPPKKDVTRNVRWPRNVTLQRKKRILKMRLKVPPALNQFTKTLDKNLATNLFKMLLKYRPEDKAAKKERLVKRAQAEAEGKTPETKKPIIVKYGLKHITYLIEQNKAQLVVIAHDVDPIELVVWLPALCRKMEIPYCIVKGKARLGSIVHKKTASALCLTTVKNEDKTEFSRVLEAIKANFNDKYEENRKKWGGGIMGSKSQARTKAKERVLAKEAAQRLN

SEQ ID NO: 8880 - protein, 258 aa, Unknown
  Sequence found in Organisms: Solanum tuberosum, Solanum phureja
MAPKKGVAVAAKKKPEKAKVVNPLFEKRPKQFGIGGALPPKKDVTRNVRWPRNVTLQRKKRILKMRLKVPPALNQFTKTLDKNLATNLFKMLLKYRPEDKAAKKERLVKRAQAEAEGKTPETKKPIIVKYGLKHITYLIEQNKAQLVVIAHDVDPIELVVWLPALCRKMEIPYCIVKGKARLGSIVHQKTASALCLTTVKNEDKMEFSRILEAIKANFNDKYEENRKKWGGGIMGSKSQARTKAKERVLAKEAAQRLN

SEQ ID NO: 8881 - protein, 290 aa, Artemisia annua
SPFRTSKSKFHTNGSKERCEDCNQEEDGEGGEPVVREEAEAVWDWWSFATKKDVHRFVRWPQVVRIQRKRRILKQRLKVPPALNQFTKTLDKNLATTLFKMLLKYRPEDKAAKKERLIKRAQAESEGKTVEAKKPIVVKYGLNHITYLIEQNKAQLVIIAHDVDPIELVVWLPALCRKMEIPYCIVKGKSRLGTIVHQKTAAALCLTTVKNEDKMEFSRVLEAIKANFNDKYEEYRKKWGGGIMGSKSQAKTRAKERVLAKEAALESIFGNLLSAVEVVIFDFETFVTFF

SEQ ID NO: 8882 - protein, 256 aa, Brassica rapa
MAPKKGVKAVTKKKSEKVTNPLFERRPKQFGIGGALPPKKDLTRYIKWPKSIRLQRQKRILKQRLKVPPALNQFTKTLDKNLATSLFKMMLKYRPEDKAAKKERLLKKAQAEAEGKTVESKKPIVVKYGLNHVTYLIEQNKAQLVVIAHDVDPIELVVWLPALCRKMEVPYCIVKGKSRLGAIVHQKTAACLCLTTVKNEDKMEFSKILEAIKANFNDKYEEYRKKWGGGIMGSKSQAKTKAKERVLAKEAAQRMN

SEQ ID NO: 8883 - protein, 256 aa, Brassica napus
MAPKKGVKAVTKKKSEKVTNPLFERRPKQFGIGGALPPKKDLTRYIKWPKSIRLQRQKRILKQRLKVPPALNQFTKTLDKNLATSLFKMMLKYRPEDKAAKKERLLKKAQAETEGKTVESKKPIVVKYGLNHVTYLIEQSKAQLVVIAHDVDPIELVVWLPALCRKMEVPYCIVKGKSRLGAIVHQKTAACLCLTTVKNEDKMEFSKILEAIKANFNDKYEEYRKKWGGGIMGSKSQAKTKAKERVLAKEAAQRMN

SEQ ID NO: 8884 - protein, 256 aa, Cleome spinosa
MAPKKGVKVATKKKPEKVTNPLFEKRPKQFGIGGALPPKKDLSRYIKWPKAIRLQRQKRILKQRLKVPPAVNQFTKTLDKNLATSVFKLLLKYRPEDKAAKKERLLKKAQAETEGKPSEAKKPIVVKYGLNHVTYLIEQNKAQLVVIAHDVDPIELVVWLPALCRKMEVPYCIVKGKSRLGAVVHKKTASCLCLTTVKNEDKMEFSKILEAIKANFNDKYDENRKKWGGGIMGSKSQAKTKAKERVLAKEAAQRMS

SEQ ID NO: 8885 - protein, 258 aa, Humulus lupulus
MPPKKTGKSSALSKKKPEKIVNPLFEKRPKQFGIGGALPPKRDLHRYVKWPKAVQLQRKKRILKQRLKVPPQLNQFTKTLDKNLATSLFKLLLKYRPEDKAEKKERLVKRAQAETEGKTAETKKPIVVKYGLNHVTYLIEQNKAQLVVIAHDVDPIELVVWLPALCRKMEIPYCIVKGKSRLGSIVHQKTAAALCLTTVKNEDKMEFSKILEAIKANFNDKFDEFRKKWGGGIMGSKSQAKTKAKERVLAKEAAQRMN

SEQ ID NO: 8886 - protein, 256 aa, Mimulus guttatus
MAPKKGAKLPLKKKSDKVVNPLFEKRPKQFGIGGALPPKKDLHRFVKWPQVVRIQRKKMILKQRLKVPPPIHQFSKTLDKNLATSLFKMLLKYRPEDRAEKKERLLKRAQAESEGKAPEYKKPIVVKYGLNHVTYLIEQNKAQLVVIAHDVDPIELVVWLPALCRKMEIPYCIVKGKARLGTIVHQKTASVLCLTSVKNEDKMDFSKILEAIKANFNDKYDETRKKWGGGVMGSKSQAKTKAKERVLAKEAAQRMN

SEQ ID NO: 8887 - protein, 256 aa, Olea europaea
MAPKKGTKLPAKKKVEKVVNPLFEKRPKQFGIGGALPPKKDLHRFVKWPQVVRIQRKKMILKQRLKVPPPIHQFSKTLDKNLATSLFKMLLKYRPEDRAQKKERLLKRAQAEAEGKTPEVKKPIIVKYGLNHITYLIEQNKAQLVVIAHDVDPIELVVWLPALCRKMEIPYCIVKGKARLGTIVHKKTASALCLTSVKNEDKLEFSKILEAIKANFNDKYEETRKKWGGGVMGSKSQAKAKAKERILAKEAAQRMS

SEQ ID NO: 8888 - protein, 256 aa, Eutrema halophilum
MAPKKGVKVATKKKPEKVTNPLFERRPKQFGIGGALPPKKDLTRYIKWPKAIRLQRQKRILKQRLKVPPALNQFTKTLDKNLATSLFKILLKYRPEDKAAKKDRLLKKAQAEAEGKTSESKKPIVVKYGLNHVTYLIEQNKAQLVVIAHDVDPIELVVWLPALCRKMEVPYCIVKGKSRLGTVVNQKTAACLCLTTVKNEDKLEFSKILEAIKANFNDKYDEYRKKWGGGIMGSKSQAKTKAKERVLAKEAAQRMT

SEQ ID NO: 8889 - protein, 255 aa, Eutrema halophilum
APKKGVKVAAKKKTEKVTNPLFERRPKQFGIGGALPPKKDLTRYIKWPKAIRLQRQKRILKQRLKVPPALNQFTKTLDKNLATSLFKILLKYRPEDKAAKKERLVKKAQAEAEGKPSESKKPIVVKYGLNHVTYLIEQNKAQLVVIAHDVDPIELVVWLPALCRKMEVPYCIVKGKSRLGAVVHQKTAACLCLTTVKNEDKLEFSKILEAIKANFNDKYDEYRKKWGGGIMGSKSQAKTKAKERVLAKEAAQRMT

SEQ ID NO: 8890 - protein, 257 aa, Arabidopsis thaliana
MAPKKGVKVAAKKKTAEKVSNPLFERRPKQFGIGGALPPKKDLSRYIKWPKSIRLQRQKRILKQRLKVPPALNQFTKTLDKNLATSLFKVLLKYRPEDKAAKKERLVKKAQAEAEGKPSESKKPIVVKYGLNHVTYLIEQNKAQLVVIAHDVDPIELVVWLPALCRKMEVPYCIVKGKSRLGAVVHQKTASCLCLTTVKNEDKLEFSKILEAIKANFNDKYEEYRKKWGGGIMGSKSQAKTKAKERVIAKEAAQRMN

SEQ ID NO: 8891 - protein, 256 aa, Brassica juncea
MAPKKGVKAVTKKKPEKVTNPLFERRPKQFGIGGALPPKKDLTRYIKWPKSIRLQRQKRILKQRLKVPPALNQFTKTLDKNLATSLFKMMLKYRPEDKAAKKERLLKKAQAEAEGKTVESKKPIVVKYGLNHVTYLIEQNKAQLVVIAHDVDPIELVVWLPALCRKMEVPYCIVKGKSRLGTIVNQKTAACLCLTTVKNEDKMEFSKILEAIKANFNDKYEEYRKKWGGGIMGSKSQAKTKAKERVLAKEAAQRMN

SEQ ID NO: 8892 - protein, 256 aa, Brassica napus
MAPKKGVKAVTKKKSEKVTNPLFERRPKQFGIGGALPPKKDLTRYIKWPKSIRLQRQKRILKQRLKVPPALNQFTKTLDKNLATSLFKMMLKYRPEDKAAKKERLLKKAQAETEGKTVESKKPIVVKYGLNHVTYLIEQNKAQLVVIAHDVDPIELVVWLPALCRKMEVPYCIVKGKSRLGAIVHQKTAACLCLTTVKNEDKMEFSKILEAIKANFNDKYEEYRKKWGGGIMGSKSQAKTKAKERVLAKEAAQRMN

SEQ ID NO: 8893 - protein, 256 aa, Cleome gynandra
MAPKKGVKVATKKKPEKVTNPLFEKRAKQFGIGGALPPKKDLSRYIKWPKAIRLQRQKRILKQRLKVPPTVNQFTKTLDKNLATNLFKLLLKYRPEDKAAKKERLIKKAQAEAEGKSSETKKPIVVKYGLNHVTYLIEQNKAQLVVIAHDVDPIELVVWLPALCRKMEVPYCIVKGKSRLGAIVHKKTASCLCLTTVKNEDKMEFSRVLEAIKANFNDKYDEYRKKWGGGIMGSKSQAKTKAKERVLAKEAAQRMT

SEQ ID NO: 8894 - protein, 258 aa, Unknown
  Sequence found in Organisms: Solanum tuberosum, Solanum phureja
MAPKKGVAVASKKKPEKAKVVNPLFEKRPKQFGIGGALPPKKDVTRNVRWPRNVTLQRKKRILKMRLKVPPALNQFTKTLDKNLATNLFKMLLKYRPEDKAAKKERLVKRAQAEAEGKTPETKKPIIVKYGLKHITYLIEQNKAQLVVIAHDVDPIELVVWLPALCRKMEIPYCIVKGKARLGSIVHKKTASALCLTTVKNEDKMEFSRVLEAIKANFNDKYEENRKKWGGGIMGSKSQARTKAKERVLAKEAAQRLN

SEQ ID NO: 8895 - protein, 256 aa, Sarracenia psittacina
MAPKKGVKPVAAAKKKPEKVVNPLFEKRPKQFGIGGALPPKKDLHRFVKWPKVVQIQRKRRILCQRLKVPPALNQFTKTLDKNLATNLFKMLLKYRPEDKAAKKERLLKTAQAQAEGKPLESKKPIVVKYGLNHVTYLIEQNKAQLVIIAHDVDPIELVVWLPALCRKMEIPYCIVKGKARLGTIVHKKTSAVLCLTTVKNEDKLEFSKILEAIKANFNDKYDEYRKKWGGGIMGSKSQAKTRQKRGFLQRKLLRG

SEQ ID NO: 8896 - protein, 259 aa, Fragaria vesca
MGPKKGVKAPVAASKKKPEKVVNPLFEKRPKQFGIGGALPPKRDLTRFVKWPKAVQIQRKKRILQQRLKVPPALNQFTKTLDKNIATSLFKMLLKYRPEDKAEKKERLLTRAQQETQGITVENKKPIVVKYGLNHVTYLIEQNKAQLVVIAHDVDPIELVVWLPALCRKMQIPYCIVKGKARLGAIVHKKTASVLCLTTIKNQDRMDFSKVLEAINANFNDKYEEYRKKWGGGIMGSKSQAKTKAKERLLAREAAQRMT

SEQ ID NO: 8897 - protein, 256 aa, Eutrema halophilum
MAPKRGVKVATKKKPEKVTNPLFERRPKQFGIGGALPPKKDLTRYIKWPKSIRLQRQKRILKQRLKVPPALNQFTKTLDKNLATSLFKILLKYRPEDKAAKKERLLKKAQSEAEGKPAESKKPIVVKYGLNHVTYLIEQNKAQLVVIAHDVDPIELVVWLPALCRKMEVPYCIVKGKSRLGAVVHQKTASCLCLTTVKNEDKMEFSKVLEAIKANFNDKFDEYRKKWGGGIMGSKSQAKTKAKERVLAKEAAQRMN

SEQ ID NO: 8898 - protein, 256 aa, Triphysaria pusilla
MAPKKGTKPVAKKNVEKVVNSLFEKRPKQFGIGGALPPKKDLHRFVKWPQVVRIQRKKMILKQRLKVPPPIHQFSKTLDKNLATSLFKMLLKYRPEDKAQKKERLLKRAQAETEGKTPEVKKPIVVKYGLNHVTYLIEQNKAQLVVIAHDVDPIELVVWLPALCRKVEIPYCIVKGKARLGTIVHKKTASVLCLTSVKNEDKLDFSKILEAIKANFNDKYDETRKKWGGGVMGSKSQSKTKAKERVLAKETAQRMN

SEQ ID NO: 8899 - protein, 259 aa, Fraxinus spp
MAPKKGAKLPAKKKVEKVVNPLFEKRPKQFGIGGALPPKKDLHRFVKWPQVVRIQRKKMILKQRLKVPPPIHQFSKTLDKNLATSLFKMLLKYRPEDRAQKKERLLKRAQAEAEGKTPEIKKPIIVKYGLNHITYLIEQNKAQLVVIAHDVDPVELVVWLPALCRKMEIPYCIVKGKARLGTIVHKKTASALCLTSVKNEDKLEFSKILEAIKANFNDKYEETRKKWGGGVMGSKSQAKAKAKEGFLPRRLLRGCLRSS

SEQ ID NO: 8900 - protein, 256 aa, Unknown
  Sequence found in Organisms: Brassica juncea, Brassica rapa
MAPKRGVKVAAKKKTEKVTNPLFERRPKQFGIGGALPPKKDLTRYIKWPKSIRLQRQKRILKQRLKVPPALNQFTKTLDKNLATQLFKVLMKYRPEDKAAKKDRLLKKAQAEAEGKPSESKKPIVVKYGLNHVTYLIEQNKAQLVVIAHDVDPIELVVWLPALCRKMEVPYCIVKGKSRLGTVVHQKTAACLCLTTVKNEDKLEFSKILEAIKANFNDKYEEYRKKWGGGIMGSKSQAKTKAKERVLAKEAAQRMN

SEQ ID NO: 8901 - protein, 256 aa, Unknown
  Sequence found in Organisms: Brassica napus, Brassica oleracea, Brassica rapa
MAPKRGVKVVAKKKTEKVTNPLFERRPKQFGIGGALPPKKDLTRYIKWPKSIRLQRQKRILKQRLKVPPALNQFTKTLDKNLATQLFKVLMKYRPEDKAAKKDRLLKKAQAEAEGKPSESKKPIVVKYGLNHVTYLIEQNKAQLVVIAHDVDPIELVVWLPALCRKMEVPYCIVKGKSRLGTVVHQKTAACLCLTTVKNEDKLEFSKILEAIKANFNDKYEEYRKKWGGGIMGSKSQAKTKAKERVLAKEAAQRMN

SEQ ID NO: 8902 - protein, 256 aa, Raphanus sativus
MAPKKGVKAVTKKKSEKVTNPLFERRPKQFGIGGALPPKKDLTRYIKWPKSIRLQRQKRILKQRLKVPPALNQFTKTLDKNLATSLFKILLKYRPEDKAAKKERLLKKAQAEAEGKTVESKKPIVVKYGLNHVTYLIEQNKAQLVVIAHDVDPIELVVWLPALCRKMEVPYCIVKGKSRLGTIVNQKTAACLCLTTVKNEDNMEFSKILEAIKANFNDKYEEYRKKWGGGIMGSKSQAKTKAKERVLAKEAAQRMN

SEQ ID NO: 8903 - protein, 254 aa, Solanum phureja
APKRGVAVAAKKTSKVVNPLFEKRPKQFGIGGALPPKKDVTRNVRWPRNVTLQRKKRILKMRLKVPPALYQFTKTLDKNLATNLFKMLLKYRPEDKAAKKERLVKRAQAEAEGKTPETKKPIIVKYGLKHITYLIEQNKAQLVVIAHDVDPIELVVWLPALCRKMEIPYCIVKGKARLGSIVHKKTASALCLTTVKNEDKMEFSRVLEAIKANFNDKYEENRKKWGGGIMGSKSQARTKAKERILAKEAAQRLN

SEQ ID NO: 8904 - protein, 258 aa, Solanum lycopersicum
MAPKKGVAVAAKKKPEKSKVVNPLFEKRPKQFGIGGALPPKKDVTRNVRWPRNVTLQRKKRILKMRLKVPPALNQFTKTLDKNLATTLFKMLLKYRPEDKAAKKERLVKRAQAEAEGKTPETKKPIIVKYGLKHITYLIEQNKAQLVVIAHDVDPIELVVWLPALCRKMEIPYCIVKGKARLGSIVHKKTASALCLTTVKNEDKMEFSRVLEAIKANFNDKYEENRKKWGGGIMGSKSQARTKAKERVLAKEAAQRLN

SEQ ID NO: 8905 - protein, 234 aa, Brassica oleracea
  misc_feature (118)..(118): Xaa can be any naturally occurring amino acid
MAPKKGVKAVTKKKSEKVTNPLFERRPKQFGIGGALPPKKDLTRYIKWPKSIRLQRQKRILKQRLKVPPALNQFTKTLDKNLATSLFKMMLKYRPEDKAAKKERLLKKAQAEAEGKTXESKKPIVVKYGLNHVTYLIEQNKAQLVVIAHDVDPIELVVWLPALCRKIEVPYCIVKGKSRLGAIVHQKTAACLCLTTVKNEDKMEFSKILEAIKANFNDKYEEYRKEVGRWNYGI

SEQ ID NO: 8906 - protein, 260 aa, Fraxinus spp
PKKGAKLPTGVAKRKAEKVVNPLFEKRPKQFGIGGALPPKKDLHRFVKWPQVVRIQRKKMILKQRLKVPPPIHQFSKTLDKNLATSLFKMLLKYRPEDRAQKKERLLKRAQAEAEGKTPEVKKPIIVKYGLNHVTYLIEQNKAQLVVIAHDVEPIELVVWLPALCRKMEIPYCIVKGKARLGTIVHKKTASVLCLTSVKNEDKMDFSRILEAIKANFNDKYDETRKKWGWWSYGLKIPGQVKGQRETHGQGGCTEDDLGS

SEQ ID NO: 8907 - protein, 90 aa, Fraxinus spp
MEIPYCIVKGRARLGTIVHKKTASALCLTSVKNEDKLEFSKILEAIKANFNDKYDETRKKWGGGVMGSKSQAKAKAKEKILAKEAAQRMS

SEQ ID NO: 8908 - protein, 277 aa, Malus domestica
MVRICSLSVILRLPFHLGRAPKRGVKAPVAASKKKTDKVVNPLFEKRPKQFGIGGALPPKRDLTRFVKWPKVVQIQRKKRILKQRLKVPPALNQFTKTLDKNLATSLFKMLLKYRPEDKAAKKERLLKRAQAETEGKSVEAKKPIVVKYGLNHVTYLIEQNKAQLVVIAHDVDPIELVVWLPALCRKMEVPYCIVKGKARLGSIVHKKTASVLCLTTVKNEDKLEFSKVLEAIKANFNDKYEEYRKKWGGGIMGSKSQAKTRAKEKLLAKEAAQRLN

SEQ ID NO: 8909 - protein, 256 aa, Brassica juncea
MAPKKGVKVVAKKKTEKVTNPLFERRPKQFGIGGALPPKKDLTRYIKWPKSIRLQRQKRILKQRLKVPPALNQFTETLDKNLATQLFKVLMKYRPEDKAAKKDRLLKKAQAEAEGKPSESKKPIVVKYGLNHVTYLIEQNKAQLVVIAHDVDPIELVVWLPALCRKMEVPYCIVKGKSRLGTVVHQKTAACLCLTTVKNEDKLEFSKILEAIKANFNDKYEEYRKKWGGGIMGSKSQAKTKAKERVLAKEAAQRMN

SEQ ID NO: 8910 - protein, 256 aa, Brassica juncea
MAPKKGVKVAAKKKTDKVTNPLFERRPKQFGIGGALPPKKDLTRYIKWPKSIRLQRQKRILKQRLKVPPALNQFTKTLDKNLATQLFKVLMKYRPEDKAAKKDRLLKKAQAEAEGKPSESKKPIVVKYGLNHVTYLIEQNKAQLVVIAHDVDPIELVVWLPALCRKMEVPYCIVKGKSRLGTVVHQKTAACLCLTTVKNEDKLEFSKILEAIKANFNDKYEEYRKKWGGGIMGSKSQAKTKAKERVLAKEAAQRMN

SEQ ID NO: 8911 - protein, 256 aa, Brassica juncea
MAPKRGVKVVAKKKTEKVTNPLFERRPKQFGIGGALPPKKDLTRYIKWPKSIRLQRQKRILKQRLKVPPALNQFTKTLDKNLATQLFKLLMKYRPEDKAAKKDRLLKKAQAEAEGKPSESKKPIVVKYGLNHVTYLIEQNKAQLVVIAHDVDPIELVVWLPALCRKMEVPYCIIKGKSRLGTVVHQKTAACLCLTTVKNEDKLEFSKILEAIKANFNDKYEEYRKKWGGGIMGSKSQAKTKAKERVLAKEAAQRMN

SEQ ID NO: 8912 - protein, 256 aa, Brassica juncea
MAPKRGVKVVAKKKTEKVTNPSFERRPKQFGIGGALPPKKDLTRYIKWPKSIRLQRQKRILKQRLKVPPALNQFTKTLDKNLATQLFKVLMKYRPEDKAAKKDRLLKKAQAEAEGKPSESKKPIVVKYGLNHVTYLIEQNKAQLVVIAHDVDPIELVVWLPALCRKMEVPYCIVKGKSRLGTVVHQKTAACLCLTTVKNEDKLEFSKILEAIKANFNDKYEEYRKKWGGGIMGSKSQAKTKAKERVLAKEAAQRMN

SEQ ID NO: 8913 - protein, 256 aa, Unknown
  Sequence found in Organisms: Brassica napus, Brassica oleracea
MAPKRGVKVAAKKKTEKVTNPLFERRPKQFGIGGALPPKKDLTRYIKWPKSIRLQRQKRILKQRLKVPPALNQFTKTLDKNLATQLFKLLMKYRPEDKAAKKDRLLKKAQAEADGKPSESKKPIVVKYGLNHVTYLIEQNKAQLVVIAHDVDPIELVVWLPALCRKMEVPYCIVKGKSRLGTVVHQKTAACLCLTTVKNEDKLEFSKILEAIKANFNDKYEEYRKKWGGGIMGSKSQAKTKAKERVLAKEAAQRMN

SEQ ID NO: 8914 - protein, 256 aa, Brassica rapa
MAPKKGVKVAAKKKTDKVTNPLFERRPKQFGIGGALPPKKDLTRYIKWPKSIRLQRQKRILKQRLKVPPALNQFTKTLDKNLATQLFKVLMKYRPEDKAAKKDRLLKKAQAEAEGKPSESKKPIVVKYGLNHVTYLIEQNKAQLVVIAHDVDPIELVVWLPALCRKMEVPYCIVKGKSRLGTVVHQKTAACLCLTTVKNEDKLEFSKILEAIKANFNDKYEEYRKKWGGGIMGSKSQAKTKANERVLAKEAAQRMN

SEQ ID NO: 8915 - protein, 256 aa, Unknown
  Sequence found in Organisms: Brassica napus, Raphanus sativus
MAPKKGVKVAAKKKTEKVTNPLFERRPKQFGIGGALPPKKDLTRYIKWPKSIRLQRQKRILKQRLKVPPALNQFTKTLDKNLATQLFKVLMKYRPEDKAAKKDRLLKKAQAEAEGKPSESKKPIVVKYGLNHVTYLIEQNKAQLVVIAHDVDPIELVVWLPALCRKMEVPYCIVKGKSRLGTVVHQKTAACLCLTTVKNEDKLEFSKILEAIKANFNDKYEEYRKKWGGGIMGSKSQAKTKAKERVLAKEAAQRMN

SEQ ID NO: 8916 - protein, 256 aa, Brassica napus
MAPKKGVKVVAKKKTEKVTNPLFERRPKQFGIGGALPPKKDLTRYIKWPKSIRLQRQKRILKQRLKVPPALNQFTKTLDKNLATQLFKLLMKYRPEDKAAKKDRLLKKAQAEAEGKPSESKKPIVVKYGLNHVTYLIEQNKAQLVVIAHDVDPIELVVWLPALCRKMEVPYCIVKGKSRLGTVVHQKTAACLCLTTVKNEDKLEFSKILEAIKANFNDKYEEYRKKWGGGIMGSKSQAKTKAKERVLAKEAAQRMN

SEQ ID NO: 8917 - protein, 256 aa, Brassica napus
MAPKKGVKVAAKKKTDKVANPLFERRPKQFGIGGALPPKKDLTRYIKWPKSIRLQRQKRILKQRLKVPPALNQFTKTLDKNLATSLFKILLKYRPEDKAAKKERLVKKAQAEAEGKPSESKKPIVVKYGLNHVTYLIEQNKAQLVVIAHDVDPIELVVWLPALCRKMEVPYCIVKGKSRLGAVVHQKTAACLCLTTVKNEDKLEFSKVLEAIKANFNDKYEEYRKKWGGGIMGSKSQAKTKAKERVLAKEAAQRNN

SEQ ID NO: 8918 - protein, 256 aa, Brassica napus
MAPKRGVKVVAKKKTEKVTNPLFERRPKQFGIGGALPPKKDLTRYIKWPKSIRLQRQKRILKQRLKVPPALNQFTKTLDKNLATQLFKVLMKYRPEDKAAKKDRLLKKAQAEAEGKPSESKKPIVVKYGLNHVTYLIEQNKAQLVVIAHDVDPIELIVWLPALCRKMEVPYCIVKGKSRLGTVVHQKTAACLCLTTVKNEDKLEFSKILEAIKANFNDKYEEYRKKWGGGIMGSKSQAKTKAKERVLAKEAAQRMN

SEQ ID NO: 8919 - protein, 235 aa, Zingiber officinale
LFEKRPKQFGIGGALPPKKDLRRFVKWPKVVRIQRQKRILKQRLKVPPALNQFTRTLDKNLATNLFKLLLKYRPEDRAAKKERLLKRAQTEAEGKTLEVKKPIVVKYGLNHITYLIEQNKAQLVVIAHDVDPVELVVWLPALCRKMEIPYCIVKGKSRLGAIVHKKTATALCLTTVKNEDKLEFSKILEAIKANFNDKFDEIRRKWGGGIMGSKSQAKAKAKEKLLAKESAQRMT

SEQ ID NO: 8920 - protein, 258 aa, Mesembryanthemum crystallinum
MAPKRGVKAPVASKKKTEKVVNPLYEKRPKQFGIGGALPPKKDLTRFIKWPRVVQIQRKRRILKQRLKVPPAVNQFTKALDKNLASNLFKLLLKYRPEDKAAKKERLLKAAQAEAEGKKPEAKKPVVVKYGLNHVTYLIEQGKAQLVVIAHDVDPIELVVWLPALCRKMEVPYCIVKGKARLGTVVHNKTATALCLTSVKNEDKMEFSRIVEAVKANFNDKYDEHRKKWGGGIMGSKSQAKMKAKERVLAKEAAQRLN

SEQ ID NO: 8921 - protein, 256 aa, Raphanus sativus
MAPKKGVKVAAKKKTEKVTNPLFERRPKQFGIGGALPPKKDLTRYIKWPKSIRLQRQKRILKQRLKVPPALNQFTKTLDKNLATSLFKILLKYRPEDKAAKKERLVKKAQAEAEGKPSESKKPIVVKYGLNHVTYLIEQNKAQLVVIAHDVDPIELVVWLPALCRKMEVPYCIVKGKSRLGAVVHQKTAACLCLTTVKNEDKLEFSKILEAIKANFNDKYEEYRKKWGGGIMGSKSQAKTKAKERVLAKEAAQRNN

SEQ ID NO: 8922 - protein, 256 aa, Raphanus sativus
MAPKRGVKAVTKKKTEKVTNPLFERRPKQFGIGGALPPKKDLTRYIKWPKSIRLQRQKRILKQRLKVPPALNQFTKTLDKNLATQLFKVLMKYRPEDKAAKKDRLLKKAQAEAEGKPSESKKPIVVKYGLNHVTYLIEQNKAQLVVIAHDVDPIELVVWLPALCRKMEVPYCIVKGKSRLGTVVHQKTAACLCLTTVKNEDKLEFSKILEAIKANFNDKYEEYRKKWGGGIMGSKSQAKTKAKERVLAKEAAQRMN

SEQ ID NO: 8923 - protein, 253 aa, Carthamus tinctorius
  misc_feature (238)..(238): Xaa can be any naturally occurring amino acid
MGPKKGGKPIATKKKTEKVVNPLFEKRPKQFGIGGALPPKKDVHRFVRWPQVVRIQRKRRILKQRLKVPPALNQFTKTLDKNLATTLFKMLLKYRPEDKAAKKERLLKRAQAESEGKTAEAKKPIVVKYGLNHVTYLIEQNKAQLVIIAHDVDPIELVVWLPALCRKMEIPYCIVKGKSRLGTIVHQKTAAALCLTTVKNEDKMEFSRILEAIKANFNDKYEEYRKKWGGGIMGSKSXAKTKAKERVFARRLP

SEQ ID NO: 8924 - protein, 166 aa, Brassica juncea
MKYRPEDKAAKKDRLLKKAQAEAEGKPSESKKPIVVKYGLNHVTYLIEQNKAQLVVIAHDVDPIELVVWLPALCRKMEVPYCIVKGKSRLGTVVHQKTAACLCLTTVKNEDKLEFSKILEAIKANFNDKYEEYRKKWGGGIMGSKSQAKTKAKERVLAKEAAQRMN

SEQ ID NO: 8925 - protein, 142 aa, Fraxinus spp
MLLKYRPEDRAQKEERLLKRAQAEAEGKTPEVKKPIIVKYGLNHVTYLIEQNKAQLVVIAHDVDPIELVVWLPALCRKMEIPYCIVKGKARLGTIVHKKTASVLCLTSVKNEDKMDFSRILEAIKANFNDKYDETRKKWGVV

SEQ ID NO: 8926 - protein, 263 aa, Ceratodon purpureus
MAPKRGNIKTPVPAPVVKKAAPVKTVNPLFEKRPKQFGIGGALPPKRDLHRFVKWPKYVRIQRQRRVLNQRLKVPPALNQFTKTLDKNLATSLFKMLLKYRPEDKAAKKERLLNKAKAEAEGKTVESKKPVVVKYGINHITYLIEQGKAQLVVIAHDVDPIELVVWLPALCRKMGVPYAIVKGKSRLGQIVHAKTATALCLTSVKNEDKHEFSKIVEAVKANFNEKFDEYRRQWGGGIMGVKSQAKTKIRERIIAKEAAQRAA

SEQ ID NO: 8927 - protein, 262 aa, Pteridium aquilinum
MAPKRGIKVPVPAPVEKKKVPEKVVNPLFEKRPKQFGIGGALRPTKDLHRFVKWPKYVRIQRQRRVLNQRLKVPPALNQFTKTLDKNLASSLFKMLLKYRPEDKAAKKDRLLKKAQAESEGKTIESKKPIVVKYGINHVTYLIEQGKAQLVVIAHDVDPIELVLWLPALCRKMGIPYAIVKGKARLGQIVHSKTATALCVTSVKNEDKLEFSKIVEAVKANFNDRFDDLRRQWGGGIMGVKSQAKAKAKEKVIAKEAAQRMS

SEQ ID NO: 8928 - protein, 262 aa, Pteridium aquilinum
MAPKRGSKIAVPTPAEKKKTPEKVVNPLFEKRPKQFGIGGSLPYKKNLHRFVKWPKYVRIQRQRRVLNQRLKVPPALNQFTKTLDKNLASSLFKMLLKYRPEDKAAKKERLLKKAQAESEGKTIESKKPIVVKYGINHVTYLIEQGKAQLVVIAHDVDPLELVIWLPALCRKMGIPYCIVKGKARLGQIVHSKTATALCLTSVKNEDKLEFSKIVEAIKANFNDRFDDLRRQWGGGIMGVKSQAKSKAKEKVVAKEAAQRMS

SEQ ID NO: 8929 - protein, 270 aa, Citrullus lanatus
MEKRKMENDNANDAAPKKAVGKVSAKKKPEKVVNPLFEKRPKQFGIGGALPPKRDLTRFVKWPKVVQIQRKKRILKQRLKVPPALNQFTKTLDKNLATNLFKMLLKYRPEDKTQKRERLLKRAQEEAEGKSHDAKKPIVVKYGLNHVTYLIEQNKAQLVVIAHDVDPIELVVWLPALCRKMEIPYCIVKGKARLGAIVHKKTASVLCLTTVKNEDKLEFSRILEAIKANFNDKYDEYRKKWGGGIMGSKSQAKTKAKEKLLAKEAAQRMS

SEQ ID NO: 8930 - protein, 257 aa, Capsicum annuum
APKKGVAVAAKKKNEKAKVVNPLYEKKPRQFGIGGALPPKKDLSRFVKWPRNVVLQRKKRILKMRLKVPPALNQFTKTLDKNLATTLFKMLLKYRPEDKAAKKERLVKRAQAEAEGKTPETKKPIIVKYGLKHITYLIEQNKAQLVVIAHDVDPIELVVWLPALCRKMEIPYCIVKGKARLGSIVHKKTASALCLTTVKNEDKMEFSRVLEAIKANFNDKYEENRKKWGGGIMGSKSQARTKAKERVLAKEAAQRLN

SEQ ID NO: 8931 - protein, 256 aa, Arabidopsis lyrata
MAPKKGVKVASKKKPEKVTNPLFERRPKQFGIGGALPPKKDLSRYIKWPKSIRLQRQKRILKQRLKVPPALNQFTKTLDKNLATSLFKILLKYRPEDKAAKKDRLLKKAQAEAEGKPAESKKPIVVKYGLNHVTYLIEQNKAQLVVIAHDVDPIELVVWLPALCRKMEVPYCIVKGKSRLGAVVHQKTAAALCLTTVKNEDKLEFSKILEAIKANFNDKYEEYRKKWGGGIMGSKSQAKTKAKERVLAKEAAQRLN

SEQ ID NO: 8932 - protein, 256 aa, Arabidopsis thaliana [sequence omitted]

SEQ ID NO: 8933 - protein, 256 aa, Brassica juncea
MAPKKGVKLAAKKKTEKVTNPLFERRPKQFGIGGALPPKKDLTRYIKWPKSIRLQRQKRILKQRLKVPPALNQFTKTLDKNLATQLFKVLMKYRPEDKAAKKDRLLKKAQAEAEGKPSESKKPIVVKYGLNHVTYLIEQNKAQLVVIAHDVDPIELVVWLPALCRKMEVPYCIVKGKSRLGTVVHQKTAACLCLTTVKNEDKLEFSKILEAIKANFNDKYEEYRKKWGGGIMGSKSQAKTKAKERVLAKEAAQRMN

SEQ ID NO: 8934 - protein, 256 aa, Brassica juncea
MAPKKGVKAVTKKKPEKVTNPLFERRPKQFGIGGAFPPKKDLTRYIKWPKSIRLQRQKRILKQRLKVPPALNQFTKTLDKNLATSLFKILLKYRPEDKAAKKERLLKKAQSEAEGKPVESKKPIVVKYGLNHVTYLIEQNKAQLVVIAHDVDPIELVVWLPALCRKMEVPYCIVKGKSRLGTIVNQKTAACLCLTTVKNEDKMEFSKILEAIKANFNDKYEEYRKKWGGGIMGSKSQAKTKAKERVLAKEAAQRMN

SEQ ID NO: 8935 - protein, 256 aa, Brassica oleracea
MAPKRGVKVVTKKKTEKVTNPLFERRPKQFGIGGALPPKKDLTRYIKWPKSIRLQRQKRILKQRLKVPPALNQFTKTLDKNLATQLFKLLMKYRPEDKAAKKDRLLKKAQAEAEGKPSESKKPIVVKYGLNHVTYLIEQNKAQLVVIAHDVDPIELVVWLPALCRKMEVPYCIVKGKSRLGTVVHQKTAACLCLTTVKNEDKLEFSKILEAIKANFNDKYEEYRKKWGGGIMGSKSQAKTKAKERVLAKEAAQRMN

SEQ ID NO: 8936 - protein, 256 aa, Brassica rapa
MAPKKGVKVVAKKKTEKVTNPLFERRPKQFGIGGALPPKKDLTRYIKWPKSIRLQRQKRILKQRLKVPPALNQFTKTLDKNLATQLFKLLMKYRPEDKAAKKDRLLKKAQAEAEGKPSESKKPIVVKYGLNHVTYLIEQNKAQLVVIAHDVDPIELVVWLPALCRKMEVPYCIVKGKSRLGTVVHQKTAACLCLTTVKNEDKLEFSKILEAIKANFNDKYEEYRKKWGGGIMGSKSQAKTKAKDRVLAKEAAQRMN

SEQ ID NO: 8937 - protein, 256 aa, Unknown
  Sequence found in Organisms: Brassica napus, Brassica rapa
MAPKKGVKAVTKKKPEKVTNPLFERRPKQFGIGGALPPKKDLTRYIKWPKSIRLQRQKRILKQRLKVPPALNQFTKTLDKNLATSLLKILLKYRPEDKAAKKERLLKKAQAEAEGKPVESKKPIVVKYGLNHVTYLIEQNKAQLVVIAHDVDPIELVVWLPALCRKMEVPYCIIKGKSRLGAIVHQKTAACLCLTTVKNEDKMEFSKVLEAIKANFNDKYEENRKKWGGGIMGSKSQAKTKAKERVLAKEAAQRMN

SEQ ID NO: 8938 - protein, 256 aa, Unknown
  Sequence found in Organisms: Brassica napus, Brassica rapa
MAPKKGVKVAAKKKTDKVTNPLFERRPKQFGIGGALPPKKDLTRYIKWPKSIRLQRQKRILKQRLKVPPALNQFTKTLDKNLATSLFKILLKYRPEDKAAKKERLVKKAQAEAEGKPSESKKPIVVKYGLNHVTYLIEQNKAQLVVIAHDVDPIELVVWLPALCRKMEVPYCIVKGKSRLGAVVHQKTAACLCLTTVKNEDKLEFSKVLEAIKANFNDKYEEYRKKWGGGIMGSKSQAKTKAKERVLAKEAAQRNN

SEQ ID NO: 8939 - protein, 255 aa, Cynara scolymus
  misc_feature (8)..(8): Xaa can be any naturally occurring amino acid
  misc_feature (61)..(61): Xaa can be any naturally occurring amino acid
  misc_feature (207)..(207): Xaa can be any naturally occurring amino acid
MGPKKGGXPVATKKKTEKVVNPLFEKRPKQFGIGGALPPKKDVHRFVRWPQVVRIQRKRRXLKQRLKVPPALNQFTKTLDKNLATTLFKMLLKYRPEDKAAKKERLLKRAQAESEGKTAEAKKPIVVKYGLNHVTYLIEQNKAQLVIIAHDVDPIELVVWLPALCRKMEIPYCIVKGKSRLGTIVHQKTAAALCLTTVKNEDKMEFXRILEAIKANFNDKYEEYRKKWGGGIMGSKSQGETKAKERVLARRLLKG

SEQ ID NO: 8940 - protein, 235 aa, Flaveria ramosissima
LFEKRPKQFGIGGALLPKKDLHRFVRWPQVVRIQRKRRILKQRLKVPPALNQFTKTLDKNLATNLFKMLLKYRPEDKAAKKERLQKRAAAEDEGKTVEAKKPIVVKYGLNHVTYLIEQNKAQLVVIAHDVDPIELVVWLPALCRKMEIPYCIVKGKSRLGAIVHQKTAAALCLTTVKNEDKMEFSRILEAIKANFNDKYDEYRKKWGGGIMGSKSQAKTKAKERVLAKEAAQRLT

SEQ ID NO: 8941 - protein, 256 aa, Raphanus sativus
  misc_feature (3)..(3): Xaa can be any naturally occurring amino acid
MAXKKGVKVPTKKKTEEVTNPLFERRPKQFGIGGALPPKKDLTRYIKWPKSIRLQRQKRILKQRLKVPPALNQFTKTLDKNLATSLFKILLKYRPEDKAAKKERLVKKAQAEAEGKPSESKKPIVVKYGLNHVTYLIEQNKAQLVVIAHDVDPIELVVWLPALCRKMEVPYCIVKGKSRLGAVVHQKTAACLCLTTVKNEDKLEFSKILEAIKANFNDKYEEYRKKWGGGIMGSKSQAKTKAKERVLAKEAAQRNN

SEQ ID NO: 8942 - protein, 256 aa, Raphanus sativus
MAPKKGVKAVAKKKTEKVTNPLFERRPKQFGIGGALPPKKDLTRYIKWPKSIRLQRQKRILKQRLKVPPALNQFTKTLDKNLATQLFKVLMKYRPEDKAAKKDRLLKKAQAEAEGKPSESKKPIVVKYGLNHVTYLIEQNKAQLVVIAHDVDPIELVVWLPALCRKMEVPYCIVKGKSRLGTVVHQKTAACLCLTTVKNEDKLEFSKILEAIKANFNDKYEEYRKKWGGGIMGSKSQAKTKAKERVLAKEAAQRMN

SEQ ID NO: 8943 - protein, 256 aa, Raphanus sativus
MAPKRGVKVVTKKKTEKVTNPLFERRPKQFGIGGALPPKKDLTRYIKWPKSIRLQRQKRILKQRLKVPPALNQFTKTLDKNLATQLFKVLMKYRPEDKAAKKDRLLKKAQAEAEGKPSESKKPIVVKYGLNHVTYLIEQNKAQLVVIAHDVDPIELVVWLPALCRKMEVPYCIVKGKSRLGTVVHQKTAACLCLTTVKNEDKLEFSKILEAIKANFNDKYEEYRKKWGGGIMGSKSQAKTKAKERVLAKEAAQRMN

SEQ ID NO: 8944 - protein, 118 aa, Brassica juncea
MAPKKGVKVAAKKKTEKVTNPLFERRPKQFGIGGALPPKKDLTRYIKWPKSIRLQRQKRILKQRLKVPPALNQFTKTLDKNLATQLFKVLMKYRPEDKAAKKDRLLKKAQAEAEGEAF

SEQ ID NO: 8945 - protein, 167 aa, Flaveria ramosissima
MLLKYRPEDKAAKKTSLKRAQAESEGKTIEAKKPIVVKYGLNHVTYLIEQNKAQLVIIAHDVDPIELVVWLPALCRKMEIPYCIVKGKSRLGAIVHQKTAAALCLTTVKNEDKMEFSRILEAIKANFNDKYDEYRKKWGGGIMGSKSQAKTKAKERVLAKEAAQRMT

SEQ ID NO: 8946 - protein, 263 aa, Physcomitrella patens
MAPKRGTLKTPVAAPAQKKQAPVKTVNPLFEKRPKQFGIGGALPPKRDLHRFVKWPKYVRIQRQRRVLNQRLKVPPALNQFTKTLDKNLATSLFKLLLKYRPEDKAAKKERLLNKAKAEAEGKSVESKKPVVVKYGINHITYLIEQNKAQLVVIAHDVDPIELVVWLPALCRKMGVPYCIVKGKSRLGQIVHAKTATALCLTAVKNEDKHEFSKIIEAVKANFNEKYDEHRRHWGGGIMGVKSQAKTKIRERILAKEAAQRAT

SEQ ID NO: 8947 - protein, 287 aa, Platanus occidentalis
MVMLILIIGEFLLVLTDFFVCNFIVLNLQAPKRGGKAPAAPAKKKPEKVVNPLFEKRPKQFGIGGALPPKRDLHRFVKWPKVVRIQRQRRILKQRLKVPPTLNQFTKTLDKNLATNLFKMLLKYRPEDKAAKKERLLKRAQAEAEGKTVEVKKPIVVKYGLNHVTYLIEQNKAQLVVIAHDVDPIELVVWLPALCRKMEIPYCIVKGKARLGAIVHKKTAAVLCLTTVKNEDKFEFSKILEAIKANFNDKYDEYRKKWGGGIMGSKSQAKTKAKERLLAKEAAQRMT

SEQ ID NO: 8948 - protein, 259 aa, Cirsium arvense
MGPKKGGKAVTTKKKTEKVVNPLFEKRPKQFGIGGALPPKKDVHRFVRWPQVVRIQRKRRILKQRLKVPPALNQFTKTLDKNLATTLFKMLLKYRPEDKAAKKERLLKRAQAESEGKTAEAKKPIVVKYGLNHVTYLIEQNKAQLVIIAHDVDPIELVVWLPALCRKMEIPYCIVKGKSRLGTIVHQKTAAALCLTTVKNEDKMEFSRILEAIKANFNDKYEEYRKKWGGGIMGSKSQAKTKAKERVFGQGGCSEVELD

SEQ ID NO: 8949 - protein, 90 aa, Arabidopsis lyrata
MEVPYCIVKGKSRLGAVVHQKTAACLCLTTVKNEDKLEFSKILEAIKANFNDKYEEYRKKWGGGIMGSKSQAKTKAKERVLAKEAAQRLN

SEQ ID NO: 8950 - protein, 234 aa, Flaveria ramosissima
PLFEKRPKQFGIGGALPPKKDLHRFVRWPQVVRIQRKRRILKQRLKVPPALNQFTKTLDKNLATTLFKMLLKYRPEDKAAKKERLLKRAQAESEGKTVEAKKPIVVKYGLNHVTYLIEQNKAQLVIIAHDVDPIELVVWLPALCRKMEIPYCIVKGKSRLGAIVHQKTAAALCLTTVKNEDKMEFSRILEAIKANFNDKYDEYRKKWGGGIMGSKSQAKPRQKREFLPRRLLRG

SEQ ID NO: 8951 - protein, 253 aa, Cannabis sativa
MPPKKTGKASALSKKKPEKVVNPLFEKRPKQFGIGGALPPKRDLHRFVKWPKAVQLQRKKRILKQRLKVPPQLNQFTKTLDKNLGMIQNNRPEDKAEKKERLVKRAQAEAEGKTAETKKPIVVKYGLNHVTYLIEQNKAQLVVIAHDVDPIELVVWLPALCRKMEIPYCIVKGKSRLGSIVHQKTAAALCLTTVKNEDKMEFSKILEAIKANFNDKFDEFRKKWGGGIMGSKSQAKTKAKERVLAKEAAQRMN

SEQ ID NO: 8952 - protein, 256 aa, Brassica napus
MAPKKGVKVVTKKKTEKVTNPLFERRPKQFGIGGALPPKKDLTRYIKWPKSIRLQRQKRILKQRLKVPPALNQFTKTLDKNLATQLFKVLMKYRPEDKAAKKDRLLKKAQAEAEGKPSESKKPIVVKYGLNHVTYLIEQNKAQLVVIAHDVDPIELVVWLPALCRKMEVPYCIVKGKSRLGTVVHQKTAACLCLTTVKNEDKLEFSKILEAIKANFNDKYEEYRKKWGGGIMGSKSQAKTKAKERVLAKEAAQRMN

SEQ ID NO: 8953 - protein, 253 aa, Fraxinus spp
SKLPAGVAKKKADKVVNPLFEKRPKQFGIGGALPPKKDLHRFVKWPQVVRIQRKKMILKQRLKVPPPIHQFSKTLDKNLATSLFKMLLKYRPEDRAQKKERLLKRAQAEAEGKTPEVKKPIIVKYGLNHVTYLIEQNKAQLVVIGHDVEPIELVVWLPALCRKMEIPYCIVKGKARLGTIVHKKTASVLCLTSVKNEDKMDFSRILEAIKANFNDKYDETRKKWGGGVMGSKSQAKTKAKERLMAKEAAQRMT

SEQ ID NO: 8954 - protein, 253 aa, Fraxinus spp
AKLPSGVAKKKAEKVVNPLFEKRPKQFGIGGALPPKKDLHRFVKWPQVVRIQRKKMILKQRLKVPPPIHQFSKTLDKNLATSLFKMLLKYRPEDKAQKKERLLKRAQAEAEGKTPEVKKPIIVKYGLNHVTYLIEQNKAQLVVIAHDVEPIELVVWLPALCRKMEIPYCIVKGKARLGTIVHQKTAAVLCLTSVKNEDKMDFSRILEAIKANFNDKYDETRKKWGGGVMGSKSQAKSKAKERLMAKEAAQRMT

SEQ ID NO: 8955 - protein, 256 aa, Raphanus sativus
MAPKKGVKAVTKKKPEKVTNPLFERRPKQFGIGGALPPKKDLTRYIKWPKSIRLQRQKRILKQRLKVPPALNQFTKTLDKNLATSLLKILLKYRPEDKAAKKERLLKKAQSEAEGKPVESKKPIVVKYGLNHVTYLIEQNKAQLVVIAHDVDPIELVVWLPALCRKMEVPYCIIKGKSRLGAIVHQKTAACLCLTTVKNEDKMEFSKVLEAIKANFNDKYEENRKKWGGGIMGSKSQAKTKAKERVLAKEAAQRMN

SEQ ID NO: 8956 - protein, 258 aa, Silene vulgaris
MAPKRGVKAPVVSKKKPEKAVNPLYEKRPKQFGIGGAIPPKKDLTRFIKWPKVVQLQRKKRILKQRLKVPPAINQFTKALDKNLASNLFKLLLKYRPEDKAAKKERLLKAAQAEAEGKKPEIKKPVVVKYGLNHITYLIEQGKAQMVVIAHDVDPIELVVWLPALCRKMEVPYCIVKGKARLGTIVHKKTAAALCLTSVKNEDKMEFSRIVEAVKANFNDKYDEHRKKWGGGIMGSKSQAKMKARERVLAKEAAQRLN

SEQ ID NO: 8957 - protein, 256 aa, Eutrema parvulum
MAPKKGVKVATKKKPEKVTNLLFERRPKQFGIGGALPPKKDLTRYIKWPKSIRLQRQKRILKQRLKVPPALNQFTKTLDKNLATSLFKVLLKYRPEDKAAKKERLLKKAQSEAEGKPAESKKPIVVKYGLNHVTYLIEQNKAQLVVIAHDVDPIELVVWLPALCRKMEVPYCIVKGKSRLGALVHQKTAACLCLTTVKNEDKMEFSKLLEAIKANFNDKYDEYRKKWGGGIMGSKSQAKTKAKERVLAKEAAQRMN

SEQ ID NO: 8958 - protein, 263 aa, Marchantia polymorpha
MAPKRGNIKPSVPAPVEKKKVVEKVANPLFEKRPKQFGIGGSLPPKRDLHRFVKWPKYVRIQRQRRVLNQRLKVPPALNQFTKCLDKNLAAGLFKMLLKYRPEDKAAKKERLLKKAQAEAEGKTVETKKPIVVKYGLNHVTYLIEQGKAQLVVIAHDVDPIELVVWLPALCRKMGVPYAIVKGKSRLGQIIHSKTASALCLTSVKNEDKHDFSKIVEAVKANFNDRYDEYRKQWGGGIMGVKSQAKTKIKEKILAKEAAQRAA

SEQ ID NO: 8959 - protein, 773 aa, Oryza sativa
MQRPFRPEEYSLKETSPHLGGGAAGDKLTTTYDLVEQMQYLYVRVVKAKDLPSKDITGSCDPYVEVKLGNYKGTTRHFEKKTNPEWNQVFAFSKERIQSSVVEIIVKDKDFVKDDFIGRVLFDLNEVPKRVPPDSPLAPQWYRLEERNGHKVKGELMLAVWMGTQADEAFPEAWHSDAASIPGDGLASIRSKVYLTPKLWYLRVNVIEAQDLIPNDRTRFPDVYVKAMLGNQALRTRVSPSRTLNPMWNEDLMFVAAEPFEEHLILSVEDRIAPGKDDVLGRTIISLQHVPRRLDHKLLNSQWYNLEKHVIVDGEQKKETKFSSRIHLRICLEGGYHVLDESTHYSSDLRPTAKQLWKHSIGILELGILTAQGLLPMKTKDGRGTTDAYCVAKYGQKWVRTRTIIDSFTPKWNEQYTWEVYDPCTVITIGVFDNCHLNGGEKANGARDTRIGKVRIRLSTLETDRVYTHAYPLIVLTPAGVKKMGEVQLAVRFTCSSLLNMMHLYSQPLLPKMHYVHPLSVMQVDNLRRQATNIVSTRLSRAEPPLRKEIVEYMLDVDSHMWSMRKSKANFFRIMGVLSPLIAVAKWFDQICHWRNPLTTILIHILFVILVLYPELILPTIFLYLFLIGVWYYRWRPRQPPHMDTRLSHAESAHPDELDEEFDTFPTSRPPDIVRMRYDRLRSVAGRIQTVVGDLATQGERLQSLLSWRDPRATALFVTFCFVAAIVLYVTPFRVVVFLAGLYTLRHPRFRHKMPSVPLNFFRRLPARTDSML

SEQ ID NO: 8960 - protein, 773 aa, Hordeum vulgare
MQRPFRPEEYSLKETTPHLGGAAAGDKLTTTYDLVEQMQYLYVRVVKAKELPSKDLTGSCDPYVEVKLGNYKGTTRHFEKKTNPEWNQVFAFSKERIQASVVEIIVKDKDFVKDDYIGRVMFDLNEVPKRVPPDSPLAPQWYRLEERNGHKVKGELMLAVWMGTQADEAFPEAWHSDAASIPGDGLASIRSKVYLTPKLWYLRVNVIEAQDLIPNDKTRFPEVYVKAMLGNQALRTRVSPGRTLNPMWNEDLMFVAAEPFEEHLILSVEDRIAPGKDDVIGRTVISLQHVARRLDHKLLNSQWYNLEKHVMVDGEQRKETKFSSRIHLRICLEGGYHVLDESTHYSSDLRPTAKQLWKHNIGVLELGILTAQGLLPMKTKDGRGTTDPYCVAKYGQKWVRTRTIIDSFTPKWNEQYTWEVHDPCTVITIGVFDNCHLNGGEKANGARDTRIGKVRIRLSTLETDRVYTHSYPLIVLTPAGVKKMGEVQLAVRFTCSSLLNMMTLYSQPLLPKMHYVHPLSVIQVDNLRRQATNIVSTRLSRAEPPLRKEIVEYMLDVDSHMWSMRKSKANFFRIMGVLSPLIAVARWFDQICHWRNPLTTILIHVLFVILVLYPELILPTIFLYLFLIGVWYYRWRSRQPPHMDTRLSHAETAHPDELDEEFDTFPTSRPPDIVRMRYDRLRSVAGRIQTVVGDLATQGERLQSLLSWRDPRATALFVTFCFIAAIVLYVTPFRVVVFLAGLYTLRHPRFRHKMPSVPLNFFRRLPARTDSML

SEQ ID NO: 8961 - protein, 773 aa, Brachypodium distachyon
MQRPFRPEEYSLKETSPHLGGAAAGDKLTTTYDLVEQMQYLYVRVVKAKELPSKDISGSCDPYVEVKLGNYKGTTRHFEKKTNPEWNQVFAFSKERIQASVVEIIVKDKDFVKDDYIGRVLFDLNEVPKRVPPDSPLAPQWYRLEERNGHKVKGELMLAVWMGTQADEAFPEAWHSDAASIPGDGLASIRSKVYLTPKLWYLRVNVIEAQDLMPNDKTRFPEVYVKAMLGNQALRTRVSPGRTLNPMWNEDLMFVAAEPFEEHLILNVEDRIAPGKDDVIGRTVISLQHVARRLDYKLLNSQWYNLEKHVIVDGEQKKETKFSSRIHLRICLEGGYHVLDESTHYSSDLRPTAKQLWKHNIGVLELGILTAQGLLPMKTKDGRGTTDPYCVAKYGQKWVRTRTIIDSFTPKWNEQYTWEVHDPCTVITIGVFDNCHLNGGEKANGARDTRIGKVRIRLSTLETDRVYTHSYPLIVLTPGGVKKMGEVQLAVRFTCSSLLNMMHLYSQPLLPKMHYIQPLSVIQVDNLRRQATNIVSTRLSRAEPPLRKEIVEYMLDVDSHMWSMRKSKANFFRIMGVLSPLIAVARWFDQICHWRNPLTTILIHVLFVILVLYPELILPTIFLYLFLIGVWYYRWRPRQPPHMDTRLSHAETAHPDELDEEFDTFPTSRPPDIVRVRYDRLRSVAGRIQTVVGDLATQGERLQSLLSWRDPRATALFVTFCFIAAIVLYVTPFRVVVFLAGLYTLRHPRFRHKMPSVPLNFFRRLPARTDSML

SEQ ID NO: 8962 - protein, 773 aa, Secale cereale
MQRPFRPEEYSLKETTPHLGGAAAGDKLTTTYDLVEQMQYLYVRVVKAKELPAKDLTGSCDPYVEVKLGNYKGTTRHFEKKTNPEWNQVFAFSKERIQASVVEIIVKDKDFVKDDYIGRVMFDLNEVPKRVPPDSPLAPQWYRLEERNGHKVKGELMLAVWMGTQADEAFPEAWHSDAASIPGDGLASIRSKVYLTPKLWYLRVNVIEAQDLIPNDKTRFPEVYVKAMLGNQALRTRVSPGRTLNPMWNEDLMFVAAEPFEEHLILSVEDRIAPGKDDVIGRTVISLQHVARRLDHKLLNSQWYNLEKHVMVDGEQRKETKFSSRIHLRICLEGGYHVLDESTHYSSDLRPTAKQLWKHNIGVLELGILTAQGLLPMKTKDGRGTTDPYCVAKYGQKWVRTRTIIDSFTPKWNEQYTWEVHDPCTVITIGVFDNCHLNGGEKANGARDTRIGKVRIRLSTLETDRVYTHSYPLIVLTPAGVKKMGEVQLAVRFTCSSLLNMMTLYSQPLLPKMHYVHPLSVIQVDNLRRQATNIVSTRLSRAEPPLRKEIVEYMLDVDSHMWSMRKSKANFFRIMGVLSPLIAVARWFDQICHWRNPLTTILIHVLFVILVLYPELILPTIFLYLFLIGVWYYRWRSRQPPHMDTRLSHAETAHPDELDEEFDTFPTSRPPDIVRMRYDRLRSVAGRIQTVVGDLATQGERLQSLLSWRDPRATALFVTFCFIAAIVLYVTPFRVVVFLAGLYTLRHPRFRHKMPSVPLNFFRRLPARTDSML

SEQ ID NO: 8963 - protein, 773 aa, Triticum aestivum
MQRPFRPEEYSLKETTPHLGGAAAGDKLTTTYDLVEQMQYLYVRVVKAKELPAKDLTGSCDPYVEVKLGNYKGTTRHFEKKTNPEWNQVFAFSKERIQASVVEIIVKDKDFVKDDYIGRVMFDLNEVPKRVPPDSPLAPQWYRLEERNGHKVKGELMLAVWMGTQADEAFPEAWHSDAASIPGDGLASIRSKVYLTPKLWYLRVNVIEAQDLIPNDKTRFPEVYVKAMLGNQALRTRVSPGRTLNPMWNEDLMFVAAEPFEEHLILSVEDRIAPGKDDVIGRTVISLQHVARRLDHKLLNSQWYNLEKHVMVDGEQRKETKFSSRIHLRICLEGGYHVLDESTHYSSDLRPTAKQLWKHNIGVLELGILTAQGLLPMKTKDGRGTTDPYCVAKYGQKWVRTRTIIDSFTPKWNEQYTWEVHDPCTVITIGVFDNCHLNGGEKANGARDTRIGKVRIRLSTLETDRVYTHSYPLIVLTPAGVKKMGEVQLAVRFTCSSLLNMMTLYSQPLLPKMHYIHPLSVIQVDNLRRQATNIVSTRLSRAEPPLRKEIVEYMLDVDSHMWSMRKSKANFFRIMGVLSPLIAVARWFDQICHWRNPLTTILIHVLFVILVLYPELILPTIFLYLFLIGVWYYRWRSRQPPHMDTRLSHAETAHPDELDEEFDTFPTSRPPDIVRMRYDRLRSVAGRIQTVVGDLATQGERLQSLLSWRDPRATALFVTFCFIAAIVLYVTPFRVVVFLAGLYTLRHPRFRHKMPSVPLNFFRRLPARTDSML

SEQ ID NO: 8964 - protein, 773 aa, Triticum aestivum
MQRPFRPEEYSLKETTPHLGGAAAGDKLTTTYDLVEQMQYLYVRVVKAKELPAKDLTGSCDPYVEVKLGNYKGTTRHFEKKTNPEWNQVFAFSKERIQASVVEIIVKDKDFVKDDYIGRVMFDLNEVPKRVPPDSPLAPQWYRLEERNGHKVKGELMLAVWMGTQADEAFPEAWHSDAASIPGDGLASIRSKVYLTPKLWYLRVNVIEAQDLIPNDKTRYPEVYVKAMLGNQALRTRVSPGRTLNPMWNEDLMFVAAEPFEEHLILSVEDRIAPGKDDVIGRTVISLQHVARRLDHKLLNSQWYNLEKHVMVDGEQRKETKFSSRIHLRICLEGGYHVLDESTHYSSDLRPTAKQLWKHNIGVLELGILTAQGLLPMKTKDGRGTTDPYCVAKYGQKWVRTRTIIDSFTPKWNEQYTWEVHDPCTVITIGVFDNCHLNGGEKANGARDTRIGKVRIRLSTLETDRVYTHSYPLIVLTPAGVKKMGEVQLAVRFTCSSLLNMMTLYSQPLLPKMHYIHPLSVIQVDNLRRQATNIVSTRLSRAEPPLRKEIVEYMLDVDSHMWSMRKSKANFFRIMGVLSPLIAVARWFDQICHWRNPLTTILIHVLFVILVLYPELILPTIFLYLFLIGVWYYRWRSRQPPHMDTRLSHAETAHPDELDEEFDTFPTSRPPDIVRMRYDRLRSVAGRIQTVVGDLATQGERLQSLLSWRDPRATALFVTFCFIAAIVLYVTPFRVVVFLAGLYTLRHPRFRHKMPSVPLNFFRRLPARTDSML

SEQ ID NO: 8965 - protein, 773 aa, Triticum aestivum
MQRPFRPEEYSLKETTPHLGGAAAGDKLTTTYDLVEQMQYLYVRVVKAKELPAKDLTGSCDPYVEVKLGNYKGTTRHFEKKTNPEWNQVFAFSKERIQASVVEIIVKDKDFVKDDYIGRVMFDLNEVPKRVPPDSPLAPQWYRLEERNGHKVKGELMLAVWMGTQADEAFPEAWHSDAASIPGDGLASIRSKVYLTPKLWYLRVNVIEAQDLIPNDKTRFPEVYVKAMLGNQALRTRVSPGRTLNPMWNEDLMFVAAEPFEEHLILSVEDRIAPGKDDVIGRTVISLQHVARRLDHKLLNSQWYNLEKHVMVDGEQRKETKFSSRIHLRICLEGGYHVLDESTHYSSDLRPTAKQLWKHNIGVLELGILTAQGLLPMKTKDGRGTTDPYCVAKYGQKWVRTRTIIDSFTPKWNEQYTWEVHDPCTVITIGVFDNCHLNGGEKANGARDTRIGKVRIRLSTLETDRVYTHSYPLIVLTPAGVKKMGEVQLAVRFTCSSLFNMMTLYSQPLLPKMHYIHPLSVIQVDNLRRQATNIVSTRLSRAEPPLRKEIVEYMLDVDSHMWSMRKSKANFFRIMGVLSPLIAVARWFDQICHWRNPLTTILIHVLFVILVLYPELILPTIFLYLFLIGVWYYRWRSRQPPHMDTRLSHAETAHPDELDEEFDTFPTSRPPDIVRMRYDRLRSVAGRIQTVVGDLATQGERLQSLLSWRDPRATALFVTFCFIAAIVLYVTPFRVVVFLAGLYTLRHPRFRHKMPSVPLNFFRRLPARTDSML

SEQ ID NO: 8966 - protein, 774 aa, Saccharum officinarum
MQRPPFRPEEYSLKETSPHLGGAAAGDKLTTTYDLVEQMQYLYVRVVKAKELPNKDITGSCDPYVEVKLGNYKGQTRHFEKKNNPEWNQVFAFSKERIQSSVVEIVVKDKDLVKDDFIGRVIFDLNEVPKRVPPDSPLAPQWYRLEDRNGHKVKGELMLAVWMGTQADEAFPEAWHSDAASVPGDGLASIRSKVYLTPKLWYLRVNVIEAQDLIPNDKTRFPEVYVKAMLGNQVLRTRVLASRTLNPMWNEDLMFVAAEPFEEHLILSVEDRVAPGKDEVIGRTIISLQHVPRRLDHRLLTSQWYNLEKHVIIDGEQKKETKFSSRIHLRICLEGGYHVLDESTHYSSDLRPTAKPLWKPSIGILELGVLTAQGLLPMKTKDGRGTTDAYCVAKYGQKWVRTRTIIDSFTPKWNEQYTWEVYDPCTVITIGVFDNCHLNGGEKANGARDTRIGKVRIRLSTLETDRVYTHSYPLIVLTPGGVKKMGEVQLAVRFTCSSLLNMMHLYSQPLLPKMHYVHPLSVIQVDNLRRQATNIVSTRLGRAEPPLRKEIVEYMLDVDSHMWSMRKSKANFFRIMGVLSPLIAVAKWFDQICLWRNPLTTILIHVLFVILVLYPELILPTIFLYLFLIGVWYYRWRPRQPPHMDTRLSHAETAHPDELDEEFDTFPTSRPPDIVRMRYDRLRSVAGRIQTVVGDLATQGERLQSLLSWRDPRATALFVVFCFIAAIVLYVTPFRVVVFLAGLYVLRHPRFRHRMPSVPLNFFRRLPARTDSML

SEQ ID NO: 8967 - protein, 774 aa, Sorghum bicolor
MQRPPLRPEEYSLKETSPHLGGAAAGDKLTTTYDLVEQMQYLYVRVVKAKELPNKDITGSCDPYVEVKLGNYKGQTRHFEKKNNPEWNQVFAFSKERIQSSVVEIVVKDKDLVKDDFIGRVMFDLNEVPKRVPPDSPLAPQWYRLEDRNGHKVKGELMLAVWMGTQADEAFPEAWHSDAASVPGDGLASIRSKVYLTPKLWYLRVNVIEAQDLIPNDKTRFPEVYVKAMLGNQVLRTRVLASRTLNPMWNEDLMFVAAEPFEEHLILSVEDRVAPGKDEVIGRTIISLQHVPRRLDHRLLTSQWYPLEKHVIIDGEQKKETKFSSRIHLRICLEGGYHVLDESTHYSSDLRPTAKPLWKPSIGILELGILTAQGLLPMKTKDGRGTTDAYCVAKYGQKWVRTRTIIDSFTPKWNEQYTWEVYDPCTVITIGVFDNCHLNGGEKANGARDTRIGKVRIRLSTLETDRVYTHSYPLIVLTPGGVKKMGEVQLAVRFTCSSLLNMMHLYSQPLLPKMHYVHPLSVIQVDNLRRQATNIVSTRLGRAEPPLRKEIVEYMLDVDSHMWSMRKSKANFFRIMGVLSPLIAVAKWFDQICLWRNPLTTILIHVLFVILVLYPELILPTIFLYLFLIGVWYYRWRPRQPPHMDTRLSHAETAHPDELDEEFDTFPTSRPPDIVRMRYDRLRSVAGRIQTVVGDLATQGERLQSLLSWRDPRATALFVVFCFIAAIVLYVTPFRVVVFLAGLYVLRHPRFRHRMPSVPLNFFRRLPARTDSML

SEQ ID NO: 8968 - protein, 774 aa, Panicum virgatum
MQRPPFRPEEYSLKETRPHLGGHAAGDKLTSTYDLVEQMQYLYVRVVKAKELPNMDITGGCDPYVEVKLGNYKGTTRFFEKNNNPEWNQVFAFSKERIQSSVVEIVVKDKDLVKDDFIGRVVFDLNEVPKRVPPDSPLAPQWYRMEDRHGHKVKGELMLAVWMGTQADEAFPEAWHSDAASVPGDGLASIRSKVYLTPKLWYLRVNVIEAQDLIPNDKTRFPEVYVKAMLGNQVLRTRVSASRTLNPMWNEDLMFVAAEPFEEHLMLSVEDRVAPGKDEVIGRTTISLQHVPRRLDHRLLTSQWYNLEKHVMIDGEQKKETKFSSRIHLRICLEGGYHVLDESTHYSSDLRPTAKPLWKPSIGILELGILTAQGLLPMKTKDGRGTTDAYCVAKYGQKWVRTRTIIDSFTPKWNEQYTWEVYDPCTVITIGVFDNCHLNGGEKANGARDTRIGKVRIRLSTLETDRVYTHSYPLIVLTPAGVKKMGEVQLAVRFTCSSLLNMMHLYSQPLLPKMHYVHPLSVMQVDNLRRQATNIVSTRLGRAEPPLRKEIVEYMLDVDSHMWSMRKSKANFFRIMGVLSPLIAVAKWFDQICHWRNPLTTILIHVLFVILVLYPELILPTIFLYLFLIGVWYYRWRPRQPPHMDTRLSHAETAHPDELDEEFDTFPTSRPPDIVRMRYDRLRSVAGRIQTVVGDLATQGERLQSLLSWRDPRATALFVVFCFIAAIVLYVTPFRVVVFLAGLYVLRHPRFRHKMPSVPLNFFRRLPARTDSML

SEQ ID NO: 8969 - protein, 774 aa, Panicum virgatum
MQRPLFRPEEYSLKETRPHLGGHAAGDKLTSTYDLVEQMQYLYVRVVKAKELPNMDITGGCDPYVEVKLGNYKGTTRFFEKNNNPEWNQVFAFSKERIQSSVVEIVVKDKDLVKDDFIGRVVFDLNEVPKRVPPDSPLAPQWYRLEDRHGHKVKGELMLAVWMGTQADEAFPEAWHSDAASVPGDGLASIRSKVYLTPKLWYLRVNVIEAQDLIPNDKTRFPEVYVKAMLGNQVLRTRVSASRTLNPMWNEDLMFVAAEPFEEHLMLSIEDRVAPGKDEVIGRTTISLQHVPRRLDHRLLTSQWYNLEKHVMIDGEQKKETKFSSRIHLRICLEGGYHVLDESTHYSSDLRPTAKPLWKPSIGILELGILTAQGLLPMKTKDGRGTTDAYCVAKYGQKWVRTRTIIDSFTPKWNEQYTWEVYDPCTVITIGVFDNCHLNGGEKANGARDTRIGKVRIRLSTLETDRVYTHSYPLIVLTPAGVKKMGEVQLAIRFTCSSLLNMMHLYSQPLLPKMHYVHPLSVMQVDNLRRQATNIVSTRLGRAEPPLRKEIVEYMLDVDSHMWSMRKSKANFFRIMGVLSPLIAVAKWFDQICHWRNPLTTILIHVLFVILVLYPELILPTIFLYLFLIGVWYYRWRPRQPPHMDTRLSHAETAHPDELDEEFDTFPTSRPPDIVRMRYDRLRSVAGRIQTVVGDLATQGERLQSLLSWRDPRATALFVVFCFIAAIVLYVTPFRVVVFLAGLYVLRHPRFRHRMPSVPLNFFRRLPARTDSML

SEQ ID NO: 8970 - protein, 774 aa, Setaria italica
MQRPPFRPEEYSLKETKPHLGGHAAGDKLTSTYDLVEQMQYLYVRVVKAKELPNMDITGSCDPYVEVKLGNYKGTTRFFEKTSNPEWNQVFAFSKERIQSSVVEIVVKDKDLVKDDFIGRVIFDLNEVPKRVPPDSPLAPQWYRLEDRNGHKVKGELMLAVWMGTQADEAFPDAWHSDAASVPGDGLSSIRSKVYLTPKLWYLRVNVIEAQDLIPNDKTRFPDVYVKAILGNQVLRTRVSPARTLNPMWNEDLLFVAAEPFEEHLILSVEDRVAPGKDEVIGRTVISLQHVPRRLDHRLLTSQWYNLEKHVMIDGEQKKETKFSSRIHLRICLEGGYHVLDESTHYSSDLRPTAKPLWKPSIGVLELGILTAQGLLPMKTKDGRGTTDAYCVAKYGQKWVRTRTIIDSFTPKWNEQYTWEVYDPCTVITIGVFDNCHLNGGDKANGARDTRIGKVRIRLSTLETDRVYTHSYPLIVLTPAGVKKMGEVQLAVRFTCSSLLNMMHLYSQPLLPKMHYVHPLSVMQVDNLRRQATNIVSTRLGRAEPPLRKEIVEYMLDVDSHMWSMRKSKANFFRIMGVLGPLIAVAKWFDQICHWRNPLTTILIHVLFMILVLYPELILPTIFLYLFLIGVWYYRWRPRQPPHMDTRLSHAETAHPDELDEEFDTFPTSRPPDVVRMRYDRLRSVAGRIQTVVGDLATQGERLQSLLSWRDPRATALFVVFCFIAAIVLYVTPFRVVVFLAGLYVLRHPRFRHKMPSVPLNFFRRLPARTDSML

SEQ ID NO: 8971 - protein, 774 aa, Panicum virgatum
MQRPLFRPEEYSLKETRPHFGGHAAGDKLTSTYDLVEQMQYLYVRVVKAKELPNMDITGGCDPYVEVKLGNYKGTTRFFEKNNNPEWNQVFAFSKERIQSSVVEIVVKDKDLVKDDFIGRVVFDLNEVPKRVPPDSPLAPQWYRLEDRHGHKVKGELMLAVWMGTQADEAFPETWHSDAASVPGDGLASIRSKVYLTPKLWYLRVNVIEAQDLIPNDKTRFPEVYVKAMLGNQVLRTRVSASRTLNPLWNEDLMFVAAEPFEEHLMLSVEDRVAPGKDEVIGRTTISLQHVPRRLDHRLLTSQWYNLEKHVMIDGEQKKETKFSSRIHLRICLEGGYHVLDESTHYSSDLRPTAKPLWKPSIGILELGILTAQGLLPMKTKDGRGTTDAYCVAKYGQKWVRTRTIIDSFTPKWNEQYTWEVYDPCTVITIGVFDNCHLNGGEKANGARDTRIGKVRIRLSTLETDRVYTHSYPLIVLTPAGVKKMGEVQLAIRFTCSSLLNMMHLYSQPLLPKMHYVHPLSVMQVDNLRRQATNIVSTRLGRAEPPLRKEIVEYMLDVDSHMWSMRKSKANFFRIMGVLSPLIAVAKWFDQICHWRNPLTTILIHVLFVILVLYPELILPTIFLYLFLIGVWYYRWRPRQPPHMDTRLSHAETAHPDELDEEFDTFPTSRPPDIVRMRYDRLRSVAGRIQTVVGDLATQGERLQSLLSWRDPRATALFVVFCFIAAIVLYVTPFRVVVFLAGLYVLRHPRFRHRMPSVPLNFFRRLPARTDSML

SEQ ID NO: 8972 - protein, 774 aa, Pennisetum glaucum
MQRPPFRPEEYSLKETRPHLGGNATGDKLTSTYDLVEQMQYLYVRVVKAKELPNMDITGSCDPYVEVKLGNYKGTTRFFEKNSNPEWNQVFSFSKERIQSSVVEIVVKDKDLVKDDFIGRVIFDLNEVPKRVPPDSPLAPQWYRLEDHNGHKVKGELMLAVWMGTQADEAFPEAWHSDAASVAGDGLASIRSKVYLTPKLWYLRVNVIEAQDLIPNDKTRFPDVYVKAILGNQVLRTRVSPARTLNPMWNEDLLFVAAEPFEEHLILSVEDRVAPGKDDVIGRTVISLQHVPRRLDHRLLTSQWYNLEKHVMIDGEQKKETKFSSRIHLRICLEGGYHVLDESTHYSSDLRPTAKPLWKPSIGVLELGILTAQGLLPMKTKDGRGTTDAYCVAKYGQKWVRTRTIIDSFTPKWNEQYTWEVYDPCTVITIGVFDNCHLNGGDKGNGARDTRIGKVRIRLSTLETDRVYTHSYPLIVLTPAGVKKMGEVQLAVRFTCSSLLNMMHLYSQPLLPKMHYVHPLSVMQVDNLRRQATNIVSTRLSRAEPPLRKEIVEYMLDVDSHMWSMRKSKANFFRIMGVLGPLIAVAKWFDQICHWRNPLTTILIHVLFMILVLYPELILPTIFLYLFLIGVWYYRWRPRQPPHMDTRLSHAETAHPDELDEEFDTFPTSRQPDIVRMRYDRLRSVAGRIQTVVGDLATQGERLQSLLSWRDPRATALFVVFCFIAAIVLYVTPFRVVVFLAGLYVLRHPRFRYKMPSVPLNFFRRLPARTDSML

SEQ ID NO: 8973 - protein, 773 aa, Zea mays
MQRPLLRPEEYSLKETSPHLGGAAAGDKLTTTYDLVEQMQYLYVRVVKAKELPNMDITGSCDPYVEVKLGNYKGQTQHFEKKNNPEWNQVFAFSKERIQSSVVEIVVKDKDLVKDDFIGRVIFDLNEVPKRVPPDSPLAPQWYRLEDRNGHKVKGELMLAVWMGTQADEAFPEAWHSDAASVPGDGLASIRSKVYLTPKLWYLRVNVIEAQDLIPNDRARFPEVYVKAMLGNQVLRTRAPSRTLNPMWNEDLMFVAAEPFEEHLILSVEDRVAPGKDEVIGRTMISLHHVPRRLDHRLLTSQWYNLEKHVIIDGEQKKETKFSSRIHLRICLEGGYHVLDESTHYSSDLRPTAKPLWKPSIGMLELGILTAQGLLPMKTKDGRGTTDAYCVAKYGQKWVRTRTIIDSFTPKWNEQYTWEVYDPCTVVTIGVFDNCHLNGGEKVNGARDTRIGRVRIRLSTLETDRVYTHSYPLIVLTPGGVKKMGEVQLAVRFTCSSLLNMMHLYTQPLLPKMHYVHPLSVMQVDNLRRQATNIVSTRLGRAEPPLRKEIVEYMLDVDSHMWSMRKSKANFFRIMSVLSPLVAVTKWFDQICRWRNPLTTILIHVLFMILVLYPELILPTVFLYLFLIGVWYYRWRLRQPPHMDTRLSHAETAHPDELDEEFDTFPTSRPPDVVRMRYDRLRSVAGRIQTVVGDLATQGERLQSLLSWRDPRATALFVVFCFVAAIVLYVTPFRVVVFLAGLYMLRHPRFRHKMPSVPLNFFRRLPARTDSML

SEQ ID NO: 8974 - protein, 774 aa, Zea mays
MQRPPLRPEEYSLKETTPHLGGAAAGDKLTTTYDLVEQMQYLYVRVVKAKELPNKDITGSCDPYVEVKLGNYKGQTGHFEKKNNPEWNQVFAFAKERIQSSVVEILVKDKDLVKDDFIGRVIFDLNEVPKRVPPDSPLAPQWYRLEDRNGHKVKGELMLAVWMGTQADEAFPEAWHSDAASVPGDGLASIRSKVYLTPKLWYLRLNVIEAQDLIPNDKTRFPEVYVKAMLGNQVQRTRALASRTLNPLWNEDLMFVAAEPFEEHLVLSVEDRVAPGKDEVIGRTIIALQHVPRRLDHRLLTSQWYNLEKHVIIDGEQKKETKFSSRIHLRICLEGGYHVLDESTHYSSDLRPTAKPLWKPSIGILELGILTAQGLLPMKTKDGRGTTDAYCVAKYGQKWVRTRTIIDSFTPKWNEQYTWEVYDPCTVVTIGVFDNCHLNGGEKANGARDTRIGKVRIRLSTLETDRVYTHSYPLIVLTPGGVKKMGEVQLAVRFTCSSLLNMMHLYSQPLLPKMHYVHPLSVIQVDNLRRQATSIVSTRLGRAEPPLRKEIVEYMLDVDSHMWSMRKSKANFFRITGVLSPLFAVARWFDQICHWKNPLTTVLIHVLFMILVLYPELILPTIFLYLFLIGVWYYRWRPRQPPHMDTRLSHAETAHPDELDEEFDTFPTSRPPDLVRMRYDKLRSVAGRIQTVVGDLATQGERLQSLLSWRDPRATALFVVFCFVAAIVLYVTPFRVVVFLAGLYVLRHPRFRHKMPSVPLNFFRRLPARTDSML

SEQ ID NO: 8975 - protein, 775 aa, Musa acuminata
MQRPLRPEEYSLKETSPHLGGGGVSGDKLTTTYDLVEQMQYLYVRVVKAKDLPPKDVTGSCDPYVEVKLGNYKGTTRHFEKKTNPEWNQVFAFSKDRIQASVLEVIVKDKDFIKDDFIGRVLFDLTEVPKRVPPDSPLAPQWYRLEDRKGDKGKGELMLAVWMGTQADEAFPDSWHSDAATIPSDGLANIRSKVYLTPKLWYLRVNVIEAQDLIPYEKNRFPEVFVKVMLGNQALRTRISQSRTLNPMWNEDLMFVAAEPFEEHLVLSVEDRVAPNKDEVLGKTVIPLQKIDRRLDYKPVNSRWYNLEKHVIVEGDQKKKEVKFSSRIHLRICLEGGYHVLDESTHYSSDLRPTAKQLWKPSIGVLELGILSAQGLLPMKTKDGRGTTDAYCVAKYGQKWVRTRTIIDSFAPKWNEQYTWEVYDPCTVITIGVFDNCHLQGGEKAAGTRDTRIGKVRIRLSTLETDRVYTHSYPLIVLLPSGVKKMGEVQLAVRFTCSSLLNILHMYSQPLLPKMHYLHPLSVMQLDNLRHQATQIVSMRLSRAEPPLRKEVVEYMLDVDSHMWSMRKSKANFFRIMGVLSPLVAVGKWFDQICHWKNPLTTILIHVLFVILILYPELILPTIFLYLFLIGVWYFRWRPRQPPYMDTRLSHADTAHPDELDEEFDTFPTSRPPDIVRMRYDRLRSVAGRIQTVVGDLATQGERLQSLLSWRDPRATALFVTFCLVAAVVLYVTPFRVVAFLTGLYVLRHPRFRHKLPSVPLNFFRRLPARTDSML

SEQ ID NO: 8976 - protein, 774 aa, Elaeis guineensis
MQRPLQPQEYSLKETSPHLGGGGVAGDKLTTTYDLVEQMQYLYVRVVKARDLPTKDVTGSCDPYVEVKLGNYKGTTRHFEKTTNPEWNQVFAFSKERIQASSVEVIVKDKDFVKDDFIGRVSFDLNEIPKRVPPDSPLAPQWYRLEDRKGDKVKGELMLAVWMGTQADEAFPEAWHSDAATVPSDGLASIRSKVYLTPKLWYVRVNVIEAQDLQPSDKSRFEFYVKVMLGNQALRTRISQIRTINPMWNEDLMFVAAEPFEEHLVLSVEDRVAPNKDEVLGKTVISLQNVDRRLDYKPVNSRWYNLEKHVIVEGEQKKKEVKFSSRIHLRICLDGGYHVLDESTHYSSDLRPTAKQLWKQSIGVLELGILNAQGLLPMKTKDGRGTTDAYCVAKYGQKWVRTRTIIDSFTPKWNEQYTWEVYDPCTVITIGVFDNCHLQGGEKAAATRDTRIGKVRIRLSTLETDRVYTHYYPLIVLLPSGVKKMGEVQLAVRFTCSSLINMLHLYSQPLLPKMHYLYPLSVVQLDNLRHQATQIVSMRLSRAEPPLRKEVVEYMLDVDSHMWSMRKSKANFFRIMGVLSPLISVGKWFDQVCSWRNPLTTILIHILFVILVLYPELILPTIFLYLFLIGVWYFRWRPRQPPHMDTRLSHAESAHPDELDEEFDTFPTSRPPDIVRMRYDRLRSVAGRVQTVVGDLATQGERLQSLLSWRDPRATALFVTFCLIAAIVLYVTPFRVVALLTGLYVLRHPRFRHRLPSVPLNFFRRLPARTDSML

SEQ ID NO: 8977 - protein, 773 aa, Aristolochia fimbriata
MQRPLPPEDYRLKETSPHLGGGGVAGDKLTSTYDLVEQMQYLYVRVVKARDLPAKDVTGSCDPYVEVKLGNYKGTTRHFEKKTNPEWNQVFAFSKDRLQSSMIEVMVKDKDLVKDDIIGRVIFDLNEVPKRVPPDSPLAPQWYRLEDRKGDKVKGELMLAVWMGTQADEAFPEAWHSDAAAVHSEGLANIRSKVYLSPKLWYVRVNVIEAQDLQPSDKGRYPEVFVKAILGNQALRTRISPSRNINPMWNEDLMFVAAEPFEEHLILSVEDRVGPNKDEVLGKCVIPLQHVERRLDYKPVNTRWYNLEKHIVVEGEKKKDTKFASRIHLRICLDGGYHVLDESTHYSSDLRPTAKQLWKPSIGVLELGILNAQGILPMKTKDGRGTTDAYCVAKYGQKWVRTRTIIDSFIPKWNEQYTWEVFDPCTVITIGVFDNCHLLGDKASGARDARIGKVRIRLSTLETDRVYTHSYPLLVLHPSGVKKMGELQLAVRFTCSSLLNMMHIYSQPLLPKMHYLHPLSVTQLDSLRHQATQIVSMRLNRAEPSLRKEVVEYMLDMDSHMWSMRRSKANFFRIMSVLSGLIAVGRWFDQICLWKNPLTTILIHILFLILVLYPELILPTIFLYLFLIGIWYFRWRPRQPPHMDTRLSHAETVHPDELDEEFDTFPTSRPSDIVRMRYDRLRSVAGRIQTVVGDLATQGERLQNLLSWRDPRATALFVTFCLIAAIVLYVTPFRVVALLSGFYVLRHPRFRHKLPSVPLNFFRRLPARTDSLL

SEQ ID NO: 8978 - protein, 773 aa, Unknown
  Sequence found in Organisms: Citrus clementina, Citrus sinensis
MRPPLEEFSLKETKPHLGGGKITGDKLTSTYDLVEQMQYLYVRVVKAKDLPPKDVTGSCDPYVEVKMGNYKGTTRHFEKKTNPEWNQVFAFSKDRIQSSVLEVTVKDKDFVKDDFMGRVLFDLNEIPKRVPPDSPLAPQWYRLEDRKGDKVRGELMLAVWMGTQADEAFPEAWHSDAATVTGIEGLANIRSKVYLSPKLWYLRVNVIEAQDLQPTDKGRFPEVYVKAQLGNQALRTRVSASRTINPMWNEDLMFVAAEPFEEHLILTVEDRVAPNKDEVLGKCMIPLQYVDKRLDHKPVNTRWYNLEKHIVVEGEKKKDTKFASRIHMRICLEGGYHVLDESTHYSSDLRPTAKQLWKSSIGVLELGILNAQGLMPMKTKDGRGTTDAYCVAKYGQKWVRTRTIIDSPTPKWNEQYTWEVFDPCTVITIGVFDNCHLHGGDKAGGARDSRIGKVRIRLSTLETDRVYTHSYPLLVLYPNGVKKMGEIHLAVRFTCSSLLNMMHMYSQPLLPKMHYLHPLTVSQLDSLRHQATQIVSMRLSRAEPPLRKEVVEYMLDVGSHMWSMRRSKANFFRIMGVLSGIIAVGKWFDQICNWKNPITTVLIHILFIILVLYPELILPTVFLYLFLIGVWYYRWRPRHPPHMDTRLSHADSAHPDELDEEFDTFPTSRPSDIVRMRYDRLRSIAGRIQTVVGDLATQGERLQSLLSWRDPRATALFVIFCLIAAIVLYVTPFQVVALLTGFYVLRHPRFRHKLPSVPLNFFRRLPARTDCML

SEQ ID NO: 8979 - protein, 55 aa, Populus trichocarpa
MTVQGSKTSQVYCSFHLGVKLSIMVLVRTHFCPYFATQYASVVPRLSFVFMGINP

SEQ ID NO: 8980 - protein, 775 aa, Phalaenopsis aphrodite
MQRPLRPEDYSLKQTSPHLGGGGAAGDKLTTTYDLVEQMQYLYVRVVKAKDLPAKDITGSLDPYVEVKLGNYKGTTRHFEKKTNPEWNQVFAFSKDRIQASILEVLVKDKDFVKDDFVGRVTFDLSEIPKRVPPDSPLAPQWYRLENKNGDKIKGELMLAVWMGTQADEAFSNAWHSDAATVPSDGLANIRSKVYLTPKLWYVRVNVIEAQDLQLSDKGRFPEVFVKASLGNQALRTRISAIRNINPMWNEDLMFVAAEPFEEHLVISAEDRVGPNKEEVLGKTIIPLQNVDRRLDYKPVPSRWYTIEKHVVITEGDKKKELKFSSRIHLRICLDGGYHVLDESTHYSSDFRPTAKQLWKPSIGVLELGILNAQGLSPMKNKDGKGTVDAYCIAKYGQKWVRTRTIIDSFAPKWNEQYTWEVYDPCTVVTIGVFDNCHLQGGEKAAGTRDSRIGKVRIRLSTLETDKVYTHAYPLLVLLPSGVKKMGEVQLAVRFTCSSLLNMMHMYSLPLLPKMHYLFPLSVTQLDNLRYQATQIVSMRLSRAEPPLRKEVVEYMLDVDSHMWSMRKSKANFFRLMGVFSGVIAVGKWFNQICNWRNPLTTVLIHVLFVILVLYPELILPTIFLYLFLIGVWYYRRRPRHPPHMDTRLSHAETAHPDELDEEFDTFPTSRPPDIVRMRYDRLRSVAGRIQTVVGDLATQGERLLSLLSWRDPRATALFVIFCLIAAIVLYVTPFRLVAFLAGIYVLRHPRFRHKMPSVPLNFFRRLPARTDSML

SEQ ID NO: 8981 - protein, 774 aa, Populus trichocarpa
MQRPLHEDFLLKETNPHLGGGKITGDKLTSTYDLVEQMQYLYVRVVKAKELPAKDVTGSCDPYVEVKLGNYKGTTRHFEKKSNPEWNQVFAFSKDRMQASMLEVTVKDKDFVKDDFMGRVLFDLNEVPKRVPPDSPLAPQWYRLEDRKGDKFKGELMLAVWMGTQADEAFPEAWHSDAATVTGTDGLANIRSKVYLSPKLWYLRVNVIEAQDLQPSDKGRYPEVYVKATLGNQVLRTRVSPSRSINPMWNEDLMFVAAEPFEEPLILSVEDRIAPNKDEVLGKCAIPMHYVDRRLDHKPVNTRWFNLERHVIVEGEKKKETKFSSRIHTRICLEGGYHVLDESTHYSSDLRPTAKQLWKNSIGVLEVGILNAQGLMPMKTKDSRGTTDAYCVAKYGQKWVRTRTIIDSFTPKWNEQYTWEVFDPCTVITIGVFDNCHLHGGDKPGGARDSRIGKVRIRLSTLETDRVYTHSYPLLVLHPNGVKKMGEIHLAVRFTCSSLLNMMHMYSQPLLPKMHYIHPLTVSQLDSLRHQATQIVSMRLSRAEPPLRKEIVEYMLDVGSHMWSMRRSKANFFRIMNVFGGLIAVGKWFDQICNWKNPITTVLIHILFIILVLFPELILPTIFLYLFLIGVWYYRWRPRHPPHMDTRLSHAESAHPDELDEEFDTFPTSRPPDIVRMRYDRLRSIAGRIQTVVGDLATQGERLQSLLSWRDPRATALFVLFCLIAAIVLYVTPFQVVALLTGFYVLRHPRFRHKLPSVPLNFFRRLPARTDCML

SEQ ID NO: 8982 - protein, 143 aa, Amorphophallus konjac
MGEIQLAIRFACASLINMMHIYSQPLLPKMHYLHPLSVAQLDSLRHQATQIVSMRLSRAEPPLRKEVVEYMLDVDSHMWSMRRSKANFFRIMGVLSGLIAVGRWFDQICNWKNPLTTILIHVLFMTLVLYPELILPTVFYTCS

SEQ ID NO: 8983 - protein, 305 aa, Vinca minor
MQRPPQDDFQLKETKPHLGGMKVTGDKLTSTYDLVEQMQYLYVRVVKAKELPGKDVTGSCDPYVEVRMGNYKGTTRHFEKKSNPEWSQVFAFSKDRIQASVLEVTVKDKDMVKDDFIGRVLFDLNEIPKRVPPDSPLAPQWYRLEDRKGDKVKGELMLAVWMGTQADEAFPEAWHSDAAAVSGADGLANIRSKVYLSPKLWYLRVNVIEAQDLIPNDKSRFPEVFVKAILGNQALRTRVSMNKSINPMWNEDLMFVAAEPFEEPLILSVEDRVAPNKDEVLGRCAIPLQMVDRRLDHKPIKHKVV

SEQ ID NO: 8984 - protein, 681 aa, Ricinus communis
MQRPPPEEFVLKETNPHLGGGKVTGDKLTTTYDLVEQMQYLYVRVVKAKDLPGKDVTGSCDPYVEVKLGNYKGTTRHFEKKSNPEWSQVFAFSKDRIQASVLEVTVKDKDVVKDDFMGRVLFDLNEVPKRVPPDSPLAPQWYRLEDRKGDKVKGELMLAVWMGTQADEAFPEAWHSDAASVSGMDSLANIRSKVYLSPKLWYLRVNVIEAQDLQPNDKGRYPEVFVKAILGNQALRTRISLSRSINPLWNEDLMFVAAEPFEEPLILSVEDRVAPNKEEVLGRCAIPLQYVDRRLDHRPVNTRWFNLEKHVIVEGEKKKETKFASRIHMRICLEGGYHVLDESTHYSSDLRPTAKQLWKQSIGVLELGILSAQGLMPMKTKDGRGTTDAYCVAKYGQKWVRTRTIIESFTPKWNEQYTWEVFDPCTVITIGVFDNCHLHGGDKSGAAKDSRIGKVRIRLSTLETDRVYTHSYPLLVLHGNGVKKMGEIHLAVRFTCSSLLNMMHMYSHPLLPKMHYLHPLTVSQLDSLRHQATQIVSMRLSRAEPPLRKEVVEYMLDVGSHMWSMRRSKANFFRIMGVLSGLIAVGKWFDQICNWKNPITTVLIHILFIILVLYPELILPTIFLYLFLIGVWYYRWRPRHPPHMDTRLSHAESAHPDELDEEFDTFPTSRPSDIVRMRYDR

SEQ ID NO: 8985 - protein, 774 aa, Malus domestica
MQRPPPEDFALKETKPHLGGGRISGDKLTSTYDLVEQMQYLYVRVVKAKDLPAKDVTGSCDPYVEVKLGNYKGATRHFEKKSNPEWNQVFAFSKDRIQATVLEVIVKDKDLMKDDFMGRVSFDLNEVPKRVPPDSPLAPQWYRLEDHKGNKARGELMLAVWMGTQADEAFPEAWHSDAATISGADSLANIRSKVYLSPKLWYLRVNVIEAQDLIPSDKGRYPEVYVKAILGNQALRTRISPSRSINPMWNEDLMFVASEPFEEPLILSVEDRIAPNKDEVLGRCAIPLQYVPRRYDHKPVNTSWHNLEKHVIVEGEKKKEIKFASRIHMRICLEGGYHVLDESTHYSSDLRPTAKPLWKSSIGILEVGILNAQGLMPMKTKDGRGTTDAYCVAKYGQKWVRTRTIIDSFMPRWNEQYTWEVFDPCTVITIGVFDNCHLHGGEKAGGAKDARIGKVRIRLSTLETDRVYTHSYPLLVLHPNGVKKMGEIHMAVRFTCSSLLNMMHMYSQPLLPKMHYIHPLTVSQLDSLRHQATQIVSIRLSRAEPPLRKEVVEYMLDVGSHMWSMRRSKANFFRIMNVLGGIIAVGKWFDQICNWKNPITTVLIHILFIILVMYPELILPTIFLYLFLIGVWYYRWRPRHPPHMDTRLSHADSAHPDELDEEFDTFPTSRPSDIVRMRYDRLRSIAGRIQTVVGDLATQGERLQSLLSWRDPRATALFVLFCLIAAIVLYVTPFQVVALLAGFYVLRHPRFRHKLPSVPLNFFRRLPARTDCML

SEQ ID NO: 8986 - protein, 774 aa, Aquilegia formosa
MQRPHPPEDFSLKETSPHLGGGGLTGDKHTSTYDLVEQMQYLYVRVVKAKDLPTKDVTGSCDPYVEVKLGNYKGTTPHFEKKTNPEWNRVFAFSKDRLQASVLEVLVKDKDLVKDDIIGRIMFDLNEVPKRVPPDSPLAPQWYRLDDRKGDKVKGELMLAVWMGTQADEAFPEAWHSDAAAVSSSDGLANIRSKVYLSPKLWYLRVNVIEAQDLLPSDKGRYPEVYVKAILGNQALRTRISPSKNINPLWNEDLLFVASEPFEEHLILSVEDRVGPNKDEVLGKCVIPLLSVQRRLDHRPVNTKWYNLEKHVIVDGEKKEIKFASKIHLRICLDGGYHVLDESTHYSSDLRPTAKQMWKQSIGVLELGILTAQGLLPTKTKDGRGTTDAYCVAKYGQKWIRTRTIIDNSTPKWNEQYTWEVFDPCTVITIGVFDNFHLHGGDKAGGAKDTRIGKVRIRLSTLETDRVYTHSYPLLVLHPAGVKKMGEIQLAVRFTCSSLLNMMHIYSQPLLPKMHYIHPLSVTQLDSLRHQATQIVSMKLSRAEPPLRKEIVEYMLDVDSHMWSMRRSRANFFRIMGVLSGLIKVAKWFDQIYNWKNPVTTVLIQILFLILVLYPELILPTIFLYLFLIGVWHYRWRPRHPPHMDTRLSYADSVHPDELDEEFDTFPTSRPPDIVRMRYDRLRSVAGRIQTVVGDLATQGERLQSLLSWRDPRASALFVTFCLIAAIVLYVTPFQVVAILMSFYTLRHPRFRHKLPSVPLNFFRRLPARTDSML

SEQ ID NO: 8987 - protein, 772 aa, Sesamum indicum
MQRPPQEDFSLKETNPHLGGGKVTGDKLTSTYDLVEQMQYLYVRVVKAKDLPGKDVTGSCDPYVEVRLGNYKGTTRHFEKKSNPEWNQVFAFSKERIQASVLEVTVKDKDVVKDDFIGRVLFDLNEIPKRVPPDSPLAPQWYRLEDRKNEKAKGELMLAVWMGTQADEAFPEAWHSDAAAVSGADGLANIRSKVYLSPKLWYLRVNVIEAQDLQPSDKSRFPEVFVKAILGNQALRTRVSMSKSINPMWNEDLMFVAADPFEEPLILSVEDRVAPNKDEVLGRCAIPLQYVDRRLDHKPVSTRWYNLEKHVIVEGEKKKEVKFASKIHMRICLEGGYHVLDESTHYSSDLRPTAKQLWKSSIGVLELGILNAQGLSPMKTKDGRATTDAYCVAKYGQKWVRTRTIIDSFAPKWNEQYTWEVFDPCTVVTIGVFDNCHLQGGDKAGRDSRIGKVRIRLSTLETDRVYTHSYPLLVLHPSGVKKMGEIHLAVRFTCSSLVNMMHMYSQPLLPKMHYIHPLTVSQLDSLRHQATQIVSIRLSRAEPPLRKEVVEYMLDVGSHMWSMRRSKANFFRIMGVLSGLIAVGKWFDQICNWKNPITTVLIHILFLILVMYPELILPTIFLYLFLIGVWYYRWRPRHPPHMDTRLSCADNAHPDELDEEFDTFPTSRPADIVRMRYDRLRSIAGRIQTVVGDLATQGERLQSLLSWRDPRATALFVIFCLVAAIVLYVTPFQVVALLTGFYVLRHPRFRYKLPSVPLNFFRRLPARTDCML

SEQ ID NO: 8988 - protein, 774 aa, Tabernaemontana elegans
MQRPLQDDFQLKETKPHLGGLKVTGDKLTSTYDLVEQMQYLYVRVVKAKDLPGKDVTGSCDPYVEVKLGNYKGTTRHFEKKSNPEWNQVFAFSKDRIQASVLDVTVKDKDFVKDDFMGKVSFDLNEIPKRVPPDSPLAPQWYRLEDRSGNKVRGELMLAVWMGTQADEAFPEAWHSDAAAVSGADALANIRSKVYLSPKLWYLRVNVIEAQDLIPSDKSRFPEVFVKAILGNQALRTRVSMSKTINPMWNEDLMFVAAEPFEEPLILSVEDRVAPNKDEVLGRCAIPLHMVDRRLDHKPINSKWYNLEKHVIVEGEKKKDVKFASRIHMRICLEGGYHVLDESTHYSSDLRPTAKQLWKSSIGVLELGILNAQGLSPMKTKDARATTDAYCVAKYGQKWVRTRTIIDSFAPKWNEQYTWEVFDPCTVITIGVFDNCHLQGGDKSGGARDSRIGKVRIRLSTLETDRVYTHSYPLLVLHPSGVKKMGEIHLAVRFTCSSLLNMMHLYSQPLLPKMHYIYPLTVSQLDNLRHQATQIVSMRLSRAEPPLRKEVVEYMLDVGSHMWSMRRSKANFFRIMGVLGGLIAVGKWFDQICNWKNPITTVLIHILFLILVLYPELILPTIFLYLFLIGVWYYRWRPRNPPHMDTRLSCADNAHPDELDEEFDTFPTTRPADIVRMRYDRLRSIAGRIQTVVGDLATQGERLQSLLSWRDPRATALFVIFCLVAAVVLYVTPFQVVALLTGFYVLRHPRFRHKLPSVPLNFFRRLPARTDCML

SEQ ID NO: 8989 - protein, 774 aa, Gossypium hirsutum
MPRPPPEDFALKETNPHLGGGKVSGDKLTSTYDLVEQMQYLYVRVVKAKDLPGKDVTGSCDPYVEVKLGNYLGKTRFFVKKSNPEWNQVFAFSKDRLQASLLEVTVKDKDFVKDDFIGKVFFDLNEIPKRVPPDSPLAPQWYRLEDRQGHKVKGELMLAVWMGTQADEAFPEAWHSDAAFVSGADGLANIRSKVYLSPKLWYLRVNVIEAQDLQPGDKGRYPEVFVKAILGNQALRTRISQARGINPMWNEDLMFVAAEPFEEPLILSVEDRVAPNKDEVLGKCAIPLQYVDRRLDHKAVNSRWFNLEKHVIVEGEKKKETKFASRIHMRICLEGGYHVLDESTHYSSDLRPTAKQLWKSSIGVLELGILNAHGLMPMKNKDGRGTTDAYCVAKYGQKWVRTRTIIDSFAPKWNEQYTWEVFDPCTVITIGVFDNCHLHGGDKAAGAKDTKIGKVRIRLSTLETDRVYTHSYPLLVLHPNGVKKMGEIHLAVRFSCSSLLNMMHMYSHPLLPKMHYLHPLTVSQLDSLRHQATQIVSMRLGRAEPPLRKEVVEYMLDVGSHMWSMRRSKANFFRIMNVLGGLIAVGKWFDQICNWKNPITTVLIHILFIILVLYPELILPTIFLYLFLIGVWYYRWRPRHPPHMDTRLSHADSAHPDELDEEFDTFPTSRPSDIVRMRYDRLRSIAGRIQTVVGDLATQGERLQSLLSWRDPRATALFVIFCLVAAIVLYVTPFQVVALLAGFYILRHPRFRHKLPSVPLNFFRRLPARTDSML

SEQ ID NO: 8990 - protein, 774 aa, Euphorbia peplus
MPRPPPEDYVLKETNPHLGGGKVTGDKLTSTYDLVEQMQYLYVRVVKAKELPGKDVTGSCDPYVEVKLGNYKGTTRHFEKKSNPEWSQVFAFSKDRIQASVLEVTVKDKDFVKDDFMGRVFFDLNEVPKRVPPDSPLAPQWYRLEDRKGDKVKGELMLAVWMGTQADEAFPEAWHSDAASVSGMDSLANMRSKVYLSPKLWYLRVNVIEAQDLQPTDKGRYPEVFVKAILGNQALRTRISASRSINPMWNEDLMFVAAEPFEEHLILSVEDRVAPNKDEVLGRCAIHLQHLDRRLDHRPVNTRWFNLEKHVIVDGEKKKEIKFASRIHMRVCLEGGYHVLDESTHYSSDLRPTAKQLWKQSIGVLELGILNATGLMPMKTKDGRGTTDAYCVAKYGQKWIRTRTIIDSFTPKWNEQYTWEVFDPCTVLTIGVYDNCHLHGGDKAAAAKDARIGKVRIRLSTLETDRVYTHSYPLLVLHPNGVKKMGEIHLAVRFNCSSLLNMMHMYSQPLLPKMHYLHPLTVSQLDSLRHQATQIVSMRLSRAEPPLRKEVVEYMLDVGSHMWSMRRSKANFFRIMGVLSGLIAVGKWFDQICNWKNPITTVLIHILFIILVLYPELILPTIFLYLFLIGVWYYRWRPRHPPHMDTRLSHAENAHPDELDEEFDTFPTSRPSDIVRMRYDRLRSIAGRIQTVVGDLATQGERLQSLLSWRDPRATALFVIFCLLAAVILYVTPFQVVALLSGIYVLRHPRFRHRLPSVPLNFFRRLPARTDCML

SEQ ID NO: 8991 - protein, 774 aa, Vinca minor
MQRPPQDDFQLKETKPHLGGLKVTGDKLTSTYDLVEQMQYLYVRVVKARDLPGKDVTGSCDPYVEVRMGNYRGTTRHFEKKSNPEWSQVFAFSKDRIQASVLEVTVKDKDMVKDDFIGRVLFDLNEIPKRVPPDSPLAPQWYRLEDRKGDKVKGELMLAVWMGTQADEAFPEAWHSDAAAVSGHDSLANIRSKVYLSPKLWYLRVNVIEAQDLIPNDRSRFPEVFVKAILGNQALRTRVSMNKSINPMWNEDLMFVAAEPFEEPLILSVEDRVAPNKDEVLGRCAIPLHMVDRRLDHKPINTKWYNLEKHIIVEGEKKRDVKFASRIHMRICLEGGYHVLDESTHYSSDLRPTAKQLWKSSIGVLELGILNAQGLQPMKTKDGRATTDAYCVAKYGQKWIRTRTIIDSFAPKWNEQYTWEVFDPCTVITLGVFDNCHLHGGDKAVGSRDSRIGKVRIRLSTLETDRVYTHSYPLLVLHPSGVKKMGEIHLAVRFTCSSLLNMMHLYSHPLLPKMHYIHPLTVSQLDNLRHQATLIVSMRLSRAEPPLRKEIVEYMLDVGSHMWSMRRSKANFFRIMGVLSGLISVGKWFDQICNWKNPITTVLIHILFLILVLYPELILPTIFLYLFLIGVWYYRWRPRNPPHMDTRLSCADNAHPDELDEEFDTFPTSRPADIVRMRYDRLRSIAGRIQTVVGDLATQGERLQSLLSWRDPRATALFVIFCLVAAIVLYVTPFQVVALLAGFYVLRHPRFRHKLPSVPLNFFRRLPARTDCML

SEQ ID NO: 8992 - protein, 602 aa, Gossypium hirsutum
MPRPPPEDFALKETNPHLGGGKVSGDKLTSTYDLVEQMQYLYVRVVKAKDLPGKDVTGSCDPYVEVKLGNYLGKTRFFEKKSNPEWNQVFAFSKDRLQASLLEVTVKDKDFVKDDFIGKVFFDLNEIPKRVPPDSPLAPQWYRLEDRQGNKVKGELMLAVWMGTQADEAFPEAWHSDAAFVSGADGLANIRSKVYLSPKLWYLRVNVIEAQDLQPGDKGRYPEVFVKAILGNQALRTRISQARGINPMWNEDLMFVAAEPFEEPLILSVEDRVAPNKDEVLGKCAIPLQYVDRRLDHKPVNGRWFNLEKHVIIEGEKKKETKFASRIHMRICLEGGYHVLDESTHYSSDLRPTAKQLWKSSIGVLELGILNAHGLMPMKNKDGRGTTDAYCVAKYGQKWVRTRTIIDSFAPKWNEQYTWEVFDPCTVITIGVFDNCHLHGGDKAAGAKDTKIGKVRIRLSTLETDRVYTHSYPLLVLHPNGVKKMGEIHLAVRFSCSSLLNMMHMYSHPLLPKMHYLHPLTVSQLDSLRHQATQIVSMRLGRAEPPLRKEVVEYMLDVGSHMWSMRRSKANFFRIMNVLGGLIAVGKWFDQICNWKTQLQQY

SEQ ID NO: 8993 - protein, 774 aa, Phaseolus coccineus
MQRPPPEDFLLKETKPHLGGGKVSGDKLTSTYDLVEQMQYLYVRVVKAKELPAKDVTGSCDPYAEVKLGNYKGTTRHFEKKTNPEWNQVFAFSKDRLQASVLEVTVKDKDVVKDDFIGRVWFDLNEVPKRVPPDSPLAPQWYRLEDRKGDKVKGELMLAVWMGTQADEAFPEAWHSDAATVGGSDALANIRSKVYLSPKLWYLRVNVIEAQDLQPTDKGRYPEVFVKAILGNQALRTRISHSRSINPMWNEDLMFVAAEQFEEPLILSVEDRVAPNKDEVLGRCAIPLQYVERRLDHKPVNTRWFNLERHIVVEGEKKKDTKFSSRIHMRVCLEGGYHVLDESTHYSSDLRPTAKQLWKSGIGVLELGILNAHGLVPMKTKDGRGTTDAYCVAKYGQKWVRTRTIIDSFAPRWNEQYTWEVFDPCTVITIGVFDNCHLHGGDKAGGAKDSKIGKVRIRLSTLETDRVYTHSYPLLVLHPNGVKKMGEIHLAVRFTCSSLLNMMHMYSQPLLPKMHYIHPLTVSQLDSLRHQATQIVSMRLSRAEPPLRKEVVEYMLDVGSHMWSMRRSKANFFRIMGVLGGLIAVGKWFDQICNWRSPVTTILIHILFIILVMYPELILPTIFLYLFLIGIWYYRWRPRQPPHMDTRLSHADSAHPDELDEEFDTFPTSRPNDIVRMRYDRLRSIAGRIQTVVGDLATQGERLQSLLSWRDPRATSLFVLFCLIAAIVLYVTPFQVVALLAGIYVLRHPRFRHKLPSVPLNFFRRLPARTDCML

SEQ ID NO: 8994 - protein, 774 aa, Prunus mume
MQRPPPEDFALKETKPHLGGGRISGDKLTSTYDLVEQMQYLYVRVVKAKDLPAKDVTGSCDPYVEVRLGNYKGATRHFEKKSNPEWNQVFAFSKDRIQASVLEVIVKDKDVVKDDFMGRVSFDLNEIPKRVPPDSPLAPQWYRLEDRKGDKVRGELMLAVWMGTQADEAFPEAWHSDAATVSGADSLSNIRSKVYLSPKLWYLRVNVIEAQDLQPSDKGRYPEVYVKAILGNQALRTRISPSRSINPMWNEDLMFVASEPFEEPLILSVEDRVAPNKDEVLGRCAIPLQYVNRRYDHKPVNTSWHNLEKHVIVEGEKKKEIKFASRIHMRICLEGGYHVLDESTHYSSDLRPTAKPLWKSSIGVLEVGILNAQGLMPMKTKDGRGTTDAYCVAKYGQKWVRTRTIIDSFTPRWNEQYTWEVFDPCTVITIGVFDNCHLHGGDKAGGARDARIGKVRIRLSTLETDRVYTHSYPLLVLHPNGVKKMGEIHMAVRFTCSSLLNMMHMYSQPLLPKMHYIHPLTVSQLDSLRHQATQIVSMRLSRAEPPLRKEVVEYMLDVGSHMWSMRRSKANFFRIMNVLGGVIAVGKWFDQICTWKNPITTVLIHILFIILVMYPELILPTIFLYLFLIGVWYYRWRPRHPPHMDTRLSHADSAHPDELDEEFDTFPTSRPSDIVRMRYDRLRSIAGRIQTVVGDLATQGERLQSLLSWRDPRATSLFVLFCLIAAIVLYVTPFQVVALLAGFYVLRHPRFRHKLPSVPLNFFRRLPARTDCML

SEQ ID NO: 8995 - protein, 775 aa, Theobroma cacao
MHRPPPPDDFALKETNPHLGGGKVSGDKLTSTYDLVEQMQYLYVRVVKAKDLPGKDVTGSCDPYVEVKLGNYLGKTRVFEKKTNPEWNQVFAFSKDRLQASVLEVTVKDKDVVKDDFIGKVFFDLNEVPKRVPPDSPLAPQWYRLEDRQGNKAKGELMLAVWMGTQADEAFPEAWHSDAAVVSGADGLANIRSKVYLSPKLWYLRVNVIEAQDLLPGDKGRYPEVFVRAILGNQALRTRVSVARGINPMWNEDLMFVAAEPFEEPLILSVEDRVAPNKDEVLGKCAIPLQYVDRRLDHKPVNSRWFNLEKHVIVEGEKKKETKFSSRIHMRICLEGGYHVLDESTHYSSDLRPTAKQLWKSSIGVLELGILNAQGLMPMKTKDGRGTTDAYCVAKYGQKWVRTRTIIDSFAPKWNEQYTWEVFDPCTVITIGVFDNWHLHGGDKASGAKDSKIGKVRIRLSTLETDRVYTHSYPLLVLHSNGVKKMGEIHLAVRFTCSSLLNMMHMYSHPLLPKMHYLHPLTVSQLDSLRHQATQIVSMRLGRAEPPLRKEVVEYMLDVGSHMWSMRRSKANFFRIMNVLSGLIAVGKWFDQICNWKNPITTVLIHILFIILVLYPELILPTIFLYLFLIGVWYYRWRPRHPPHMDTRLSHADSSHPDELDEEFDTFPTSRPSDVVRMRYDRLRSIAGRIQTVVGDLATQGERLQSLLSWRDPRATALFVIFCLVAAIVLYVTPFQVVALLTGFYILRHPRFRHKLPSVPLNFFRRLPARTDSML

SEQ ID NO: 8996 - protein, 774 aa, Cucumis sativus
MQRPPPEDFLLKETNPHLGGGKVTGDKLTSTYDLVEQMQYLYVRVVKAKDLPGKDVTGSCDPYVEVKLGNYKGTTRHFEKKSNPEWSQVFAFSKDRIQSSVLEVTVKDKDFVKDDFMGRVLFDMNEIPKRVPPDSPLAPQWYRLEDKKGDKLKGELMLAVWMGTQADEAFPEAWHSDAATVSGTDGLANIRSKVYLSPKLWYLRVNVIEAQDLQPTDKGRYPEVFVKAVLGNQALRTRISQNRTINPLWNEDLMFVAAEPFEEPLILSVEDRVAPNKDETLGRCAIPLQYVDRRLDHKPVNSKWYNLEKHIILEGEKKKEIKFASRIHMRICLEGGYHVLDESTHYSSDLRPTAKVLWKQSIGVLELGILNAQGLMPMKTKDGRGTTDAYCVAKYGQKWVRTRTIIDSFTPKWNEQYTWEVFDPCTVVTIGVFDNCHLLGGDKGGGTKDSRIGKVRIRLSTLETDRVYTHSYPLLVLHPNGVKKMGEIHLAVRFTCSSLLNMMHMYTHPLLPKMHYIHPLTVSQLDSLRHQATQIVSMRLTRAEPPLRKEVVEYMLDVGSHMWSMRRSKANFFRIMGVLSGLIAVGKWFDQICNWKNPITTVLIHILFIILVMYPELILPTIFLYLFLIGVWYYRWRPRHPPHMDTRLSHADSAHPDELDEEFDTFPTSRGGDIVRMRYDRLRSIAGRIQTVVGDLATQGERLQSLLSWRDPRATALFVLFCLVAAIVLYVTPFQVVALLTGFYVLRHPRFRHKLPSVPLNFFRRLPARTDCML

SEQ ID NO: 8997 - protein, 774 aa, Gossypium raimondii
MPRPPPEDFALKETNPHLGGGKVSGDKLTSTYDLVEQMQYLYVRVVKAKDLPGKDVTGSCDPYVEVKLGNYLGKTRFFEKKSNPEWNQVFAFSKDRLQASLLEVTVKDKDFVKDDFIGKVFFDLNEIPKRVPPDSPLAPQWYRLEDRQGNKVKGELMLAVWMGTQADEAFPEAWHSDAAFVSGADGLANIRSKVYLSPKLWYLRVNVIEAQDLQPGDKGRYPEVFVKAILGNQALRTRISQARGINPMWNEDLMFVAAEPFEEPLILSVEDRVAPNKDEVLGKCAIPLQYVDRRLDHKAVNSRWFNLEKHVIIEGEKKKETKFASRIHMRICLEGGYHVLDESTHYSSDLRPTAKQLWKSSIGVLELGILNAHGLMPMKNKDGRGTTDAYCVAKYGQKWVRTRTIIDSFAPKWNEQYTWEVFDPCTVITIGVFDNCHLHGGDKAAGAKDTKIGKVRIRLSTLETDRVYTHSYPLLVLHPNGVKKMGEIHLAVRFSCSSLLNMMHMYSHPLLPKMHYLHPLTVSQLDSLRHQATQIVSMRLGRAEPPLRKEVVEYMLDVGSHMWSMRRSKANFFRIMNVLGGLIAVGKWFDQICNWKNPITTVLIHILFIILVLYPELILPTIFLYLFLIGVWYYRWRPRHPPHMDTRLSHADSAHPDELDEEFDTFPTSRPSDIVRMRYDRLRSIAGRIQTVVGDLATQGERLQSLLSWRDPRATALFVIFCLVAAIVLYVTPFQVVALLAGFYILRHPRFRHKLPSVPLNFFRRLPARTDSML

SEQ ID NO: 8998 - protein, 777 aa, Vitis vinifera
MHRPPPDDFSLKETSPHLGGGKVTGDKLTSTYDLVEQMQYLYVRVVKAKDLPSKDVTGSCDPYVEVKLGNYKGTTPHFEKKTNPEWNRVFAFSKDRMQASMLEVIVKDKDFVKDDYIGRVVFDLNEVPKRVPPDSPLAPQWYRLEDRKGDKVKGGELMLAVWMGTQADEAFPDAWHSDAAAVSGSDGLANMRSKVYLSPKLWYLRVNVIEAQDLQPTDRGRYPEVFVKAILGNQALRTRISQIKSINPMWNEDLMFVASEPFEEPLILSVEDRVGNNKDEVLGRCAIPLQYVDRRFDHKIMNSRWFNLEKHIVVDGEQKKKEIKFASRIHLRICLEGGYHVLDESTHYSSDLRPTEKRLWKSSIGVLELGILNAQGLLPMKTKDGRGTTDAYCVAKYGQKWVRTRTIIDSSTPKWNEQYTWEVYDPCTVITIGVFDNCHLHGGDKAGGATKDSRIGKVRIRLSTLETDRVYTHSYPLLVLHPTGVKKMGEIHLAVRFTCSSLLNMMHMYSQPLLPKMHYLHPLTVNQLDSLRHQATQIVSMRLSRAEPPLRKEVVEYMLDVGSHMWSMRRSKANFFRIMGVLGGLIAVGKWFDQICNWKNSITTVLIHILFFILVMYPELILPTIFLYLFLIGVWYFRWRPRHPPHMDTRLSHADSAHPDELDEEFDTFPTSRPSDVVRMRYDRLRSIAGRIQTVVGDLATQGERLQSLLSWRDPRATALFVLFCLVAAIVLYVTPFQVVALLTGFYVLRHPRFRHKLPSVPLNFFRRLPARTDCML

SEQ ID NO: 8999 - protein, 772 aa, Solanum lycopersicum
MQRPHQEDFSLKETKPHLGGGKITGDKLTSTYDLVEQMQYLYVRVVKAKDLPAKDVTGSLDPYVEVKLGNYKGTTRHFEKKSNPEWSQVFAFSKDRIQASVLEVIVKDKDFVKDDFVGRVLFDLNDIPKRVPPDSPLAPQWYRLEERNGTKVKGELMLAVWMGNQADEAFPEAWHSDAAAVSGADGLANIRSKVYLSPKLWYLRVNVIEAQDLIPNDKSRFPEVYVKAMLGNQALRTRVSMSKTINPLWNEDLMFVAAEPFEEPLILSVEDRVANKDEVLGRCAIPLQYVDRRLDHRPVNTRWFNLEKHVIVEGEKKEIKFASRIHMRVCLEGGYHVLDESTHYSSDLRPTAKQLWKSSIGVLEVGVLSAQGLSPMKTKDGRATTDAYCVAKYGQKWVRTRTIIDSFAPRWNEQYTWEVFDPCTVITIGVFDNCHLQGGDKSGGARDSRIGKVRIRLSTLETDRVYTHSYPLLVLHPTGVKKMGEIHLAVRFTCSSLVNMMHMYSQPLLPKMHYLHPLTVTQLDNLRHQATQIVSLRLSRAEPPLRKEIVEYMLDVTSHMWSMRRSKANFFRIMGVLGVVISVGKWFDQICNWKNPITTVLIHILFLILVLYPELILPTIFLYLFLIGIWYYRWRPRHPPHMDTRLSCADTAHPDELDEEFDTFPTSRSPDIIRMRYDRIRSIAGRIQTVVGDLATQGERLQSLLSWRDPRATALFVIFCLVAAVVLYVTPFQAVGLLTGFYVLRHPRFRYKLPSVPLNFFRRLPARTDCML

SEQ ID NO: 9000 - protein, 774 aa, Populus trichocarpa
MQKPPQDDFLLKETNPHLGGGKITGDKLTSTYDLVEQMQYLYVRVVKAKDLPAKDVTGSCDPYVEVKLGNYKGTTRHFEKKTNPEWNQVFAFSKERIQASMLEVTVKDKDLVKDDFIGRVLFDMNEIPKRVPPDSPLAPQWYRLEDRKGDKFKGELMLAVWMGTQADEAFPEAWHSDAATVSGTDSLANIRSKVYLSPKLWYLRVNVIEAQDLVPSDKGRYPEVYVKAILGNQVLRTRVSPSRSINPMWNEDLMFVASEPFEEALILSVEDRIAPNKDEVLGRCAIPMHHVDRRLDHNPVNTRWFNLEKHVIVEGEKKKEIKFASRIHMRICLEGGYHVLDESTHYSSDLRPTAKQLWKHSIGVLELGILNAQGLMPMKAKDGRGTTDAYCVAKYGQKWVRTRTIIDSFTPKWNEQYTWEVFDPCTVITIGVFDNCHLHGGDKPGGSRDSRIGKVRIRLSTLETDRVYTHSYPLLVLHRNGVKKMGEIHLAVRFTCSSLLNMMHMYSHPLLPKMHYIHPLTVSQLDSLRHQATVIVSLRLSRSEPPLRKEIVEYMLDVGSHMWSMRRSKANFFRIMNVFGGLIALGKWFDQICNWKNPITTVLIHILFIILVLYPELILPTIFLYLFLIGVWYYRRRPRHPPHMDTRLSHAESAHPDELDEEFDTFPTSQSADIVRMRYDRLRSIAGRIQTVVGDLATQGERLQSLLSWRDPRATALFVLFCLIAAIVLYITPFQVVAVLIGLYVLRHPRFRHKLPSVPLNFFRRLPARTDSML

SEQ ID NO: 9001 - protein, 773 aa, Arabidopsis thaliana
MQRPPPEDFSLKETRPHLGGGKLSGDKLTSTYDLVEQMQYLYVRVVKAKELPGKDMTGSCDPYVEVKLGNYKGTTRHFEKKSNPEWNQVFAFSKDRIQASFLEATVKDKDFVKDDLIGRVVFDLNEVPKRVPPDSPLAPQWYRLEDRKGDKVKGELMLAVWFGTQADEAFPEAWHSDAATVSGTDALANIRSKVYLSPKLWYLRVNVIEAQDLIPTDKQRYPEVYVKAIVGNQALRTRVSQSRTINPMWNEDLMFVAAEPFEEPLILSVEDRVAPNKDEVLGRCAIPLQYLDRRFDHKPVNSRWYNLEKHIMVDGEKKETKFASRIHMRICLEGGYHVLDESTHYSSDLRPTAKQLWKPNIGVLELGILNATGLMPMKTKDGRGTTDAYCVAKYGQKWIRTRTIIDSFTPRWNEQYTWEVFDPCTVVTVGVFDNCHLHGGEKIGGAKDSRIGKVRIRLSTLETDRVYTHSYPLLVLHPNGVKKMGEIHLAVRFTCSSLLNMMYMYSQPLLPKMHYIHPLTVSQLDNLRHQATQIVSMRLTRAEPPLRKEVVEYMLDVGSHMWSMRRSKANFFRIMGVLSGLIAVGKWFEQICNWKNPITTVLIHLLFIILVLYPELILPTIFLYLFLIGIWYYRWRPRHPPHMDTRLSHADSAHPDELDEEFDTFPTSRPSDIVRMRYDRLRSIAGRIQTVVGDLATQGERLQSLLSWRDPRATALFVLFCLIAAVILYVTPFQVVALCIGIYALRHPRFRYKLPSVPLNFFRRLPARTDCML

SEQ ID NO: 9002 - protein, 771 aa, Plantago ovata
MQRPPPEDFSLKETKPHLGGGKVTGDKLTSTYDLVEQMQYLYVRVVKAKDLPAKDVTGSCDPYVEVRLGNYKGTTRHFEKKSNPEWNQVFAFSKDRIQASVLEVTVKDKDFVKDDFIGRVLFDLNEVPKRVPPDSPLAPQWYRLDDRKNDKVKGELMLAVWMGTQADEAFPEAWHSDAATVAGGEGVASIRSKVYLSPKLWYLRVNVIEAQDLIPGDKSRFPEVYVKAILGNQALRTRVSMSKSINPMWNEDLMFVAAEPFEEPLILSVEDRVAPNKDEVLGRCAIPLQYVDRRLDHRPVHTRWHNLEKHVIVEGEKKKEMKFASKIHMRVCLEGGYHVLDESTHYSSDLRPTAKQLWKSSIGVLELGILNAHGLSPMKSKDGRATTDAYCVAKYGQKWVRTRTIIDSFTPKWNEQYTWEVFDPCTVVTIGVFDNCHLHGGDKARDSRIGKVRIRLSTLETDRVYTHSYPLLVLHPSGVKKMGEIHLAVRFTCSSLLNMMHMYSQPLLPKMHYIHPLTVSQLDSLRHQATQIVSMRLSRAEPPLRKEVVEYMLDVGSHMWSMRRSKANFFRIMNVFSGLIAVGKWFDQICNWKNPITTVLIHILFLILVLYPELILPTIFLYLFLIGVWYYRWRPRKPSHMDTRISCADNAHPDELDEEFDTFPTSRPPDIVRMRYDRLRSIAGRIQTVVGDLATQGERLQSLLSWRDPRATALFVIFCLLAAIILYVTPFQVVALLTGFYVLRHPRFRYKLPSVPLNFFRRLPARTDCML

SEQ ID NO: 9003 - protein, 774 aa, Citrullus lanatus
MQRPPPEDFLLKETNPHLGGGKVTGDKLTSTYDLVEQMQYLYVRVVKAKELPGKDVTGSCDPYVEVKLGNYKGTTRHFEKKSNPEWNQVFAFSKDRIQSSVLEVTVKDKDFVKDDFMGRVLFDMNEIPKRVPPDSPLAPQWYRLEDKKGEKLKGELMLAVWMGTQADEAFPEAWHSDAATVSGTDGLANIRSKVYLSPKLWYLRVNVIEAQDLQPTDKGQYPEVFVKAILGNQALRTRISQNRTINPLWNEDLMFVAAEPFEEPLILSVEDRVAPNKDETLGRCAIPLQYVDRRLDHKPVNSKWYNLEKHIVLEGEKKKEIKFASRIHMRICLEGGYHVLDESTHYSSDLRPTAKVLWKQSIGVLELGILNAQGLMPMKTKDGRGTTDAYCVAKYGQKWVRTRTIIDSFTPKWNEQYTWEVFDPCTVVTIGVFDNCHLLGGDKGGGTKDSRIGKVRIRLSTLETDRVYTHSYPLLVLHPNGVKKMGEIHLAVRFTCSSLLNMMHMYTHPLLPKMHYIHPLTVSQLDSLRHQATQIVSMRLSRAEPPLRKEVVEYMLDVGSHMWSMRRSKANFFRIMGVLSGLIAVGKWFDQICNWKNPITTVLIHVLFIILVMYPELILPTIFLYLFLIGVWYYRWRPRHPPHMDTRLSHADSAHPDELDEEFDTFPTSRPGDIVRMRYDRLRSIAGRIQTVVGDLATQGERLQSLLSWRDPRATALFVLFCLVAAIVLYVTPFQVVALLTGFYVLRHPRFRHKLPSVPLNFFRRLPARTDCML

SEQ ID NO: 9004 - protein, 773 aa, Arabidopsis lyrata
MQRPPPEDFSLKETRPHLGGGKISGDKLTSTYDLVEQMQYLYVRVVKAKELPGKDMTGSCDPYVEVKLGNYKGTTRHFEKKSNPEWNQVFAFSKDRIQASFLEATVKDKDVVKDDLIGRVVFDLNEVPKRVPPDSPLAPQWYRLEDRKGDKVKGELMLAVWFGTQADEAFPEAWHSDAATVSGTDALANIRSKVYLSPKLWYLRVNVIEAQDLIPSDKQRYPEVYVKAIVGNQALRTRVSQSRTINPMWNEDLMFVAAEPFEEPLILSVEDRVAPNKDEVLGRCAIPLQYLDRRFDHKPVNSRWYNLEKHIMVDGEKKETKFASRIHMRICLEGGYHVLDESTHYSSDLRPTAKQLWKPNIGVLELGILNATGLMPMKTKDGRGTTDAYCVAKYGQKWIRTRTIIDSFTPRWNEQYTWEVFDPCTVVTVGVFDNCHLHGGEKNGGAKDSRIGKVRIRLSTLETDRVYTHSYPLLVLHPNGVKKMGEIHLAVRFTCSSLLNMMYMYSLPLLPKMHYIHPLTVSQLDNLRHQATQIVSMRLTRAEPPLRKEVVEYMLDVGSHMWSMRRSKANFFRIMGVLSGLIAVGKWFEQICNWKNPITTVLIHLLFIILVLYPELILPTIFLYLFLIGVWYYRWRPRHPPHMDTRLSHADSAHPDELDEEFDTFPTSRPSDIVRMRYDRLRSIAGRIQTVVGDLATQGERLQSLLSWRDPRATALFVLFCLIAAVILYVTPFQVVALCIGIYVLRHPRFRYKLPSVPLNFFRRLPARTDCML

SEQ ID NO: 9005 - protein, 776 aa, Eucalyptus grandis
MHRPPHLEDFALKETKPHLGGGKVSGDKLTSTYDLVEQMQYLYVRVVKAKELPAKDVTGSLDPYVEVKLGNYKGTTRHFEKKSNPEWNQVFAFSKDRLQASMLEIIVKDKDLAKDDFVGRVVFDLNEVPKRVPPDSPLAPQWYRLEDRKGDKVRGEVMLAVWMGTQADEAFPEAWHSDAATVSGTDALANIRSKVYLSPKLWYLRVNVIEAQDLQPSDKGRYPEVYVKAKLGNQVLRTRVSQSRSINPLWNEDLMFVAAEPFEEPLILSVEDRVAPNKDEVLGHCGIPLQYVDRRLDHKPVNTRWHNLERYIIVEGEQKKKDTKFASRIHLRICLEGGYHVLDESTHYSSDLRPTAKQLWKSSIGILELGILSAQGLLPMKTKDGRGTTDAYCVAKYGQKWVRTRTIIDSFMPRWNEQYTWEVFDPCTVITIGVFDNCHLHGGDKNGPARDSKIGKVRIRLSTLETDRVYTHSYPLLVLHPNGVKKMGEIHLAVRFTCSSLLNMMHMYSHPLLPKMHYIHPLTVSQLDSLRHQATLIVSMRLSRAEPPLRKEVVEYMLDVGSHMWSMRRSKANFFRIMGVLSGLIAVGKWFDQICHWKNPITTVLIHILFIILVIYPELILPTIFLYLFMIGVWYYRWRPRHPPHMDTRLSHADSAHPDELDEEFDTFPTSRPTDIVRMRYDRLRSIAGRIQTVVGDLATQGERLQSLLSWRDPRATALFVIFCLVAAIVLYVTPFQVVALLTGFYVLRHPRFRHKLPSVPLNFFRRLPARTDCML

SEQ ID NO: 9006 - protein, 774 aa, Flaveria ramosissima
MHRPPPDDFSLKETKPHLGGGKITGDKLTSTYDLVEQMQYLYVRVVKARDLPSKDVTGSCDPYVEVRMGNYKGTTRHFEKKTNPEWNQVFAFSRDRIQSTMLEVSVKDKDMMKDDFMGWVLFDLTEVPKRVPPDSPLAPQWYRLEDRKGMKLKGEVMLAVWWGTQADEAFPEAWHSDAATVGGADALANIRSKVYLSPKLWYLRVNVIEAQDLIPSDRTRFPEVFVKAVLGHQALRTRVSMNKSINPMWNEDLMFVAAEPFEEHLVLSVEDRIAPNKDEVLGMCAIPLQYVDRRLDHKAINSRWFNLEKHVIVDGEKKKEVKFASRIHMRICLEGGYHVLDESTHYSSDLRPTAKQLWKSSIGVLEVGILSAHGLSPMKTKDGRATTDAYCVAKYGTKWVRTRTIIDSFMPKWNEQYTWEVFDPCTVITIGVFDNCHLQGGDKGNGARDSRIGKVRIRLSTLETDRVYTHAYPLLVLHPSGVKKMGEIQLAVRFTCSSLLNMMHMYSQPLLPKMHYIHPLTVSQLDSLRHQATQIVSMRLSRAEPPLRKEIVEYMLDVGSHMWSMRRSKANFFRIMGVFGGLIAVGKWFDQICNWKNPITTVLIHILFLILVLYPELILPTIFLYLFLIGVWYYRWRPKNPPHMDTRLSCADNAHPDELDEEFDTFPTSRPADIIRMRYDRLRSISGRIQTVVGDLATQGERLQSLLSWRDPRATALFVIFCLIAAIVLYVTPFQVVALLTGFYVLRHPRFRHKLPSVPLNFFRRLPARTDCML

SEQ ID NO: 9007 - protein, 774 aa, Populus trichocarpa
MQKPPQDDFLLKETNPHLGGGKITGDKLTSTYDLVEQMQYLYVRVVKAKDLPAKDVTGSCDPYVEVKLGNYKGTTRHFEKKTNPEWNQVFAFSKERIQASMLEVTVKDKDLVKDDFIGRVLFDMNEIPKRVPPDSPLAPQWYRLEDRKGDKFKGELMLAVWMGTQADEAFPEAWHSDAATVSGTDSLANIRSKVYLSPKLWYLRVNVIEAQDLVPSDQGRYPEVYVKAILGNQVLRTRVSPSRSINPMWNEDLMFVASEPFEEPLILSVEDRIAPNKDEVLGRCAIPMHHVDRRLDHNPVNTRWFNLEKHVIVEGEKKKEIKFASRIHMRICLEGGYHVLDESTHYSSDLRPTAKQLWKHSIGVLELGILNAQGLMPMKPKDGRGTTDAYCVAKYGQKWVRTRTIIDSFTPKWNEQYTWEVFDPCTVITIGVFDNCHLHGGDKPGGSRDSRIGKVRIRLSTLETDRVYTHSYPLLVLHRNGVKKMGEIHLAVRFTCSSLLNMMHMYSHPLLPKMHYIHPLTVSQLDSLRHQATVIVSVRLSRSEPPLRKEIVEYMLDVGSHMWSMRRSKANFFRIMNVFGGLIALGKWFDQICNWKNPITTVLIHILFIILVLYPELILPTIFLYLFLIGVWHYRRRSRHPPHMDTRLSHAESAHPDELDEEFDTFPTSQSADIVRMRYDRLRSIAGRIQTVVGDLATQGERLQSLLSWRDPRATALFVLFCLIAAIVLYITPFQVVAVLIGLYVLRHPRFRHKLPSVPLNFFRRLPARTDSML

SEQ ID NO: 9008 - protein, 773 aa, Solanum phureja
MQRPHQEDFSLKETKPHLGGGKITGDKLTSTYDLVEQMQYLYVRVVKAKDLPAKDVTGSLDPYVEVKLGNYKGTTRHFEKKSNPEWSQVFAFSKDRIQASVLEVTVKDKDFVKDDFVGRVLFDLNDIPKRVPPDSPLAPQWYRLEERNGNKVKGELMLAVWMGNQADEAFPEAWHSDAAAVSGADGLANIRSKVYLSPKLWYLRVNVIEAQDLIPNDKSRFPEVYVKAILGNQALRTRVSMSKTINPLWNEDLMFVAAEPFEEPLILSVEDRVAPNKDEVLGRCAIPLQYVDRRLDHRPVNTRWFNLEKHVIVEGEKKEIKFASRIHMRVCLEGGYHVLDESTHYSSDLRPTAKQLWKSSIGVLEVGVLSAQGLSPMKTKDGRATTDAYCVAKYGQKWVRTRTIIDSFAPRWNEQYTWEVFDPCTVITIGVFDNCHLQGGDKSGGARDSRIGKVRIRLSTLETDRVYTHSYPLLVLHPTGVKKMGEIHLAVRFTCSSLVNMMHMYSQPLLPKMHYLHPLTVTQLDNLRHQATQIVSLRLSRAEPPLRKEIVEYMLDVTSHMWSMRRSKANFFRIMGVLGVVISVGKWFDQICNWKNPITTVLIHILFLILVLYPELILPTIFLYLFLIGIWYYRWRPRHPPHMDTRLSCADTAHPDELDEEFDTFPTSRSPDIIRMRYDRIRSIAGRIQTVVGDLATQGERLQSLLSWRDPRATALFVIFCLAAAVVLYVTPFQAVGLLTGFYVLRHPRFRYKLPSVPLNFFRRLPARTDCML

SEQ ID NO: 9009 - protein, 774 aa, Tripterygium wilfordii
MQRPPPEDFLLKETKPHLGGGKVTGDKLTGTYDLVEQMQYLYVRVVKAKDLPAKDVTGSLDPYVEVKLGNYKGTTRHFEKKTNPEWNQVFAFSKDRMQASTLEVSVKDKDVVKDDFVGWVLFDLNEIPKRVPPDSPLAPQWYRLEDKKRDKGRGELMLAVWMGTQADEAFPEAWHSDAATVRGTDGLANMRSKVYLSPKLWYLRVNVIEAQDLMPSDKGRYPDVYVKAILGNQALRTKSSQSRSINPMWNEDLMFVAAEPFEEPLILSVEDRVAPNKDEVLGRCAIPLQYVDRRLDHKPVNTRWVNLEKHVVLEGEKKKEIKFASRIHLRICLEGGYHVLDESTHYSSDLRPTAKQLWKHSIGVLELGVLNAQGLMPMKKTDGRGTTDAYCVAKYGQKWVRTRTIIDSFTPKWNEQYTWEVFDPCTVITIGVFDNCHLQGGDKAGGPRDSRIGKVRIRLSTLETDRVYTHSYPLLVLHPNGVRKMGEIHLAVRFTCSSLLNMMHMYSMPLLPKMHYIHPLTVSQLDSLRHQATQIVSVRLSRAEPPLRREVVEYMLDVGSHMWSMRRSKANFFRIMNVLGGIIAVGKWFDQICNWKNPITTVLIHILFIILVLYPELILPTIFLYLFLIGVWYYRWRPRHPPHMDTRLSHAESAHPDELDEEFDTFPTSRPADIVRMRYDRLRSIAGRIQTVVGDLATQGERLQSLLSWRDPRATALFVIFCLIAAIVLYVTPFQVVALLAGFYVLRHPRFRHKLPSVPLNFFRRLPARTDCML

SEQ ID NO: 9010 - protein, 775 aa, Solanum lycopersicum
MQRPPQEDFSLKETKPHLGGGKVTGDKLTSTYDLVEQMQYLYVRVVKAKDLPGKDVTGSLDPYVEVRLGNYRGTTRHFEKKSNPEWNQVFAFSKERIQASVLEVNVKDKDFIKDDFVGRVMFDLNEIPKRVPPDSPLAPQWYRLEDRSGNKVKGELMLAVWMGTQADEAFPESWHSDAATVSGADALANIRSKVYLSPKLWYLRVNVIEAQDLIPSDRSRFPEVYVKAILGNQALRTRVSMSKTINPMWNEDLMFVAAEPFEEPLILSVEDRVTAANKDEVLGRCVIPLQYIDRRFDHRPINSRWYNLEKHIIVEGEKKKEIKFASRIHMRLYLEGGYHVLDESTHYSSDLRPTAKQLWKSSIGVLELGILNAQGLSPMKTKDNRATTDAYCVAKYGQKWVRTRTIIDSFAPKWNEQYTWEVFDPCTVITIGVFDNCHLHGGDKPGGSRDSRIGKVRIRLSTLETDRVYTHSYPLLVLHPTGVKKMGEIHLAVRFTCSSLMNMMHMYSQPLLPKMHYIHPLTVTQLDSLRHQATQIVSMRLSRAEPPLRKEIVEYMLDVGSHMWSMRRSKANFFRIMGVLGGLIAIGRWFDQICNWKNPITTVLIHILFLILVLYPELILPTIFLYLFLIGVWYYRWRPRHPPHMDTRLSCADNAHPDELDEEFDTFPTSRPPDIVRMRYDRLRSIAGRIQTVVGDLATQGERLQSLLSWRDPRATALFVIFCLIAAIVLYVTPFQVVALLSGFYVLRHPRFRHKLPSAPLNFFRRLPARTDCML

SEQ ID NO: 9011 - protein, 163 aa, Fagus grandifolia
MQRPPPQEEFLLKETNPHLGGGKVTGDKHTSTYDLVEQMQYLYVRVVKAKELPAKDVTGSCDPYVEVKLGNYKGATRHFEKKSNPEWNQVFAFSKDRLQASVLEVTVKDKDLVKDDFIGRVLFDLNEVPKRVPPDSPLAPQWYRLEDRKGDKHHNRGELMLAV

SEQ ID NO: 9012 - protein, 774 aa, Cajanus cajan
MQRPPPEDFLLKETKPHLGGGKVSGDKLTSTYDLVEQMQYLYVRVVKAKELPAKDVTGSCDPYVEVKLGNYKGTTRHFEKKTNPEWNQVFAFSKDRLQASVLEVTVKDKDVVKDDFIGRVWFDLNEIPKRVPPDSPLAPQWYRLEDRKGDKVKGELMLAVWMGTQADEAFPEAWHSDAATVGGSDALANIRSKVYLSPKLWYLRVNVIEAQDLQPTDKGRYPEVFVKAILGNQALRTRTSHSRSINPMWNEDLMFVAAEQFEEPLILSVEDRVAPNKDEVLGRCAIPLQLVERRLDYKPVNTRWFNLERHIVVEGEKKKDTKFASRIHLRVCLEGGYHVLDESTHYSSDLRPTAKQLWKSGIGILEVGILNAQGLMPMKTKDGRGTTDAYCVAKYGQKWVRTRTIIDSFAPRWNEQYTWEVFDPCTVITIGVFDNCHLHGGDKAGGAKDLKIGKVRIRLSTLETDRVYTHSYPLLVLYPNGVKKMGEIHLAVRFTCSSLLNMMHMYSQPLLPKMHYIHPLTVTQLDSLRHQATQIVSMRLSRAEPPLRKEVVEYMLDVGSHMWSMRRSKANFFRIMAVLSGLIAVGRWFDQICNWKSPITTILIHILFIILVMYPELILPTIFLYLFLIGIWYYRWRPRHPPHMDTRLSHADSAHPDELDEEFDTFPTSRPNDIVRMRYDRLRSIAGRIQTVVGDLATQGERLQSLLSWRDPRATSLFVIFCLVAAIVLYVTPFQVVALLSGIYVLRHPRFRHKLPSVPLNFFRRLPARTDCML

SEQ ID NO: 9013 - protein, 775 aa, Phaseolus coccineus
MQRPPPEDFLLKETKPHLGGGKVSGDKLTSTYDLVEQMQYLYVRVVKAKDLPAKDVTGSCDPYTEVKLGNYKGTTRHFEKKSNPEWNQVFAFSKDRIQASILEVTVKDKDVVRDDFIGRVLFDLNEVPKRVPPDSPLAPQWYRLEDRKGDKAKGELMLAVWMGTQADEAFPEAWHSDAATVSGTDALANIRSKVYLSPKLWYLRVNVIEAQDLQPSDKGRYPEVFVKATLGNQTLRTRISQSRTINPMWNEDMMFVAAEPFEEPLILSVEDRVASNKEESLGRCAIPLQMVDRRLDHKPVNTKWYNIEKHVVIMEGEKKKEIKFSSKIHMRICLEGGYHVLDESTHYSSDLRPTAKQLWKSSIGVLELGILNAQGLMPMKTKDGKGTTDAYCVAKYGQKWVRTRTIIDSFAPRWNEQYTWEVFDPCTVITIGVFDNCHLHGGDKPGGAKDSKIGKVRIRLSTLETDRVYTHSYPLLVLHPNGVKKMGEIHLAVRFTCSSLLNMMHMYSLPLLPKMHYIHPLTVSQLDNLRHQATQIVSMRLSRAEPPLRKEIVEYMLDVGSHMWSMRRSKANFFRIMGVLSGLIAVGKWFDQICNWKNPITTVLIHILFIILVMYPELILPTIFLYLFLIGVWYYRWRPRHPPHMDTRLSHADSAHPDELDEEFDTFPTTRHSDIVRMRYDRLRSIAGRIQTVVGDLATQGERLQSLLSWRDPRATALFVIFCLVAAIVLYVTPFQVVALLSGIYVLRHPRFRHKLPSVPLNFFRRLPARTDCML

SEQ ID NO: 9014 - protein, 773 aa, Nicotiana benthamiana
MQRPPQEDFSLKETKPHLGGGKVSGDKLTSTYDLVEQMLYLYVRVVKARDLPGKDVTGSLDPYVEVKLGNYKGTTRHFEKKSNPEWSQVFAFSKDRIQASVLEVTVKDKDVVKDDFVGRVLFDLNDIPKRVPPDSPLAPQWYRLEERNGSKVKGELMLAVWMGNQADEAFPEAWHSDAAAVSGADGLANIRSKVYLSPKLWYLRVNVIEAQDLIPSDKSRFPEVFVKAILGNQALRTRVSMSKTINPMWNEDLMFVAAEPFEEPLILSVEDRVAPNKDEVIGRCAIPLQYVDRRLDHKPVNTRWFNLEKHIIVEGEKKEIKFASRIHLRVCLEGGYHVLDESTHYSSDLRPTAKQLWKSNIGVLEVGVLSAQGLSPMKTKDGRATTDAYCVAKYGQKWVRTRTIIDSFAPKWNEQYTWEVFDPCTVITIGVFDNCHLQGGDKSGGARDSRIGKVRIRLSTLETDRVYTHSYPLLVLHPTGVKKMGEIHLAVRFTCSSLVNMMHMYSQPLLPKMHYLHPLTVSQLDNLRHQATQIVSLRLSRAEPPLRKEIVEYMLDVGSHMWSMRRSKANFFRIMGVLGVVISVGKWFDQICNWKNPITTVLIHILFLILILYPELILPTIFLYLFLIGIWYYRWRPRHPPHMDTRLSCADAAHPDELDEEFDTFPTSRPPDIIRMRYDRIRSIAGRIQTVVGDLATQGERLQSLLSWRDPRATALFVIFCLVAAIVLYVTPFQAVALLTGFYVLRHPRFRYKLPSVPLNFFRRLPARTDCML

SEQ ID NO: 9015 - protein, 775 aa, Cucumis sativus
MQKPPPEDFLLKETNPHLGGGKVAGDKLASTYDLVEQMYYLYVRVVKAKDLPGKDVTGSCDPYVEVKLGNYKGTTRHFEKKSNPEWNQVFAFSKDRIQASVLEVSVKDKDFVKDDFMGRVLFDLNEVPRRVPPDSPLAPQWYRLDDRKGDKVKGELMLAVWMGTQADEAFPEAWNSDAATVSGADGLANIRSKVYLSPKLWYLRVNIIEAQDLQPTDKGRYPEVFVKAILGNQALRTRISQSRTINPMWNEDLMFVAAEPFEEPLILSVEDRVAPNKDEVLGRCAIQLQYIDRRLDHRAVNTRWFNLEKHVVVVEGEKKKEIKFSSRIHMRICLEGGYHVLDESTHYSSDLRPTAKQLWKNSIGVLELGILNAQGLMPMKTKDGRGTTDAYCVAKYGQKWIRTRTIIDSFIPKWNEQYTWEVFDPCTVITIGVFDNCHLHGGEKAGVSKDARIGKVRIRLSTLETDRVYTHSYPLLVLHPNGVKKMGEIHLAVRFTCSSLLNMLHMYSHPLLPKMHYIHPLTVSQLDSLRHQATQIVSMRLSRAEPPLRKEVVEYMLDVGSHMWSMRRSKANFFRIMGVFSGLIAVGKWFDQICNWRNPITTVLIHILFIILVMYPELILPTIFLYLFLIGVWHYRWRPRHPPHMDTRLSHADSSHPDELDEEFDTFPTSRPADIVRMRYDRLRSIAGRIQTVVGDLATQGERLQSLLSWRDPRASALFVIFCLVSAIVLYVTPFQVVALLSGIYVLRHPRFRYKLPSVPLNFFRRLPARTDCML

SEQ ID NO: 9016 - protein, 775 aa, Cajanus cajan
MQRPPPEDFLLKETNPHLGGGKVSGDKLTSTYDLVEQMQYLYVRVVKAKDLPAKDVTGSCDPYVEVKLGNYKGTTRHFEKKTNPEWSQVFAFSKDRIQASMLEVTVKDKDVVKDDFIGRVWFDLNEIPKRVPPDSPLAPQWYRLEDRKGDKVKGELMLAVWMGTQADEAFPEAWHSDAATVSGTDALANIRSKVYLSPKLWYLRVNVIEAQDLQPTDKGRYPEVLVKASLGNQTMRTRISQSRTINPMWNEDLMFVAAEPFEEPLILSVEDRVAPNKEESLGRCAIPLQMVERRLDHKPVNTKWYNIEKHVVIMEGEKKKEFKFSSKIHMRICLEGGYHVLDESTHYSSDLRPTAKQLWKSGIGVLELGILSAQGLMPMKTGDDKGKTDAYCVAKYGQKWVRTRTIIDSFAPKWNEQYTWEVFDPCTVITIGVFDNCHLHGGDKAGGAKDSKIGKVRIRLSTLETDRVYTHYYPLLVLHPSGVKKMGEIHLAVRFTCSSLLNMMHMYSLPLLPKMHYIHPLTVSQLDNLRHQATQIVSMRLSRAEPPLRKEIVEYMLDVGSHMWSMRRSKANFFRIMGVLSGLISVGKWFDQICNWKNPITTVLIHILFIILVMYPELILPTIFLYLFLIGVWYYRWRPRHPPHMDTRLSHADSAHPDELDEEFDTFPTTRPSDIVRMRYDRLRSIAGRIQTVVGDLATQGERLQSLLSWRDPRATALFVIFCLVAAIVLYVTPFQVVALLTGIYVLRHPRFRHKLPSVPLNFFRRLPARTDCML

SEQ ID NO: 9017 - protein, 774 aa, Eutrema halophilum
MQRPPPEDFSLKETRPHLGGGKVSGDKLTSTYDLVEQMQYLYVRVVKAKELPGKDMTGSCDPYVEVKLGNYKGTTRHFEKKSNPEWNQVFAFSKDRIQASFLEVTVKDKDFVKDDLIGRVVFDLNEVPKRVPPDSPLAPQWYRLEDRKDNKVKGELMLAVWFGTQADEAFPEAWHSDAATVSGTDALANIRSKVYLSPKLWYLRVNVIEAQDLIPSDKGRYPEVYVKAIVGNQALRTRVSQSRTINPMWNEDLMFVAAEPFEEPLILSVEDRVAPNKDEVLGRCAIPLQYLDRRFDHRPVNSRWYNLEKHIMVDGEKKETKFASRIHMRICLEGGYHVLDESTHYSSDLRPTAKQLWKPNIGVLELGILNATGLMPMKAKEGRGTTDAYCVAKYGQKWIRTRTIIDSFTPRWNEQYTWEVFDPCTVLTVGVFDNCHLHGGGEKNGGAKDSRIGKVRIRLSTLETDRVYTHSYPLLVLHPNGVKKMGEIHLAVRFTCSSLLNMMYLYSVPLLPKMHYIHPLTVSQLDNLRHQATQIVSMRLTRAEPPLRKEVVEYMLDVGSHMWSMRRSKANFFRIMGVLSGLIAVGKWFEQICNWKNPITTVLIHLLFIILVLYPELILPTIFLYLFLIGVWYYRWRPRHPPHMDTRLSHADSAHPDELDEEFDTFPTSRPSDIVRMRYDRLRSIAGRIQTVVGDLATQGERLQSLLSWRDPRATAIFVLFCLIAAIVLYVTPFQVVALLIGIYVLRHPRFRYRLPSVPLNFFRRLPARTDCML

SEQ ID NO: 9018 - protein, 651 aa, Vaccinium corymbosum
MRSPKRVPPDSPLAPQWYRLEDRNTNKVKGELMLAVWMGTQADEAFPEAWHSDAAAVSGADGLANIRSKVYLSPKLWYLRVNVIEAQDLMPSDKTRFPEVFVRAILGNQVMRTRPSMSKTINPMWNEDLMFVAAEPFEEPLILSVEDRVAPNKEEVLGRCGIPLQYVERRLDHKPINARWLNLEKHIIVEGEKKKEIKFASRIHVRVCLEGGYHVLDESTHYSSDLRPTAKQLWKSSIGVLELGILNAHGLSPMKTKDGRATTDAYCVAKYGQKWVRTRTIIDSFAPKWNEQYTWEVFDPCTVITIGVFDNCHLHGGGDKAGGAKDSRIGKVRIRLSTLETDRVYTHSYPLLVLLPTGVKKMGEIHLAVRFTCSSLLNMMHMYSQPLLPKMHYIHPLTVTQLETLRHQATQIVSMRLTRAEPPLRKEVVEFMLDVGSHMWSMRRSKANFFRIMGVLSGLIAVGKWFDQICNWKNPITTVLIHILFLILVLYPELILPTIFLYLFLIGVWYYRWRPRHPPHMDTRLSCADNALPDELDEEFDTFPTSRQNDMVRMRYDRLRSIAGKIQTVVGDLATQGERLQSLLSWRDPRATALFVIFCLVAAIVLYVTPFQVVALLAGFYVLRHPRFRHRLPSVPLNFFRRLPARTDCML

SEQ ID NO: 9019 - protein, 774 aa, Fragaria vesca
MQRPPPEDFALKETKPHLGGGRISGDKHTSTYDLVEQMQYLYVRVVKAKDLPSKDVTGSCDPYVEVKLGNYKGATRHFEKKSNPEWNQVFAFSKDRIQASALEVIVKDKDLMKDDLIGYVIFDLNEVPKRVPPDSPLAPQWYRLEDRKGDKARGELMLAVWMGTQADEAFPEAWHSDAATVSGADSLSNIRSKVYLSPKLWYLRVNVIEAQDLMPSDKGRYPEVYVKAILGNQALRTRISQSRSINPMWNEDLMFVASEPFEEPLILSVEDRIAPNKDEVLGRCAIPLQYVPRRYDHKPVNTSWHNLEKHIIVEGEKKKDVKFASRIHMRICLEGGYHVLDESTHYSSDLRPTAKPLWKSSIGVLEVGILNAQGLMPMKTKDGRGTTDAYCVAKYGQKWVRTRTIIDSLAPRWNEQYTWEVFDPCTVITIGVFDNCHLHGGDKAAGAKDSRIGKVRIRLSTLETDRVYTHSYPLLVLHPNGVKKMGEIHMAVRFTCSSLLNMMHMYSQPLLPKMHYLHPLTVSQLDSLRHQATQIVSVRLSRAEPPLRKEVVEYMLDVGSHMWSMRRSKANFFRIMNVLGGLIAVGKWFDQICNWKNPITTVLIHILFIILVMYPELILPTIFLYLFLIGVWYYRWRPRHPPHMDTRLSHADSAHPDELDEEFDTFPTSRPSDIVRMRYDRLRSIAGRIQTVVGDLATQGERLQSLLSWRDPRATALFVLFCLIAAIVLYVTPFQIVALLAGFYVLRHPRFRHKLPSVPLNFFRRLPARTDCML

SEQ ID NO: 9020 - protein, 775 aa, Citrullus lanatus
MQKPPPEDFLLKETNPHLGGGKVTGDKLASTYDLVEQMYYLYVRVVKAKDLPGKDVTGSCDPYVEVKLGNYKGTTRHFEKKSNPEWNQVFAFSKDRIQASVLEVTVKDKDFVKDDFMGRVLFDLNEVPRRVPPDSPLAPQWYRLDDRKGDKVKGELMLAVWMGTQADEAFPEAWNSDAATVSGADGLANIRSKVYLSPKLWYLRVNIIEAQDLQPTDKGRYPEVFVKAILGNQALRTRISQSRTINPMWNEDLMFVAAEPFEEPLILSVEDRVAPNKDEVLGRCAIPLQYIDRRLDHRAVNTRWFNLEKHVVVVEGEKKKEIKFSSRIHMRICLEGGYHVLDESTHYSSDLRPTAKQLWKNSIGVLELGILNAQGLMPMKTKDGRGTTDAYCVAKYGQKWIRTRTIIDSFIPKWNEQYTWEVFDPCTVITIGVFDNCHLHSGEKAGGSKDARIGKVRIRLSTLETDRVYTHSYPLLVLHPNGVKKMGEIHLAVRFTCSSLLNMLHMYSHPLLPKMHYIHPLTVSQLDSLRHQATQIVSMRLSRAEPPLRKEVVEYMLDVGSHMWSMRRSKANFFRIMGVFSGLIAVGKWFDQICNWRNPITTVLIHILFIILVMYPELILPTIFLYLFLIGVWHYRWRPRHPPHMDTRLSHADSSHPDELDEEFDTFPTSRPADIVRMRYDRLRSIAGRIQTVVGDLATQGERLQSLLSWRDPRASALFVIFCLVSAIVLYVTPFQVVALLSGIYVLRHPRFRYKLPSVPLNFFRRLPARTDCML

SEQ ID NO: 9021 - protein, 775 aa, Beta vulgaris
MHKPPHEYFSLKETNPHLGGGKVTGDKLTSTYDLVEQMQYLYVRVVKAKDLPSMDVTGGCDPYVEVRLGNYKGTTRHFEKKSNPEWSQVFAFSKERIQASVLEVNVKDKDAIKDDFIGRVLFDLNEVPKRVPPDSPLAPQWYRLEDRKSDKARGELMLAVWWGTQADEAFPEAWHSDAATVSGTDALANIRSKVYLSPKLWYLRVNVIEAQDLVPSDKSRFPEVYVKAVLGSQALRTRVSQSRTINPMWNEDLMFVAAEPFEDALILSVEDRVGPNKDEVLGRCAIPLQYLDRRLDHKPINTRWFNLEKHVVIDGEKKKETKFSSRLHMRVCLEGGYHVLDESTHYSSDLRPTAKQLWKHSIGVLELGILTAQGLMPMKVKDSRQTTDAYCVAKYGQKWVRTRTIIDSFSPKWNEQYTWEVFDPCTVLTVGVFDNCHLHGGGDKGGAARDSRIGKVRIRLSTLETDRVYTHAYPLLVLHPSGVKKMGEIQLAVRFTCSSLLNMMHMYSHPLLPKMHYLHPLTVSQLDNLRHQATQIVSMRLSRAEPPLRKEVVEFMLDVSSHMWSMRRSKANFFRIMNVLGGIIAVGRWFDQICNWKNPITTVLIHILFFILVMYPELILPTIFLYLFLIGVWYYRWRPRHPPHMDTRLSHADSAHPDELDEEFDTFPTSKPADIVRMRYDRLRSIAGRIQTVVGDLATQGERLQSLLSWRDPRATALFVIFCLIAAIVLYVTPFQVVALLTGFYVLRHPRFRHKLPSVPLNFFRRLPARTDSML

SEQ ID NO: 9022 - protein, 772 aa, Mimulus guttatus
MQRPPHEDFSLKETKPHLGGGKITGDKLTSTYDLVEQMQYLYVRVVKAKDLPGKDVAGSCDPYVEVRLGNYKGTTRHFEKKSNPEWNQVFAFSKDRIQASVLEVNIKDKDFVKDDFIGRVVFDLNEVPKRVPPDSPLAPQWYRLEDRKNEKAKGELMLAVWMGTQADEAFPEAWHSDAAAVSGADGLSNIRSKVYLSPKLWYLRVNVIEAQDLQPSDKSRFPEVYVKAILGNQALRTRVSMNKSINPMWNEDLMFVAAEPFEEPLILSVEDRVAPNKDEVLGRCGVPLQYVDRRLDHKPVNTRWYNLEKHVMVEGEKKKEVKFASKIHMRICLEGGYHVLDESTHYSSDLRPTAKQLWKSSIGVLELGVLNAQGLSPMKTKDGRATTDAYCVAKYGQKWVRTRTIIDSFSPKWNEQYTWEVFDPCTVVTIGVFDNCHTQGGDKNGRDARIGKVRIRLSTLETDRVYTHSYPLLVLHPSGVKKMGEIHLAVRFTCSSLVNMMHMYSQPLLPKMHYIHPLTVSQLDSLRHQATQIVSLRLTRAEPPLRKEVVEFMLDVGSHMWSMRRSKANFFRIMGVLSGLIAVGKWFDQICNWKNPITTVLIHILFLILVMYPELILPTVFLYLFLIGVWYYRWRPRHPPHMDTRLSCADNAHPDELDEEFDTFPTSRPADIVRMRYDRLRSIAGRIQTVVGDLATQGERLQSLLSWRDPRATALFVIFCLIAAIVLYVTPFQVVALLTGFYVLRHPRFRYKLPSVPLNFFRRLPARTDCML

SEQ ID NO: 9023 - protein, 776 aa, Valeriana officinalis
MQRPPHEDFSLKETKPHLGGGKITGDKLTSTYDLVEQMQYLYVRVVKARDLPAKDVTGSCDPYVEVKLGNYKGTTRHFEKKSNPEWNQVFAFSKDRIQATVLEATVKDKDFVKDDFMGRVLFDLNEVPKRVPPDSPLAPQWYRIEDRKGDKVKGELMLAVWWGTQADEAFPEAWHSDAASVSGSDGLANIRSKVYLSPKLWYLRVNVIEAQDLQPGDKTRFPEVFVKAILGNQALRTRISMNKSINPMWNEDLMFVAAEPFEEHLMLSVEDRVAPNKDEVIGRCVIPLNYVDRRLDHKPINSRWYNLEKHVVIMEGDKKKEVKFASRIHMRICLEGGYHVLDESTHYSSDLRPTAKQLWKSSIGVLEVGILNAQGLSPMKTKDGRASTDAYCVAKYGQKWVRTRTIIDSFAPKWNEQYTWEVFDPCTVITVGVFDNCHLHGGGDKAGGSRDSRIGKVRIRLSTLETDRVYTHTYPLLVLHPSGVKKMGEIHLAVRFTCSSLLNMMHMYSMPLLPKMHYIHPLTVSQLDSLRHQATQIVSMRLSRAEPPLRKEIVEYMLDVGSHMWSMRRSKANFFRIMGVLGGIIAVGKWFDQICNWKNPITTVLIHILFLILVLYPELILPTIFLYLFLIGVWYYRWRPRHPPHMDTRLSCADNAFPDELDEEFDTFPTSRQADMVRMRYDRLRSIAGRIQTVVGDLATQGERLQSLLSWRDPRATALFVIFCLIAAIVLYVTPFQVVALLTGFYVLRHPRFRHKLPSVPLNFFRRLPARTDCML

SEQ ID NO: 9024 - protein, 773 aa, Silene vulgaris
MQKPPQEDFSLKETNPHLGGGKATGDKLTSTYDLVEQMQYLYVRVVKVKDLPSMDLTGSCDPYVEVKLGNYKGTTRHYEKRTSAEWNQVFAFSKDRIQASVLEVSVKDKDVVKDDFIGRVLFDLNEVPKRVPPDSPLAPQWYRLEDRKSDKARGELMLAVWWGTQADEAFPEAWHSDAAAVSGSDALASFRSKVYLSPKLWYLRVNVIEAQDLIPSDKGRFPEVYVKAILGSQALRTRVSQSRTINPMWNEDLMFVAAEPFEEPLILSVEDRVGPNKDEVLGRSLIPLQYVDRRLDHRPMNSKWYNLEKHVVVEGEKKKDNKFSSRIHMRICLEGGYHVLDESTHYSSDLRPTAKQLWKPSIGVLELGILTAQGLMPMKVKDNRQTTDAYCVAKYGQKWIRTRTIIDSFSPKWNEQYTWEVFDPCTVITVGVFDNCHLHGGDKGGNRDSRIGKVRIRLSSLETDRVYTHAYPLLVLHPTGVKKMGEIQLAVRFTCSSLLNMMHMYSHPLLPKMHYLHPLTVSQLDNLRHQATQIVSMRLSRAEPPLRKEVVEFMLDVGSHMWSMRRSKANFFRIMNVLGGIIAVGRWFDQICNWKNPITTVLIHILFFILVMYPELILPTIFLYLFLIGVWYYRWRPRHPPHMDTRISHADSAHPDELDEEFDTFPTSKPADIVRMRYDRLRSIAGRIQTVVGDLATQGERVQSLLSWRDPRATALFVIFCLIAAIVLYVTPFQVVALLTGFYVLRHPRFRHRLPSVPLNFFRRLPARTDSML

SEQ ID NO: 9025 - protein, 778 aa, Zostera marina
MHRPPIPRDDYALKKTTPHLGGGGLGGDKPSSTYDLVEQMQYLYVRVVKAKDLPAKDITGSCDPYVEVKLGNYKGTTRYFEKKTNPEWSQVFAFSKDRIQATVVEILVKDKDLLKDDFIGRVGFDLSEIPKRVPPDSPLAPQWYRLEDRKGDKQKGELMLAVWMGTQADEAFPEAWHSDAATIPSDGLTNIRSKVYLSPKLWYVRVNIIEAQDLQPSDKGRYPEVYVKVMLGNQALRTRISPSRNTNPMWNEDLMFVAAEPFEDPLILSVEDRVAPGKDDVLGKTVISLQNVDRRLDYRAVGSRWYTIERHVVVMEGEKKKELKFSSRIHLRICLDGGYHVLDESTHYSSDLRPTAKQLWKPSIGVLELGILTAQGLLPMKTKDGRGTADAYCVAKYGQKWVRTRTIIDSFTPKWNEQYTWEVYDPCTVVTVGVFDNCHLQGGGDKSVVVARDSRIGKVRIRLSTLETDKVYTHSYPLLVLHPSGVKKMGEVQLAIRFTCSSLLNMMQIYSQPLLPKMHYLHPLTVTQLDSLRHQATQIVSMRMNRAEPPLRKEVVEYMLDVDSHMWSMRRSKANFFRIMGLIGGMIAVSKWFSQICNWKNPLTTILIHVLYVILVLYPELILPTLFLYLFLIGIWYFRWRPRQPPHMDTRLSHAENVHPDELDEEFDTFPTSRPPEIVRDRYNRLRNVAGRIQTVVGDLATQGERFQSLLSWRDPRATSLFVTFCLVAAIVLYVTPFRVVALLLGLYTLRHPRFRMKLPSVPLNFFRRLPARTDSML

SEQ ID NO: 9026 - protein, 762 aa, Aquilegia formosa
MQRPHPPEDFSLKETSPHLGGGGISGDKLTSTYDLVEQMQYLYIRVVKAKDLPAKDVTGSCDPYVEVKLGNYKGTTRHFEKKTNPEWNQVFAFSKERIQSSFIEVVVKDKDLVKDDFIGRVMFDLNEIPKRVPPDSPLAPQWYRLEDRKGDKIKGELMLAVWMGTQADEAFPEAWHSDAAAVSSDGVSNIRSKVYLSPKLWYVRVNGRYPEVYVKAIHGNQALRTRISQSRSINPMWNEDLMFVAAEPFEEHLVLSVEDRVAPNKDEVLGRCVIPLQNMNRRLDHKAVNTRWFNLEKHIVVDGEKKKDTKFASRIHLRICLDGGYHVLDESTHYSSDLRPTAKQLWRSSIGVLELGVLSAQGLMPMKTKDGRGTTDAYCVAKYGQKWVRTRTIIDSFAPKWNEQYTWEVYDPCTVITIGVFDNCHLHGADKNGGSKDARIGKVRIRLSTLETDRVYTHSYPLLVLHSSGVKKMGEIQLAVRFTCSSLINMLHIYSHPLLPKMHYLHPLSVTQLDSLRHQATQIVSMRLSRAEPPLRKEVVEYMLDVDSHMWSMRRSKANFFRIMGVLSGMIAVCKWFDQICHWKNPLTTVLIHVLFLILVLYPELILPTIFLYLFLIGVWYYRWRPRHPPHMDTQLSHADKVHPDELDEEFDTFPTSRPSDIVRMRYDRLRSVAGRIQTVVGDLATQGERLQSLLSWRDPRATALFVIFCLITAIVLYVTPFQVVALLTGFYVLRHPRFRHKLPSVPLNFFRRLPARTDSML

SEQ ID NO: 9027 - protein, 772 aa, Amborella trichopoda
MQRPLQSEDYSLKETSPHLGGGGVHGDKLTSTYDLVEQMQYLYVRVVKAKDLPTDVTGSCDPYVEVKLGNYKGTTRHFEKKTNPEWNQVFAFSKERIQFSVIEVTVKDKDLVKDDFIGRVTFDLNEIPKRVPPDSPLAPQWYRLEDRKGDKAKGELMLAVWMGTQADEAFPEAWHSDAATIHGEGLSNIRSKVYLSPKLWYLRVNVIEAQDLVPSDKARFPEVHVKVMLGSQGMKTRVSQSRSLSPLWNEDLMFVAAEPFEEHLVISVEDRIGPNKDELMGKCVIPLQSVEKRFDHKPVNSRWYNLEKHAITEGEKKKEVKFASRIHLRICLDGGYHVLDESTHYSSDLRPTAKQLWKPSIGVLELGILNAQGLLPMKTKDGRNTTDAYCVAKYGSKWIRTRTIIDSFTPKWNEQYTWEVYDPCTVVTVGVFDNCHLAGDKANGTKDSRIGKVRIRLSTLETDRVYTHSYPLLVLHSSGVKKMGEVQLAVRFARSSLLNMLHIYSQPLLPKMHYLHPLSVTQLDSLRHQATQIVSMRLSRAEPSLRKEVVEYMLDYDSHMWSMRRSKANFFRIMSVMSGMIAVGKWLDKICNWKNPLTTILVHILFLILVLYPELILPTIFLYMFLIGIWHYRWRPRQPPYMDTRLSHAENVHPDELDEEFDTFPTSRHSDIVRMRYDRLRSVAGRIQTVVGDMATQGERLQSLLSWRDPRATALFVTFCFLAAIVLYVTPFRVVAILTAFYVLRHPRFRHKLPSVPLNFFRRLPAKTDSML

SEQ ID NO: 9028 - protein, 773 aa, Brassica rapa
MQRPPPEDFSLKETRPHLGGGKVTGDKLTSTYDLVEQMQYLYVRVVKAKELPGKDLTGSCDPYVEVKLGNYKGTTRHFEKKSNPEWNQVFAFSKDRIQASFLEAAVKDKDVVKDDLIGRVVFDLNEVPKRVPPDSPLAPQWYRLEDRKGEKVKGELMLAVWFGTQADEAFPEAWHSDAATVSGTDALANIRSKVYLSPKLWYLRVNVIEAQDLIPSDKGRYPEVYVKAIVGNQAQRTRVSQSRTINPMWNEDLMFVAAEPFEEPLILSVEDRVAPNKDEVLGRCAIPLQYLDRRFDHRPVNTKWYNLEKHIMVDGEKKEIKFASKIHMRICLEGGYHVLDESTHYSSDLRPTAKQLWKPNIGVLELGILNATGLMPMKAKDGRGTTDAYCVAKYGQKWIRTRTIIDSFTPRWNEQYTWEVFDPCTVVTVGVFDNCHLHGGEKNGGGKDSRVGKVRIRLSTLETDRVYTHSYPLLVLHPNGVKKMGEIHLAVRFTCSSLLNMMHMYSLPLLPKMHYIHPLTVSQLDNLRHQATQIVSMRLTRAEPPLRKEVVEYMLDVGSHMWSMRRSKANFFRIMGVLSGLIAVGKWFEQICNWKNPITTVLIHLLFIILVLYPELILPTIFLYLFLIGVWYYRWRPRHPPHMDTRLSHADSAHPDELDEEFDTFPTSRPSDIVRMRYDRLRSIAGRIQTVVGDLATQGERLQSLLSWRDPRATALFVLFCLIAAVVLYVTPFQVVALLVGIYVLRHPRFRYRLPSVPLNFFRRLPARTDCML

SEQ ID NO: 9029 - protein, 775 aa, Glycine max
MQRPPPEDFLLKETKPHLGGGKVSGDKLTSTYDLVEQMQYLYVRVVKAKDLPAKDVTGSCDPYTEVKLGNYKGTTRHFEKKSNPEWNQVFAFSKDRIQASILEVTVKDKDVVKDDFIGRVLFDLNEIPKRVPPDSPLAPQWYRLEDRKGDKAKGELMLAVWMGTQADEAFPEAWHSDAATVSGTDALANIRSKVYLSPKLWYLRVNIIEAQDLQPSDKGRYPEVFVKATLGNQTLRTRISQSRTINPMWNEDLMFVAAEPFEEPLILSVEDRVAPNKEESLGRCAIPLQMVDRRLDQKPVNTKWYNIEKHIVIMEGEKKKEIKFSSKIHMRICLEGGYHVLDESTHYSSDLRPTAKQLWKSSIGVLELGILSAHGLMPMKTKDGKGTTDAYCVAKYGQKWVRTRTIIDSFAPRWNEQYTWEVFDPCTVITIGVFDNCHLHGGDKPGGSKDSKIGKVRIRLSTLETDRVYTHSYPLLVLNPNGVKKMGEIHLAVRFTCSSLLNMMHMYSLPLLPKMHYIHPLTVSQLDNLRHQATQIVSMRLSRAEPPLRKEIVEYMLDVGSHMWSMRRSKANFFRIMGVLGGLIAVGKWFDQICNWKNPITTVLIHILFIILVMYPELILPTIFLYLFLIGVWYYRWRPRHPPHMDTRLSHADSAHPDELDEEFDTFPTTRASDIVRMRYDRLRSIAGRIQTVVGDLATQGERLQSLLSWRDPRATALFVIFCLVAAIVLYVTPFQIVALFTGIYVLRHPRFRHKLPSVPLNFFRRLPARTDCML

SEQ ID NO: 9030 - protein, 773 aa, Eutrema parvulum
MQRPPPEDFSLKETRPHLGGGKVTGDKLTSTYDLVEQMQYLYVRVVKAKELPGKDLTGSCDPYVEVKLGNYRGTTRHFEKKSNPEWNQVFAFSKDRIQASFLEATVKDKDVVKDDLIGRVVFDLNEVPKRVPPDSPLAPQWYRLEDRKGEKVRGELMLAVWFGTQADEAFPEAWHSDAATVSGTDALANIRSKVYLSPKLWYLRVNVIEAQDLIPSDKGRYPEVYVKAIVGNQALRTRVSQSRTINPMWNEDLMFVAAEPFEEPLILSVEDKVAPNKDEVLGRCAIPLQYLDRRFDHKPVNSRWHNLEKHIMVDGEKKETKFASKIHMRICLEGGYHVLDESTHYSSDLRPTAKQLWKPNIGVLELGILSANGLMPMKAKDGRGTTDAYCVAKYGQKWIRTRTIIDSFTPRWNEQYTWEVFDPCTVVTVGVFDNCHLHGGEKNGGAKDSRVGKVRIRLSTLETDRVYTHSYPLLVLHPNGVKKMGEIHLAVRFTCSSLLNMMYMYSLPLLPKMHYIHPLTVSQLDNLRHQATQIVSMRLTRAEPPLRKEVVEYMLDVGSHMWSMRRSKANFFRIMGVLSGLIAVGKWFEQICVWKNPITTILIHLLFIILVLYPELILPTIFLYLFLIGVWYYRWRPRHPPHMDTRLSHADSAHPDELDEEFDTFPTSRPSDIIRMRYDRLRSIAGRIQTVVGDLATQGERLQSLLSWRDPRATALFVLFCLIAAVVLYVTPFQVVALLVGIYVLRHPRFRYRLPSVPLNFFRRLPARTDCML

SEQ ID NO: 9031 - protein, 777 aa, Musa acuminata
MQRPFPLPQEDFSLKETAPRLGGGGLGGGDKLTNTYDLVEQMQYLYVRVVKAKDLPAKDVTGSCDPYVEVKLGNYKGTTRHFEKKTNPEWNQVFAFSKDRIQASVVEVVVKDKDFVKDDFMGMVLFDLNEIPKRVPPDSPLAPQWYRLEDRKGEKVKGELMLAVWMGTQADEAFPDAWHSDAATVPGDGLANIRSKVYLSPKLWYVRVNIIEAQDLLLNAKPGFPEVFVKATIGNQTLRTRISPSRCPNPLWNEDLMFVVAEPFEEHLILSVEERIGPNKDEVLGKAVIHLQKVERRFDCRIINSRWYHLEKHVAADGEQKKEVKFASRIHLRLCLDGGYHVLDESTHYSSDLRPTAKQLWKPSIGILELGILTAQGLLPMKTKDGRGTTDAYCVAKYGQKWVRTRTIIDSFSPKWNEQYTWEVYDPCTVITVGVFDNCHLQGGDKANGAKDNRIGKVRIRLSTLETDKVYTHSYPLLVLHTTGVKKMGEVHLAVRFSCSSLLNMLHTYSRPLLPKMHYLHPLTVTQLDYLRHQSTQIVSTRLGRAEPPLRKEVVEYMLDVGSHMWSMRRSKANFFRIINVLSGLIATGRWFGQICLWKNPITTVLIHVLYVILVLYPELILPTMFLYLFLIGVWYYRWRPRKPPHMDTRLSHADTAHPDELDEEFDTFPTSRPPEIVRMRYDRLRSVAGRVQTVVGDLATQGERFQSLLSWRDPRATALFLIFCLAAAIVLYVTPFQVVALLTGFYVLRHPRFRHRLPSVPLNFFRRLPARTDSML

SEQ ID NO: 9032 - protein, 775 aa, Medicago truncatula
MQRPPPEDFLLKETKPHLGGKVSGDKLTSTYDLVEQMQYLYVRVVKAKELPSKDVTGSCDPYVEVKLGNYKGTTRHFEKKTNPEWNQVFAFSKDRIQASVLEVFVKDKDFVKDDFIGRVWFDLNEIPKRVPPDSPLAPQWYRLEDRKSDKVKGELMLAVWMGTQADEAFPEAWHSDAATVSGTDALANIRSKVYLSPKLWYLRVNVIEAQDLQPSDKGRFPEVYVKAILGNQTLRTRISQSRSINPMWNEDLMFVAAEPFEEPLILSVEDRVAPNKEELLGKCVIPLQMMDRRLDHKPVNTRWFNIEKHVVIMEGDKKKEIKFASRIHMRVCLEGGYHVLDESTHYSSDLRPTAKQLWKSSIGVLEVGILNASGLMPMKSNNGRGTTDAYCVAKYGQKWVRTRTIIDSFAPRWNEQYTWEVFDPCTVITIGVFDNCHLHHGGDKPGGQRDSKIGKVRIRLSTLETDRVYTHSYPLLVLHPTGVKKMGEIQLAVRFTCSSLLNMMHMYSNPLLPKMHYIHPLTVSQLDSLRHQATQIVSMRLSRAEPPLRKEVVEYMLDVGSHMWSMRRSKANFFRIMGVLSGLIAVGKWFDQICNWKNPITTVLIHILFIILVMYPELILPTIFLYLFLIGVWYYRWRPRHPPHMDTRLSHADSAHPDELDEEFDTFPTTRPSDIVRMRYDRLRSIAGRIQTVVGDLATQGERLQSLLSWRDPRATALFVLFCLIAAIVLYVTPFQVVALLSGIYVLRHPRFRHKLPSVPLNFFRRLPARTDCML

SEQ ID NO: 9033 - protein, 775 aa, Glycine max
MQRPPPEDFLLKETKPHLGGGKVSGDKLTSTYDLVEQMQYLYVRVVKAKDLPAKDVTGSCDPYTEVKLGNYKGTTRHFDKKSNPEWNQVFAFSKDRIQASILEVTVKDKDVVKDDFIGRVLFDLNEIPKRVPPDSPLAPQWYRLEDRKGDKAKGELMLAVWMGTQADEAFPEAWHSDAATVSGTDALANIRSKVYLSPKLWYLRVNIIEAQDLQPSDKGRYPEVFVKAALGNQTLRTRISQSRTINPMWNEDLMFVAAEPFEEPLTLSVEDRVAPNKEESLGKCAIPLQMVDRRLDQKPVNTKWYNIEKYIVIMEGEKKKEIKFSSKIHMRICLEGGYHVLDESTHYSSDLRPTAKQLWKSSIGVLELGILNAQGLMPMKTKDGKGTTDAYCVAKYGQKWVRTRTIIDSFAPRWNEQYTWEVFDPCTVITIGVFDNCHLHGGDKPGGAKDSKIGKVRIRLSTLETDRVYTHSYPLLVLHPNGVKKMGEIHLAVRFTCSSLLNMMHMYSLPLLPKMHYIHPLTVSQLDNLRHQATQIVSMRLSRAEPPLRKEIVEYMLDVGSHMWSMRRSKANFFRIMGVLGGLIAVGKWFDQICNWKNPITTVLIHILFIILVMYPELILPTIFLYLFLIGVWYYRWRPRHPPHMDTRLSHADSAHPDELDEEFDTFPTTRPSDIVRMRYDRLRSIAGRIQTVVGDLATQGERLQSLLSWRDPRATALFVIFCLVAAIVLYVTPFQIVALFTGIYVLRHPRFRHKLPSVPLNFFRRLPARTDCML

SEQ ID NO: 9034 - protein, 776 aa, Cicer arietinum
MQRPPPEDFLLKETKPHLGGGKVSGDKLTSTYDLVEQMQYLYVRVVKAKELPSKDVTGSCDPYVEVKLGNYKGTTRHFEKKTNPEWSQVFAFSKDRIQASVLEVTVKDKDVVKDDFIGRVWFDLNEVPKRVPPDSPLAPQWYRLEDRKGDKAKGELMLAVWMGTQADEAFPEAWHSDAATVSGTDALANIRSKVYLSPKLWYLRVNVIEAQDLQPSDKGRFPEVYVKAILGIQTLRTRISQSRSINPMWNEDLMFVAAEPFEEPLILSVEDRVAPNKEELLGKCVIPLQIMDRRLDHKPVNTRWFNIEKHVVIMEGDKKKEIKFASRIHMRVCLEGGYHVLDESTHHSSDLRPTAKQLWKSSIGVLEVGILSAQGLMPMKTSNGRGTTDAYCVAKYGQKWVRTRTIIDSFAPRWNEQYTWEVFDPCTVITIGVFDNCHLHGGGDKPGGQKDSKIGKVRIRLSTLETDRVYTHSYPLLVLHPTGVKKMGEIQLAVRFTCSSLLNMMHMYSNPLLPKMHYIHPLTVSQLDNLRHQATQIVSMRLSRAEPPLRKEVVEYMLDVGSHMWSMRRSKANFFRIMGVLSGIVAVGKWFDQICHWKNPITTILIHILFVILVMYPELILPTIFLYLFLIGIWYYRWRPRHPPHMDTRLSHADSAHPDELDEEFDTFPTTRPSDIVRMRYDRLRSIAGRIQTVVGDLATQGERLQSLLSWRDPRATALFVLFCLIAAIVLYVTPFQVVALLTGIYVLRHPRFRHKLPSVPLNFFRRLPARTDCML

SEQ ID NO: 9035 - protein, 774 aa, Helianthus annuus
MHRPPPDDFSLKETKPHLGGGKITGDKLTSTYDLVEQMQYLYVRVVKARDLPAKDVTGSCDPYAEVRLGNYKGTTRHFEKKSNPEWNQVFAFSRDRIQSTMLEVAVKDKDLMKDDFMGWVLFDLSEVPKRVPPDSPLAPQWYRLEDRKGMKLKGEIMLAVWWGTQADEAFPEAWHSDAATVGGSDALANIRSKVYLSPKLWYLRVNVIEAQDLIPSDRTRFPEVFVKAQLGHQALRTRVSMGKSINPMWNEDLMFVAAEPFEEHLILSVEDRVAPNKDESLGMTMIPLQYVDRRLDHKPIHSKWVNLEKHIMIDGEKKKEVKFASRLHLRICLEGGYHVLDESTHYSSDLRPTAKQLWKNSIGVLEVGILSAHGLTPMKTKDGRATTDAYCVAKYGTKWVRTRTIIDSFTPKWNEQYTWEVFDPCTVITIGVFDNCHLQGGDKGNGARDSRIGKVRIRLSTLETDRVYTHSYPLLVLHPSGVKKMGEIHLAVRFTCSSLLNMMHMYSQPLLPKMHYIYPLTVSQLDSLRHQATQIVSMRLSRAEPPLRKEIVEYMLDVGSHMWSMRRSKANFFRIMGVFGGLIAVGKWFDQICNWKNPITTVLIHILFLILVLYPELILPTIFLYLFLIGVWYYRWRPKNPPHMDTRLSCADGAHPDELDEEFDTFPTSRPADIIRMRYDRLRSISGRIQTVVGDLATQGERLQSLLSWRDPRATALFVIFCLIAAIVLYVTPFQVVALLTGFYVLRHPRFRHKLPSVPLNFFRRLPARTDCML

SEQ ID NO: 9036 - protein, 772 aa, Papaver somniferum
MQRPNPDFSLKETAPHLGGGGLTGDKLTSTYDLVEQMQYLYVRVVKAKDLPGKDSTGCCDPYVEVKLGNYKGMTRHFEKRSNPEWNQVFAFSKDRIQSSVIEVLVKDKDLVKDDIIGRVMFDLNDVPKRVPPDSPLAPQWYRLEDRKSDKVRGELMLAVWMGTQADEAFPEAWHSDAATVGGEGVTNIRSKVYLSPKLWYLRVNVIEAQDLLVTDKTRFPEVYVKAVLGNQALRTKISQSRNINPMWNEDMMFVAAEPFEEHLVLSVEDRVAPNKDEVLGKCVIPLQNVARRLDHKPVLTKWFNLEKHILVDGEKKKDNKFASRLHLRICLDGGYHVLDESTHYSSDLRPTAKPLWKQSIGVLELGILTANGLLPMKTKDGRGTTDAYCVAKYGQKWIRTRTIIDCPTPKWNEQYTWEVFDPCTVITIGVFDNCHLQGGDKSVGAKDSRIGKVRIRLSTLETDRVYTHSYPLLVLQPSGLKKMGEIQLAVRFTCSSLLNMMHIYSQPLLPKMHYLHPLSVTQLENLRHQACQIVSIRLSRAEPPLRKEVVEYMLDVDSHMWSMRRSRANFFRIMGVLSSLVAVVKWFSQICNWKNPLTTVLIHILFIILVLYPELILPTIFLYLFLIGVWYFRWRPRNPSHMDTRLSHAENVHPDELDEEFDTFPTSRPSDMVRMRYDRLRSVAGRIQTVVGDLATQGERFQSLLSWRDPRASTLFITFCLIAAIVLYVTPFRVVALLTGFYVLRHPRFRHKLPSAPLNFFRRLPARTDSMI

SEQ ID NO: 9037 - protein, 778 aa, Brassica napus
MQRPPPEDFSLKETRPHLGGGKLTGDKLTSTYDLVEQMQYLYVRVVKAKELPGKDLTGSCDPYVEVKLGNYKGTTRHFEKKSNPEWNQVFAFSKDRIQASFLEATVKDKDVVKDDLIGRVVFDLNEVPKRVPPDSPLAPQWYRLEGTKGEKVRGELMLAVWFGTQADEAFPEAWHSDAATVSGTDALANIRSKVYLSPKLWYLRVNVIEAQDLIPSDKGRYPEVYVKAIVGNQALRTRVSQSRTINPMWNEDLMFVAAEPFEEPLILSVEDRVAPNKDEVLGRCAIPLQHLDRRFDHRPVNSRWFNLEKHIMVDGEKKEIKFASRIHMRICLEGGYHVLDESTHYSSDLRPTAKQLWKPSIGVLEVGILNATGLMPMKNKDGRGTTDAYCVAKYGQKWIRTRTIIDSFTPRWNEQYTWEVFDPCTVVTVGVFDNCHLHGGGEKNGGGGGGGKDSRIGKVRIRLSTLETDRVYTHSYPLLVLHPNGVKKMGEIHLAVRFTCSSLLNMMYMYSVPLLPKMHYIHPLTVSQLDNLRHQATQIVSMRLTRAEPPLRKEVVEYMLDVGSHMWSMRRSKANFFRIMGVLSGLIAVGKWFEQICNWKNPITTVLIHLLFIILVVYPELILPTIFLYLFLIGVWYYRWRPRHPPHMDTRLSHADSAHPDELDEEFDTFPTSRPSDIVRMRYDRLRSIAGRIQTVVGDLATQGERLQSLLSWRDPRATALFVLFCLIAAVVLYVTPFQVVALLVGIYVLRHPRFRYRLPSVPLNFFRRLPARTDCML

SEQ ID NO: 9038 - protein, 773 aa, Solanum phureja
MQRPPQEDFLLKETKPHLGGGKVTGDKLTSTYDLVEQMQYLYVRVVKAKDLPGKDVTGSLDPYVEVRLGNYKGTTRHFEKKSNPEWSQVFAFSKDRIQASVLEVNVKDKDFIKDDFVGCVMFDLNDIPKRVPPDSPLAPQWYRLEDRHGNKVKGELMLAVWMGTQADEAFPESWHSDSAAVTGADALATIRSKVYLSPKLWYLRVNVIEAQDLIPGDRSRFPEVYVKAILGNQALRTRVSMSKTINPMWNEDLMFVAAEPFEEPLILSVEDRVAPNKDEVLGRCAIPLQYIDRRLDHRPINSKWYNLEKHIIVEGEKKEIKFASRIHMRLYLEGGYHVLDESTHYSSDLRPTAKQLWKSSIGVLELGILNAHGISPMKTKDGRATTDAYCVAKYGQKWVRTRTIIDSFAPKWNEQYTWEVFDPCTVINIGVFDNCHLQGGDKSGGAKDSRIGKVRIRLSTLETGCVYTHSYPLLVLHPTGVKKMGEIHLAVRFTCSSLLNMMHMYSQPLLPKMHYIYPLTVSQLDNLRHQATQIVSMRLSRAEPPLRKEIVEYMLDVGSHMWSMRRSKANIFRIMGVLGGLIAIGKWFDQICNWKNPITTVLIHILFLILVLYPELILPTIFLYLFLIGVWYYRWRPRHPPHMDTRLSCADNAHPDELDEEFDTFPTSRPPDIVRMRYDRMRSIAGRIQTVVGDLATQGERLQSLLSWRDPRATALFVIFCLIAAIALYVTPFQVVALVTGFYVLRHPRFRHKLPSTPVNFFRRLPARTDCML

SEQ ID NO: 9039 - protein, 774 aa, Solanum lycopersicum
MQRPPQEDFLLKETKPHLGGGKVMGDKLTSTYDLVEQMQYLYVRVVKAKDLPGKDVTGSLDPYVEVRLGNYRGTTRHFEKKSNPEWSQVFAFSKDRIQASVLEVNVKDKDFIKDDFVGRVMFDLNEIPKRVPPDSPLAPQWYRLEDRHGNKVKGELMLAVWMGTQADEAFPESWHSDSAAVTGADALATIRSKVYLSPKLWYLRVNVIEAQDLIPGDRSRFPEVYVKAILGNQALRTRVSMSKTINPMWNEDLMFVAAEPFEEPLILSVEDRIAPNNDVVLGRCAIPLQYIERRLDHRPVTSKWYNLEKHIIIEGEKKKEIKFASRIHMRLYLEGGYHVLDESTHYSSDLRPTAKQLWKSSIGVLELGILNAHGISPMKTKDGRATTDAYCVAKYGQKWVRTRTIIDSFAPKWNEQYTWEVFDPCTVITIGVFDNCHLQVGDKSGGAKDSRIGKVRVRLSTLETGRVYTHSYPLLVLHPTGVKKMGEIHLAVRFTCSSLLNMMHMYSQPLLPKMHYIYPLTVSQLDNLRHQATQIVSLRLSRAEPPLRKEIVEYMLDVGSHMWSMRRSKANVFRIMGVLGGLIAIGKWFDQICNWKNPITTVLIHILFLILVLYPELILPTIFLYLFLIGVWYYRWRPRHPPHMDTRLSCADNAHPDELDEEFDTFPTSRPPDIVRMRYDRLRSIAGRIQTVVGDLATQGERLQSLLSWRDPRATALFVIFCLIAAIALYVTPFQVVALVNGFYVLRHPRFRHKLPSTPVNFFRRLPARTDCML

SEQ ID NO: 9040 - protein, 777 aa, Lactuca sativa
MHRPPPHDDFSLKETKPHLGGGKVTGDKLTSTYDLVEQMQYLYVRVVKARDLPAKDVTGSCDPYAEVRLGNYKGTTRHFEKKSNPEWNQVFAFSRERIQATMLEVTVKDKDFVKDDFMGWVLFDLTEVPKRVPPDSPLAPQWYRLEDRKSNKLKGELMLAVWWGTQADEAFPEAWHSDAASVGGADALANIRSKVYLSPKLWYLRVNVIEAQDLIPSDRTRFPEVFVKAALGHQVLRTRISMSKSINPMWNEDLMFVAAEPFEEHLVLSVEDRLAPNKDEILGMCAIPLQYVDRRLDHKAINTRWFNLEKHVIIDGEKKKEVKFASRLHMRICLEGGYHVLDESTHYSSDLRPTAKQLWKNSIGVLEVGVLSAQGLSPMKTKDGRATTDAYCVAKYGTKWVRTRTIIDSFTPKWNEQYTWEVFDPCTVITIGVFDNCHLQGGDKGGGGGARDSRIGKVRIRLSTLETDRVYTHSYPLLVLHPSGVKKMGEIHLAVRFTCSSLLNMMHMYSQPLLPKMHYIHPLTVSQLDSLRHQATQIVSMRLSRAEPPLRKEVVEYMLDVGSHMWSMRRSKANFFRIMGVLGGLIAVGKWFDQICNWKNPITTVLIHILFLILVLYPELILPTIFLYLFLIGVWYYRWRPKNPPHMDTRLSCADNAHPDELDEEFDTFPTSRPADIIRMRYDRLRSISGRIQTVVGDLATQGERLQSLLSWRDPRATALFVIFCLIAAIVLYVTPFQVVALLTGFYVLRHPRFRQKLPSVPLNFFRRLPARTDCML

SEQ ID NO: 9041 - protein, 777 aa, Brassica rapa
MQRPPPEDFSLKETRPHLGGGKLTGDKLTSTYDLVEQMQYLYVRVVKAKELPGKDLTGSCDPYVEVKLGNYKGTTRHFEKKSNPEWNQVFAFSKDRIQASFLEATVKDKDVVKDDLIGRVVFDLNEVPKRVPPDSPLAPQWYRLEGTKGEKVRGELMLAVWFGTQADEAFPEAWHSDAATVSGTDALANIRSKVYLSPKLWYLRVNVIEAQDLIPSDKGRYPEVYVKAIVGNQALRTRVSQSRTINPMWNEDLMFVAAEPFEEPLILSVEDRVAPNKDEVLGRCAIPLQHLDRRFDHRPVNSRWFNLEKHIMVDGEKKEIKFASRIHMRICLEGGYHVLDESTHYSSDLRPTAKQLWKPNIGVLEVGILNATGLMPMKNKDGRGTTDAYCVAKYGQKWIRTRTIIDSFTPRWNEQYTWEVFDPCTVVTVGVFDNCHLHGGGEKNGGGGGGKDSRIGKVRIRLSTLETDRVYTHSYPLLVLHPNGVKKMGEIHLAVRFTCSSLLNMMYMYSVPLLPKMHYIHPLTVSQLDNLRHQATQIVSMRLTRAEPPLRKEVVEYMLDVGSHMWSMRRSKANFFRIMGVLSGLIAVGKWFEQICNWKNPITTVLIHLLFIILVVYPELILPTIFLYLFLIGVWYYRWRPRHPPHMDTRLSHADSAHPDELDEEFDTFPTSRPSDIVRMRYDRLRSIAGRIQTVVGDLATQGERLQSLLSWRDPRATALFVLFCLIAAVVLYVTPFQVVALLVGIYVLRHPRFRYRLPSVPLNFFRRLPARTDCML

SEQ ID NO: 9042 - protein, 759 aa, Amorphophallus konjac
KETSPHLGGIAGDKVTSTYDLVEQMQYLYVRVVKAKDLPPKDVTGSCDPYVEVKLGNYKGATRHFEKKSNPEWNQVFAFSKERIQASYVEIVVKDKDFVKDDFMGRLTFDLHEIPKRVPPDSPLAPQWYRLEDRKGEKVKGEIMLAVWMGTQADEAFPEAWHSDAATVPGDGLTNIRSKVYLSPKLWYVRVNVIEAQDLQLSDKGRFPEVFVKVILGNQALRTRVSQSRSVNPMWNEDLMFVAAEPFEEHLILTVEDRVGPNKDEVLGKAVIPLQQVDRRLDYRPVHSKWYTIEKHVTIMEGEKKKEMKFSSRVHLRICLDGGYHVLDESTHYSSDLRPTAKQLWKPSIGVLELGILSAQGLLPMKTKDGKGTTDAYCIAKYGQKWVRTRTIIDSFAPKWNEQYHWEVFDPCTVITVGVFDNCHLQGGEKASKDSRIGKVRIRLSTLETDRVYTHSYPLLVLHPSGVKKMGEVQLAIRFACSSLLNMMHIYSQPLLPKMHYLHPLSVAQLDSLRHQATLTVSMRLSRAEPPLRKEVVEYMLDVDSHMWSMRRSKANFFRIMSVFSGLIAVGKWLDQICNWKNPLTTVLIHILFIILVLYPELILPTVFLYLFLIGIWYFRWRPRHPPHMDTKLSHAENVHPDELDEEFDTFPTSRPPDFVRMRYDRLRSIAGRIQTVVGDLATQGERLQSLLSWRDPRATALFVTFCFLAAIVIYVTPFRIVALVTGLYTLRHPRFRHKLPSAPLNYFRRLPARTDSML

SEQ ID NO: 9043 - protein, 774 aa, Cicer arietinum
MQRPPPDDFLLKETKPHLGGGKISGDKLTSTYDLVEQMQYLYVRVVKAKELPSKDVTGSCDPYAEVKLGNYKGTTRHFEKKTNPEWNQVFAFSKDRLQASVLEVTVKDKDMVKDDFIGRVWFDLNEVPKRVPPDSPLAPQWYRLEDRKGDKAKGELMLAVWMGTQADEAFPEAWHSDAASVSGADAVANIRSKVYLSPKLWYLRVNVIEAQDLQPTDKGRYPEVFVKAILGNQALRTRISQSRSINPLWNEDLMFVAAEPFEEPLILSVEDRVAPNKDEVLGRCAIPLQFVDRRLDHKPVNTRWFNLEKHIVVEGEKKKEIKFASRIHMRVCLEGGYHVLDESTHYSSDLRPTAKQLWKSGIGVLEVGILNAHGLMPMKNINGRGTTDAYCVAKYGQKWVRTRTIIDSFMPRWNEQYTWEVFDPCTVITIGVFDNCHLHSPDKTGGAKDARIGKVRIRLSTLETDRVYTHSYPLLVLHNSGVKKTGEIQLAVRFTCSSLLNMMHMYSQPLLPKMHYIHPLTVSQLDSLRHQATQIVSMRLSRAEPPLRKEVVEYMLDVGSHMWSMRRSKANFFRIMGVLSALIAVGKWFDSICNWKNPITTVLIHFLFVILVMYPELILPTVFLYLFLIGIWHYRWRPRHPPHMDTRLSHADSSHPDELDEEFDTFPTSRPSDIVRMRYDRLRSIAGRIQTVVGDLATQGERLQSLLSWRDPRATALFVIFCLVVATVLYVTPFQMVAILTGIYVLRHPRFRHKLPSVPLNFFRRLPARTDCML

SEQ ID NO: 9044 - protein, 771 aa, Tropaeolum majus
MMKPPQNVEFALKETNPRIGAGAISGDKLSSTYDLVEQMQYLYVRVVKAKDLPAKDVTGSCDPYVEVKLGNYKGTTKHFEKKSNPEWNQIFAFSKERIQASVLEATIKDKDVVVDDFIGRILFDLNEIPKRVPPDSPLAPQWYRLEDRHGNKAKGELMLAVWMGTQADEAFSEAWHSDAATVGSDGVANIRSKVYLSSKLWYVRVNVIEAQDLIPTDKTRFPDVYVKVVLGNQALRTRTSQSRTINPMWNEDLMFVAAEPFEEPLVLSVEDRVAPNKDEVLGRCVIPLQHLQRRLDHKPVNTRWFNLEKHIIVDGEKKETKFASRIHLRICLDGGYHVLDESTHYSSDLRPTAKQLWKPPIGILEVGVLSAQGLMPMKTRDGRGTTDAYCVAKYGQKWVRTRTIVDSFMPKWNEQYTWEVFDPCTVITIGVFDNGHIHGGNAGPKDARIGKVRIRLSTLETDRVYTHSYPLLVLHPSGVKKMGEIHLAVRFTCSSLINMLHMYSHPLLPKMHYIHPLSVVQLDSLRHQAMQIVSMRLSRAEPPLRKEVVEYMLDVDSHMWSMRRSKANFFRIMGVLSGLIAVGKWFDQICNWRNPITTVLIHILFIILVLYPELILPTVFLYLFLIGIWNYRWRPRHPPHMDTRLSHADAVHPDELDEEFDTFPTSRPADIVRMRYDRLRSIAGRVQTVIGDLATQGERFQSLLSWRDPRATTLFVTFCLIAAVVLYVTPFQVVALLTGFYMLRHPRFRHKLPSVPLNFFRRLPARSDSML

SEQ ID NO: 9045 - protein, 759 aa, Orobanche aegyptiaca
TNPHLGGGKITGDKLTSTYDLVEQMQYLYVRVVKAKDLPGKDVTGSCDPYVEVRLGNYKGTTRHFEKKSNPEWNQVFAFSKDRIQASVLEVNVKDKDFVKDDFMGRVIFDLNEIPKRVPPDSPLAPQWYRLEDRKNEKAKGELMLAVWMGTQADEAFPEAWHSDAATVSGADGLANIRSKVYLSPKLWYLRVNVIEAQDLQPSDKSRFPEVYVKAILGNQALRTRVSMNKSINPMWNEDLMFVAAEPFEEPLILSVEDRVAPNKDEVLGRCAIPLQYVDRRLDHKPVNTRWHNLEKHVMIEGEKKKEVKFASKIHMRICLEGGYHVLDESTHYSSDLRPTAKQLWKSSIGVLELGILNAQGLSPMKTKDGRATTDAYCVAKYGQKWVRTRTLIDSFSPKWNEQYTWEVFDPCTVVTIGVFDNCHLQSGDKSGRDSRIGKVRIRLSTLETDRVYTHSYPLLVLHPSGVKKMGEIHLAVRFTCSSLVNMMHMYSQPLLPKMHYIHPLTVSQLDSLRHQATQIVSMRLSRAEPPLRKEVVEYMLDVGSHMWSMRRSKANFFRIMGVLSGLIAIGKWFDQICNWKNPITTVLIHILFLILVMYPELILPTIFLYLFLIGVWYYRWRPRHPPHMDTRLSCADNAHPDELDEEFDTFPTSRPADIVRMRYDRLRSIAGRIQTVVGDLATQGERLQSLLSWRDPRATALFVIFCLIAAVVLYVTPFQVVALVSGFYVLRHPRFRYKLPSVPLNFFRRLPARTDCML

SEQ ID NO: 9046 - protein, 792 aa, Nicotiana benthamiana
MQRPPQEDFSLKETKPHLGGGKVTGDKLTSTYDLVEQMQYLFVRVVKAKDLPGKDLTGSLDPYVEVRLGNYRGTTRHFEKKSNPEWSQVFAFSKDRIQASVLEVTVKDKDLVKDDFVGRVMFDLNEIPKRVPPDSPLAPQWYRLEDRNGNKVKGELMLAVWMGTQADEAFPESWHSDAATVSGADALANIRSKVYLSPKLWYLRVNVIEAQDLIPGDRSRFPEVYVKAILGNQALRTRVSMSKTINPMWNEDLMFVAAEPFEEPLILSVEDRVAPNKDEVLGRCGIPLQYIDRRLDHRPINSKWYNLEKHIMVEGEKKKEIKFASRLHMRLYLEGGYHVLDESTHYSSDLRPTAKQLWKSSIGVLELGILNAQGLSPMKSKDGRATILNAQGLSPMKTKDGRATTDAYCVAKYGQKWVRTRTIIDSFAPKWNEQYTWEVFDPCTVITIGVFDNCHLHGGDKSGGARDSRIGKVRIRLSTLETDRVYTHSYPLLVLHPTGVKKMGEIHLAVRFTCSSLMNMMHMYSQPLLPKMHYIHPLTVSQLDSLRHQATQIVSMRLTRAEPPLRKEIVEYMLDVGSHMWSMRRSKANFFRIMGVLGGLIAIGRWFDQICHWKNPITTVLIHILFLILVLYPELILPTIFLYLFLIGVWYYRWRPRNPPHMDTRLSCADNVHPDELDEEFDTFPTSRPPDIVRMRYDRLRSIAGRIQTVVGDLATQGERLQSLLSWRDPRATALFVIFCLIAAIVLYVTPFQVVALLTGFYVLRHPRFRHKLPSAPLNFFRRLPARTDCML

SEQ ID NO: 9047 - protein, 756 aa, Prunus persica
MQRPPPEDFALKETKPHLGGGRISGDKLTSTYDLVEQMQYLYVRVVKAKDLPAKDVTGSCDPYVEVRLGNYKGATRHFEKKSNPEWNQVFAFSKDRIQASVLEVIVKDKDVVKDDFMGRVSFDLNEIPKRVPPDSPLAPQWYRLEDRKGDKVRGELMLAVWMGTQADEAFPEAWHSDAATVSGADSLSNIRSKDLQPSDKGRYPEVFVKAILGNQALRTRISPSRSINPMWNEDLMFVASEPFEEPLILSVEDRVAPNKDEVLGRCAIPLQYVTRRYDHKPVNTSWHNLEKHVIVEGEKKKEIKFASRIHMRICLEGGYHVLDESTHYSSDLRPTAKPLWKSSIGVLEVGILNAQGLMPMKTKDGRGTTDAYCVAKYGQKWVRTRTIIDSFTPRWNEQYTWEVFDPCTVITIGVFDNCHLHGGDKAGGARDARIGKVRIRLSTLETDRVYTHSYPLLVLHPNGVKKMGEIHMAVRFTCSSLLNMMHMYSQPLLPKMHYIHPLTVSQLDSLRHQATQIVSMRLSRAEPPLRKEVVEYMLDVGSHMWSMRRSKANFFRIMNVLGGVIAVGKWFDQICTWKNPITTVLIHILFIILVMYPELILPTIFLYLFLIGVWYYRWRPRHPPHMDTRLSHADSAHPDELDEEFDTFPTSRPSDIVRMRYDRLRSIAGRIQTVVGDLATQGERLQSLLSWRDPRATSLFVLFCLIAAIVLYVTPFQVVALLAGFYVLRHPRFRHKLPSVPLNFFRRLPARTDCML

SEQ ID NO: 9048 - protein, 795 aa, Nicotiana benthamiana
MQRPPQEDFSLKETKPHLGGGKVTGDKLTSTYDLVEQMHYLYVRVVKAKDLPGKDVTGSLDPYVEVRLGNYRGTTRHFEKKSNPEWNQVFAFSNDRIQASVLEVTVKDKDLVKDDFVGRYMFDLNEIPKRVPPDSPLAPQWYRLEDRNGNKVKGELMLAVWMGTQADEAFPESWHSDAATVSGADALANIRSKVYLSPKLWYLRVNVIEAQDLIPGDRSRFPEVYVKAILGNQALRTRVSMSKTINPMWNEDLMFVAAEPFEEPLILSVEDRVAPNKDEVLGRCAIPLQYIDRRLDHRPINSKWYNLEKHIMVEGEKKKEIKFASRLHMRLYLEGGYHVLDESTHYSSDLRPTAKQLWKSSIGVLELGILNAQGLSPMKTKDGRATTDAYCVAKYGQKWVRTRTIIDSFAPKWNEQYTWEVFDPCTVITIGVFDNCHLHGGDKSGGARDSRIGKVRIRLSTLETDRVYTHSYPLLVLHPTGVKKMGEIHLAVRFTCSSLMNMMHMYSQPLLPKMHYIHPLTVSQLDSLRHQATQIVSIRLSRAEPPLRKEIVEYMLDVGSHMWSMRRSKANFFRIMGVLGGLIAIGKWFDQICNWKNPITTVLIHILFLILVLYPELILPTIFLYLFLIGVWYYRWRPRNPPHMDTRLSCADNAHPDELDEEFDTFPTSRSPDLVDPDELDEEFDTFPTSRPPDIVRMRYDRLRSIAGRIQTVVGDLATQGERLQSLLSWRDPRATALFVIFCLIAAIVLYVTPFQVVALLTGFYVLRHPRFRHKLPSAPLNFFRRLPARTDCML

SEQ ID NO: 9049 - protein, 777 aa, Lactuca sativa
MNRPPNEDFSLKETKPHLGGGKVTGDKLTSTYDLVEQMQYLYVRVVKAKDLPTKDVTGSCDPYVEVRMGNYKGTTRHFEKKTNPEWNQVFSFSKDRIQATMLEVTVKDKDLMKDDIMGGVLFDLNEVPKRVPPDSPLAPQWYRLSDRKGDKLKGELMLAVWWGTQADEAFPEAWHSDAAAVSADGLASIRSKVYLSPKLWYLRVNVIEAQDLIPNDRTRFPEVYVKAVLGNQALRTRISTSKTINPLWNEDLMFVAAEPFEEPLILSVEDRVAPNKDEVLGRCAIPLQYVDRRLDHKAINTRWFNLEKHVIIEGEKKKEVKFASRIHMRVCLEGGYHVLDESTHYSSDLRPTAKQLWKNSIGVLEVGILSANGLSPMKTKDGRATTDAYCVAKYGTKWVRTRTIIDSFVPKWNEQYTWEVFDPCTVITIGVFDNCHLQGGGDKAAGGGGNRDSRIGKVRIRLSTLETDRVYTHSYPLLVLHPSGVKKMGEIHLAVRFTCSSLLNMMHMYSQPLLPKMHYIHPLTVAQLESLRHQATQIVSMRLSRAEPPLRKEIVEYMLDVGSHMWSMRRSKANFLRMMGVLGGMIAIGKWFDQICNWKNPITTVLIHFLFLILVLYPELILPTIFLYLFLIGLWYYRWRPRNPPHMDTRLSCADNLHPDELDEEFDTFPTSRQPDIVRMRYDRLRSIAGRMQTVVGDLATQGERFQSLISWRDPRATSLFVIFCLIAAVVLYVTPFQVVAIFAGFYVLRHPRFRRRLPSVPLNFFRRLPARTDCML

SEQ ID NO: 9050 - protein, 771 aa, Gossypium hirsutum
MQKPPQSIDFALKETSPKIGAGAVTGDKLSSTYDLVEQMQYLYVRVVKAKDLPGKDVTGGCDPYVEVKLGNYKGVTKHFEKKNNPEWNQVFAFSKERIQASVLEVYVKDKDVVADDLIGRALFDLNEIPKRIPPDSPLAPQWYRLEDRKGDKAKGELMLAVWMGTQADEAFPEAWHSDAASVGPDAVASIRSKVYLSPKLWYVRVNVIKAQDLVPNDKSRFPEVFVKAMLGNQALRTRISQSKTINPMWNEDLMFVVAEPFEEPLVLSVEDRVGGNKDETLGKCVIPLHIVQRRLDHRPVNSQWLNLEKHVIVDGEKKEIKFASRIHLRICLEGGYHVLDESTHYSSDLRPTAKQLWRPSIGILELGILSAHGLMPMKTKDGRGTTDAYCVAKYGQKWIRTRTIVDNFMPRWNEQYTWEVFDTCTVITVGVFDNGHVHGGAGGARDARIGKVRIRLSTLEADRVYTHSYPLLVLHPSGVKKTGEIQLALRFTCSSLINMLHMYSHPLLPKMHYIHPLSVIQLDVLRHQAMQIVSTRLSRAEPPLRKEVVEYMLDVDSHMWSMRRSKANFFRIMGVLSGLIAVGKWFDQICNWRNPLTTILIHILFIILVLYPELILPTIFLYLFLIGIWNYRWRPRHPPHMDTRLSHADAAHPDELDEEFDTFPTSRPSDIVRMRYDRLRSIAGRVQTVIGDLATQGERFQSLLSWRDPRATTLFVTFCLIAALVLYVTPFQVVALLAGIYILRHPRFRHKLPSTPLNFFRRLPARSDSML

SEQ ID NO: 9051 - protein, 771 aa, Unknown
  Sequence found in Organisms: Gossypium hirsutum, Gossypium raimondii
MQKPPQSIDFALKETSPKIGAGAVTGDKLSSTYDLVEQMQYLYVRVVKAKDLPGKDVTGGCDPYVEVKLGNYKGVTKHFEKKNNPEWNQVFAFSKERIQASVLEVYVKDKDVVADDLIGRALFDLNEIPKRIPPDSPLAPQWYRLEDRKGDKAKGELMLAVWMGTQADEAFPEAWHSDAASVGPDAVASIRSKVYLSPKLWYVRVNVIEAQDLVPNDKSRFPEVFVKAMLGNQALRTRISQSKTINPMWNEDLMFVVAEPFEEPLVLSVEDRVGGNKDETLGKCVIPLHIVQRRLDHRPVNSRWLNLEKHVIVDGEKKEIKFASRIHLRICLEGGYHVLDESTHYSSDLRPTAKQLWRPSIGILELGILSAHGLMPMKTKDGRGTTDAYCVAKYGQKWIRTRTIVDNFMPRWNEQYTWEVFDTCTVITVGVFDNGHVHGGAGGARDARIGKVRIRLSTLEADRVYTHSYPLLVLHPSGVKKTGEIQLALRFTCSSLINMLHMYSHPLLPKMHYIHPLSVIQLDVLRHQAMQIVSTRLSRAEPPLRKEVVEYMLDVDSHMWSMRRSKANFFRIMGVLSGLIAVGKWFDQICNWRNPLTTILIHILFIILVLYPELILPTIFLYLFLIGIWNYRWRPRHPPHMDTRLSHADAAHPDELDEEFDTFPTSRPSDIVRMRYDRLRSIAGRVQTVIGDLATQGERFQSLLSWRDPRATTLFVTFCLIAALVLYVTPFQVVALLAGIYVLRHPRFRHKLPSTPLNFFRRLPARSDSML

SEQ ID NO: 9052 - protein, 776 aa, Arabidopsis lyrata
MQRPPPEDFSLKETKPHLGGGKVTGDKLTTTYDLVEQMQYLYVRVVKAKDLPGKDLTGSCDPYVEVKLGNYRGTTRHFEKKSNPEWNQVFAFSKDRVQASYLEATVKDKDLVKDDLIGRVVFDLNEIPKRVPPDSPLAPQWYRLEDGKGQKVKGELMLAVWFGTQADEAFPEAWHSDAATVSGTDALANIRSKVYLSPKLWYLRVNVIEAQDLIPSDKGRYPEVFVKVIMGNQALRTRVSQSRSINPMWNEDLMFVVAEPFEEPLILSVEDRVAPNKDEVLGRCAVPLQYLDKRFDYRPVNSRWFNLEKHVIMEGGEKKEIKFASKIHMRICLEGGYHVLDESTHYSSDLRPTAKQLWKPNIGVLELGVLNATGLMPMKAKEGGRGTTDAYCVAKYGQKWIRTRTIIDSFTPRWNEQYTWEVFDPCTVVTVGVFDNCHLHGGDKNNGGGKDSRIGKVRIRLSTLEADRVYTHSYPLLVLHPNGVKKMGEIHLAVRFTCSSLLNMMYMYSLPLLPKMHYLHPLTVSQLDNLRHQATQIVSTRLTRAEPPLRKEVVEYMLDVGSHMWSMRRSKANFFRIMGVLSGIIAVGKWFEQICVWKNPITTVLIHILFIILVIYPELILPTIFLYLFLIGVWYYRWRPRHPPHMDTRLSHADSAHPDELDEEFDTFPTSRPSDIVRMRYDRLRSIAGRIQTVVGDLATQGERFQSLLSWRDPRATALFVLFCLIAAVVLYVTPFQVVAFLIGLYVLRHPRLRYKLPSVPLNFFRRLPARTDCML

SEQ ID NO: 9053 - protein, 180 aa, Eschscholzia californica
MQRPHPTEDFSLKETSPHLGGGLAGDKHTSTYDLVEQMQYLYVRVVKAKDLPTKDVTGSCDPYVEVKLGNYKGTTRHFEKKTNPEWNQVFAFSKDRIQASVVEVLVKDKDFMKDDFMGRVWFDLNEVPKRVPPDSPLAPQWYRLEDRKVIKLKESLCWLFGWVPKLMKRFQRRGTQMQQL

SEQ ID NO: 9054 - protein, 771 aa, Theobroma cacao
MQKPPQSVDFALKETSPNIGAGAVTGDKLSCTYDLVEQMQYLYVRVVKAKDLPGKDVTGSCDPYVEVKLGNYKGVTKHFEKKTNPEWNQVFAFSKERIQASVLEVLVKDKDVVIDDLIGRVMFDLNEIPRRVPPDSPLAPQWYRLEDRKGNKAKGELMLAVWMGTQADEAFPDAWHSDAASVGPDGVANIRSKVYLSPKLWYVRVNVIEAQDLVPTDKSRFPEVFVKVALGNQALRTRASQIKTINPMWNEDLMFVVAEPFEEPLVLTVEDRVGSNKDETLGKCVINLHAVQRRLDHKPVNSRWYNLEKHVIVDGEKKETKFSSRIHLRICLEGGYHVLDESTHYSSDLRPTAKQLWRPSIGILELGILSAHGLMPMKTKDGRGTTDAYCVAKYGQKWIRTRTIVDNFMPKWNEQYTWEVFDPCTVITVGVFDNGHMHGEAGGTKDARIGKVRIRLSTLEADRVYTHSYPLLVLHSSGVKKTGEVQLAVRFTCSTLINMLHMYSHPLLPKMHYIHPLSVIQLDSLRHQAMQIVSMRLSRAEPPLRKEVVEYMLDVDSHMWSMRRSKANFFRIMGVLSGLIAVGKWLDQICNWRNPLTTILIHILFIILVLYPELILPTVFLYLFLIGIWNYRWRPRHPPHMDTRLSHADAAHPDELDEEFDTFPTSRPSDIVRMRYDRLRSIAGRVQTVIGDLATQGERFQSLLSWRDPRATTLFVTFCLIAAIVLYVTPFQVVALLIGLYALRHPRFRHKLPSVPLNFFRRLPARSDSML

SEQ ID NO: 9055 - protein, 773 aa, Glycine max
MQRPPPEDFLLKETKPHLGGGKVSGDRLTSTYDLVEQMQYLYVRVVKAKDLPAKDITGSCDPYVEVKLGNYKGTTRNFAKNTHPEWNQVFAFSKDRLQASMLEVNVIDKDVLKDDLIGRVWFDLNEIPKRVPPDSPLAPQWYRLEDRKSDKAKGELMLAVWMGTQADEAFPEAWHSDAAMVSGSDALANIRSKVYLSPKLWYLRVNVIEAQDLMPTDKGRYPEVFVKAILGNQALRTRISQSRSINPMWNEDLMFVVAEQFEEPLILSVEDRVAPNKDEVLGRCAIPLQYVERRLDEKPVNTRWFNLERHIVIEGEKKDTKFASRIHMRICLEGGYHVLDESTHYSSDLRPTAKQLWMPGIGVLELGILNAQGLMPMKTKDGRGTTDAYCVAKYGQKWVRTRTIIDSFAPRWNEQYTWEVFDPCTVITIGVFDNCHLHGGDKAGGARDAKIGKVRVRLSTLETDRVYTHSYPLLVLHPNGVKKMGEIHLAMRFTCSSFVNMMHMYSRPLLPRMHYIHPLTVSQLDSLRHQATQIVSMRLSRAEPPLRKEVVEYMLDVGSHMWSMRRSKANFFRIMGVLSGLIAVGKWFDQICNWRSPITTILIHILFIILVMYPELILPTIFLYLFLIGIWYYRWRPRHPPHMDTRLSHADSAHPDELDEEFDTFPTSRPNDLVRMRYDRLRSIAGRIQTVVGDLATQGERLQSLLSWRDPRATSLFVIFCLVAATVLYVTPFQVVALFTGIYVLRHPRFRYMLPSVPLNFFRRLPARTDCML

SEQ ID NO: 9056 - protein, 803 aa, Nicotiana benthamiana
MQRPPQEDFSLKETKPHLGGGKVTGDKLTSTYDLVEQMQYLYVRVVKAKDLPGKDVTGSLDPYVEVRLGNYRGTTRHFEKKSNPEWSQVFAFSKDRIQASVLEVTVKDKDLVKDDFVGRVIFDLNEIPKRVPPDSPLAPQWYRLEDRNGNKVKGELMLAVWMGTQADEAFPESWHSDAATVSGADALANIRSKVYLSPKLWYLRVNVIEAQDLIPGDRSRFPEVYVKAILGNQALRTRVSMIPGDRSRFPEVYVKAILGNQALRTRVSMSKTINPMWNEDLMFVAAEPFEEPLILSVEDRVAPNKDEVLGRCAIPLQYIDRRLDHRPINSKWYNLEKHIMVEGEKKKEIKFASRLHMRLYLEGGYHVLDESTHYSSDLRPTAKQLWKSSIGVLELGILNAQGLSPMKTKDGRATTDAYCVAKYGQKWVRTRTIIDSFAPKWNEQYTWEVFDPCTVITIGVFDNCHLHGGDKSGGARDSRIGKVRIRLSTLETDRVYTHSYPLLVLHPTGVKKMGEIHLAVRFTCSSLMNMMHMYSQPLLPKMHYIHPLTVSQLDSLRHQATQIIVSIRLSRAEPPLRKEIVEYMLDVGSHMWSMRRSKANFFRIMGVLGGLIAIGRWFDQICHWKNPITTVLIHILFLILVLYPELILPTIFLYLFLIGVWYYRWRPRNPPHMDTRLSCADNAHPDELDEEFDTFPTSRPPDIVRMRYDRLRSIAGRIQTVVGDLATQGERLQSLLSWRDPRATALFVIFCLIAAIVLYVTPFQVVALLTGFYVLRHPRFRHKLPSAPLNFFRRLPARTDCML

SEQ ID NO: 9057 - protein, 772 aa, Citrus sinensis
MQKSPQAIDFALKETSPKIGAGSITGDKLSCTYDLVEQMQYLYVRVVKAKDLPGKDVTGSCDPYVEVKLGNYKGTTKHFEKKSNPEWNQCFAFSKDRIQASVLEVLVKDKDVVLDDLIGRVMFDLNEVPKRIPPDSPLAPQWYRLEDRKGDKVKTGELMLAVWMGTQADEAFPDAWHSDAATVSGEGVANIRSKVYLSPKLWYVRVNIIEAQDLLPSDKSRFPEVFVKAILGNQASRTRISPSKTINPMWNEDLMFVAAEPFEEPLILTVEDRVAPNKDEVLGKCLIPLQAVQRRLDHKPVNTRWFNLEKHVIVDGEKKETKFSSRIHLRICLDGGYHVLDESTHYSSDLRPTAKQLWKPSIGILELGVLSAHGLTPMKTKDGRGTTDAYCVAKYGQKWVRTRTIVDSFGPRWNEQYTWEVFDPCTVITVGVFDNGHIHGQGGGGKDSRIGKVRIRLSTLETDRVYTHSYPLLVLHPSGVRKMGEVQLAVRFTCSSLINMLHMYSQPLLPKMHYIHPLSVIQLDSLRHQAMQIVSIRLNRAEPPLRKEVVEYMLDVDSHMWSMRRSKANFFRIMGVLSSLISVGKWFDQICNWKNPLTTILIHILFIILVLYPELILPTVFLYLFLIGIWNFRWRPRHPPHMDTRLSHAEAAHPDELDEEFDTFPTTKGSDIVRMRYDRLRSIAGRVQTVIGDLATQGERFQSLISWRDPRATTLFVTFCLIAAIVLYVTPFQVVALLAGIYVLRHPRFRHKLPSVPLNFFRRLPARSDSML

SEQ ID NO: 9058 - protein, 778 aa, Eutrema halophilum
MQRPPPEDFSLKETKPHLGGGKVTGDKLTSTYDLVEQMQYLYVRVVKAKELPGKDLTGSCDPYVEVKLGNYKGTTRHFEKKSNPEWNQVFAFSKDRLQASVLEATVKDKDFVKDDLIGHVVFDLNEIPKRVPPDSPLAPQWYRLEDRKGQKVKGELMLAVWFGTQADEAFPEAWHSDAATVSGTDALANIRSKVYLSPKLWYLRVNVIEAQDLVPSDKGRYPEVYVKVMMGTQALRTRVSQGRGINPMWNEDLMFVVAEPFEEPLILSVEDRVAPNKDEVLGRCAIPLQYLDRRFDYKPVNSRWFNLEKHVIMESGEKKEIKFSSKIHMRICLEGGYHVLDESTHYSSDLRPTAKQLWKPNIGVLELGILNATGLMPMKAKEGGRGATDAYCVAKYGQKWIRTRTIIDSFTPRWNEQYTWEVFDPCTVVTVGVFDNCHLHGADKNNGGGGGKDSRIGKVRIRLSTLETDRVYTHSYPLLVLHPNGVKKMGEIHLAVRFTCSSLLNMMYMYSLPLLPKMHYLHPLTVSQLDNLRHQATQIVSTRLTRAEPPLRKEVVEYMLDVGSHMWSMRRSKANFFRIMGVLSGLIAVGKWFEQICVWKNPITTVLIHILFIILVVYPELILPTVFLYLFLIGVWNYRWRPRHPPHMDTRLSHADSAHPDELDEEFDTFPTSRPADIVRMRYDRLRSIAGRIQTVVGDLATQGERLQSLLSWRDPRATALFVLFCLIAAVVLYVTPFQLVALIIGLYVLRHPRLRYRLPSVPLNFFRRLPARTDCML

SEQ ID NO: 9059 - protein, 772 aa, Citrus clementina
MQKSPQAIDFALKETSPKIGAGSITGDKLSCTYDLVEQMQYLYVRVVKAKDLPGKDVTGSCDPYVEVKLGNYKGTTKHFEKKSNPEWNQCFAFSKDRIQASVLEVLVKDKDVVLDDLIGRVMFDLNEVPKRIPPDSPLAPQWYRLEDRKGDKVKTGELMLAVWMGTQADEAFPDAWHSDAATVSGEGVANIRSKVYLSPKLWYVRVNIIEAQDLLPSDKSRFPEVFVKAILGNQASRTRISQSKTINPMWNEDLMFVAAEPFEEPLILTVEDRVAPNKDEVLGKCLIPLQAVQRRLDHKPVNTRWFNLEKHVIVDGEKKETKFSSRIHLRICLDGGYHVLDESTHYSSDLRPTAKQLWKPSIGILELGVLSAHGLTPMKTKDGRGTTDAYCVAKYGQKWVRTRTIVDSFGPRWNEQYTWEVFDPCTVITVGVFDNGHIHGQGGGGKDSRIGKVRIRLSTLETDRVYTHSYPLLVLHPSGVRKMGEVQLAVRFTCSSLINMLHMYSQPLLPKMHYIHPLSVIQLDSLRHQAMQIVSIRLNRAEPPLRKEVVEYMLDVDSHMWSMRRSKANFFRIMGVLSSLISVGKWFDQICNWKNPLTTILIHILFIILVLYPELILPTVFLYLFLIGIWNFRWRPRHPPHMDTRLSHAEAAHPDELDEEFDTFPTTKGSDIVRMRYDRLRSIAGRVQTVIGDLATQGERFQSLISWRDPRATTLFVTFCLIAAIVLYVTPFQVVALLAGIYVLRHPRFRHKLPSVPLNFFRRLPARSDSML

SEQ ID NO: 9060 - protein, 776 aa, Arabidopsis thaliana
MQRPPPEDFSLKETKPHLGGGKVTGDKLTTTYDLVEQMQYLYVRVVKAKELPGKDLTGSCDPYVEVKLGNYRGTTRHFEKKSNPEWNQVFAFSKDRVQASYLEATVKDKDLVKDDLIGRVVFDLNEIPKRVPPDSPLAPQWYRLEDGKGQKVKGELMLAVWFGTQADEAFPEAWHSDAATVSGTDALANIRSKVYLSPKLWYLRVNVIEAQDLIPSDKGRYPEVFVKVIMGNQALRTRVSQSRSINPMWNEDLMFVVAEPFEEPLILSVEDRVAPNKDEVLGRCAVPLQYLDKRFDYRPVNSRWFNLEKHVIMEGGEKKEIKFASKIHMRICLEGGYHVLDESTHYSSDLRPTAKQLWKPNIGVLELGVLNATGLMPMKAKEGGRGTTDAYCVAKYGQKWIRTRTIIDSFTPRWNEQYTWEVFDPCTVVTVGVFDNCHLHGGDKNNGGGKDSRIGKVRIRLSTLEADRVYTHSYPLLVLHPSGVKKMGEIHLAVRFTCSSLLNMMYMYSMPLLPKMHYLHPLTVSQLDNLRHQATQIVSTRLTRAEPPLRKEVVEYMLDVGSHMWSMRRSKANFFRIMGVLSGIIAVGKWFEQICVWKNPITTVLIHILFIILVIYPELILPTIFLYLFLIGVWYYRWRPRHPPHMDTRLSHADSAHPDELDEEFDTFPTSRPSDIVRMRYDRLRSIAGRIQTVVGDLATQGERFQSLLSWRDPRATALFVLFCLIAAVILYITPFQVVAFAIGLYVLRHPRLRYKLPSVPLNFFRRLPARTDCML

SEQ ID NO: 9061 - protein, 772 aa, Gossypium raimondii
MQKPPPQSVDFALKQTSPNIGAGAVTGDKLSCTYDLVEQMQYLYVRVVKAKDLPGKDVTGSCDPYVEVKLGNYKGVTKHFEKKSNPEWNQVFGFSKERIQASILEVFVKDKDVVVDDLIGRVVFDVNEIPKRVPPDSPLAPQWYRLEDRKGNKAKGELMLAVWMGTQADEAFPDAWHSDAASVGPDGVTNIRSKVYLSPKLWYVRVNVIEAQDLVPSDKGRFPEVFVKAVLGNQALRTRISPSKTINPMWNEDLMFVVAEPFEEPLFLSVEDRVGSNKDETLGKCVIPLQVVQRRLDHKPVNSRWHNLEKHVIVDGEKKEMKFASRIHLRICLEGGYHVLDESTHCSSDLRPTAKQLWRPNIGILELGILSAHGLMPMKTKDGRGTTDAYCVAKYGQKWIRTRTIVDNFMPRWNEQYTWEVFDPCTVITIGVFDNGHIHGGAGGAKDARIGKVRIRLSTLEADRVYTHSYPLLVLHSSGVKKTGEVQLAVRFTCSTLINMLHMYSHPLLPKMHYIHPLSVIQLDSLRHQAVQMVSVRLSRAEPPLRKEVVEYILDVDSHMWSMRRSKANFFRIMGVLSGLIAVGKWFDQICNWRNPITTILIHILFIILVLYPELILPTVFLYLFLIGIWNYRWRPLHPPHMDTRLSHADAAHPDELDEEFDTFPTSRPSDIVRMRYDRLRSIGGRVQTVIGDLATQGERLQSLLSWRDPRATTLFVTFCLIAAIVLYVTPFQVVALLIGLYALRHPRFRHKLPSVPLNFFRRLPARSDSML

SEQ ID NO: 9062 - protein, 772 aa, Gossypium hirsutum
MQKPPPQSVDFALKQTSPNIGAGAVTGDKLSCTYDLVEQMQYLYVRVVKAKDLPGKDVTGSCDPYVEVKLGNYKGVTKHFEKKSNPEWNQVFGFSKERIQASILEVFVKDKDVVVDDLIGRVVFDVNEIPKRVPPDSPLAPQWYRLEDRKGNKAKGELMLAVWMGTQADEAFPDAWHSDAASVGPDGVTNIRSKVYLSPKLWYVRVNVIEAQDLVPSDKGRFPEVFVKAVLGNQALRTRISPSKTINPMWNEDLIFVVAEPFEEPLFLSVEDRVGSNKDETLGKCVIPLQVVQRRLDHKPVNSRWHNLEKHVIVDGEKKEMKFASRIHLRICLEGGYHVLDESTHCSSDLRPTAKQLWRPNIGILELGILSAHGLMPMKTKDGRGTTDAYCVAKYGQKWIRTRTIVDNFMPRWNEQYTWEVFDPCTVITIGVFDNGHIHGGAGGAKDARIGKVRIRLSTLEADRVYTHSYPLLVLHSSGVKKTGEVQLAVRFTCSTLINMLHMYSHPLLPKMHYIHPLSVIQLDSLRHQAMQIVSVRLSRAEPPLRKEVVEYILDVDSHMWSMRRSKANFFRIMGVLSGLIAVGKWFDQLCNWRNPITTILIHILFIILVLYPELILPTVFLYLFLIGIWNYRWRPLHPPHMDTRLSHADAAHPDELDEEFDTFPTSRPSDIVRMRYDRLRSIGGRVQTVIGDLATQGERLQSLLSWRDPRATTLFVTFCLIAAIVLYVTPFQVVALLIGLYALRHPRFRHKLPSVPLNFFRRLPARSDSML

SEQ ID NO: 9063 - protein, 773 aa, Ambrosia trifida
MHRPPPDDYLLKETRPHLGGVKMAGDKLTSTYDLVEQMQYLYVRVVKARDLPAKDVTGSCDPYVEVRLGNYKGTTRHFEKKSNPEWNQVFAFSRERIQAGMLEVTVKDKDLVKDDFIGLMSFDLHEVPKRVPPDSPLAPQWYRLEDRKGNKLKGEIMLAVWWGTQADEAFPEAWHSDAATVGGADALANIRSKVYLSPKLRYLRVNVIEAQDLIPSDRTRFPEVYVKAVLGHQTLRTRVSMSKSINPMWNEDLMFVAAEPFEEHLILSIEDRVAPNKEEVLGMCVIPLQHVERRLDHRAINTRWFNLEKHVMIDGEKKQVRFASKIHTRIGLEGGYHVLDESTHYSSDLRPTDKRLWKKSIGVLEVGILSAHGLTPMKSKDGRAATDAYCVAKYGTKWVRTRTIIDSFTPKWNEQYTWEVFDPCTVVTIGVFDNCHLHGGDKGNGAKDSRIGKVRIRLSTLETDRVYTHSYPLLVLHPSGVKKMGEIHLAVRFTCSSLLNMMHMYSQPLLPKMHYIHPLTITQLEILRHQATQIVSMRLSRAEPPLRKEIVEYMLDVGSHMWSMRRSKANMFRIMGVLGGFIAIGKWFGQICNWKNPITTVLIHILFLILVLYPELILPTIFLYLFLIGVWYYRWRPKNPPHMDTRLSCADNAHPDELDEEFDTFPTSRHPDIIRMRYDRLRSFSGKIQTVVGDIATQGERLQSLLSWRDPRATALFVIFCLIAAIVLYVTPFQVVALITGFYVLRHPRFRHRLPSVPLNYFRRLPAKTDCML

SEQ ID NO: 9064 - protein, 360 aa, Sorghum bicolor
MAGGGVQQVVAVLAVVALMVTVVEGFISKKKWSTIRQVDRDGPFVGLVAPNAYEMKPVLDSPDFKPSNNIPILDVQGRRFRFGTIGGQNVVMVMTGLSMLNAGLTTQLLLSLFRVKGIVHWGIAGNANEDLQIGDVTIPESWAHLSLWNWQRHGDGAENRVPLEIAGDYTREYGFLHFSNYTVGLANPELSANTLNSVWYQPEEIFPISATPEKRQHAFWVPVSKRYYKLAGKLEGLELPACVNATTCLPRAPRVTRVPRGCSANIYTDNASYRQFIRSHFGCTPVEMESAAVALVAHQHGVPFITIRSLSDLAGGGSSLSNEAGTFLDIAAKNAVDVMLKFVPLLGRGGAQADGPGEDM

SEQ ID NO: 9065 - protein, 228 aa, Zea mays
MAGGGTQHLLQVAAVLAAAVVLMATASEGFISKKTWSAIRRADRDGPFVGLVVPNAYEMVPVLNSPDFKPSSNIPILDVQGRRFRFGTIGSQNVVMVMTGLSMLNAGLTTQLLLSLFRVKGIVHWGIAGNANEDLQIGDVTIPESWAHLSLWNWQRHGDGPENELPLENAGDYTREYGFLNFSDYTVGQDAGNPELAANTLNSVWYQPEEIFPISGTPEERQHAFWCP

SEQ ID NO: 9066 - protein, 361 aa, Leymus cinereus x Leymus triticoides
MGGVRQQLIAAVLVAVALMATAAEGYISQKTWGAIRRANRAGPFVGLVVPNTYEMVPVLESPSFVASKSVPNMDIQGRRFRFGTIGGQSVVMVMTGLSMLNAGLTTQMLLSLFRVKGIVHWGIAGNANEDLQIGDVTIPEYWAHVSLWNWQRFGDGKDNELPLEAAGDYTREYGFLNFSDYTVGQSNPEPSANQLNSIWYQPEEIFPASGEPEERQHAFWVPASKRYYALAAKLEGMELPACVNATTCLPRAPRVTRVSKGCSANVFLDNAEYRQFLRKQFGCTPVEMESAAVALVAHTQGVPFLTIRSLSDLAGGGSALGNEASTFIDIAAKNAVEVMLKFVSLLGKRGDEMDDGAAADM

SEQ ID NO: 9067 - protein, 361 aa, Triticum aestivum
MGGVRQQLMAAVLVAVALMATAAEGYITQKTWGAIRRANRAGPFVGLVVPNTYEMVPVLESPSFVASKSIPNMDIQGRRFRFGTIEGQSVVMVMTGLSMLNAGLTTQMLLSLFRVKGIVHWGIAGNANEDLQIGDVTIPEYWAHVSLWNWQRFGDGKDNELPLEAAGDYTREYGFLNFSDYTVGQSNPALSANQLNSIWYQPEEIFPKSGEPEERQHAFWVPASKRYYALAAKLEGMELPACVNATTCLPRAPRVTRVSKGCSANVFLDNAEYRQFLRKQFECTPVEMESAAVALVAHTQGVPFLTIRSLSDLAGGGSALGNEASTFIDIAAKNAVEVMLKFVPLLGKGGDEMDDGAAADM

SEQ ID NO: 9068 - protein, 437 aa, Zea mays
MEDPPALPLPEPESEPDPDPEASPAPPQRLLRLRCAVQHYEWGQRGAASLVARLADQNPDPARPYAELWMGTHPSAPSTLLDDGTLLSDWLARNPDALGPAVAARWGVDLPFLFKVLSVAKALSIQAHPDKKLAEVLHALRPSTYKDDNHKPEMAIAITEFRALCGFAGIEELKDVLRAFPEIEGLVGHEDTGKLMNMKEDDGVSEVKSSLQSAFAKLMTASKDMVSEAVAKLISRLNTKSKIRTLTDKEQLVLSLERQYQDDVGVIAALFFNYVKLSPGEALYIGANEPHAYLSGECIECMATSDNVVRAGLTPKYRDVQTLCSMLTYKQGFPEILRGVPVQPHVRRYTPPFNEFEVDWCLVPPGGLVVISPVPGPSIFLVITGEGEIQLDFMSDGEKAEEGDVFFVPAYTEVKISACGPESVQLYRAGVNSRFFS

SEQ ID NO: 9069 - protein, 440 aa, Setaria italica
MEDPPPPPEPEPAAASASPQRDVEPSPPPPQRLLRLRCAVQHYEWGRRGSASLVARLADQDPDPARPYAELWMGTHPSGPSTLLDGGALLRDWLARNPDALGPAVAARWGGDLPFLFKVLSVAKALSIQAHPDKKLAEVLHALRPSTYKDDNHKPEMAIAITEFRALCGFAGIEELKDVLRTVPEVEGLVGHEDTGKLMSMKEYDGGSEVKSSLQSAFAKLMTASKDMVSEAISKLISRLNIESKIRTLTDKEQLVLSLEKQYQEDVGVLAALFFNYVKLSPGEALYIGANEPHAYLSGECIECMATSDNVVRAGLTPKYRDVQTLCSMLTYKQAFPEILRGVPVQPHVRRYTPPFDEFEVDCCLVPPGELVVIAPVPGPSMFLIMMGEGELQIDSLSAGEKAKDGDVFFVPAYTEVKLSTFGTESMQLYRAGINSRFFS

SEQ ID NO: 9070 - protein, 445 aa, Panicum virgatum
MEDPPPPPPPEPEPEPAAASASPRRDAEPPPPQPRRRLLRLRCAVQHYEWGRRGDASLVARLAAQDPDPARPYAELWIGTHPSGPSTLLDDGELLGDWLARNLDALGPAVAARWGGDLPFLFKVLSVAKALSIQAHPDKKLAEVLHALRPSTYKDDNHKPEMAIAITEFRALCGFATSEELKDILRTVPEVEGLVGHEDAGKLMSMKEYDGGSEVKSTLQSAFAKLMTASKDMVSEAISKLISRLNIESKIRTLTDKEQLVLSLERQYQEDVGVLAALFFNYVKLSPGEALYIGANEPHAYLSGECIECMATSDNVVRAGLTPKYRDVQTLCSMLTYKQAFPEILRGVPVQSHVRRYTPPFDEFEVDSCLVPPGELVLISPVPSPSIFLVMAGEGELQADSLSDGEKAKEGDVFFVPAYTEVKLSSCGPESMKLYRAGVNSRSFN

SEQ ID NO: 9071 - protein, 446 aa, Panicum virgatum
MEDPPPPPPPPPEPEPAAASPRRDAEPSPPLQPPPRRRLLRLRCAVQHYEWGRRGDASLVARLAARDPDPSRPYAELWMGTHPSGPSTLLDGGELLGDWLARNPDALGPAVAARWGGDLPFLFKVLSVAKALSIQAHPDKKLAEVLHALRPSTYKDDNHKPEMAIAITEFRALCGFATIEELKDILRTVPEVEGLVGHEDAGKLMTMKEYDGGSEVKSTLQSAFAKLMTASKDMVSEAISKLISRLNIESKIRTLTDKEQLVLSLERQYQEDVGVLAALFFNYVKLSPGEALYIGANEPHAYLSGECIECMATSDNVVRAGLTPKYRDVQTLCSMLTYRQAFPEILRGVPVQPHVRRYTPPFDEFEVDSCLVPPGKLVVISPVPSPSIFLVMTGEGELQADSLSDGEKAKEGDVFFVPAYTEVKLSASGPESMKLYRAGVNSRSFN

SEQ ID NO: 9072 - protein, 362 aa, Panicum virgatum
RKKPSHPPKPRWQTVLSVAAKNAALLAALLYLGDLAWRWSHPPPPSPPPDRAARVDEVEASLARTFRMLQVQLEAIDRKIDGEVGAAKADLAALLEEKRLALEGGLARLDGRVDELGDALAGLGRMEFLRKDEFEKFWEEVKGSLASGSGSEVDLDQVRALAREIALREIEKHAADGIGRVDYALASGGGRVVRHSEPYMPKRGMLNVWLGGRNADPQKMIQPSFGEPGQCFPLQGSSGFVEIKLKTGIIPEAVTLEHVSKDVAYDRSTAPKDCRVSGWYDETPGETQSGHAAKMTALAEFTYDLDKNNIQTFDVTAPDVGMINMIRLDFTSNHGSSLLTCIYRLRVHGHEPVSPGTAGVLA

SEQ ID NO: 9073 - protein, 442 aa, Panicum virgatum
MASPSLAAAATSPASSPLTLDAIPLASRPPPAAAALRKRPVLLLDTRPHPASPTPPLLSSTAAAAAAAAAPARRKKPSHPPKPRWQTVLSVAAKNAALLAALLYLGDLAWRWSHPPPPSPPPDRAALEAYAARVDEVQASLARTLRMVQVQLEAIDRKIDGEVGAARADLAALLEERRLALEGALARLDARADELGDALAGLGRMDFVRQDEFEKFWEEVKGSLASGSGSEVDLDQVRALAREIALSEIEKHAADGIGRVDYAVASGGGRVVRHSEPYVPNRGGIFNGWLGGRDADPQKMIQPSFGEPGQCFPLQGGSGFVEIKLKTGIIPEAVTLEHVSKDVAYDRSTAPKDCRVSGWYDETPGETQSGHAAKMAALAEFTYDLDKNNIQTFDVTAPDVGMINMLRLDFTSNHGSSLLTCIYRLRVHGHEPVSPGTAGVLA

SEQ ID NO: 9074 - protein, 267 aa, Pennisetum glaucum
KKRLALEGGLNRLDARASELGDALAGLSRMEFLRKDELEKFWEEVKGSLTSGSGSEVDLDQVRALAREIAMREIEKHSADGIGRVDYAVASGGGRVVRHSEPYVPKRGSIWTGWLGGGNPDPQKMIQPSFGEPGQCFAVQGSNGFVEIKLKTGIIPEAVTLEHVSKDVAYDRSTAPKDCRVSGWYDETPGETQSSHAAKMAALAEFTYDLDKNNIQTFDVTAPDVGMINMIRLDFNSNHGSSQLTCIYRLRVHGHEPLSPSTAGFKA

SEQ ID NO: 9075 - protein, 249 aa, Panicum virgatum
  misc_feature (63)..(63): Xaa can be any naturally occurring amino acid
  misc_feature (71)..(71): Xaa can be any naturally occurring amino acid
  misc_feature (149)..(149): Xaa can be any naturally occurring amino acid
DELGDALAGLGRMEFLRKDEFEKFWEEVKGSLASGSGSEVDLDQVRALAREIALREIEKHAAXGIGRVDYXLASGGGRVVRHSEPYMPKRGMLNVWLGGRNADPQKMIQPSFGEPGQCFPLQGSSGFVEIKLKTGIIPEAVTLEHVSKXVAYDRSTAPKDCRVSGWYDETPGETQSGHAAKMTALAEFTYDLDKNNIQTFDVTAPDVGMINMIRLDFTSNHGSSLLTCIYRLRVHGHEPVSPGTAGVLA

SEQ ID NO: 9076 - protein, 443 aa, Setaria italica
MASPSLAAAATGPASSPLALDAIPIASRPPAAAPRKRPVLLLDTRPHPASPTPPLLSSTAAAAAAAASAPPAHARRKKPSHPPRPRWQTALSIAAKNAALLAALFYLGDLAWRWSHPPPPSPPPDRAALEGYAARVDEVEASLARAFKMMQVQLEAVDRKIDGEVGAARADLAVLLEEKRLALEGGLNRLDARAGELGDALAGLSRMEFLRKDEFEKFWEEVKGGLASGSGSEVDLDQVRALAREIAMREIEKHAADGIGRVDYAVASGGGRVVHHSVPYEPKRGIFSGLLGGGNPDPQKMIQPSFGEPGQCFAVQGSSGFVEIKLKSGIIPEAVTLEHVSKDVAYDRSTAPKDCRVSGWYDETSGETQSSHAAKMAALAEFTYDLDKNNIQTFDVTAPDVGVINMIRLDFTSNHGSSLLTCIYRLRVHGREPVSPGTAGFRA

SEQ ID NO: 9077 - protein, 83 aa, Zea mays
MAGKGGSTNLEKEQMFGMAEKEMEYRVDLFNRLTQTCFNKCIEKRYKEAELNMGENSCIDRCVSKYWQVTNLVGQMLGNRPQM

SEQ ID NO: 9078 - protein, 83 aa, Setaria italica
MAAKGGPTNLEKEQMFGMAEKEMEYRVDLFNRLTQTCFDKCVEKRYKEAELNMGENSCIDRCVSKYWQVTNLVGQMLGNRPQI

SEQ ID NO: 9079 - protein, 83 aa, Unknown
  Sequence found in Organisms: Zea mays, Triticum aestivum
MAGKGGPTNLEKEQMFGMAEKEMEYRVDLFNRLTKTCFEKCVEKRYKEAELNMGENSCIDRCVSKYWQVTNLVGQMLGNQPQM

SEQ ID NO: 9080 - protein, 83 aa, Pennisetum glaucum
MAAKGGPTNLEKEQMFGMAEKEMEYRVDLFNRLTQTCFDKCVEKRYKEPELNMGENSCIDRCVSKYWQVTNLVGQMLGNRPQI

SEQ ID NO: 9081 - protein, 83 aa, Oryza sativa
MAAKPEPTQLEKEQMFGMMEKEMEYRVDLFNRLTQTCFDKCIEKRYKEAELNMGENSCIDRCVSKYWQVTNMVGQMLGNRPQM

SEQ ID NO: 9082 - protein, 84 aa, Avena sativa
MAAKGGGPSDLEKEQMFGMAEKEMEYRVDLFNRLTHSCFDKCIEKRHKEAELNMGENSCIDRCVSKYWQVTNLVGQMLGNRPQM

SEQ ID NO: 9083 - protein, 84 aa, Festuca arundinacea
MAAKGGGPSDLEKEQMFGMAEKEMEYRVDLFNRLTHSCFDKCIEKRHKEAELNMGENSCIDRCVSKYWQVTNLVGQMLGNRPQI

SEQ ID NO: 9084 - protein, 83 aa, Brachypodium distachyon
MASKGGPSNLEKEQMFGMAEKEMEYRVDLFNRLTHSCFEKCIEKRHKESELNMGENSCIDRCVSKYWQVTNLVGQMLGNKPQI

SEQ ID NO: 9085 - protein, 83 aa, Panicum virgatum
MAAKGSSSNLEKEQMFWMAEKEMEYRVDLFNRLTQTCFDKCVEKRYKETELNMGENSCIDRCVSKYWQVSNIVGQMLGNRPQM

SEQ ID NO: 9086 - protein, 83 aa, Panicum virgatum
MAAKGSSSNMEKEQMFWMAEKEMEYRVDLFNRLTQTCFDKCVEKRYKETELNMGENSCIDRCVSKYWQVSNIVGQMLGNRPQM

SEQ ID NO: 9087 - protein, 83 aa, Eragrostis curvula
MAANGAPTNMQKEQMFGLAEKEMEYRVDLFNRLTQTCFDKCIEKRHKEAELNMGENSCIDRCVSKYWQVTNLVGQLLGNQPKM

SEQ ID NO: 9088 - protein, 83 aa, Setaria italica
MAAGGAPTNMQKEQMFGLAEKEMEYRVDLFNRLTQTCFAKCIEKRHKEAELNMGENSCIDRCVSKYWQVTNLVGQLLGNQPKM

SEQ ID NO: 9089 - protein, 82 aa, Pennisetum glaucum
MAAGGVPTNMQKEQMFGLAEKEMEYRVDLFNRLTQTCFDKCIEKRHKEAELNMGENSCIDRCVSKYWQVTNLVGQLLGNQPK

SEQ ID NO: 9090 - protein, 83 aa, Panicum virgatum
MAAKGFSSNPEKEQMFWMAEKEMEYRVELFNKLTQTCFDKCVEKRYKETELNMGENSCIDRCVSKYWQVSNIVGQMLGNRPQM

SEQ ID NO: 9091 - protein, 85 aa, Musa acuminata
MAAKNGASSIEKEQQIFGMAEKEMEYRVDLFNRLTQTCFDKCIEKRYKESELNMGENSCIDRCVSKYWQVTNIVGQLLGSNRPPM

SEQ ID NO: 9092 - protein, 84 aa, Elaeis guineensis
MAATNAPTNIEKEQIFGMAEKEMEYRVDLFNRLTATCFDKCIEKRYKESELNMGENSCIDRCVSKYWQVTNLIGQLLGSNRPPV

SEQ ID NO: 9093 - protein, 84 aa, Epimedium sagittatum
MATDGVPAGLDKEQVFGMAEKEMEYRVDLFNRLTQTCFNKCIEKKYKESELNMGENSCIDRCVSKYWQVTNLVGGLLGNSRPPM

SEQ ID NO: 9094 - protein, 84 aa, Persea americana
MGSNNAAAGLDKEQIFGMAEKEMEYRVDLFNRLTQTCFDKCIEKRYKESELNMGENSCIDRCVSKYWQVTNLIGQLLGSNRPPM

SEQ ID NO: 9095 - protein, 163 aa, Panicum virgatum
MAGDGRSPTGRCVVLFPFPSESHTTPMLQLAGLLRARGLGVTVLHADLNAPDPARHPGLAFVSIGESLPDEIASSPDLAERVMSLNAACEAPFQAALEDLVRRGEPVACTVVDGQWYRMLGAARPAGVPALALGADSAAAFLAMLAATRPRADGHAPVQGTFQ

SEQ ID NO: 9096 - protein, 82 aa, Panicum virgatum
MAAGGEPTNFQKEQMFGMAEKEMEYRVDMFNRLTQTCFDKCIANRHKEVELNMGENSCIDRCVSKYWQVTSLVGQLLGNAPK

SEQ ID NO: 9097 - protein, 81 aa, Zostera marina
MASPNDLEKEQILGMAEKEMEYRVDLFNRLTKTCFEKCIEKRYKESELNMGENSCIDRCVSKYWQVTNLVGQLLGANRPPM

SEQ ID NO: 9098 - protein, 84 aa, Liriodendron tulipifera
MAANNAAAGLDKEQIFGMAEKEMEYRVDLFNRLTGTCFNKCIEKRYKESELNMGENSCIDRCVSKYWQVTNLIGQLLGSNRPPM

SEQ ID NO: 9099 - protein, 84 aa, Elaeis guineensis
MAAKNGQTSIEKEQIFGMAEQEMEYRVDLFNRLTKLCFDKCIDKRYKETELNMGENSCIDRCVSKYWQVTNLIGQLLASNRPPM

SEQ ID NO: 9100 - protein, 82 aa, Amborella trichopoda
MSTNPTALEKEQIFGMAEKEMEYRVDLFNRLTQTCFHKCIEKRYKDSELNMGENSCIDRCVSKYWQVTNLIGQLLGSNKPPL

SEQ ID NO: 9101 - protein, 88 aa, Papaver somniferum
MAANSAQAAAQAAFEKDQMFGMAANEMEYRVDLFNRLTQTCFNKCIEKRYKEAELNMGENSCIDRCVSKYWQVTNLVGQLLGSNRPPM

SEQ ID NO: 9102 - protein, 90 aa, Oryza sativa
MAAKGQPVNVQKEQVNMQKEQMFGLAEKEMEYRVDLFNRLTQTCFSKCIEKRHKEAELNMGENSCIDRCASKYWQVTNLVGQLLGNQPQM

SEQ ID NO: 9103 - protein, 85 aa, Sarracenia psittacina
MAANNNPPNQLDKEQIFGMAEKEMEYRVELFNKLTHTCFNKCVEKRYKEAELNMGENSCIDRCVSKYWQVTNLIGQLLGSNRPPM

SEQ ID NO: 9104 - protein, 85 aa, Helianthus annuus
MAANNNMPTALDKEQIFGMAEKEMEYRVELFNKLTQTCFAKCVEKRYKESELNMGENSCIDRCVSKYWQVTNLVGQLLGSGRPPM

SEQ ID NO: 9105 - protein, 214 aa, Setaria italica
MPPPPPPPTPALNKCCRCCSSPSPPTPPKLQRAAETRKKPICTAGGGAARLPITRRAHAASLLLGLVGVDVAVAAPAPARADDESGGGEEGVLGAIKSIFDPNEKTKAGKVLPKAYLKAAREVVRTLRESLEEDDGGDMAKFRRNADAAKESIREFLGGWRGQQAVAAEESYVALEKAIRSLAEFYSKAGPSAPLPQDVKNKILDDLSTADAYL

SEQ ID NO: 9106 - protein, 247 aa, Panicum virgatum
MAAAAANGKSSPVKNGAGTRGKPIKCKAAVAWGPGEPLAMEEVEVAPPGRLEVRVKVLFTSVCHTDLSAWKGENELQRKFPRIFGHEAAGVVESVGEGVEDLVPGDHVVPIFTGECRECVYCESDKTNLCGTYRVNPFKSTMVSDNGTRFSVVDRSGVRQPVYHFLNTSTFTEYTVLDAACAVKINPKAPLERMYLLSCGISTGVGAAWNTANVSKGSTVAVFGLGAVGLAAAEGCQAAGGSSDNRC

SEQ ID NO: 9107 - protein, 401 aa, Panicum virgatum
MAAAAANGKSSPVKNGAGTRGKPIKCKAAVAWGPGEPLAMEEVEVAPPGRLEVRVKVLFTSVCHTDLSAWKGENELQRKFPRIFGHEAAGVVESVSEGVEDLVPGDHVVPIFTGECRECVYCESDKTNLCGTYRVNPFKSTMVSDNGTRFSVVDRSGVRQPVYHFLNTSTFTEYTVLDAACAVKINPKAPLERMYLLSCGISTGVGAAWNTANVSKGSTVAVFGLGAVGLAAAEGARLRGVARIIGVDINPEKFIKGKEMGVTDFINSKACGKPVHEVIREMTDGGVDYSFECTGMNDVLREAFVSTHDGWGLTVVLGIHATPKMMPLHPMELFDGRRITGCVFGDFKGKSQLPDLVDKCINGEVNINFDGFITHKMPFSDINKAFQLLEEGKSLRCLLNL

SEQ ID NO: 9108 - protein, 618 aa, Zea mays
MSAIAASSAAAAAASNSDEEENYEEYIPVAKRRAMEAERLRQLRLSKSAPASAVSSLPMPPPPPLLPAQTSVPDAAAKPSLLVKATQLKRAAPEVTATEQRIQQEKEVIENLSDNKSLRSVREIAKGIIYTEPIQTGWKPPLRLRRMPLAKANEFRRKWHIIVDGDDIPPPARDFRDLRLPEPMLRKLRERGIVQPTPIQVQGLPVVLSGRDMIGIAFTGSGKTLVFVLPLIMVALQEESLMPIVPGEGPFGMIICPSRELAKQTYDVIEQFLIPLKEAGYPEIRHLLCIGGVDMRTQLDVLKKGVHIVVATPGRLKDLLAKKKMNLDNCRYLTLDEADRLVDLGFEDDIKEVFDHFKDQRQTLLFSATMPQKIQNFAKNALVKPVTVNVGRAGAANLDVIQEVEYVKEDARIIYLLECLQKTPPPVLIFCENKADVDYIHEYLLLKGVEAVAIHGGKDQEERQNAIDSFKTGRKDVLVATDVASKGLDFPDIQHVINYDMPAEIENYVHRIGRTGRCGKTGIATTFINKNQTETTLLDLKHLLKEAKQRIPPVLAELNDPLDDEEIIAKESGVKGCAYCGGLGHRVSDCPKLEHQKSMAIAGSRKDYFGGGGYRGEI

SEQ ID NO: 9109 - protein, 620 aa, Setaria italica
MAATAAASAAAAAAAANSDDDNNYEEYIPVAKRRALEAERLRQLRLSKPAPSSAASSLAMPPPPPPPPTQPSAPDAAAKPSLLVKSTQLKRAAPEVTATEQRIQQEKEVIENLSSDSKSLRSVREIAKGIIYTEPIQTGWKPPLRLRRMPLAKANELRRKWHIIVDGNDVPPPARDFRDLRLPEPILRKLRERGIVQPTPIQVQGLPVVLSGRDMIGIAFTGSGKTLVFVLPLIMVALQEEILMPIVPGEGPFGMIICPSRELAKQTYDVIEEFLLPLKDAGYPEIRPLLCIGGVDMRTQLDVLKKGVHIVVATPGRLKDLLAKKKMNLDNCRYLTLDEADRLVDLGFEEDIKEVFDHFKDQRQTLLFSATMPQKIQNFAKNALVQPVTVNVGRAGAANLDVIQEVEYVKEDARIIYLLECLQKTPPPVLIFCENKVDVDYIHEYLLLKGVEAVAIHGGKDQEERQNAIDSFKSGKKDVLVATDVASKGLDFPDIQHVINYDMPAEIENYVHRIGRTGRCGKTGIATTFINKNQTETTLLDLKHLLKEAKQRIPPVLAELDDPLEDEEIIAKESGVKGCAYCGGLGHRVGDCPKLEHQKSMAIAGSRKDYFGGGGYRGEI

SEQ ID NO: 9110 - protein, 581 aa, Pennisetum glaucum
RLRRLRLSKPAPSSAASSLAMPPPPPPPPMQPSAPDAAAKPSLLVTATQLKRAAPEVTATEQRIQQEKEVIENLSSDSKSLRSVREIAKGIIYTEPIKTGWKPPLRLRRMPLAKANELRRKWHIIVDGDDVPPPARDFRDLRLPEPMLQKLRERGIVQPTPIQVQGLPVVLSGRDMIGIAFTGSGKTLVFVLPLIMVALQEEILMPIVPGEGPFGMIICPSRELAKQTYDVIEQFLLPLKDAGYPEIRPLLCIGGVDMRTQLDVLKKGIHIVVATPGRLKDLLAKKKMNLDNCRYLTLDEADRLVDLGFEDDIKEVFDHFKDQRQTLLFSATMPQKIQNFAKNALVKPVTVNVGRAGAANLDVIQEVEYVKEDARIIYLLECLQKTPPPVLIFCENKVDVDYIHEYLLLKGVEAVAIHGGKDQEERQNAIDSFKSGKKDVLVATDVASKGLDFPDIQHVINYDMPAEIENYVHRIGRTGRCGKTGIATTFINKNQTETTLLDLKHLLKEAKQRIPPVLAELDDPLEDEEIIAKESGVKGCAYCGGLGHRVADCPKLEHQKSMAIAGSRKDYFGGGGYRGEI

SEQ ID NO: 9111 - protein, 627 aa, Oryza sativa
MAAATASSPATAAAANSDDEDNYEEYIPVAKRRAMEADRLRRLRLSKPAPPSSSAAEAASDLPPPPPPPPNQPSAGGGGGGLEASAKPSLLVKATQLKRAAPEVTHTEQLIMQEKEMIEHLSDRKTLMSVRELAKGITYSDPLKTGWKPPLRLRRMPRAKADELRRKWHILVDGDDVPPPARDFRDLRLPEPMLRKLREKGIVQPTPIQVQGLPVVLSGRDMIGIAFTGSGKTLVFVLPLIMVALQEEMMMPIVPGEGPFGMIICPSRELAKQTYDVIEQFLVPLKEAGYPEIRPLLCIGGVDMRAQLDVVKKGVHIVVATPGRLKDLLAKKKMNLDNCRYLTLDEADRLVDLGFEDDIREVFDHFKAQRQTLLFSATMPKKIQNFAKSALVKPVIVNVGRAGAANLDVIQEVEYVKEDARIIYLLECLQKTPPPVLVFCENKADVDYIHEYLLLKGVEAVAIHGGKDQEERENAIEFFKNGKKDVLVATDVASKGLDFPDIQHVINYDMPAEIENYVHRIGRTGRCGKTGIATTFINKNQTETTLLDLKHLLKEAKQRIPPVLAELNDPLEDEETMAKESGVKGCAYCGGLGHRVTDCPKLEHQKSMAIAGSRRDYYGGGGYRGEI

SEQ ID NO: 9112 - protein, 340 aa, Oryza sativa
MAAATASSPATAAAANSDDEDNYEEYIPVAKRRAMEADRLRRLRLSKPAPPSSSAAEAASDLPPPPPPPPNQPSAGGGGGGLEASAKPSLLVKATQLKRAAPEVTHTEQLIMQEKEMIEHLSDRKTLMSVRELAKGITYSDPLKTGWKPPLRLRRMPRAKADELRRKWHILVDGDDVPPPARDFRDLRLPEPMLRKLREKGIVQPTPIQVQGLPVVLSGRDMIGIAFTGSGKTLVFVLPLIMVALQEEMMMPIVPGEGPFGMIICPSRELAKQTYDVIEQFLVPLKEAGYPEIRPLLCIGGVDMRAQLDVVKKGVHIVVATPGRLKDLLAKKKMNLDNCR

SEQ ID NO: 9113 - protein, 615 aa, Secale cereale
MPPGAAAAATKSDDEDNYEEYIPVSKRRAMEADRLRHQRLSKPAAAASAGSLPPPPPPPTANPAAAPDDAAPAAKPSLLVTSTQLKRAAPEVTATEQIILQEKEMIDNLSNKNTLMSVRELAKGITYTEPLRTGWKPPLRLRRMPRTKADELRRKWHILVEGDEIPPPARDFRDLRFPEPVLRMLREKGIVQPTPIQVQGLPVVLSGRDMIGIAFTGSGKTLVFVLPLIMVALQEEMLMPIVPGEGPFGMIICPSRELAKQTYDVIEMFLTPLKQAGFPEIRPLLCIGGIDMRTQLDVVKKGVHIVVATPGRLKDLLAKKKMNLDNCRYLTLDEADRLVDLGFEDDIREVFDHFKAQRQTLLFSATMPKKIQNFAKSALVKPVIVNVGRAGAANLDVIQEVEYVKEDARIIYLLECLQKTPPPVLIFCENKADVDYIHEYLLLKGVEAVAIHGGKDQEERQNAIEFFKNGKKDVLVATDVASKGLDFPDIQHVINYDMPAEIENYVHRIGRTGRCGKTGIATTFINKNQTETTLLDLKHLLKEAKQRIPPVLAELVDPLEDAEAIAKESGVKGCAFCGGLGHRLADCPKLEHQKSVAIAGSRRDYYGGGGYRGEI

SEQ ID NO: 9114 - protein, 613 aa, Brachypodium distachyon
MAPAAVTPAAKSDDEDNYEEYIPVAKRRAMEADRLRNRRISKPAAASDGSPASLPPPPPPPPTNSPAPDAAAAKPSLLVTSTQLKRAAPEVTATEQVILQEKEMIENLSDRKTLMSVRELAKGITYTEPLLTGWKPPLRLRRMPRTKADELRRKWHILVEGDEVPPPARQFQDLRFPEPILRMLREKGIVQPTPIQVQGLPVVLSGRDMIGIAFTGSGKTLVFVLPLIMVALQEEMMMPIVAGEGPFGMIICPSRELAKQTYDVIEMFLAPLKQAGFPEIRPLLCIGGIDMRTQLDVVKRGVHIVVATPGRLKDLLAKKKMNLDNCRYLTLDEADRLVDLGFEDDIREVFDHFKAQRQTLLFSATMPKKIQNFAKSALVKPVIVNVGRAGAANLDVIQEVEYVKEDARIIYLLECLQKTPPPVLIFCENKADVDYIHEYLLLKGVEAVAIHGGKDQEERQNAIEFFKNGRKDVLVATDVASKGLDFPDIQHVINYDMPAEIENYVHRIGRTGRCGKTGIATTFINKNQTETTLLDLKHLLKEAKQRIPPVLAELIDPEDAETIAKESGVRGCANCGGLGHRLAECPKLEHEKSVAIAGSRRDYYGGGGYRGEI

SEQ ID NO: 9115 - protein, 614 aa, Triticum aestivum
MPPGAAAAAKSDDEDDYEEYIPVSKRRAMEADRLRHQRLSKPAAAASAGSLPPPPPPPAANPAAAPDDAAPAAKPSLLVTSTQLKRAAPEVTATEQIILQEKEMIDNLSNKNTLMSVRELAKGITYTEPLRTGWKPPLRLRRMPRTKADELRRKWHILVEGDEIPPPARDFRDLRFPEPVLRMLREKGIVQPTPIQVQGLPVVLSGRDMIGIAFTGSGKTLVFVLPLIMVALQEEMLMPIVPGEGPFGMIICPSRELAKQTYDVIDMFLTPLKQAGFPEIRPLLCIGGIDMRTQLDVVKKGVHIVVATPGRLKDLLAKKKMNLDNCRYLTLDEADRLVDLGFEDDIREVFDHFKAQRQTLLFSATMPKKIQNFAKSALVKPVIVNVGRAGAANLDVIQEVEYVKEDARIIYLLECLQKTPPPVLIFCENKADVDYIHEYLLLKGVEAVAIHGGKDQEERQNAIEFFKNGKKDVLVATDVASKGLDFPDIQHVINYDMPAEIENYVHRIGRTGRCGKTGIATTFINKNQTETTLLDLKHLLKEAKQRIPPVLAELVDPLEDAEAIAKESGVKGCAFCGGLGHRLADCPKLEHQKSVAIAGSRRDYYGGGGYRGEI

SEQ ID NO: 9116 - protein, 873 aa, Setaria italica
MAASASAAAGKLAAALHRRTHRVTSALAHAALEWVLIALLLINGLLAYAIDRFADYFGLAPPCLLCSRVDRLFQADGGEAGGARWLRDALCGDHAAEISALGYCLRHRRLAEGREMCEDCLSSTKEKTRDAAEKSARACACCKAVVRTSSRELEGTREEHVEEKITEEVTDDDQGYVLLAQEDHEEEEEEQDEVEKQERQSEVEGQHQQEKDEAMAAVQDESLEVMAQGQGEEIALEDDRLVPVVALDEMTIADDSGLHRDVEEADGMNQVAEDEQDSRDVDIGVVLEEKRMLDSSVATPADVIEDSVVPISPIPCPETVASPSHPDHNSNSQDDEDVPEDAVEVGDSTAEEDHIFVPHETVSEDDRTAEVDTNCEVSIGSDICEREQDDHVVPFQDLATHEEQVAPLAGADDQPSPLEILASTEQEAGEAEQEEMTTNTGSDYQPNEQNEVEEDKAPETPTNGVAAQLSDRMFLLERKRSLSLSLDGSVASEMEGGEPSTVDQLKSALQAERKALGALYAELEEERSAAAIAASQTMAMINRLQEEKAAMQMEALQYQRMMEEQSEYDQEALQLLNELVTKREREKQELERELELFRQKVQRYEDKERRRMASFKANGGSPSGSGSGTSVSSSGEDSDGHSDDYCELGESPDGGNIQMSSSDAALSSMRDPDSTKHLVALDDSLTYFEMERLSILEELKTLEERLFTLEDDDVTANAAAGHSSGDMDLSADVLHSPEDILTGDKARCRGRTSISRGKSLLPLFDAVGNETCDQMPSARVGEADQADDSATKPASVLAKEQERLAIIEEVDHVYERLQALEADKEFLRHCIKSLKKGDKGMDLLQEILQHLRDLRNVELHVKNAGDAIAANSV

SEQ ID NO: 9117 - protein, 864 aa, Panicum virgatum
MAASASAGRLATALHRRTHRVTSALAHAALEWVLIALLLINGLLAYAIARFADYFGLAPPCLLCSRVDRLFQAGGGESGGARWLRDALCGDHAAEISALGYCLRHRRLAEAGEMCEGCLSSCKEETSDAREKSATACSCCKVAVRTSSREPEGIKEEHAEEKVTEEGNDDDQGYVLLAQEDHEEEEQDEVENQEQQSEVEGQRREEDEVMAAVQDESLEVMVQGEEIALEDGRLVPVVVLDEMTIADDSGLHWDVEGEDGMNQVEDEPESRDVDIGVVLEEKRMLDSSVATPADVIQDSAVPISPIPCPETVSSPAHPDHNSIPQDDEDVPEDAVEIGDSTAEEDRIFVPQVSEAVCEDDNRTAEVDTNCEVSIGSDICEREQDDHVVPFQDLAALEDPVAAVAGADDQPSPLEILAPTEQGEAEQEEVVRSTGLDNQPTGQNEMEEDKAPETPTNSVATQRSDRMFLLERKRSLSLSLDGSVASEMDGGEPSTVDQLRSALQAERKALGALYAELEEERSAAAIAAYQTMAMINRLQEEKAAMQMEALQYQRMMEEQSEYDQEALQLLNELVTKREREKQELERELELCRQRVQHYEDKERRRMASFKANNGGSPSGSGASVSSSGEDSDGHSDDYCELAESPDGGNIQSSSDAALSSVRDQDSTKHLVALDDSLTYFEMERLSILEELKALEERLFTLEDDDITGNAAAGHSSGDLDLSPDGLQSPEHILTGDKQRFGGRTSISRGKSLLPLFDAVGDETCNQMPSTRAGDAGQADDSATKSVSVLVKEQERLAIIEEVDHVYERLQALEADKEFLRHCIKSLKKGDRGMDLLQEILQHLRDLRNVELHVKNAGDAIATNSV

SEQ ID NO: 9118 - protein, 303 aa, Saccharum officinarum
MNNLLTDSFELPRRDSSRDADIEMGMHQADASDNLKDFLKKVDAIESLIAKLTNLLNKLQTANEESKAVTKASSMKAIKQRMEKDIDEVGKIARQAKTKVDELEKDNLSNRQKPGCGKGSAVDRSREQTTGAVKKKLKERMDDFQTLREAIRQEYREVVERRVFTVTGNRPDEETIDDLIETGKSEQIFKDAIQHQGRGQILDTVAEIQERHDAVRDLERKLLELQQIFMDMAVLVEAQGDMINNIETHVSNATNHIQHGVTALQNAKKLQKNSRKWMCYAIILLLVIVVVIVVAVIQPWKKG

SEQ ID NO: 9119 - protein, 304 aa, Zea mays
MNNLLTDSFELPRRDSSRDADIEMGMHQADASDNLKDFLKKVDTIESLIAKLTNLLNKLQTANEESKAVTKASSMKAIKQRMEKDIDEVGKIARQAKTKVDELEKDNLSNRQKPGCGKGSAVDRSREQTTGAVKKKLKERMDDFQTLREAIRQEYREVVERRVFTVTGNRPDEETIDDLIETGKSEQIFKDAIQHQGRGQILDTVAEIQERHDAVRDLERKLLELQQIFMDMAVLVEAQGDMINNIETHVSNATNHIQQGVSALQNAKKLQRNSRKWMCYAIIILLVIVVVIVVAVIQPWKKGT

SEQ ID NO: 9120 - protein, 302 aa, Zea mays
MNNLLTDSFELPRRDSSRDADIEMGMHQADASDNLKDFLKKVDAIESIIAKLSNLLNKLQTANEESKAVTKASSMKAIKQRMEKDIDEVGKIARQAKTKVDELERDNLSNRQKPGCGKGSAVDRSREQTTGAVKKKLKERMDDFQTLREAIRQEYREVVERRVFTVTGNRPDEETIDDLIETGKSEQIFKDAIQHQGRGQILDTVAEIQERHDAVRDLERKLLELQQIFMDMAVLVEAQGDMINNIETHVSNATNHIQQGVSALQNAKKLQKNSRKWMCYAIILLLVIVAVIVVAVIQPWKK

SEQ ID NO: 9121 - protein, 304 aa, Panicum virgatum
MNNLLSDSFELPRRDSSRDADIEMGLHQADASDNLKDFLKKVDAIESLIAKLTNLLNKLQTANEESKAVTKASAMKAIKQRMEKDIDEVGKIARQAKTKVDELEKDNLSNRQKPGCGKGSAVDRSREQTTGAIKKKLKERMDDFQALREAIRQEYREVVERRVFTVTGNRPDEETIDDLIETGKSEQIFKDAIQQQGRGQILDTVAEIQERHDAVRDLERKLLELQQIFMDMAVLVEAQGDMINNIETHVSNATNHIQQGVSALQNAKRLQKNSRKWMCYAIIILLVIVVIIVVAVIQPWKKGT

SEQ ID NO: 9122 - protein, 303 aa, Setaria italica
MNNLLSDSFELPRRDSSRDADIEMGMHQADASDNLKDFLKKVDAIESLIAKLTNLLTKLQTANEESKAVTKASAMKAIKQRMEKDIDEVGKFARQAKTKVDELEKDNLSNRQKPGCGKGSAVDRSREQTTGAVKKKLKERMDDFQALREAIRQEYREVVERRVFTVTGNRPDEETIDDMIETGKSEQIFKDAIQQGRGQILDTVAEIQERHDAVRDLERKLLELQQIFMDMAVLVEAQGDMINNIETHVSNATNHIQQGVSALQNAKKLQKNSRKWMCYAIIILLVIVVIIVVAVIQPWKKGA

SEQ ID NO: 9123 - protein, 304 aa, Pennisetum glaucum
MNNLLTDSFELPRRDSSRDADIEMGMHQADASDNLKGFLKKVDAIEGLIAKLTNLLTKLQTANEESKAVTKANAMKAIKQRMEKDIDEVGKIARLAKTKVDELEKDNLSNRQKPGCGKGSAVDRSREQTTGAVKKKLKERMDDFQALREAIRQEYREVVERRVFTVTGNRPDEETIDDMIETGKSEQIFKDAIQQQGRGQILDTVAEIQERHDAVRDLERKLLELQQIFMDMAVLVEAQGDMINNIETHVSNATNHIQQGVSALQNAKKLQKNSRKWMCYAIILLLVIVVVIVVAVIQPWKKGA

SEQ ID NO: 9124 - protein, 304 aa, Cenchrus ciliaris
  misc_feature (23)..(23): Xaa can be any naturally occurring amino acid
MNNLLSDSFELPRRDSSRDADIXMGMHQADASDNLKGFLKKVDAIEGLIAKLTNLLTKLQTANEESKAVTKASAMKAIKQRMEKDIDEVGKIARLAKTKVDELEKDNLSNRQKPGCGKGSAVDRSREQTTGAVKKKLKERMDDFQALREAIRQEYREVVERRVFTVTGNRPDEETIDDMIETGKSEQIFKDAIQQQGRGQILDTVAEIQERHDAVRDLERKLLELQQIFMDMAVLVEAQGDMINNIETHVSNATNHIQQGVGALQHAKKLQKNSRKWMCYAIILLLVIVVVIVVAVIQPWKKGA

SEQ ID NO: 9125 - protein, 303 aa, Panicum virgatum
MNNLLSDSFELPRRDSSRDADIEMGMHQADASDNLKDFLKKVDVIESLIAKLTNLLNKLQTANEESKAVTKASAMKAIKQRMEKDIDEVGKIARQAKTKVDELEKDNLSNRQKPGCGKGSAVDRSREQTTGAVKKKLKERMDDFQALREAIRQEYREVVERRVFTVTGNRPNEETIDDLIETGKSEQIFKDAIQQQGRGQILDTVAEIQERHDAVRDLERKLLELQQIFMDMAVLVEAQGDMINNIETHVSNATNHIQQGVSALQNAKKLQKNSRKWMCYAIIILLVIVVIVVVGIIQPWKKG

SEQ ID NO: 9126 - protein, 229 aa, Panicum virgatum
MKAIKQRMEKDIDEVGKIARQAKTKVDELEKDNLSNRQKPGCGKGSAVDRSREQTTGAVKKKLKERMDDFQALREAIRQEYREVVERRVFTVTGNRPNEETIDDLIETGKSEQIFKDAIQQQGRGQILDTVAEIQERHDAVRDLERKLLELQQIFMDMAVLVEAQGDMINNIETHVSNATNHIQQGVSALQNAKKLQKNSRKWMCYAIIILLVIVVIVVVGIIQPWKKG

SEQ ID NO: 9127 - protein, 302 aa, Triticum aestivum
MNNLLTDSFELPRRDSSRDGDVEMGMHQPDASDNLKGFLKKVDGIESLIAKLTNLLTKLQTANEESKAVTKASAMKAIKQRMEKDIDEVGKIARMAKTKVDELEKDNLSNRQKPGCGKGSAVDRSREQTTGAVKKKLKERMDDFQVLRESIRQEYREVVERRVFTVTGNRPDEETIDDLIETGRSEQIFKDAVQQQGRGQILDTVAEIQERHDAVRDLERKLLELQQIFLDMAVLVEAQGDMINHIETHVSNATNHIQQGVGALQNAKKLQKNSRKWMCYAIILLLVIVVIIVVAVIQPWKK

SEQ ID NO: 9128 - protein, 302 aa, Secale cereale
MNNLLTDSFELPRRDSSRDGDVEMGMHQPDASDNLKGFLKKVDGIESLIAKLKNLLTKLQTANEESKAVTKASAMKAIKQRMEKDIDEVGKIARMAKTKVDELEKDNLSNRQKPGCGKGSAVDRSREQTTGAVKKKLKERMDDFQVLRESIRQEYREVVERRVFTVTGNRPDEETIDDLIETGRSEQIFKDAVQQQGRGQILDTVAEIQERHDAVRDLERKLLELQQIFLDMAVLVEAQGDMINHIETHVSNATNHIQQGVGALQNAKKLQKNSRKWMCYAIILLLVIVVIIVVAVIQPWKK

SEQ ID NO: 9129 - protein, 302 aa, Hordeum vulgare
MNNLLTDSFELPRRDSSRDGDVEMGMHQPDASDNLKGFLKKVDGIESLIVKLTNLLTKLQSANEESKAVTKASAMKAIKQRMEKDIDEVGKIARMAKTKVDELEKDNLSNRQKPGCGKGSAVDRSREQTTGAVKKKLKERMDDFQVLRESIRQEYREVVERRVFTVTGNRPDEETIDDLIETGRSEQIFKDAVQQQGRGQVLDTVAEIQERHDAVRDLERKLLELQQIFLDMAVLVEAQGDMINHIETHVSNATNHIQQGVGALQNAKKLQKNSRKWMCYAIILLLVIVVIIVVAVIQPWKK

SEQ ID NO: 9130 - protein, 302 aa, Brachypodium distachyon
MNNLLTDSFELPRRDSSRDGDIEMGMHQADASDNLKGFLKKVDGIEGLIAKLTNLLTKLQTANEESKAVTKASAMKAIKQRMEKDIDEVGKIARTAKTKVDELEKDNLSNRQKPGCGKGSAVDRSREQTTGAVKKKLKERMDDFQVLRESIRQEYREVVERRVFTVTGNRPDEETIDDLIETGRSEQIFKDAVQQQGRGQVLDTVAEIQERHDAVRDLERKLLELQQIFLDMAVLVEAQGDMINHIETHVSNATNHIQQGVGALQNAKKLQKNSRKWMCYAIILLLVIVAIIILAVIQPWKK

SEQ ID NO: 9131 - protein, 121 aa, Secale cereale
MNNLLTDSFELPRRDSSRDGDVEMGMHQPDASDNLKGFLKKVDGIESLIAKLKNLLTKLQTANEESKAVTKASAMKAIKQRMEKDIDEVGKLARMDKNQVDELEKDNLSNRQKPGCGKGLQ

SEQ ID NO: 9132 - protein, 303 aa, Oryza sativa
MNNLLTDSFELPRGGSSRDGDIEMGMQADPSDNLKGFLKKVDAIESLIAKLTNLLHKLQTANEESKAVTKARDMKAIKQRMEKDIDEVGKIARMAKTKVDELEKDNLSNRQKPGCGKGSAVDRSREQTTGAVKKKLKERMDDFQVLREAIRQEYRDVVERRVFTVTGSRPDEETVDNLIETGRSEQIFQEAIQQQGRGQILDTVAEIQERHDAVRDLERKLLELQQIFMDMAVLVDAQGDMINNIETHVSNATNHIQQGVSALQNAKKLQKNSRKWMCYAIILLLIIVVIIVVAVIQPWKKGA

SEQ ID NO: 9133 - protein, 188 aa, Triticum aestivum
MWEGVCSRSIKRTDYWSSQKKLKERMDDFQVLRESIRQEYREVVERRVFTVTGNRPDEETIDDLIETGRSEQIFKDAVQQQGRGQILDTVAEIQERHDAVRDLERKLLELQQIFLDMAVLVEAQGDMINHIETHVANATNHIQQGVGALQKAKTLQKNSRKWMCYAIILLLVVVAIVVLGVIQPWKKK

SEQ ID NO: 9134 - protein, 291 aa, Avena sativa
MNNLLTDSFELPRRDSSRDGDVEMGMHQPDASDNLKGFLKKVDGIESLIAKLTALLTKLQTANEESKAVTKASAMKAIKQRMEKDIDEVGKIARMAKAKFDELEKDNLSNRQKPGCGKGSAVDRSREQTTGAVKKKLKGRMDEFQVLRESIRQEYREVVERRVFTVTGNRPDEETIDDLIETGRSEQIFKDAVQQQGRGQILDTVAEIQERHDAVRDLERKLLELQQIFLDMAVLVDAQGDMINHIETHVSNATNHISQGVGALQNAKKLQRNSRKWMCYAIILLLVVVVI

SEQ ID NO: 9135 - protein, 281 aa, Leymus cinereus x Leymus triticoides
  misc_feature (234)..(234): Xaa can be any naturally occurring amino acid
VAVVEMGMHQPDASDNLKGFLKKVDGIESLIAKLTNLLTKLQTANEESKAVTKASAMKAIKQRMEKDIDEVGKIARMAKTKVDELEKDNLSNRQKPGCGKGSAVDRSREQTTGAVKKKLKERMDDFQVLRESIRQEYREVVERRVFTVTGNRPDEETIDDLIETGRSEQIFKDAVQQQGRGQILDTVAEIQERHDAVRDLERKLLELQQIFLDMAVLVEAQGDMINHIETHVSXATNHIQQGVGALQNAKKLQKNSRKWMCYAIILLLVIVVIIVVAVIQP

SEQ ID NO: 9136 - protein, 304 aa, Secale cereale
MNNLLTDSFELPRRDSSRDVGDLEMGVHHPDASDNLQAFYKKVDAIDTLIAKLTTLFTKLQTANGESKAVTKASAMKAIKQRMEKDIDEVGKIARMAKTKLDQLEKDNSSNRQKPGCGKDSAVDRSREQITGGVKNKLKERMDSFQVLRESIQQEYREVVERRVFTVTGNRPDEETIDDLIETGRSEQIFKDAVQQQGRGQVLDTVAEIQERHDAVRDLERKLLELQQIFLDMAVLVEAQGDMINNIETHVSNATNHIQDGVGALQKAKTLQKNSRKWMCYAIILLLVVVVIVVLGVIQPWKKK

SEQ ID NO: 9137 - protein, 229 aa, Secale cereale
MKAIKQRMEKDIDEVGKIARMAKTKLDQLEKDNSSNRQKPGCGKDSAVDRSREQITGGVKNKLKERMDSFQVLRESIQQEYREVVERRVFTVTGNRPDEETIDDLIETGRSEQIFKDAVQQQGRGQVLDTVAEIQERHDAVRDLERKLLELQQIFLDMAVLVEAQGDMINNIETHVSNATNHIQDGVGALQKAKTLQKNSRKWMCYAIILLLVVVVIVVLGVIQPWKKK

SEQ ID NO: 9138 - protein, 306 aa, Hordeum vulgare
AAYIHLLPILQDSFELPRRDSSTDLEMGMHHPDASHNLQAFLNKVDGIDSLIAKLATLFTKLQSANEESKAVTKASAMKEIKQRMEKDIDEVGKVARLAKTKLDQLEKDNLSNRQKPGCDKDSAVDRSREQTTGAVKKKLKKRMDDFQVLRESIRQEYRQVVERRVFTVTGNRPDEETIDDLIETGRSEQIFKDAVQQQGRGQILDTVAEIQERHDAVRDLERKLLELQQIFLDMAVLVEAQGDMINHIETHVSNATNHIQQGVGALQKAKTLQKNSRKWMCYAIILLLVVVAIVVLGVIQPWKKK

SEQ ID NO: 9139 - protein, 337 aa, Hordeum vulgare
IVLAYESSTIGLSDRIHNNQALVQVLQYIRYIFYLNIPILQDSFELPRRDSSRDGDVEMGMHQPDASDNLKGFLKKVDGIESLIAKLTNLLTKLQSANEESKAVTKASAMKAIKQRMEKDIDEVGKIARMAKTKVDELEKDNLSNRQKPGCGKGSAVDRSREQTTGAVKKKLKERMDDFQVLRESIRQEYREVVERRVFTVTGNRPDEETIDDLIETGRSEQIFKDAVQQQGRGQVLDTVAEIQERHDAVRDLERKLLELQQIFLDMAVLVEAQGDMINHIETHVSNATNHIQQGVGALQNAKKLQKNSRKWMCYAIILLLVIVVIIVVAVIQPWKK

SEQ ID NO: 9140 - protein, 549 aa, Zea mays
MASAAARGAAVRSPLLVHHRVPLVHPSGGGSLRVGWPGIAPGREGRRRGAPVGARVFARYSQAQDFSTRLQDRAGELPKLVEDLIQTSISTGPRGAFRMAQGIQAVLGVGGEWLNDLSKTANTSAGIPSQMQLGLLSPLYLRRLFERMGATYIKLGQFVASAPTLFPAEYVEEFQKCFDQAPAVPYDVIESILREELQRPLDSVYEYIDPVPIASASIAQVHGARLKSSQKDVVIKVLKPGIEDTLVADLNFIYVVARVLEFLNPELQRTSLVGIVKDIKESMLEEVDFRKEAANIQAFQGYIDAMGFDRQAKAPFVYQHCSTKRVLTMERLYGVPLTDLDSIRSLVPDPELTLVTALNVWFGSLISCESFHADVHAGNLWLLRDGRIGFIDFGIVGRISPRTWAAMEVFLASFATEDYDAMASALSEMGATGNDINTNEFAKDLRKIFSSIQDLDTEIIVATARTPDATAVSANVVLDERQMNALFLDLVRVSESYGLKFPREFALLMKQLLYFDRYTRLLAPSMNMLRDERINISTNRQPRRTDRFQ

SEQ ID NO: 9141 - protein, 552 aa, Setaria italica
MAAAARCASAARSPLLIHQHRRVPKVPSGGGGSLRVGGAGIGAGRGREGRRRAQVGVRVFARYSQAQDLSTRLQDRVGELPKLVEDLLQTSISTGPRGAFRMAQGIQAVLGVGGEWLNDLSKTANASAGIPAQMQLGLLSPLYLRRLFERMGATYIKLGQFIASAPTLFPAEYVEEFQNCFDRAPAVPYDVIESILREELQRPLDSVYEYIDHVPIASASIAQVHGARLKSSQKDVVIKVLKPGIEDTLVADLNFIYVVARILEFLNPELQRTSLVGIVKDIKESMLEEVDFRKEAANIQAFQGYIDAMGFDRQAKAPFVYQHCSTKRVLTMERLYGVPLTDLDSIRSLVPDPELTLVTALNVWFGSLISCESFHADVHAGNLWLLRDGRIGFIDFGIVGRISPRTWAAMEVFLASFAAEDYDAMASALSEMGATGNDINIDEFAKDLRKIFSSIQDLDTEIIVAAARGPDATAVSANVVLDERQMNALFLDLVRVSESYGLKFPREFALLMKQLLYFDRYTRLLAPSMNMLRDERINISTDRQPRRTDRFQ

SEQ ID NO: 9142 - protein, 546 aa, Triticum aestivum
MAATAAARGTASRSPLLIHHHRLPQVPAGGGGSLRVGALGAGRDWRRRVRVGVRVFARYSSQPQDFSSRLQDRAGELPKLVEDLLQTSISTGPRGAFRMAQGIQALLGVGGEWLNDFSKTANTSEGIPAQMRLGLLSPLYLRRLFERMGATYIKLGQFIASAPTFFPAEYVEEFQNCFDRAPPVPYSEIESILREELQRPLDSVYEYIDPVPIASASIAQVHGARLKSSQKDVVIKVLKPGIEDTLVADLNFIYLVARVLEFLSPELERTSLVAIIKDIKESMLEEVDFRKEAVNMEAFQRYIEAMGFDRQAKSPFVYQHCSTKRVLTMERLYGVPLTDLDSIRSLVPDPELTLVTALNVWFGSLISCESFHADVHAGNLWLLRDGRVGFIDFGIVGRISPRTWAAMEIFLASFATEDYNAMASALSEMGATGNDIDVDSFAKDLQKIFSSLQELDTEIIVAAARSSDATAVSANVVVDERQMNALFLDLVRVSESYGLRFPREFALLMKQLLYFDRYTRLLAPSMNMLRDERINITSNKQTRRMN

SEQ ID NO: 9143 - protein, 548 aa, Triticum aestivum
MAATAAARGAASRSPLLLHHHRLPQVPAGGGGSLRVGALGAGRDWRRRVRVRVGVRVFARYSSQSQDFSSRLQDRAGELPKLVEDLLQTSISTGPRGAFRMAQGIQALLGVGGEWLNDFSKTANTSEGIPAQMRLGLLSPLYLRRLFERMGATYIKLGQFIASAPTFFPAEYVEEFQNCFDRAPPVPYSEIESILHEELQRPLDSVYEYIDPVPIASASIAQVHGARLKSSQKDVVIKVLKPGIEDTLVADLNFIYLVARVLEFLSPELERTSLVAIIKDIKESMLEEVDFRKEAVNMEAFQRYIEAMGFDRQAKSPFVYHHCSTKRVLTMERLYGVPLTDLDSIRSLVPDPELTLVTALNVWFGSLISCESFHADVHAGNLWLLRDGRVGFIDFGIVGRISPRTWAAMEIFLASFATEDYNAMASALSEMGATGNDIDVDSFAKDLQKIFSSLQELDTEIIVAAARSSDATAVSANVVVDERQMNALFLDLVRVSESYGLKFPREFALLMKQLLYFDRYTRLLAPSMNMLRDERINITSNKQTRRMN

SEQ ID NO: 9144 - protein, 545 aa, Triticum aestivum
MAATAVVGAASRSRLLLHHHRLPQVPAGGGGSLRVGALGAGRDWRRRVRVGVRVFARYSSQPQDFSSRLQDRAGELPKLVEDLLQTSISTGPRGAFRMAQGIQALLGVGGEWLNDFSKTANTSEGIPAQMRLGLLSPLYLRRLFERMGATYIKLGQFIASAPTSFPAEYVEEFQNCFDRAPPVPYSEIESILREELQRPLDSVYEYIDPVPIASASIAQVHGARLKSSQKDVVIKVLKPGIEDTLVADLNFIYLVARVLEFLSPELERTSLVAIIKDIKESMLEEVDFRKEAVNMEAFQRYIEAMGFDRQAKSPFVYQHCSTKRVLTMERLYGVPLTDLDSIRSLVPDPELTLVTALNVWFGSLISCESFHADVHAGNLWLLRDGRVGFIDFGIVGRISPRTWAAMEIFLASFATEDYNAMASALSEMGATGNDIDVDSFAKDLQNIFSSLQELDTEIIVAAARSSDAAAVSANVVVDERQMNALFLDLVRVSESYGLKFPREFALLMKQLLYFDRYTRLLAPSMNMLRDERINITSNKHTRRMN

SEQ ID NO: 9145 - protein, 545 aa, Hordeum vulgare
MAATAAARGAASRSPLLLHHHHRLPQVPSGGGGSLRVGALGAGRDRRRRVRGGVRVFARYSSQAQDFSSRLQDRAGELPKLVEDLLQTSISTGPRGVFRMGQGIQVLLGVGGEWLNDFSKTANTSEGIPAQMRLGLLSPLYLRRLFERMGATYIKLGQFIASAPTFFPAEYVEEFQNCFDRAPPVPYSEIESILREELQRPLDSVYEYIDPVPIASASIAQVHGARLKSSQKDVVIKVLKPGIEDTLVADLNFIYLVARVLEFLSPELERTSLVAIIKDIKESMLEEVDFRKEAVNMEAFQRYIEAMGFDKQAKSPFVYQHCSTKRVLTMERLYGVPLTDLDSIRSLVPDPELTLVTALNVWFGSLISCESFHADVHAGNLWLLRDGRVGFIDFGIVGRISSRTWAAMEIFLASFATEDYNAMASALSEMGATGNDIDVDSFAKDLQKIFSSLQELDTEIIVAAARSSDATAVSANVVVDERQMNALFLDLVRVSESYGLKFPREFALLMKQLLYFDRYTRLLAPSMNMLRDERINITSSKQTRE

SEQ ID NO: 9146 - protein, 546 aa, Secale cereale
MAATAAARGVASRSPLLLHHHRLPQVPAGGGGSLRVGALGAGRDWRRRVRVGVRVFARYSSQPQDFTSRLQDRAGELPKLVEDLLQTSISTGPRGAFRMAQGIQSLLGVGGEWLNDFSKTANTSEGIPVQMRLGLLSPLYLRRLFERMGATYIKLGQFIASAPTFFPAEYVEEFQNCFDRAPPVPYSEIESILREELQQPLDSVYEYIDPVPIASASIAQVHGARLKSSQKDVVIKVLKPGIEDTLVADLNFIYLVARVLEFLSPELERTSLVSIIKDIKESMLEEVDFRKEAVNMEAFQRYIEAMGFDRQAKSPFVYQHCSTKRVLTMERLYGVPLTDLDSIRSLVPDPELTLVTALNVWFGSLISCESFHADVHAGNLWLLRDGRVGFIDFGIVGRISPRTWAAMEIFLSSFATEDYNAMALALSEMGATGNDINVDSFAKDLQKIFSSLQELDTEIIVAAARSSDAAAVSANVVVDERQMNALFLDLVRVSESYGLKFPREFALLVKQLLYFDRYTRLLAPSMNMLQDERINMTSNKQTRRMN

SEQ ID NO: 9147 - protein, 548 aa, Brachypodium distachyon
MAAARGAALSRPTILLLQQHHRSLHQVPAVGGGLLRVGAGRRRVRAAGVRVRARYSSSSPSQAQPQDFPSRLQDRAGELPKLVEDLLQTSISTGPRGAFRMAQGIQAVLGVGGEWLNDFSKTANTSAGIPAQMRLGLLSPLYLRRLFERMGATYIKLGQFIASAPTFFPAEYVEEFQNCFDRAPAVPYSEIESILREELQRPLDSVYEYIDPVPIASASIAQVHAARLKSSQKDVVIKVLKPGIEDTLVADLNFIYVVARVLEFLNPELERTSLVAIIKDIKESMLEEVDFRKEAVNIEAFQRYLEAMGFDRQAKAPFVYQHCSTKRVLTLERLYGVPLTDLDSIRSLVPDPELTLVTALNVWFGSLISCESFHADVHAGNLWLLRDGRVGFIDFGIVGRISPRTWAAMEIFLASFATEDYNAMASALSEMGATGTDIDVDSFARDLQKIFSSIQELDTEIIVATARGSDATAVSANVVVDERQMNALFLDLVRVSESYGLKFPREFALLMKQLLYFDRYTRLLAPSMNMLRDERINITTNQQTRRMD

SEQ ID NO: 9148 - protein, 451 aa, Panicum virgatum
MAQGIQAVLGVGGEWLNDLSKTANASAGIPAQMQLGLLSPLYLRRLFERMGATYIKLGQFIASAPTLFPAEYVEEFQNCFDRAPAVPYDVIQSILREELQRPLDSIYEYIDPVPIASASIAQVHGARLKSSQKDVVIKVLKPGIEDTLVADLNFIYVVARVLEFLNPELQRTSLVGIVKDIKESMLEEVDFRKEAANIQAFQGYIDAMGFDRQAKAPFVYQHCSTKRVLTMERLYGVPLTDLDSIRSLVPDPELTLVTALNVWFGSLISCESFHADVHAGNLWLLRDGRIGFIDFGIVGRISPRTWAAMEVFLASFATEDYDAMASALSEMGATGNDINIDEFAKDLRKIFSSIQDLDTEIIVATARGPDATAVSANVVLDERQMNALFLDLVRVSESYGLKFPREFALLMKQLLYFDRYTRLLAPSMNMLRDERINISTNRQPRRTDRFQ

SEQ ID NO: 9149 - protein, 264 aa, Avena sativa
MLEEVDFRKEAVNMEAFQRYINAMGFDRQAKSPFVYRHCSTKRVLTMERLYGVPLTDLDSIRSLVPDPELTLVTALNVWFGSLISCESFHADVHAGNLWLLRDGRVGFIDFGIVGRISPRTWAAMEIFLASFATEDYKAMASALSEMGATGNDIDIDAFTKDLQKIFSSLQELDSEIIVATARSSDATAVSASVVVDERQMNAMFLDLVRISESYGLKFPREFALLMKQLLYFDRYTRLLAPSMNMLRDERINITSNKQTRTID

SEQ ID NO: 9150 - protein, 362 aa, Zea mays
MEPALRELWAESRDLLGLPSSSQDATAVPRVSLPPTPLAFLRDHVSPGRPLLVSAAATRHWPAASLWPTASYLTDALRSTAVSLHLTPDGRADALASHPHPRRPGSSRCFASAHVRRVDFPTAVRLIRGSDPAAGLVAYAQQQDDCLRGEYAAVAGDVDAHVPWATEALGCLPEAVNLWIGNAHSVTSFHKDHYDNIYVVLSGEKHFLLLPPTEHHRLYVRDYPAARYVATEQSSEGGRQLRLKLEMEVPERIVPWSSVDPCPASPEELAVQASSFPLYFDGPAPIRCTVRAGEMLYLPSMWFHHVSQSPGPNGLTIAVNYWYDMQFDIKYAYFNFLRSLEINGCSSGKPDASEGDLEEKKD

SEQ ID NO: 9151 - protein, 356 aa, Brachypodium distachyon
MERAVRELWAESRDLLGLHSPESVQRADLPPTPLAFLRDHVSPGRPLLVSAAATRHWPAASLWPTESYLTDALRSTDVSLHLTPDGRADALAPHPRLPGARCFASAYVRRVDFPTAVRLIRGSGPAAAGGLVAYAQQQDDCLRGEYAAVAGDVDAHVPWASEALGCLPEAVNLWIGNSCSVTSFHKDHYDNVYAVLSGEKHFLLLPPTEHHRLYVRDYPAARYVAENEGEEELTGLKLEMEEPERIVPWSSVDPYPASPEEMAAQVSSFPLYFEGPRPIRCTVRAGEMLYLPSMWFHHVSQSPGPNGLTIAVNYWYDMQFDIKYAYFNFLRSLEISNSPLDNKDAALEGDLEEKND

SEQ ID NO: 9152 - protein, 657 aa, Zea mays
MDGGGEGGSSGGRFPILQANRDPESNWEVDVAKSLEDYLLKICSGEVSGEDGAHSVNFAEAALLLQGSVQVYSRKVEYLYSLVLHALEFLSQKKQEQLENGSAQANQNNPSIIPSEEDDIFIGLDDVPVETRISLDNNVDRDDLQRKIVRPPANLLVFEGDCLDSEASELDSYLLATCDFYGDFLLLDPCDAPAVFDFLQGKHSGKENSVAHQGSAAPSKSQANIFTSPNARSVGTGRKSAPGKVLGGLDPTQENQSSTQETSPDNKHWSDPVEPSFADDVEMHPPDDIEDPVGDYSDDEDPWKPLNPHEPGNLKIRPYRRVKGSPRGVIGISKKKTLKSLFPIAKMVGVVIPEHAKSFEAQQSQEEHYGSQSPPRFEKFLRSFELGEENPNVFGDLKDDNASNTGINFDYDDPDMPNDIDIDLDVPTCPDEIIAITPKGTQDDIDTHENLDDLCRSHLNALLASIAEVEKQSEMDARVSTWKERIEIALEEQDRNPPFDIGSYGEQILDTLSSRTNNTGTASFSEIVSGRPKFEIARTFSALLQLVNGRSVDLDKGKATNELVCYTAENPFHVRLIGPNRRPEMEARFARKRVKSPLQNAGKDGESSLAQHECPNKPLRKNGKIPVKTATRLTPDGKRRRRSSAHLMQPINLESSG

SEQ ID NO: 9153 - protein, 609 aa, Sorghum bicolor
MDGGGGEVGSNSGRFSILQANRDPELNWEVDVAKSLEEYLLKICSGEVSGEDGPHSVNFAEAALLLQGSVQVYNRKVEYLYSLVLHALEFLSQKKQDQLENGSAQANQNDPSTIASEEDDIFMGLDDVPAESRTTLDNNVNRDDLQRKVVRPPANLLVFEGDCLDSEASELDTYLLATCDFYGDFLLLDPCDAPAVFDFLQGKHSGKENSVAHQGSSAPSKSRANVFTSPNARSAGTGRKLSAGKVLAGLDPTQKNPDQSSTQETTPDDDHWSDPVESSFDDDVGMPHPADIEDPVGDYSDDEDPWKPLNPHEPGNLKIRPYRRVKGSPRVFLRSFEFGEENPNVFGDLKDDDGSNTGLNFDNDDPDMPNDIDVDPDVPTYPDETIAPTPNGTQDDIDTHASLDDLCRSHLNALLASIAEVEKQSEMDARVSTWKERIEDALEEQDKNPPFDIGSYGEQILDTLSSRTDNTGTASFSEIVSGRPKYEVARTFSALLQLVNGRSVDLDKGQAMNELVCYTAENPFHVKLIGPNRRPEMEARFARKRVKSPLQNAGKGGESSLTQHECPKKPLHRNGKSPVKTATRLTPDGKRRRRSAAHLMQPINLEGSG

SEQ ID NO: 9154 - protein, 676 aa, Zea mays
MDSGGGEGGSTGGRFPILQANRDPESNWEVDVAKSLEQYLLKICSGEVSGEDESHSVNFAEAALLLQGSVQVYSRKVEYLYSLVLHAIEFLSHKKQDQQENVTAQSNQSDPSTIPSEDYIFMGLDDVLMETRTSLDNNVDRDDLQRKIVRPPANLLVFEGDVLDSEASELDSYLLSTCDFYGDFLLLDPCDAPSVFDFLQGKHSGKENSVARQGSPAPSKSQANVFTSPNARSAGTGCKAASGKVLGGLDSTQKNPDQPSTQETSPDDKHWSDPVEPNFTDDVEKPHPDDIGDPVGDYSDDEDPWKPLNPHEPGSLKIRPYRRVKGSLRGVIGTLRKKTLTSIFPVAKMVGVIIPEHAKSFEAQQSQQEEHYGSQSPPRFEKYLASFEFGEENSNVFGDLKDDNGSDIGINFDYNDPDMPNDIDVDPDVPTYPDEIIAATPKGTHGTQDDRDTRESLDDLCRSHLNALLASIAEVEKQSEMDARVSTWKERIEIALEEQDKNPPFDIGSYGEQILDALSSRTDSTGTASFSEIVCGRPKYEVARTFSALLQLVNSRSVYLDKGQATNELVCYTAENPFHVRLISPNRRPEMEAHFARKRVKSPLRNAGKGGESSLARHECPKKPLHKNGKIQVKTAIRLTPDGKRRRRSVTHLMQPINLESADECQWQTDSWASRA

SEQ ID NO: 9155 - protein, 604 aa, Panicum virgatum
SGEDGAHSVNFAEAALLLQGSVQVYSRKVEFLYSLVLHALEFLSQKKQDQLENGSAQANQSDPSTIANEEDDIFMGLDDVPAESRTSLNNNVNRDGLRSKIVRPPANLLVFEGDCLDSEASELDTYLLATCDFYGDFLLLDPCDAPAVFDFLQGKHSGKENSVAHQGSSAPSKSRANVFTSPNARSAGTGRKSSAGKVLGGLDPTQGNPDQSSTQETIPDDNHWSDPVEPSFADDVEMPHPDDIEDPVGDYSDDEDPWKPLNPHEPGNLKIRPYRRVKGSPRAVIGTSKKKTLTFLFPMAKMDGIVIPEHAKSFEAQQSQQEEHYGSQSPPRFEKFLRSFEFGEENPNVFGDLKDDNGSNTGINFENDDPDMPNDIDVDPYVPTYPGETIAATPNGTQDDINTHTSLDDLCRSHLNALLASIAEAEKQSEMDARVSTWKERIEDALEEQDKNPPFDIGSYGEQILDTLSSRTDNTGTASFSEIVSGRPKYEVARTFSALLQLVNGRSVDLDKGQATNELVCHTAENPFHVKLIGPNRRPEMEARFARKRGKSPLQNPGQSGESSLAQRESLKKPSHKNGKIPVKTAIRLTPDGKRRRKSAAHLM

SEQ ID NO: 9156 - protein, 131 aa, Saccharum officinarum
MRLLTHNMLASNVRGATTGYPLTLEATKWCTKEVELNADFIRGLLPKIDWRALVAATRALGLPELLPEEQPPEEEIFAEGAADVEGSAIRRIHHALLEVHVQEGSLVCPDTSRCFPINKGIPNMMLHEDEV

SEQ ID NO: 9157 - protein, 131 aa, Zea mays
MRLLTHNMLASNVRGATTGYPLTLEATNWCTKEVELNSDFIRGLLPKIDWRALVAATRAIGLPELLPEEQPPEEEIFADGAADVEGSAIRRIHHALLEVHVQEGSLVCPDTSRCFPINKGIPNMMLHEDEV

SEQ ID NO: 9158 - protein, 131 aa, Panicum virgatum
MRLLTHNMLASNVRGATTGYPLKLEAAKWVTKEVELNADFLRGLLPKIDWRALVAATRALGLPELLPEEQPPEEEIFAEGAADVEGSAIRRIHHALLEIHVQEGSLVCPDTSRCFPIDKGIPNMMLHEDEV

SEQ ID NO: 9159 - protein, 131 aa, Unknown
  Sequence found in Organisms: Pennisetum glaucum, Setaria italica
MRLLTHNMLASNVRGATTGYPLKLEAAKWVTKEVDLNADFIRGLLPKIDWRALVAATRALGLPELLPEEQPPEEEIFAEGAADVEGSAIRRIHHALLEIHVQEGSLVCPDTSRCFPIDKGIPNMMLHEDEV

SEQ ID NO: 9160 - protein, 348 aa, Saccharum officinarum
MATTASSLLKSSFAGARLPAATRTPSSSAVVRGAAGPIRASIPSSNPPYDLTSFRFSPIKESVVSREMTRRYMTDMITYADTDVVIVGAGSAGLSCAYELSKDPTVSIAIVEQSVSPGGGAWLGGQLFSAMVVRKPAHLFLDELGVAYDEAEDYVVIKHAALFTSTVMSRLWRGPREAVHAVAVEDLIVKQGRVGGVVTNWALVSMNHDTQSCMDPNVMEAKVVVSSCGHDGPFGATGVKRLQDIGMISDVPGMKALDMNTAEDEIVRLTREVVPGMIVTGMEVAEIDGAPRMGPTFGAMMISGQKAAHLALKALGRPNAVDGTIKVVSPALRQEFVIASKDDEVVDA

SEQ ID NO: 9161 - protein, 355 aa, Saccharum officinarum
MATTAASSLLKSSFAGSRLPAATRAPSSVVVSTGAPRTAAAGPICASISSSNPPYDLTSFRFSPIKESVVSREMTRRYMTDMITHADTDVVIVGAGSAGLSCAYELSKDPTVSIAIVEQSVSPGGGAWLGGQLFSAMVVRKPAHLFLDELGVAYDEAEDYVVIKHAALFTSTIMSALLARPNVKLFNAVAVEDLIVKQGRVGGVVTNWALVSMNHDTQSCMDPNVMEAKVVVSSCGHDGPFGATGVKRLQDIGMISAVPGMKALDMNTAEDEIVRLTREVVPGMIVTGMEVAEIDGAPRMGPTFGAMMISGQKAAHLALKALGRPNAVDGTIPKVSPALREEFVIASKDDEVVDA

SEQ ID NO: 9162 - protein, 352 aa, Panicum virgatum
MATTASTLLKSSFAGARLPAAPRAPSSVAVATPRAAGPICASASASSSTPPYDLTSFRFSPIKESIVAREMTRRYMTDMITHADTDVVIVGAGSAGLSCAYELSKDPSVSIAIVEQSVSPGGGAWLGGQLFSAMVVRKPAHRFLDELGVAYDEAEDYVVIKHAALFTSTIMSRLLARPNVKLFNAVAVEDLIVKQGRVGGVVTNWALVSMNHDTQSCMDPNVMEAKVVVSSCGHDGPFGATGVKRLQDIGMISAVPGMKALDMNTAEDEIVRLTREVVPGMIVTGMEVAEIDGAPRMGPTFGAMMISGQKAAHLALQALGRPNAIDGTAQTASPAWREEFVIASKDDEVVDA

SEQ ID NO: 9163 - protein, 350 aa, Panicum virgatum
MATTASTLLKSSFAGARLPAAPRAPSSVAVAAPRGAGPICASASSSSPPYDLTSFRFSPIKESIVAREMTLRYMTDMITHADTDVVIVGAGSAGLSCAYELSKDPSVSIAIVEQSVSPGGGAWLGGQLFSAMVVRKPAHRFLDELGVAYDEAEDYVVIKHAALFTSTIMSRLLARPNVKLFNAVAVEDLIVKQGRVGGVVTNWALVSMNHDTQSCMDPNVMEAKVVVSSCGHDGPFGATGVKRLQDIGMISAVPGMKALDMNTAEDEIVRLTREVVPGMIVTGMEVAEIDGAPRMGPTFGAMMISGQKAAHLALKALGRPNAIDGTAPAASPAWREEFVMASKDDEVVDA

SEQ ID NO: 9164 - protein, 354 aa, Zea mays
MATAAASSLLKSSFAGSRLPAATRTTPASLVVATGPRGAGAGPICASMSMSSSNPPYDLTSFRFSPIKESIVSREMTRRYMTDMITYADTDVVIVGAGSAGLSCAYELSKDPAVSIAIVEQSVSPGGGAWLGGQLFSAMVVRKPAHLFLDELGVAYDEAEDYVVIKHAALFTSTVMSLLLARPNVKLFNAVAVEDLIVRGGRVGGVVTNWALVSMNHDTQSCMDPNVMEAKVVVSSCGHDGPFGATGVKRLQDIGMISAVPGMKALDMNTAEDEIVRLTREVVPGMIVTGMEVAEIDGAPRMGPTFGAMMISGQKAAHLALKALGRPNAVDGTMSPPLREELMIAYKDDEVVDA

SEQ ID NO: 9165 - protein, 355 aa, Zea mays
MATTAASSLLKSSFAGSRLPSATRTTTPSSVAVATPRAGGGPIRASISSSPTPPYDLTSFRFSPIKESIVSREMTRRYMTDMITHADTDVVIVGAGSAGLSCAYELSKDPTVSVAIVEQSVSPGGGAWLGGQLFSAMVVRRPAHLFLDELGVGYDEAEDYVVVKHAALFTSTVMSRLLARPNVKLFNAVAVEDLIVRRGRVGGVVTNWALVSMNHDTQSCMDPNVMEAKVVVSSCGHDGPFGATGVKRLQDIGMISAVPGMKALDMNAAEDEIVRLTREVVPGMIVTGMEVAEIDGAPRMGPTFGAMMISGQKAAHLALKALGRPNAVDGTIPEVSPALREEFVIASKDDEVVDA

SEQ ID NO: 9166 - protein, 351 aa, Setaria italica
MATTASTLLKSSFAGARLPSAPRAPSSVVVAAPRAGPICASISSTPSNPPYDLTSFRFSPIKESIVSREMTRRYMTDMITYADTDVVIVGAGSAGLSCAYELSKDPSISIAIVEQSVSPGGGAWLGGQLFSAMVVRKPAHLFLDELGIAYDEAEDYVVIKHAALFTSTVMSRLLARPNVKLFNAVAVEDLIVKQGRVGGVVTNWALVSMNHDTQSCMDPNVMEAKIVVSSCGHDGPFGATGVKRLQDIGMISAVPGMKALDMNTAEDEIVRLTREVVPGMIVTGMEVAEIDGAPRMGPTFGAMMISGQKAAHLALKALGRPNAIDGTAQTVPQVWREEFVIASKDDEVVDA

SEQ ID NO: 9167 - protein, 351 aa, Cenchrus ciliaris
MATTASTLLKSSFAGARLPTAPRAPSSVVVAAPRAAAGPICASLSPSNPPYDLTSFRFSPIKESIVSREMTRRYMTDMITYADTDVVIVGAGSAGLSCAYELSKDPSVSIAIVEQSVSPGGGAWLGGQLFSAMVVRKPAHLFLDELGVAYDEAEDYVVIKHAALFTSTIMSRLLERPNVKLFNAVAVEDLIVKQGRVGGVVTNWALVSMNHDTQSCMDPNVMEAKVVVSSCGHDGPFGATGVKRLQDIGMISAVPGMKALDMNTAEDEIVRLTREVVPGMIVTGMEVAEIDGAPRMGPTFGAMMISGQKAAHLALKALGRPNAIDGTVQTVPPVWREEFVMASKDDEVVDA

SEQ ID NO: 9168 - protein, 356 aa, Panicum virgatum
MATTASTLLKSSFAGARLPAAPRAPSSVAVATPRAAGPICASASASASASSSTPPYDLTSFRFSPIKESIVAREMTRRYMTDMITHADTDVVIVGAGSAGLSCAYELSKDPSVSIAIVEQSVSPGGGAWLGGQLFSAMVVRKPAHRFLDELGVAYDEAEDYVVIKHAALFTSTIMSRLLARPNVKLFNAVAVEDLIVKQGRVGGVVTNWALVSMNHNTQSCMDPNVMEAKVVVSSCGHDGPFGATGVKRLQDIGMISAVPGMKALDMNTAEDEIVRLTREVVPGMIVTGMEVAEIDGAPRMGPTFGAMMISGQKAAHLALQALGRPNAIDGTAQTASPAWREEFVIASKDDEVVDA

SEQ ID NO: 9169 - protein, 354 aa, Sorghum bicolor
MATTAASSLLKSSFAGSRLPSATRAPSSVVVSTGGAPRTAAISASISSSNPPYDLTSFKFSPIKESIVSREMTRRYMTDMITHADTDVVIVGAGSAGLSCAYELSKDPTVRVAIVEQSVSPGGGAWLGGQLFSAMVVRKPAHLFLDELGVAYDEAADDYVVVKHAALFTSTVMSAVLARPNVKLFNAVAVEDLIVKGGRVGGVVTNWALVSMNHDTQSCMDPNVMEAKVVVSSCGHDGPFGATGVKRLQDIGMIAAVPGMKALDMNAAEDAIVRLTREVVPGMIVTGMEVAEIDGAPRMGPTFGAMMISGQKAAHLALKALGRPNAVDGTIPKVSPALREEFVIASKDDEVVDA

SEQ ID NO: 9170 - protein, 350 aa, Setaria italica
MATAASTLHKSSFGGARLPSAPRAPSSAAAVATPRAAGVPIRASISNPPYDLTSFKFSPIKESIVSREMTRRYMTDMITHADTDVVVVGAGSAGLSCAYELSKDPSVSVAIVEQSVSPGGGAWLGGQLFSAMVVRKPAHLFLDELGVAYDEAEDYVVVSHAALFTSTVMSRLLARPNVKLFNAVAAEDLIVKQGRVAGVVTNWALVAMNHGTQSCMDPNVMEAKVVVSSCGHDGPFGATGVKRLQDIGMISAVPGMKALDMNTAEDAIVRLTREVVPGMIVTGMEVAEIDGAPRMGPTFGAMMISGQKAAHLALKALGRPNAIDGTTQTASQAWREELVMASKDDEVVDA

SEQ ID NO: 9171 - protein, 349 aa, Pseudoroegneria spicata
MATAAPTLKFSFAGARPPPATRSLSPVVVSTPRAVGPISASICSSNPPYNLTAFKFSPIKESIVSREMTRRYMTDMITYADTDVVIVGAGSAGLTCAYELSKDPSVSIAIIEQSVSPGGGAWLGGQLFSAMVVRKPAHLFLDELDVAYDEAEDYAVIKHAALFTSTVMSRLLARPNVKLFNAVAVEDLIVKQGRVSGVVTNWALVSMNHDTQSCMDPNVMEAKVVVSSCGHDGPFGATGVKRLQDIGMIDTVPGMKALDMNTAEDEIVRLTREVVPGMIVTGMEVAEIDGAPRMGPTFGAMMISGQKAAHLALKALGRPNAMDGSLQSMSPALREEFVLAAKGDEIVEA

SEQ ID NO: 9172 - protein, 351 aa, Festuca arundinacea
  misc_feature (346)..(346): Xaa can be any naturally occurring amino acid
MAAMATTASSLLKTSFAGAHLPAATRTPSCVAVPRAGAICNSISSSTPPYDLNAFKFSPIKESVVSREMTRRYMTDMITYADTDVVIVGAGSAGLSCAYELSKDPSISIAIIEQSVSPGGGAWLGGQLFSAMVVRKPAHLFLDELNIEYDEQEDYVVIKHAALFTSTVMSRLLARPNVKLFNAVAVEDLIVKESRVAGVVTNWALVSMNHDTQSCMDPNVMEAKVVVSSCGHDGPFGATGVKRLQDIGMIETVPGMKALDMNTAEDAIVRLTREVVPGMIVTGMEVAEIDGAPRMGPTFGAMMISGQKAAHLALKALGRPNAIDGTIKNAIPALNPEMVLAAINNXDIVDA

SEQ ID NO: 9173 - protein, 351 aa, Avena sativa
MAAMATAASSLLKTSFAGARLPAATRTPSCVATPRAGAICNSISSSTPPYDLNAFKFSPIKESIVSREMTRRYMTDMITYADTDVVIVGAGSAGLSCAYELSKDPSISIAIIEQSVSPGGGAWLGGQLFSAMVVRKPAHLFLDELNIEYDETEDYVVIKHAALFTSTVMSRLLARPNVKLFNAVAVEDLIVKENRVAGVVTNWALVSMNHDTQSCMDPNVMEAKVVVSSCGHDGPFGATGVKRLQDIGMIETVPGMKALDMNTAEDAIVRLTREVVPGMIVTGMEVAEIDGAPRMGPTFGAMMISGQKAAHLALKALGRPNAIDGTIKNATPALHPEMVLAAINNGDIVDA

SEQ ID NO: 9174 - protein, 351 aa, Avena sativa
MAAMATAASSLLKTSFAGARLPAATRAPSCVATPRAGAICNSISSSAPPYDLNAFKFSPIKESIVSREMTRRYMTDMITYADTDVVIVGAGSAGLSCAYELSKDPSISIAIIEQSVSPGGGAWLGGQLFSAMVVRKPAHLFLDELNIEYDETEDYVVIKHAALFTSTVMSRLLARPNVKLFNAVAVEDLIVKENRVAGVVTNWALVSMNHDTQSCMDPNVMEAKVVVSSCGHDGPFGATGVKRLQDIGMIETVPGMKALDMNTAEDAIVRLTREVVPGMIVTGMEVAEIDGAPRMGPTFGAMMISGQKAAHLALKALGRPNAIDGTIKNATPALHPEMVLAAINNGDIVDA

SEQ ID NO: 9175 - protein, 351 aa, Avena sativa
MAAMATTASSLLKTSFVGAHLPAASRTPSCMAVPRAGAICNSISSSTPPYDLNAFNFSPIKESIVSREMTRRYMTDMITYADTDVVIVGAGSAGLSCAYELSKDPSISIAIIEQSVSPGGGAWLGGQLFSAMVVRKPAHLFLDELNIEYDEQEDYVVIKHAALFTSTVMSRLLARPNVKLFNAVAVEDLIVKENRVAGVVTNWALVSMNHDTQSCMDPNVMEAKVVVSSCGHDGPFGATGVKRLQDIGMIETVPGMKALDMNTAEDAIVRLTREVVPGMIVTGMEVAEIDGAPRMGPTFGAMMISGQKAAHLALKALGRPNGIDGTLKNVTPALHPEMVLASADNGDIVDA

SEQ ID NO: 9176 - protein, 352 aa, Brachypodium distachyon
MAAMATSASSLLKTSFAGARLPAAAARTPSSVATPRAGAICNSISASTPPYDLNAFKFSPIKESIVSREMTRRYMTDMITYADTDVVIVGAGSAGLSCAYELSKDPSISIAIIEQSVSPGGGAWLGGQLFSAMVVRKPAHLFLDELNIEYDEQEDYVVIKHAALFTSTVMSRLLARPNVKLFNAVAVEDLIVKEDRVAGVVTNWALVSMNHDTQSCMDPNVMEAKVVVSSCGHDGPFGATGVKRLQDIGMIDTVPGMKALDMNMAEDAIVRLTREVVPGMIVTGMEVAEIDGAPRMGPTFGAMMISGQKAAHLALKALGRPNGIDGTLKNATPALHPEMVLASANNGDVVDA

SEQ ID NO: 9177 - protein, 351 aa, Hordeum vulgare
MAAMATTASSLLKSSFSGVRLPAAARTPSCVATPRAGAICNSISSSTPPYDLNAFKFSPIKESIVSREMTRRYMTDMITYADTDVVIVGAGSAGLSCAYELSKDPSISIAIIEQSVSPGGGAWLGGQLFSAMVVRKPAHLFLDELNIEYDEQEDYVVIKHAALFTSTIMSRLLARPNVKLFNAVAVEDLIVKENRVAGVVTNWALVSMNHDTQSCMDPNVMEAKVVVSSCGHDGPFGATGVKRLQDIGMIQAVPGMKALDMNTAEDAIVRLTREVVPGMIVTGMEVAEIDGAPRMGPTFGAMMISGQKAAHLALKALGRPNGIDGTLKNVTPALHPEMILAASNNADIVDA

SEQ ID NO: 9178 - protein, 351 aa, Leymus cinereus x Leymus triticoides
MAAMATTASSLLKTSFSGVRLPAAARTPSCVATPRAGAICNSISSSTPPYDLNAFKFSPIKESIVSREMTRRYMTDMITYADTDVVIVGAGSAGLSCAYELSKDPSISIAIIEQSVSPGGGAWLGGQLFSAMVVRKPAHLFLDELNIEYDEQEDYVVIKHAALFTSTVMSRLLARPNVKLFNAVAVEDLIVKEDRVAGVVTNWALVSMNHDTQSCMDPNVMEAKVVVSSCGHDGPFGATGVKRLQDIGMIQTVPGMKALDMNTAEDAIVRLTREVVPGMIVTGMEVAEIDGAPRMGPTFGAMMISGQKAAHLALKALGRPNGIDGTLKNATPALHPEMILASTNNGDIVDA

SEQ ID NO: 9179 - protein, 351 aa, Pseudoroegneria spicata
MAAMATTASSLLKTSFSGVRLPAAARTPSCVATPRAGAICNSISSSTPPYDLNAFKFSPIKESIVSREMTRRYMTDMITYADTDVVIVGAGSAGLSCAYELSKDPSISIAIIEQSVSPGGGAWLGGQLFSAMVVRKPAHLFLDELNIEYDEQEDYVVIKHAALFTSTVMSRLLARPNVKLFNAVAVEDLIVKENRVAGVVTNWALVSMNHDTQSCMDPNVMEAKVVVSSCGHDGPFGATGVKRLQDIGMIQAVPGMKALDMNTAEDAIVRLTREVVPGMIVTGMEVAEIDGAPRMGPTFGAMMISGQKAAHLALKALGRPNGIDGTLKNVTPALHPEMILAATNNGDIVDA

SEQ ID NO: 9180 - protein, 351 aa, Secale cereale
MAAMATTASSLLKTSFSGVRLPAAARTPSCVATPRAGAICNSISSSTPPYDLNAFKFSPIKESIVSREMTRRYMTDMITYADTDVVIVGAGSAGLSCAYELSKDPSISIAIIEQSVSPGGGAWLGGQLFSAMVVRKPAHLFLDELNIEYDEQEDYVVIKHAALFTSTVMSRLLARPNVKLFNAVAVEDLIVKENRVAGVVTNWALVSMNHDTQSCMDPNVMEAKVVVSSCGHDGPFGATGVKRLQDIGMIQTVPGMKALDMNTAEDAIVRLTREVVPGMIVTGMEVAEIDGAPRMGPTFGAMMISGQKAAHLALKALGRPNGIDGTLKNVTPALHPEMILAATNNGDIVDA

SEQ ID NO: 9181 - protein, 351 aa, Triticum aestivum
MAAMATTASSLLKTSFSGVRLPAAARTPSCVATPRAGAICNSISSSTPPYDLNAFKFSPIKESIVSREMTRRYMTDMITYADTDVVIVGAGSAGLSCAYELSKDPSISIAIIEQSVSPGGGAWLGGQLFSAMVVRKPAHLFLDELNIEYDEQEDYVVIKHAALFTSTVMSRLLARPNVKLFNAVAVEDLIVKEDRVAGVVTNWALVSMNHDTQSCMDPNVMEAKVVVSSCGHDGPFGATGVKRLQDIGMIQAVPGMKALDMNTAEDAIVRLTREVVPGMIVTGMEVAEIDGAPRMGPTFGAMMISGQKAAHLALKALGRPNGIDGTLKNVTPALHPEMILAATNNGDIVDA

SEQ ID NO: 9182 - protein, 355 aa, Oryza sativa
MAAMATTASSLLKTSFAGARLPAAARNPTVSVAPRTGGAICNSISSSSSTPPYDLNAIRFSPIKESIVSREMTRRYMTDMITYADTDVVVVGAGSAGLSCAYELSKDPSVSVAVIEQSVSPGGGAWLGGQLFSAMVVRKPAHLFLDELGVAYDEQEDYVVIKHAALFTSTVMSRLLARPNVKLFNAVAVEDLIVKEGRVGGVVTNWALVSMNHDTQSCMDPNVMESRVVVSSCGHDGPFGATGVKRLQDIGMIDAVPGMRALDMNTAEDEIVRLTREVVPGMIVTGMEVAEIDGAPRMGPTFGAMMISGQKAAHLALKALGRPNAIDGTIKKAAAAAAHPELILASKDDGEIVDA

SEQ ID NO: 9183 - protein, 360 aa, Zea mays
MGRRGSSDRLEALSLEIERKLHKALMSNSQRLQILQQLFADIALKVDDRARDAIMSENDDGIAPADEREDGWLCFYEILANHFVRVPESGRRILELIVQLWSQSFAANIFALLFQKWLFEAPLDEKEISLRYSSALVQGATNVFWIDIQTNTRHFLSLYHYLLEDVALVPERLSKISLQAGRDLFLLLSRFMFFYDQDHMLSSFLEHFPNFPNSFLVGGPADYFVIELADQLQKLKIEPVLLHYLSRMSILQGLELRLSTSTRLKACLYSFTSPGGPTYPTRAVRHAAWNTLDLLFPIGRYPRHVISLFFRLLYPWYWPSSCWNFVMTCAMTVYYYILNLLVSCWENMRRRPSHRRTHGE

SEQ ID NO: 9184 - protein, 359 aa, Panicum virgatum
MRSRSSTDRLEALSIEIERKLQKALSSNSQRLQILQQLFADIALKVDDRARDAIMSENDDGIAPVDEREDGRLCFYEILANHFVRVPKSGRRILELIVQLWSQSFASNIFALLFHKWLFEAPLDGKEISLRYSSALVQGATNVFWIDIQTNTRHFLSLYHYLLEDVALIPDRLTKISLQAGRDLFLLLSRFMFFYDQDHLLSSFLEHFPPFPNSFLVGGPADYFVIELTDQLQKLKIEPVLLHYLSRMSILQGLELRLSTSTRLKACLYSITSPGGPTYPTRAVRHAAWNTLDLLFPVGRYPRHVISLFFRLLYPWYWPSSCWNFVVTCAMTIYYYILNLLVSTWESLRRHSHRRTHGE

SEQ ID NO: 9185 - protein, 359 aa, Panicum virgatum
MRSRSSTDRLEALSIEIERKLQKALSSNSQRLQILQQLFADISLKVDDRARDAIMSENDDGIAPVDEREDGRLCFYEILANHFVRVPKSGRRILELIVQLWSQSFASNIFALLFHKWLFEAPLDGKEISLRYSSALVQGATNVFWIDIQTNTRHFLSLYHYLLEDVALIPDRLTKISLQAGRDLFLLLSRFMFFYDQDHLLSSFLEHFPPFPNSFLVGGPADYFVIELTDQLQKLKIEPVLLHYLSRMSILQGLELRLSTSTRLKACLYSITSPGGPTYPTRAVRHAAWNTLDLLFPVGRYPRHVISLFFRLLYPWYWPSSCWNFVVTCAMTIYYYILNLLVSTWESLRRHSHRRTHGE

SEQ ID NO: 9186 - protein, 328 aa, Saccharum officinarum
MGRRGSSDRLEALSLEIERKLQKALISNSQRLQILQQLFADIALKVDDRARDAIMSENDDGIAPVDEREDGWLCFYEILANHFVKVPESGRRILELIVQLWSQSFASNIFALLFHKWLFEAPLDEKEISLRYSSALVQGATNVFWIDIQTNTRHFLSLYHYLLEDVALVPDRLTKISLQAGRDLFLLLSRFMFFYDQDPLLSSFLEHFPTFPNSFLVGGPADYFVIELTDLLQKLKIEPVLLHYLCRMSILQGMELRLSTSTRLKACLYSFTSPGGPMYPTRAVRHAAWNTLDLLFPIGRYPRHVISLFFRLLYPWDWPSSCWNFIMT

SEQ ID NO: 9187 - protein, 358 aa, Oryza sativa
MRARAADHLEALSLEIERKLQKALNSNSQRLQLLQQLFADIALKVDDRARDVILSTNDDGIAPVDEREDTRLCFYEILANHFVKVPESGRRILDLIVQLWSQSFAANIFALLFHRWLFEVPLDGKEVSLRYSSALVQGATNVFWIDIQTNTRHFLSLYNYLLEEVALVPDQLSKISVQAGRGLFLLLSRFMLFYDQDHLLASFLEHFPTFPNSFLVGGPADYYVIELTDQLQKLKVEPVLLHYLSRLTILQGLELRMSTSTRLKACLYSFTSPGGPTYPTRAVRHAAWNTLDLLFPVGRYPRHVISLFFRLLYPWYWPSSCWNFIMTCVKTVYYYILNLIVSSWENMRRPNHQRMHRD

SEQ ID NO: 9188 - protein, 358 aa, Brachypodium distachyon
MPPRTSDHLEALSLQIERKLHKALTSNSQRLQLLQQLFADIALKVDDRARDAILSRSDEGIPPVDEREDSYLCFYEILANHYVRVPESGRRILELIVQLWSQSFAANIFALLFHRWLFEVPLDGREVSLRYSSALVQGATNVFWIDIQTNTRHFLPLYHYLLEEVALVPDQLSKISLQAGRNLFCLLSRFMLFYDQDHLLASFLEHFPVFPNSFLVGGPADYFVIELTDQLQKLKVEPVLLHYLSRMTILQGWELRMSTSTRLKSCLYSFTSPGGPAYPTRAVRHAAWNTLDFLFPVGRYPRHVISLFFRLLYPWYWPSSCWNFVMTCVMTVYYYILNLLLSIWDNMRRPSHQRMHRE

SEQ ID NO: 9189 - protein, 358 aa, Triticum aestivum
MRARTADHLEALSLEIERKLHKALNSNSQRLKLLQQLFADIALKVDDRARDKILSTNNEGIAPVDEREDGHLCFYEILANHYVKVPQSGRRILELIVQLWSQSFAANIFALLFHRWLFEVPLEGKEVSLRYSSALVQGATNVFWIDIQTNTRYFLPLYHYLLEEVALVPDQLIKISPQAGRNLFCLLSRFMLFYDQDHLLTSFLGHFPAFPNSFLVGGAADYFVIELTDQLQKLKVEPVLLHYLSRMTILQGWELRMSTSTRLKSCLYSFTSPGGPAYPTRAVRHAAWNTLDLLFPVGRYPRHVISLFFRLLYPWYWPSSCWNFVMTCVSTIYYYILNLLVSIWENMRRRDHQRMHRE

SEQ ID NO: 9190 - protein, 358 aa, Secale cereale
MRTRTADHLESLSLEIERKLHKALNSNSQRLKLLQQLFADIALKVDDRARDKILSTNDEGIAPVDEREDGHLCFYEILANHYVKVPQSGRRILELIVQLWSQSFAANIFALLFHRWLFEVPLEGKDVSLRYSSALVQGATNVFWIDIQTNTRHFLPLYHYLLEEVALVPDQLIKISPQAGRNLFCLLSRFMLFYDQDHLLISFLEHFPPFPNSFLIGGAADYFVIELTDQLQKLKVEPVLLHYLSRMTILQGWELRMSTSTRLKSCLYSFTSPGGPAYPTRAVRHAAWNTLDFLFPVGRYPRHVISLFFRLLYPWYWPSSCWNFVMTCVSTIYYYILNLLVSIWENMRRPDHQRMHRD

SEQ ID NO: 9191 - protein, 358 aa, Triticum aestivum
MRPRTADHLEALSLEIERKLHKALNSNSQRLKLLQQLFADIALKVDDRARDKILSTNNEGIAPVDEREDGHLCFYEILANHYVKVPQSGRRILELIVQLWSQSFAANIFALLFHRWLFEVSLEGKEVSLRYSSALVQGATNVFWIDIQTNTRYFLPLYHYLLEEVALVPDQLIKISPQAGRNLFCLLSRFMLFYDQDHLLTSFLGHFPAFPNSFLVGGAADYFVIELTDQLQKLKVEPVLLHYLSRMTILQGWELRMSTSTRLKSCLYSFTSPGGPAYPTRAVRHAAWNTLDLLFPVGRYPRHVISLFFRLLYPWYWPSSCWNFVMTCVSTIYYYILNLLVSIWENMRRRDHQRMHRE

SEQ ID NO: 9192 - protein, 358 aa, Secale cereale
MRPRTADHLESLSLEIERKLHKALNSNSQRLKLLQQLFADIALKVDDRARDKILSTNDEGIAPVDEREDGHLCFYEILANHYVKVPQSGRRILELIVQLWSQSFAANIFALLFHRWLFEVPLEGKDVSLRYSSALVQGATNVFWIDIQTNTRHFLPLYHYLLEEVALVQDQLIKISPQAGRNLFCLLSRFMLFYDQDHLLISFLEHFPPFPNSFLIGGAADYFVIELTDQLQKLKVEPVLLHYLSRMTILQGWELRMSTSTRLKSCLYSFTSPGGPAYPTRAVRHAAWNTLDFLFPVGRYPRHVISLFFRLLYPWYWPSSCWNFVMTCVSTIYYYILNLLVSIWENMRRPDHQRMHRD

SEQ ID NO: 9193 - protein, 358 aa, Secale cereale
MRPRTADHLESLSLEIERKLHKALNSNSQRLKLLQQLFADIALKVDDRARDKILSTNDEGIAPVDEREDGHLCFYEILANHYVKVPQSGKRILELIVQLWSQSFAANIFALLFHRWLFEVPLEGKDVSLRYSSALVQGATNVFWIDIQTNTRHFLPLYHYLLEEVALVPDQLIKISPQAGRNLFCLLSRFMLFYDQDHLLISFLEHFPPFPNSFLIGGAADYFVIELTDQLQKLKVEPVLLHYLSRMTILQGWELRMSTSTRLKSCLYSFTSPGGPAYPTRAVRHAAWNTLDFLFPVGRYPRHVISLFFRLLYPWYWPSSCWNFVMTCVSTIYYYILNLLVSIWENMRRPDHQRMHRD

SEQ ID NO: 9194 - protein, 128 aa, Secale cereale
MRPRTADHLESLSLEIERKLHKALNSNSQRLKLLQQLFADIALKVDDRARDKILSTNDEGIAPVDEREDGHLCFYEILANHYVKVPQSGKRILELIVQLWSQSFAANIFALLFHRWLFEVPLEGRTYH

SEQ ID NO: 9195 - protein, 200 aa, Secale cereale
MRPRTADHLESLSLEIERKLHKALNSNSQRLKLLQQLFADIALKVDDRARDKILSTNDEGIAPVDEREDGHLCFYEILANHYVKVPQSGRRILELIVQLWSQSFAANIFALLFHRWLFEVPLEGKDVSLRYSSALVQGATNVFWIDIQTNTRHFLPLYHYLLEEVALVPDQLIKISPQAGRNLFCLLSRFMLFYDQDHLS

SEQ ID NO: 9196 - protein, 305 aa, Setaria italica
MSENDDGIAPLDEREDGWLCFYEILANHFVRVPESGRRILELIVQLWSQSFASNIFSLLLHKWLFEAPLDGKEIPLRYSSALVQGATNVFWIDIQTNTRHFLSLYHYLLEDVALVPDRLNKISLQAGRDLFLLLSRFMFFYDQDHLLSRFLEHFPTFPNSFLVGGPADYFVIDLTDQLQKLKIEPVLLHYLSRMSILQGLELRLSTSTRLKACLYSFTSPGGPTYPTRAVRHAAWNTLDLLFPIGRYPRHVISLFFRLLYPWYWPSSCWNFVMTCAMTVYYYILNLLVSTWESLRRPSHRRTHEE

SEQ ID NO: 9197 - protein, 305 aa, Panicum virgatum
MSENDDGIAPVDEREDGRLCFYEILANHFVRVPESGRRILELIVQLWSQSFASNIFALLFHKWLFEAPLDGKEISLRYSSALVQGATNVFWIDIQTNTRHFLSLYHYLLEDVALIPDRLTKISLQAGRDLFLLLSRFMFFYDQDHLLSSFLEHFPTFPNSFLVGGPADYFVIELTDQVQKLKIEPVLLHYLSCMSILQGLELRLSTSTRLKACLYSFTSPGGLTYPTRAVRHAAWNTLDLLFPVGRYPRHVISLFFRLLYPWYWPSSCWNFVGTCAMTIYYYILNLLVSTWESLRRHSHRRTHSE

SEQ ID NO: 9198 - protein, 354 aa, Saccharum officinarum
MGEADASAGGSGAGGDPQRLKRIAAAAYDYENDARWAGYWSNVLVPPHLASRPDVVDHFKRKFYQRYIDPALVVEPMSSMTSTQSSRPAARSSATPSGENVRSRDSGSSTRSTGASQQPSAERTANSLRLDGRTIHFSINAWVLVVASLGILPVLPNHISSKAYRLSLLGTICSSAYSLYSTYGKPRAWNMPAIQSWLQSIIVAKDFVHLMFSLMMFTSNVHFKIALLPVLCWALDHVARFLRRNFTHSSLYRKYLEDPCLWVETNNTTLSLLCSNAEITLGFLMIISLFSLRRNIIQTFMYFHLLKLMYHSPVTSGYHQSVWARIGRAVNPYIYRYAPFLNTPISAVQRWWLR

SEQ ID NO: 9199 - protein, 349 aa, Zea mays
MGEEDASAGGDPQRLKRIAAAAYDYENDARWAGYWSNVLVPPHLASRPDVVDHFKRKFYQRYIDPGLVVEPMSSMTSTQSSRPAAKSSATPSSENVRARDSGSSTRSTGTSQHPPAERTANSLQLDGRTINFSINAWVLVVASLGILPVLPNHISSKAYRLSLLGTICSSAYSLYGTYGKPRAWNMPAIQSWLQSIIVAKDFVHLMFSLMMFTSNVHFKIALLPVLCWALDHVARFLRRNFTHSSLYRKYLEDPCLWVETNNTTLSLLCSNAEITLGFLMIISLFSSRRNIIQTFMYFHLLKLMYHSPVTSGYHQSVWARIGRAVNPYIYRYAPFLNTPISAVQRWWLR

SEQ ID NO: 9200 - protein, 349 aa, Setaria italica
MGEGDASAGGDPQRLKRIAAAAYDYENDARWAGYWSNVLVPPHLASRPDVVDHFKRKFYQRYIDPGLIVEPMSSMNSNQSSRPAARSSATPSRENTRPHDSGSSTRSTGASQQSSAERSANSLRLDGRTIHFSINAWVLVVASLGILPILPNHISSKAYRLSLLGTICSSAYSLYTTYGKPRAWNMPAIQPWLQSIIVAKDFVHLMFSFMMFTSNVHFKIALLPVLCWALDHVARFLRRNFTRSSLYRKYLEDPCLWVETNNTTLSLLCSNAEITLGFLMIISLFSSRRNIIQTFMYFHLLKLMYHAPVTSGYHQSVWARIGRAVNPYIYRYAPFLNTPISAVQRWWLR

SEQ ID NO: 9201 - protein, 349 aa, Panicum virgatum
MGEGDASAGADPQRLKRIAAAAYDYENDARWAGYWSNVLVPPHLASRSDVVDHFKRKFYQRYIDPGLVVEPMSSMTSTQSGRPATRSSATPSSENTRACDAGSSTRSTGASQQPSAERSANSLRLDGRTIHFSINAWVLVVSSLGILPVLPNHISSKAYRLSLLGTICSSAYSLYSTYGKPRAWNMTVIQPWLQSIIVAKDFVHLMFSLMMFTSNVHFKIALLPVLCWALDHVARFLRRNFTRSSLYRKYLEDPCLWVETNNTTLSLLCSNAEITLGFLMIISLFSSRRNIIQTFMYFHLLKLMYHAPVTSSYHQSVWARIGRAVNPYIYRYAPFLNTPISAVQRWWLR

SEQ ID NO: 9202 - protein, 349 aa, Panicum virgatum
MGEGDASAGGDPQRLKRIAAAAYDYENDARWAGYWSNVLVPPHLASRSDVVDHFKRKFYQRYIDPGLVVEPMSSMTSTQSSRPAARSSATASSENTRARDSGSSTRSTGASQQPSAERSANSLRLDGRTIHFSINAWVLVVASLGILPILHNHISSKAYRLSLLGTIFSSAYSLYSTYGKPRAWNMTVIQPWLQSIIVAKDFVHLMFSLMMFTSNVHFKIALLPVLCWALDHVARFLRHNFARSSLYRKYLEDPCLWVETNNTTLSLLCSNAEITLGFLMIISLFSSRRNIIQTFMYFHLLKLMYHAPVTSGYHQSVWARIGRAVNPYISRYAPFLNTPISAVQRWWLR

SEQ ID NO: 9203 - protein, 349 aa, Pennisetum glaucum
MGEGDASSGGDPQRLKRIAAAAYDYENDARWAGYWSNVLVPPHLASRPDVVDHFKRKFYQRYIDPGLIVEPMSSINSTQSSRPAARSSATPSSENTRPRDSGSSTRSSGASQQPSAERSANSLRLDGRTIHFSINAWVLVVASLGILPILPNHISSKAYRLSLLGTICSSAYSLYTTYGKPRAWNMPAIQPWLQSIIVAKDFVHLMFSLMMFASNVHFKIALLPVLCWALDHVARFLRRNFTRSSIYRKYLEDPCLWVETNNTTLSLLCSNAEITLGFLMIISLFSSRRNIIQTFMYFHLLKLMYHAPVTSGYHQSVWARIGRVVNPYICRYAPFLNTPISAVQRWWLR

SEQ ID NO: 9204 - protein, 354 aa, Oryza sativa
MGDGEGSTGGGGGGGDPQRLKRIGAAAYDYENDSRWAGYWSNVLVPPHLASRPDVVDHFKRKFYQRYIDPDLIVEPMSSTSSSQSTKPAARSSATPSNENVRARDSGSSARSTAASQPSQTERTANSLWLDGRTIHFSINAWVLVVASLGILPILPKHIASKAYRLSLLGTICSSAYSLYVTYGKPRAWNMAAIQPWLQSIIVAKDFVHLMFSLMMFTSNVHYKIALLPVLCWALDHVARFLRRNFARSSLYRKYLEEPCLWVETNNTTLSLLCSNAEITLGFLMIVSLFSWRRNIIQTFMYFHLLKLMYHAPVTSGYHQSAWARIGRAVNPYIHRYAPFLNTPISAVQRWWLR

SEQ ID NO: 9205 - protein, 349 aa, Brachypodium distachyon
MGEADASTGGGGGGGDPQRLKRIAAGAYDYENDARWAGYWSNVLVPPHLASRPDVVDHFKRKFYQRYIDPDLVVEPMSSTGSTQSNRSAARSSSTPSSENIRARDSGSAATQPPSTERTGSSLRFDGRTIHFSINAWVLVVAGLGILPILPKDIASKAYRLSLLGTICSSAYSLYCTYGKPRAWNMPAIQPWLQSIIVAKDFVHLMFSLMMFTSNVHFRIALLPVLCWAVDHVARFLRRNFARSSFYRRYLEEPCLWVETNNTTVSLLCSNAEIALGFLMIVSLFSWKRNIIQTFMYFHLLKLMYHAPVTSGYHQSVWARIGRAVNPHIDRYAPFLNTPISAAQRWWLR

SEQ ID NO: 9206 - protein, 350 aa, Secale cereale
MGEADASTGGGDPQKLKRIGAGAYDYENDARWAGYWSNVLVPPHLASRPDVVDHFKRKFYQRYIDPDLVVEPMSSTSSTQSNRSAASSSSTPSSENSRARDTGSSARSTGASQPPPIERTGNSLRLDGRTIHFSINAWVLIVASLGILPILPKDVASKAYRLSLLGTICSSAYSLYCTYGKPRAWNMPAIQPWLQSIIVAKDFVHLMFSLMMFTSNVRFKIVLLPVLCWALDHVARFLRRNFARSSFYRRYLEETCLWVETNNTTISLLCSNAEITLGFLMIVSLFSWKRNIIQTFMYFHLLKLMYHAPVTSGYHQSVWARIGRAVNPHIHRYTPFLNTPISAVQRWWLR

SEQ ID NO: 9207 - protein, 354 aa, Hordeum vulgare
MGEADADADASNGGGDPQKLKRIGAGAYDYENDARWAGYWSNVLVPPHLASRPDVVDHFKRKFYQRYIDPDLVVEPISSTSSTQSNRSAASSSSTPSSENARARDTGSSARSTGASQSPPTERTGNSLRFDGRTIHFSINAWVLFVASLGILPILPKDVASKAYRLSLLGTICSSAYSLYCTYGKPRAWNMPAIQPWLQSIIVAKDFVHLMFSLMMFTSNVRFKIVLLPVLCWALDHVARFLRRNFARSSLYRRYMEEPCLWVETNNTTISLLCSNAEITLGFLMIVSLFSWKRNIIQTFMYFHLLKLMYHAPVTSGYHQSVWARIGRAINPHIHRYTPFLNTPISAVQRWWLR

SEQ ID NO: 9208 - protein, 350 aa, Triticum aestivum
MGEADASTGGGDPQKLKRIAAGAYDYENDARWAGYWSNVLVPPHLASRPDVVDHFKRKFYHRYIDPDLVVEPMSSTSSTQSNRSAASSSSTPSSENSRARDTGSSARSTGASQPAPTERTGNSLRFDGRTIHFSINAWVLIVASLGILPIVPKDVASKAYRLSLLGTICSSAYSLYCTYGKPRAWNMPAIQPWLQSIIVAKDFVHLMFSLMMFTSNVRFKIVLLPVLCWALDHVARFLRRNFARSSFYRRYMEEPCLWVETNNTTISLLCSNAEITLGFLMIVSLFSWKRNIIQTFMYFHLLKLMYHAPVTSGYHQSVWARIGRAVNPHIHRYTPFLNTPISAVQRWWLR

SEQ ID NO: 9209 - protein, 350 aa, Triticum aestivum
MGEADASTGGGDPQKLKRIAAGAYDYENDARWAGYWSNVLVPPHLASRPDVVDHFKRKFYHRYIDPDLVVEPMSSTSSTQSNRSAASSSSTPSSENSRARDTGSSARSTGASQPAPTERTGNSLRFDGRTIHFSINAWVLIVASLGILPIVPKDVASKAYRLSLLGTICSSAYSLYCTYGKPRAWNMPAIQPWLQSIIVAKDFVHLMFSLMMFTSNVRFKIVLLPVLCWALDHVARFLRRNFARSSFYRRYMEEPCLWVETNNTTISLLCSNAEITLGFLMIVSLFSWKRNIIQTFMYFHLLKLMYHAPVTSGYHQSVWARIGRAVNPHILRYTPFLNTPISAVQRWWLR

SEQ ID NO: 9210 - protein, 239 aa, Zea mays
MELRRPASSPLVDNYVVPGDVVLDLSEMNNQTIKLGAGLRQECDTIQATSAGKLRQLKPNKYWIENSQKRYIPSVEDTVLGIVVDTKPDNFLVDIKGPNLAFLPVLSFEGGTRRNIPKFEIGTLIYARVVKANSIMNPELSCMDATGKAAEFGQLKDGYMFDTSTGMSRMLLSSPTCPVLEVLGKKLSFEIAVGLNGRVWVNAPAASTVILVSNAIMRSESLSGIKQRAMVENLLERLS

SEQ ID NO: 9211 - protein, 239 aa, Zea mays
MELRRPAPSPLVDNYVVPGDVVLDLSEMNNQTIKLGAGLRQECDTIEATSAGKLRQLKPNKYCIENSQKRYKPSVEDTVLGIVVDTKPDNFLVDIKGPNLAFLPVLSFEGGTRRNIPKFKIGTLIYARVVKANSIMNPELSCMDATGKAAKFGQLKDGYMFDTSTGMSRMLLSSPTCPVLEVLGKKLSFEIAVGLNGRVWVNAPAASTVILVSNAIMRSESLSGIKQRAMVENLLERLS

SEQ ID NO: 9212 - protein, 239 aa, Panicum virgatum
MESMRPPPSPLVDSYVVPGDVVLDLSEMTNQTIKLGTGLRQECDTIQATSAGVLRLSKPNKYWVESSQKRYVPSVEDTILGVVVNTKPDNFLVDIKGPNVAFLPVLSFEGGTRRNIPKFEIGTLIYARVVKANSIMNPELSCMDATGKAAEFGQLKGGYMFDTSTGMSRMLLSSPTCPVLEALGKKLSFEIAVGLNGRVWVNAPAPSTVILVSNAIMRSESLSGIKQRAMVENLLERLS

SEQ ID NO: 9213 - protein, 239 aa, Setaria italica
MESKRPPPSPLVDTYVVPGDVVLDLSEMTNQTIKLGTGLRQEGDTIQATSAGILRLSKPNKYWVESSQKRYVPSVEDTVLGVVVDTKPDNFVVDIKGPHLAFLPVLAFEGGTRRNIPKFEIGTLIYARVVKANIIMNPELSCMDATGKAAEFGQLKDGYMFDTSTGMSRMLLSSPTCPVLEALGKKLSFEIAVGLNGRVWVNAPAPNTVILVSNAIMRSESLSGIQQRAMVENLLERLS

SEQ ID NO: 9214 - protein, 239 aa, Pennisetum glaucum
MESKRPPPSPFVETYVVPGDVVLDLSEMTNQTIKLGTGLRQECDTIQATSAGILRLSKPNKYWVESSQKRYVPSVDDTVLGIVVDTKPDNFVVDIKGPHLAFLPVLAFEGGTRRNIPKFEIGTLIYVRVVKANSIMNPELSCMDASGKAAEFGELRGGYMFDTSTGMSRMLLSSPTCPVLEALGKKLSFEIAVGLNGRVWVNAPAANTVILVSNAIMRSESLSGIQQRAMVENLLERLS

SEQ ID NO: 9215 - protein, 239 aa, Oryza sativa
MESRKPPPSALVDNHVVPGDVVLDLTEMTNQTIKLGAGLRQDCDTIQATSAGRLRLSKPNKYWVESSQKRYIPSVEDTVLGVVVDTKPDNFLVDIKGPNLAFLPVLAFEGGTRRNIPKFEIGTLIYARVVKANSIMNPELSCMDATGKAAEFGQLKDGYMFDTSTGLSRMLLSSPTCPVLEALGKKLSFEIAVGLNGRVWVNAPSPSNVIVVSNAIIKSESLSGIGQRSMVESLLERLS

SEQ ID NO: 9216 - protein, 239 aa, Oryza sativa
MESRKPPPSALVDNHVVPGDVVLDLAEMTNQTIKLGAGLRQDCDTIQATSAGRLRLSKPSKYWVESSQKRYIPSVEDTVLGVVVDTKPDNFLVDIKGPNLAFLPVLAFEGGTRRNIPKFEIGTLIYARVVKANSIMNPELSCMDATGKAAEFGQLKDGYMFDTSTGLSRMLLSSPTCPILEALGKKLSFEIAVGLNGRVWVNAPSPSNVIVVSNAIIKSESLSGIGQRSMVESLLERLS

SEQ ID NO: 9217 - protein, 276 aa, Panicum virgatum
MVKGTEDLLATLTMSSAAGSAAVKETNSSSWSGRPRTGSRRPSHVRGLVDSYVVPGDVVLDLSEMTNQTIKLGTGLRQECDTIQATSAGMLRLSKPNKYWVESSQKRYVPSVEDTVIGVVVDTKPDNFLVDIKGPSVAFLPVLSFEGGTRRNIPKFEIGTLIYARVVKANNIMNPELSCMDATGKAAEFGQLKGGYMFDTSTGMSRMLLSSPTCPVLEALGKKLSFEIAVGLNGRVWVNAPAPSTVILVSNAIMKSESLSGIKQRAMVENLLERLS

SEQ ID NO: 9218 - protein, 276 aa, Panicum virgatum
MVKGTEDLLATLTMSSAAGSAAVKETNSSSWSGRPRTGSRRPSHVRGLVDSYVVPGDVILDLSEMTNQTIKLGTGLRQECDTIQATSAGMLRLSKPNKYWVESSQKRYVPSVEDTVIGVVVDTKPDNFLVDIKGPSVAFLPVLSFEGGTRRNIPKFEIGTLIYARVVKANNIMNPELSCMDATGKAAEFGQLKGGYMFDTSTGMSRMLLSSPTCPVLEALGKKLSFEIAVGLNGRVWVNAPAPSTVILVSNAIMKSESLSGIKQRAMVENLLERLS

SEQ ID NO: 9219 - protein, 229 aa, Panicum virgatum
LVDSYVVPGDVVLDLSEMTNQTIKLSTGLRQECDTIQATIAGVLRLSKPNKYWVESSQKRYVPSVEDTILGVVVDTKPDNFLVDIKGPNVAFLPVLSFEGGTRRNIPKFEIGTLIYARVVKANSIMNPELSCMDATGKAAEFGQLKGGYMFDTSTGMSRMLLSSPTCPVLEALGKKLSFEIAVGLNGRVWVNAPAPSTVILVSNAIMRSESLSGIKQRAMVENLLERLS

SEQ ID NO: 9220 - protein, 239 aa, Brachypodium distachyon
MESKKPPPSALVDNHVVPGDVILDLADMTNQTIKLGAGLRQDYDTIQATSAGRLRLSKPNKYWVESSQKRYIPSVEDTVLGIVVDTKPDNFLVDIKGPNFAFLPVLSFEGGTRRNIPKFEIGTLIYARVVKANSIMNPELSCMDASGKAAEFGQLKNGYMFDTSTGLSRMLLSSPTCPLLEALGKKLSFEIAVGLNGRVWVNAPSPSNVIVVSTAIIRSESYTQIQQKSMVENLLVKLS

SEQ ID NO: 9221 - protein, 239 aa, Leymus cinereus x Leymus triticoides
MESRKPQRSALVDSYVVPGDVILDLADMTNQTIKLGAGLRQDCDTIQATSAGRLRLSKPNKYWVENSQKRYVPSVEDTVLGIVVDTKPDNFLVDIKGPNLAFLPVLSFEGGTRRNIPKFEIGTLIYARVVKANSIMNPELSCMDASGKAAEFGQLKSGYTFETSTGLARMLLSSPTCPLLEALGKKLSFEIAVGLNGRVWVNAPLPSNVILVSSAIKQSESYSRLQQKSMVEKLLAKLS

SEQ ID NO: 9222 - protein, 239 aa, Triticum aestivum
MESRKPQRSALVDSYVVPGDVILDLADMTNQTIKLGAGLRQDCDTIQATSAGRLRLSKPNKYWVENSQKRYVPSVEDTVLGIVVDTKPDNFLVDIKGPNLAFLPVLSFEGGTRRNIPKFEIGTLIYARVVKANSIMNPELSCMDASGKAAEFGQLKSGYTFETSTGLARMLLSSPTCPLLEALGKKLSFEIAVGLNGRVWVNAPSPSNVIVVSSAIKESESYSRLQQKSMVEKLLAKLS

SEQ ID NO: 9223 - protein, 239 aa, Secale cereale
MESRKPQRSALVDSYVVPGDVILELADMTNQTIKLGAGLRQDCDTIQATSAGRLRLSKPNKYWVENSQKRYVPSVEDTVLGIVVDTKPDNFLVDIKGPNLAFLPVLSFEGGTRRNIPKFEIGTLIYARVVKANSIMNPELSCMDASGKAAEFGQLKSGYTFETSTGLARMLLSSPTCPLLEALGKKLSFEIAVGLNGRVWVNAPSPSNVIVVSSAIKESESYSRLQQKSMVEKLLAKLS

SEQ ID NO: 9224 - protein, 239 aa, Hordeum vulgare
MESRKPQRSALVDSYVVPGDVILDLADMTNQTIKLGAGLRQDCDTIQATSAGRLRLSKPNKYWVENSQKRYVPSVEDTVLGVVVDTKPDNFLVDIKGPNLAFLPVLSFEGGTRRNIPKFEIGTLIYARVLKANSIMNPELSCMDASGKAAEFGQLKSGYTFETSTGLARMLLSSPTCPLLEALGKKLSFEIAVGLNGRVWVNAPSPSNVIVVSSAIKESESYSRLQQKSMVEKLLAKLS

SEQ ID NO: 9225 - protein, 239 aa, Avena sativa
MESKKPPRSALVDDYVVPGDVILDLADMTNQTIKLGAGLRQDCDTIQVTSAGRLRLSKPNKYWVENSQKRYIPSVEDTVLGIVVDTKPDNFLVDIKGPNLAFLPVLSFEGGTRRNIPKFEIGTLIYARVVKANSIMNPELTCMDATGKAAEFGQLKNGYTFEISTGLARMLLSSPTCPLLEALGKKLSFEIAVGLNGRVWVNAPSPSNVILVSEAIKKSESFNRIQQRSMVEKLLAKLA

SEQ ID NO: 9226 - protein, 506 aa, Zea mays
MAKGGAVVGTAVVVCAAAAAAVGVAVVLSRRRSRRREAEDERKRKAAAVIEEVEQRLSTPTALLRGIADAMVEEMERGLRAEPHAPLKMLISYVDNLPTGDEHGLFYALDLGGTNFRVIRVQLGGRDRRVVKQQYEEVSIPPHLMVGTSTELFDFIAAELEKFVRTEGEDFHLPDSKQRELGFTFSFPVHQTSISSGTLIKWTKGFCINGTVGEDVVAELSRAMERQGLDMKVAALVNDTVGTLAGGRYADNDVVAAVILGTGTNAAYVEHANVIPKWTGLLPRSGNMVINMEWGNFRSDKLPRSEYDKSLDFESLNPGEQIYEKMISGMYLGEIVRRILLKLAHDASLFGDVVPPKLEQLFILRTPDMSAMHHDTSHDLKHLGAKLKDILGVPDTSLEARYITLHVCDLVAERGARLAAAGIYGILKKLGKDKLLGDFSQQRTVVAIDGGLYEHYKKFSACLEATLTDLLGEEVASSVVVKLANDGSGIGAALLAASHSQYAEAA

SEQ ID NO: 9227 - protein, 505 aa, Setaria italica
MGKGAVVGTAVVVCAAAAAAVGVAVVVSRRRRRRREAENERKRKAAAVIEEVEQAFSTPTALLRGIADAMVVEMERGLRADPHAPLKMLISYVDNLPTGDEHGLFYALDLGGTNFRVIRVQLGGREKRVVKQQYEEVSIPPHLMVGTSTELFDFIAAELEKFVRTEGEDFHLPDGKQRELGFTFSFPVHQTSISSGTLIKWTKGFSINGTVGEDVVAELSRAMERQGLDMKVTALVNDTVGTLAGGRYVDNDVAAAVILGTGTNAAYVEHANAIPKWNGLLPRSGNMVINMEWGNFRSDKLPSSEYDKALDFESLNPGEQIYEKMISGMYLGEIVRRILLKLAHDASLFGDVVPPKLEQLFVLRTPDMSAMHHDTSHDLKHLGAKLKDILGVPDTSLEARYITLHVCDLVAERGARLAAAGIYGILKKLGKDKLPNDFSQQRTVVAMDGGLYEHYKKFSACLEATLTDLLGEEAASSVVVKLANDGSGIGAALLAASHSQYAEAA

SEQ ID NO: 9228 - protein, 502 aa, Pennisetum glaucum
MGKGAVAGTAVVVCAAAVGVAVVVSRSRRRRREAEGERKRKAAAVIEEVEQALSTPTALLRGIADAMVVEMERGLRADPHAPLKMLISYVDNLPTGDEQGLFYALDLGGTNFRVIRVQLGGREKRVVKQEYEEVSIPSHLMVGTSTELFDFIAAELEKFVRTEGEDFHLPDGKQRELGFTFSFPVHQTSISSGTLIKWTKGFSINGTVGEDVVAELSRAMERQGLDMKVTALVNDTVGTLAGGRYIDNDVAAAVILGTGTNAAYVEHANAIPKWKGLLPKSGNMVINMEWGNFRSDKLPSSEYDKALDFESLNPGEQIYEKMISGMYLGEVVRRILLKLAHDASLFGDVVPPKLEQLFVLRTPDMSAMHHDTSHDLKHLGAKLKDILGVADTCLEARYITLRVCDLVAERGARLAAAGIYGILKKLGKDKLPNDFSQQRTVVAMDGGLYEHYKKFSACLEATLTDLLGEEAASSVVVKLANDGSGIGAALLAASHSHYGEAA

SEQ ID NO: 9229 - protein, 87 aa, Panicum virgatum
MTGQDTYGILKKLGKDKLLNDFSQQRTVVAMDGGLYEHYKKFSSCLEATLSDLLGEEAASSVVVKLANDSSGIGAALLAASHSQYAA

SEQ ID NO: 9230 - protein, 506 aa, Oryza sativa
MGKGTVVGTAVVVCAAAAAAVGVAVVVSRRRRSKREAEEERRRRAAAVIEEVEQRFSTPTALLRGIADAMVEEMERGLRADPHAPLKMLISYVDNLPTGDEHGLFYALDLGGTNFRVIRVQLGGREKRVVSQQYEEVAIPPHLMVGTSMELFDFIAAELESFVKTEGEDFHLPEGRQRELGFTFSFPVHQTSISSGTLIKWTKGFSINGTVGEDVVAELSRAMERQGLDMKVTALVNDTVGTLAGGRYVDNDVAAAVILGTGTNAAYVEHANAIPKWTGLLPRSGNMVINMEWGNFKSERLPRSDYDNALDFESLNPGEQIYEKMISGMYLGEIVRRILLKLAHDASLFGDVVPTKLEQRFILRTPDMSAMHHDTSHDLKHLGAKLKDILGVADTSLEARYITLHVCDLVAERGARLAAAGIYGILKKLGRDRVPSDGSQKQRTVIALDGGLYEHYKKFRTCLEATLADLLGEEAASSVVVKLANDGSGIGAALLAASHSQYASVE

SEQ ID NO: 9231 - protein, 505 aa, Brachypodium distachyon
MGKETTVVGTAVAVCAAAAAAVGVAVAVSRRKSRRGAKAERRKKAADVIEEVDRAFATPTPMLRDIADAMVEEMERGLRADPHAPIKMLISYVDNLPTGDEHGLFYALDLGGTNFRVIRVQLGGKEKRVVQQYEEVAIPPHLMVGTSIELFDFIAAELERFVATEGDDFYLPEGRQRELGFTFSFPVNQTSISSGTLIKWTKGFSINGTVGDDVVAELSRAMERQGLDMKVTALVNDTVGTLAGGIYDDKDVVAAVILGTGTNAAYVEHANAIPKWNGLLPRSGNMVINMEWGNFKSDKLPHSEYDRALDFESLNPGEQIYEKMISGMYLGEIVRRILLKLAHDASLFGDVVPPKLEHLFALRTPDMSAMHHDTSHDLRFMLSKLKDILGVADISLEARYITLHICDKVAERGARLAAAGIYGILKKLGRDRVPSDGSPKKRTVVAVDGGLFEHYKKFSSCVEATLADLLGKEAASSVVVKMANDGSGIGAALLAASHSQYAIAE

SEQ ID NO: 9232 - protein, 506 aa, Pennisetum glaucum
MGKAAAVGTAVVVCAAVGVAVVLARKRSRRAAELLGSAEAERKRRAAAVIEEVERSLATPTALLRSIADAMVTEMERGLRGDIHAQLKMLISYVDNLPSGDEHGLFYALDLGGTNFRVLRVQLGGREKRVVKQQYEEVSIPPHLMVGTSLELFDFIAAALAKFVDTEGEDFQLPEGRQRELGFTFSFPVNQTSISSGTLIKWTKGFSVNGMVGEDVVSELSKAMERQGLDMKVTALVNDTVGTLAGGRYMDNDVVAAVILGTGTNAAYVEHANAIPKWTGLLPKSGNMVINTEWGSFKSKLPLSEYDKAMDFESLNPGEQIYEKLISGMYLGEIVRRILLKLAHDASLFGDVVPPKLEQPFVLRTPDMSAMHHDSSHDLKILGAKLKDIVGVADTSLEVRYITRHICDLVAERGARLAAAGIYSILKKLGRDKAPSNGSKMPRTVVALDGGLYEHYKKFSSCVETTLTDLLGEEVASSVVTKLANDGSGIGAALLAASHSQYAEVD

SEQ ID NO: 9233 - protein, 507 aa, Setaria italica
MGKAAAVGTAVVVCAAVGVAVVLARRRRRRDAELLGSADADRKRRAAAVIEEVERSLATPTALLRSIADAMVTEMERGLRADIHAQLKMLISYVDNLPTGDEHGLFYALDLGGTNFRVLRVQLGGREKRVVKQQYEEVSIPPHLMVGTSLELFDFIAAALAKFVDTEGEDFHLPEGRQRELGFTFSFPVNQTSISSGTLIKWTKGFSVNGMVGEDVVSELSKAMERQGLDMKVTALVNDTVGTLAGGRYMDNDVVAAVILGTGTNAAYVEHANAIPKWTGLLPKSGNMVINTEWGSFKSDKLPLSEYDKAMDFESLNPGEQIYEKLISGMYLGEIVRRILLKLAHDASLFGDVVPSKLEQPFVLRTPDMSAMHHDSSHDLKILGAKLKDIVGVADTSLEVRYITRHICDLVAERGARLAAAGIYSILKKIGRDKVPSNGSKMPRTVIALDGGLYEHYKKFSSCVETTLTDLLGEEASSSVVAKLANDGSGIGAALLAASHSQYAEAD

SEQ ID NO: 9234 - protein, 507 aa, Zea mays
MGKSVVVGAAVVACAAVGVAAVLVHRRRKRDAALLGSAEAERRRRAAAVIEEVERSLATPTALLRGIADAMVAEMERGLRGDIHAQLKMLISYVDNLPTGDEHGLFYALDLGGTNFRVLRVQLGGREKRVVKQQYEEVSIPPHLMVGTSIELFDFIAAALAKFVDTEGEDFHLPEGRQRELGFTFSFPVNQTSISSGTLIKWTKGFSINGTVGEDVVSELSRAMERQGLDMKVTALVNDTVGTLAGGRYMDNDVVAAVILGTGTNAAYVEHANAIPKWTGLLPKSGNMVINTEWGSFKSGKLPLSEYDKAMDFESLNPGEQIYEKMISGMYLGEIVRRILLKLAHDASLFGDVVPTKLEQPFILRTPDMSAMHHDSSHDLKTLGSKLKDIVGVADTSLEVRYITRHICDLVAERGARLAAAGIYSILKKIGRDKVPSSGSKMPRTVIALDGGLYEHYKKFSSCVEATLTDLLGEEASSSVVAKLANDGSGIGAALLAASHSQYGESD

SEQ ID NO: 9235 - protein, 507 aa, Sorghum bicolor
MGKAVVVGTAVVACAAVGVALALAHRRRKRDAELLGSAEAERKRRAAAVIEDVESSLATPTALLRSIADAMVTEMERGLRGDIHSQLKMLISYVDNLPTGDEHGLFYALDLGGTNFRVLRVQLGGREKRVVKQQYEEVSIPPHLMVGTSMELFDFIAAALAKFVDTEGEDFHLPEGRLRELGFTFSFPVNQTSISSGTLIKWTKGFSINGTVGEDVVSELSRAMERQGLDMKVTALVNDTVGTLAGGRYMDNDVVAAVILGTGTNAAYVEHANAIPKWTGLLPKSGNMVINTEWGSFKSDKLPLSEYDKAMDFESLNPGEQIYEKMISGMYLGEIVRRILLKLAHDASLFGDVVPSKLEQPFILRTPDMSAMHHDSSHDLKTLGAKLKDIVGVADTSLEVRYITRHICDLVAERGARLAAAGIYSILKKIGRDKVPSSGGKMPRTVVALDGGLYEHYKKFSSCVEATLTDLLGEEASSSVVAKLANDGSGIGAALLAASHSQYGESH

SEQ ID NO: 9236 - protein, 507 aa, Panicum virgatum
MGKAAAVGTAVVVCAAVGVAVVVAHRRRRREAELKGSAEADRKRRAAAVIEEVERSLSTPTALLRSIADAMVSEMERGLRGDIHSQLKMLISYVDNLPTGDEHGLYYALDLGGTNFRVLRVQLGGREKRVVKQQYEEVSIPPHLMVGSSMELFDFIAAALAKFVDTEGEDFHLPEGRQRELGFTFSFPVNQTSISSGTLIKWTKGFSVNGTVGADVVSELSKAMERQGLDMKVTALVNDTVGTLAGGRYLDNDVVAAVILGTGTNAAYVEHANAIPKWTGLLPKSGNMVINTEWGSFKSDKLPLSEYDKAMDFESLNPGEQIYEKMISGMYLGEIVRRILLKLAHDASLFGDVVPSKLEQPFVLRTPDMSAMHHDSSHDLKILGAKLKDIVGVADTSLEVRYITRHICDLVAERGARLAAAGIYSILKKIGRDKVPSNGSKMPRTVIALDGGLYEHYKKFSSCVETTLTDLLGEEASSSVVAKLANDGSGIGAALLAASHSQYADVD

SEQ ID NO: 9237 - protein, 507 aa, Panicum virgatum
MGKAAAVGTAVVVCAAVGVAVGVARRRRRREAELQGSAEADRKRRAAAVIEEVERSLSTPTALLRSIADAMVSEMERGLRGDIHSQLKMLISYVDNLPTGDEHGLYYALDLGGTNFRVLRVQLGGREKRVVKQQYEEVSIPPHLMVGSSMELFDFIAAALAKFVDTEGEDFHLPEGRQRELGFTFSFPVNQTSISSGTLIKWTKGFSVNGTVGADVVSELSKAMERQGLDMKVTALVNDTVGTLAGGRYMDNDVVAAVILGTGTNAAYVEHANAIPKWTGLLPKSGNMVINTEWGSFKSDKLPLSEYDKAMDFESLNPGEQIYEKMISGMYLGEIVRRILLKLAHDASLFGDVVPSKLEQPFVLRTPDMSAMHHDSSHDLKILGAKLKDIVGVADTSLEVRYITRHICDLVAERGARLAAAGIYSILKKIGRDKVPSNGSKMPRTVIALDGGLYEHYKKFSSCVETTLTDLLGEEASSSVVAKLANDGSGIGAALLAASHSQYADVD

SEQ ID NO: 9238 - protein, 507 aa, Secale cereale
MGKAAAVGTAVVVCAAVGTAVVLGRRRRRRDAELLSAAEAERKRKVAAVIEDVERTLSTPTALLRGISDALVLEMERGLRGDIHSQLKMLISYVDNLPTGDEHGLFYALDLGGTNFRVLRVQLGGREKRVVKQQYQEVSIPPHLMVGTSLELFDFIAAVLAKFVETEGDEFHLPVGRQRELGFTFSFPVNQLSISSGTLIKWTKGFSINGTVGEDVVAELSKAMERQGLDMKVSALVNDTVGTLAGGRYMDNDVVAAVILGTGTNAAYVEHANAIPKWNGLLPKSGNMVINTEWGSFKSDKLPLSEYDKALDFESLNPGEQIYEKLISGMYLGEIVRRILLKLAHDAALFGDVVPPKLELPFVLRTPDMSAMHHDASHDLKILGSKLKDIVGVADTSLEVRYITRHICDIVAERGARLAAAGIYGILKKLGRDKVPTDGSPMPRTVVALDGGLYEHYKKFSSCLEATLSDLLGEEASSSLVAKLANDGSGIGAALLAASHSQYAEVY

SEQ ID NO: 9239 - protein, 507 aa, Hordeum vulgare
MGKAAAVGTAVVVCAAVGTAVVLGRRRRRRDAELLGAAEAERKKKVAAVIEEVERTLATPTALLRGISDALVLEMERGLRGDIHSQLKMLISYVDNLPTGDEHGLFYALDLGGTNFRVLRVQLGGREKRVVKQQYEEVSIPPHLMIGTSLELFDFIAAVLAKFVDTEGDEYHLPVGRQRELGFTFSFPVNQLSISSGTLIKWTKGFSINGTVGEDVVAELSKAMERQGLDMKVTALVNDTVGTLAGGRYMDNDVVAAVILGTGTNAAYVEHANAIPKWTGLLPKSGNMVINTEWGSFKSDKLPLSEYDKALDFESLNPGEQIYEKLISGMYLGEIVRRILLKLAHDAALFGDVVPAKLELPFVLRTPDMSAMHHDASHDLKILGSKLKDIVGVADTSLEVRYITRHICDIVAERGARLAAAGIYGILKKLGRDKVPADGSPMPRTVVALDGGLYEHYKKFSSCLEATLSDLLGEEASSSLVAKLANDGSGIGAALLAASHSQYAEVD

SEQ ID NO: 9240 - protein, 507 aa, Leymus cinereus x Leymus triticoides
  misc_feature (103)..(103): Xaa can be any naturally occurring amino acid
  misc_feature (175)..(175): Xaa can be any naturally occurring amino acid
  misc_feature (234)..(234): Xaa can be any naturally occurring amino acid
MGKAAAVGTAVVVCAAVGTAVVLGRRRRRRDAELLGAAEAERKQKVADVIEEVERTLATPTALLRSISDALVAEMERGLRGDIHSQLKMLISYVDNLPTGDEXGLFYALDLGGTNFRVLRVQLGGKEKRVVKQQYEEVSIPPHLMVGTSLELFDFIAAVLAKFVDTEGDEFHLPXGRQRELGFTFSFPVNQISISSGTLIKWTKGFSINGTVGEDVVAELSKAMERQGLDMKVXALVNDTVGTLAGGRYMDNDVVAAVILGTGTNAAYVEHANAIPKWTGLLPKSGNMVINTEWGSFKSDKLPLSEYDKALDFESLNPGEQIYEKLISGMYLGEIVRRILLKLAHDAALFGDVVPAKLEQPFVLRTPDMSAMHHDASHDLKILGSKLKDIVGVADTSLEVRYITRHICDIVAERGARLAAAGIYGILKKLGRDKVPTDGSRMPRTVVALDGGLYEHYKKFSSCLEATLSDLLGEEASSSLVAKLANDGSGIGAALLAASHSQYAEVD

SEQ ID NO: 9241 - protein, 506 aa, Brachypodium distachyon
MGKAAAVGTAVVVCAAVGTAVVLARRRRRKDAELVGAEVDRKRKVAAVIEEVERTLATPTALLRGISDALVSEMERGLRGDIHSQLKMLITYVDNLPTGDEHGLFYALDLGGTNFRVLRVQLGGREKRVVKQQYEEVSIPPHLMVGTSMELFDFIAAALSSFVDTEGADFHLPEGRQRELGFTFSFPVNQTSISSGTLIKWTKGFSISGTVGADVVSELSKAMERQGLDMKVSALVNDTVGTLAGGRYMDSDVVAAIILGTGTNAAYVEHANAIPKWTGLLPRSGNMVINTEWGSFKSDKLPLSEYDKAMDFESLNPGEQIYEKMISGMYLGEIVRRILLKLAHDASLFGDVVPPKLEQPFVLRTPDMSAMHHDASHDLKVLGTKLKDIVGVADTSLEVRYITRHICDIVAERGARLAAAGIYGILKKLGRDKVPSDGSPMPRTVIALDGGLYEHYKKFSSCLEATLADLLGEEASSSMVAKLANDGSGIGAALLAASHSQYAEVD

SEQ ID NO: 9242 - protein, 509 aa, Zea mays
MVKAVVVGAAVVACAAVGVAVVLERRRRKRDADLLGSAEAERRRRAAAVIEEVESSLATPTALLRSIADAMVAEMERGLRGDIHAQLKMLISYVDSLPTGDEHGLFYALDLGGTNFRVLRVQLGGKEKRVVKQQYEEVSIPPHLMVGTSMELFDFIAAALAKFVGTEGEDFQLPEGRQRELGFTFSFPVNQTSISSGTLIKWTKGFSINGTVGEDVVSELSRAMERQGLDMKATALVNDTVGTLAGGRYMDTDVVAAVILGTGTNAAYVEHANAIPKWTGLLPKSGKMVINTEWGSFKSNKLPLSEYDKAMDFESLNPGEQIYEKMISGMYLGEIVRRILLKLAHEASLFGDVVPPKLELPFILRTPDMSAMHHDSSHDLKTLGAKLKDIVGVADTSLEVRYITRHICDLVAERAARLAAAGVYSILKKIGRDKVPSGGGKMPRTVVALDGGLYEHYKKFSSCVEATLTDLLGEEASSSVVAKLANDGSGIGAALLAASHSQYQYGASD

SEQ ID NO: 9243 - protein, 507 aa, Oryza sativa
MGKAAAVGTAVVVAAAVGVAVVLARRRRRRDLELVEGAAAERKRKVAAVIEDVEHALSTPTALLRGISDAMVTEMERGLRGDSHAMVKMLITYVDNLPTGNEQGLFYALDLGGTNFRVLRVQLGGKEKRVVQQQYEEVSIPPHLMVGTSMELFDFIASALSKFVDTEGDDFHLPEGRQRELGFTFSFPVSQTSISSGTLIKWTKGFSINDAVGEDVVSELGKAMERQGLDMKIAALVNDTVGTLAGGRYADNSVVAAIILGTGTNAAYVENANAIPKWTGLLPRSGNMVINTEWGSFKSDKLPLSEFDKAMDFESLNPGEQIYEKLISGMYLGEIVRRILLKLAHDAALFGDVVPSKLEQPFVLRTPDMSAMHHDSSHDLKTVGAKLKDIVGVPDTSLEVRYITSHICDIVAERAARLAAAGIYGVLKKLGRDKMPKDGSKMPRTVIALDGGLYEHYKKFSSCLESTLTDLLGDDVSSSVVTKLANDGSGIGAALLAASHSQYAEID

SEQ ID NO: 9244 - protein, 507 aa, Triticum aestivum
MGKAAAVGTAVVVCAAVGTAVVLGRRRRRRDAELLGAAEAERKKKVAAVIEDVERTLATPTALLRGISDALVVEMERGLRGDIHSQLKMLISYVDNLPTGDEHGLFYALDLGGTNFRVLRVQLGGREKRVAKQQYQEVSIPPHLMVGTSLELFDFIASVLAKFVETEGDEFHLPVGRQRELGFTFSFPVNQLSISSGTLIKWTKGFSINGAVGEDVVAELSKAMERQGLDMKVSALVNDTVGTLAGGRYMDNDVVAAIILGTGTNAAYVEHANAIPKWTGLLPKSGNMVINTEWGSFKSDKLPLSEYDKALDFESLNPGEQIYEKLISGMYLGEIVRRILLKLAHDAALFGDVVPAKLELPFVLRTPDMSAMHHDASHDLKILGSKLKDIVGVADTSLEVRYITRHICDIVAERGARLAAAGIYGILKKLGRDKVPTDGSPMPRTVVALDGGLYEHYKKFSSCLEATLSDLLGDEASSSLVAKLANDGSGIGAALLAASHSQYADIY

SEQ ID NO: 9245 - protein, 434 aa, Panicum virgatum
MVEEMERGLRADPHAPIKMLISYVDNLPTGDEHGLFYALDLGGTNFRVIRVQLGGREKRVVKQQYEEVSIPPHLMVGTSTELFDFIAAELEKFVGTEGEDFHLPDGRQRELGFTFSFPVHQTSISSGTLIKWTKGFSINGTVGEDVVAELTRAMERQGLDMKVTALVNDTVGTLAGGRYVDNDVVAAVILGTGTNAAYVEHANVIPKWNGPLPRSGNMVINMEWGNFRSDKLPSSEYDKALDFESLNPGEQLYEKMISGMYLGEIVRRILLKLAHDASLFGDVVPPKLEQLFILRTPDMSAMHHDTSHDLKHLGAKLKDILGVPDTSLEARYITLHVCDLVAERGARLAAAGIYGILKKLGKDKLLNDFSQQRTVVAMDGGLYEHYKKFSSCLEATLTDLLGEEAASSVVVKLANDGSGIGAALLAASHSQYAA

SEQ ID NO: 9246 - protein, 1044 aa, Triticum aestivum
MASPHRAYLPLLALCLVLHLHHAAAQQADERQLLLEVKRAWGDPPELASWSAATGSPCTGWAHVSCDGAGRVTSLALSNVTVSGPVPDAIGRLASLATLDLSNTSVSGGFPESLYNCTGLTHLDLSMNRLSGDLPADIGRLGGNLTYLALNGNGFTGEVPPALSKLKNLTVLALDSNQLTGTIPPELGELTGLQTLKLEHNHFGPGKLPESFKNLAKLATVWLAGCNLTGEFPSYLPELSELVWLDLSTNAFTGNIPPSIWNLTKLQVLYLHYNKLAGDVVIDGAIGAAGLIEIDLSYNKLTGAIPESLGTLTKLSKLCLSGNGFSGEIPASLAQLPSLVFLWLFENKLTGALPAELGMHSPSLRDIQVDDNDLSGPIPAGVCKNRGLWVITASGNRLNGSIPASLAKCPALISLQLQDNKLSGEVPAALWTETKLMTLLLQNNGGLTGTLPETLFWNMTRLYIMNNKFRGSLPSSAAKLQKFNAGNNSFSGEIPAGLTAGMPLLQEFILSSNQLSGAIPASIASLGGLTQMNFSNNQLTGEIPAGLGSMPVLTLLDLSSNQLSGSIPPALGSLRLNQLNLSSNDLAGEVPEALAVPAYDRSFLGNRALCTGAASSGNLAGVGSCAARSSDKVSPGLRIGLVAAAAALLVVIAALAFFIVRDMKRRKGLAPPEEAWKLTPFQPLDFGEGPVLRGLVDENLIGKGGSGRVYRVECPSRSGASGGTVVAVKRIWTGGKVERKLQREFESEVEVLGHVRHTNIVKLLCCLSRAETKLLVYEYMGNGSLDKWLHGHRWPAPAGSSMPARAPSARRAPLNWAARVRVAVGAARGLSYMHHECSPPVVHRDVKCSNILLDAELNAKVADFGLARILAEAAGTTPHDTVSAVAGTFGYMAPECGYTRKANEKVDVYSFGVVLLELATGREAGNGGEHCSLAEWAWRHLQSGKSIADAADECIGDARQSDDFDVVFKLGIVCTGAQPSTRPTMKDVLQILLRCEQAHRKNLDEKTAVSEYDGAPLLPAVRGGSRRKRLSDAADGKGSFDDVV

SEQ ID NO: 9247 - protein, 434 aa, Panicum virgatum
MVEEMERGLRADPHAPIKMLISYVDNLPTGDEHGLFYALDLGGTNFRVIRVQLGGREKRVVKQQYEEVSIPPHLMVGTSTELFDFIAAELEKFVGTEGEDFHLPDGRQRELGFTFSFPVHQTSISSGTLIKWTKGFSINGTVGEDVVAELTRAMERQGLDMKVTALVNDTVGTLAGGRYVDNDVVAAVILGTGTNAAYVEHANVIPKWNRPLPRSGNMVINMEWGNFRSDKLPSSEYDKALDFESLNPGEQLYEKMISGMYLGEIVRRILLKLAHDASLFGDVVPPKLEQLFILRTPDMSAMHHDTSHDLKHLGAKLKDILGVPDTSLEARYITLHVCDLVAERGARLAAAGIYGILKKLGKDKLLNDFSQQRTVVAMDGGLYEHYKKFSSCLEATLTDLLGEEAASSVVVKLANDGSGIGAALLAASHSQYAA

SEQ ID NO: 9248 - protein, 397 aa, Saccharum officinarum
MEPDSARKRLALLALLLLAAPACPASAAPVEDGLLSNGDFETAPAGGFVKSASVAEGASSIPGWTINGTVELISAGQHQGGMILIVPQGDHAVRLGNDASVGQVVDVEKGSEYAITFSAARTCAQLEALNVSVLGGVSQTVDLQTLYNIEGWDAYALAFQATEEQAHLQFMNPGMEDDPTCGPILDNVAVKKLFTPDKPKDNVVLNGDFEEGPWMFPNTSFGVLLPTNLDEQTSAIPGWMIESNRAVRYIDSDEYKVPQGKRAIELLSGKEGIISQMVETTPQKVYSLTFTLGTAGDSCQPPMAVMAFAGDQAQNFHYSPMGNATSQAANVTFTARAERTRVAFYSVYYNTRSDDHSSLCGPVIDDVRVWGLNAAAGLKASIGLVLGIVGVVGMVLF

SEQ ID NO: 9249 - protein, 397 aa, Zea mays
MEPDSATTRLALLALLLLAAPARPASAAPVEDGLLSNGDFETAPAGGFVRSASVAEGASSIPGWTINGTVELISAGQHQGGMILIVPQGDHAVRLGNDASVGQVVDVEKGSDYAVTFSAARTCAQLEALNVSVLGGVSQTVDLQTLYNIEGWDAYALAFQATEEQAHLQFMNPGMEDDPTCGPILDNVAVKKLFTPDKPKDNVVLNGDFEEGPWMFPNTSFGVLLPTNLDEQTSAIPGWMIESNRAVRYIDSDQYKVPQGKRAIELLSGKEGIISQMVETTPEKVYSLTAMLGAAGDSCQPPMAIMAFAGDQAQNFHYSPLGNATSQAVNVTFTARAERTRVAFYSVYYNTRSDDHSSLCGPVIDDVRVWGLNTAAGLKASAGLVLGIVGVVGMVLF

SEQ ID NO: 9250 - protein, 401 aa, Panicum virgatum
MERGSPRERRALLALCSALLLLAAPARSVWAAPVEDGLLSNGDFETAPAGGFVKSASVAEGASSIPGWTINGTVELISAGQHQGGMILIVPQGDHAVRLGNDASVGQVVEVEKGSEYAITFSAARTCAQLEALNVSVLGGVSQTVDLQTLYNIEGWDAYALAFQATDEQAHIQFMNPGMEDDPTCGPILDNVAIKKLFTPDKPKDNVVLNGDFEEGPWMFPNTSFGVLLPTNLDEQTSAIPGWMIESNRAVRFIDSDEYKVPQGKRAIELLSGKEGIISQMVETTPQKEYSLTFTLGTAGDSCQPPMAIMAFAGDQAQNFHYSPMGNATSQAANVTFTARAERTRVAFYSVYYNTRSDDHSSLCGPVIDDVRVWGLNAAAGLKASVGLVLGIVGMVGMVLL

SEQ ID NO: 9251 - protein, 401 aa, Setaria italica
MGRDSPRGRCALLALCSALLLLAAPARPAWAAPVEDGLLSNGDFETAPAGGFVKSASVAEGASSIPGWTINGTVELISSGQHQGGMILIVPQGDHAVRLGNDASVGQVVEVEKGSEYAITFSAARTCAQLESLNVSVLGGVSQTVDLQTLYNIEGWDAYALAFQATDEQAHIQFMNPGMEDDPTCGPILDNVAIKKLFTPDKPKDNVVLNGDFEEGPWMFPNTSFGVLLPTNLDEQTSAIPGWMIESNRAVRFIDSDEYKVPQGKRAIELLSGKEGIISQMVETTPQKEYSLTFTLGTAGDSCQPPMAIMAFAGDQAQNFHYSPMGNATSQAANVTFMARAERTRVAFYSVYYNTRSDDHSSLCGPVIDDVRVWGLNAAAGLKASVGLVLGIVCMVSMVLL

SEQ ID NO: 9252 - protein, 401 aa, Panicum virgatum
MERGSPRGRCALLALCSALLLLAASARSAWAAPVEDGLLSNGDFETAPAGGFVKSASVTEGASSIPGWTINGTVELISAGQHQGGMILIVPQGDHAVRLGNDASVGQVVEVEKGSEYAITFSAARTCAQLEALNVSVLGGVSQTVDLQTLYNIEGWDAYALAFQATDEQAHIQFMNPGMEDDPTCGPILDNVAIKKLFTPDKPKDNVVLNGDFEEGPWMFPNTSFGVLLPTNLDEQTSAIPGWMIESNRAVRFIDSDEYKVPQGKRAIELLSGKEGIISQMVETTPQKEYSLTFTLGTAGDSCQPPMAIMAFAGDQAQNFHYSPMGNATSQAANVTFTARAERTRVAFYSVYYNTRSDDHSSLCGPVIDDVRVWGLNAAAGLKASVGLVLGIVGMVGMVLL

SEQ ID NO: 9253 - protein, 401 aa, Panicum virgatum
MERGSPRGRRALLALCSALLLLAAPARSVWAAPVEDGLLSNGDFETAPAGGFVKSASVAEGASSIPGWTINGTVELISAGQHQGGMILIVPQGDHAVRLGNDASVGQVVEVEKGSEYAITFSAARTCAQLEALNVSVLGGVSQTVDLQTLYNIEGWDAYALAFQATDEQAHIQFMNPGMEDDPTCGPILDNVAIKKLFTPDKPKDNVVLNGDFEEGPWMFPNTSFGVLLPTNLDEQTSAIPCWMIESNRAVRFIDSDEYKVPQGKRAIELLSGKEGIISQMVETTPQKEYSLTFTLGTAGDSCQPPMAIMAFAGDQAQNFHYSPMGNATSQAANVTFTAHAERTRVAFYSVYYNTRSDDHSSLCGPVIDDVRVRGLNAAAGLKASVGLVLSIVGMVGMVLL

SEQ ID NO: 9254 - protein, 397 aa, Pennisetum glaucum
MGRDPPRGRRALLALCSALLLLAAASAAPVEDGLLSNGDFETAPASGFVKSASVAEGASSIPGWTINGTVELISAGQHQGGMILIVPQGDHAVRLGNDASIGQVVEVEKGSEYAITFSAARTCAQLESLNVSVLGGVSQTVDLQTLYNIEGWDAYALAFQATDEQAHIQFMNPGMEDDPTCGPILDNVAIKKLFTPDKPKDNVVLNGDFEEGPWMFPNTSFGVLLPTNLDEQTSAIPGWMIESNRAVRFIDSDEYKVPQGKRAIELLSGKEGIISQMVETTPQKEYSLTFTLGTAGDSCQPPMAIMAFAGDQAQNFHYSPMGNATSQAANVTFTARAERTRVAFYSVYYNTRSDDHSSLCGPVIDDIRVWGLNAAAGLKASVGLVLGIVGVVSMVLL

SEQ ID NO: 9255 - protein, 399 aa, Oryza sativa
MEGDSARRLALLGLCLGLLLLAPSHLASAAAVEDGLLSNGDFETAPAGGFVKSASVAEGASSIPGWTINGTVELISAGQHQGGMILIVPQGDHAVRLGNDASIGQVVQVEKGSEYAITFSAARTCAQLESLNVSVLGGASQTVDLQTLYNIEGWDAYALAFQATDEQASLEFRNPGMEDDPTCGPILDNVAIKKLFTPDKPKDTVVSNGDFEEGPWMFPNTSFGVLLPTNLDEQTSALPGWMIESNRAVRFVDSDQYTVPQGKRAIELLSGKEGIISQMVETTPQKEYSLTFTLGSAGDSCQPPMAVMAFAGDQAQNFHYSPMGNATSQAANVTFTARAERTRVAFYSVYYNTRSDDHSSLCGPVIDDVRVWGLNGAAGLKASIGLLLGIVSIVSLMLF

SEQ ID NO: 9256 - protein, 223 aa, Oryza sativa
MEDDPTCGPILDNVAIKKLFTPDKPKDNVVSNGDFEEGPWMFPNTSFGVLLPTNLDEQTSALPGWMIESNRAVRFVDSDQYTIPQGKRAIELLSGKEGIISQMVETTPQKEYSLTFTLGSAGDSCQPPMAVMAFAGDQAQNFHYSPMGNATSQAANVTFTARAERTRVAFYSVYYNTRSDDHSSLCGPVIDDVRVWGLNGAAGLKASIGLLLGIVSIVSLMLF

SEQ ID NO: 9257 - protein, 376 aa, Zea mays
MISDLLASCTTGLLSNGDFETAPSGGFVKSASVAEGASSIPGWTINGTVELISAGQHQGGMILIVPQGDHAVRLGNDASVGQVVDVEKGSEYAITFSAARTCAQLEALNVSVLGGVSQTVDLQTLYNIEGWDAYALAFQATEEQAHLQFMNPGMEDDPTCGPILDNVAVKKLFTPDKPKDNVVLNGDFEEGPWMFPNTSFGVLLPTNLDEQTSAIPGWMIESNRAVRYIDSDEYKVPQGKRAIELLSGKEGIISQMVETTPQKVYSLTFTLGTAGDSCQPPMAVMAFAGDQAQNFHYSPMGNATSQAANVTFTARAERTRVAFYSVYYNTRSDDHSSLCGPVIDDVRVWALNAAAGLKASIGLVLGIVGVVGMVLF

SEQ ID NO: 9258 - protein, 379 aa, Panicum virgatum
LDTYYSDLVISNPTGLLSNGDFETAPAGGFVKSASVAEGASSIPGWTINGTVELISAGQHQGGMILIVPQGDHAVRLGNDASVGQVVEVEKGSEYAITFSAARTCAQLEALNVSVLGGVSQTVDLQTLYNIEGWDAYALAFQATDEQAHIQFMNPGMEDDPTCGPILDNVAIKKLFTPDKPKDNVVLNGDFEEGPWMFPNTSFGVLLPTNLDEQTSAIPCWMIESNRAVRFIDSDEYKVPQGKRAIELLSGKEGIISQMVETTPQKEYSLTFTLGTAGDSCQPPMAIMAFAGDQAQNFHYSPMGNATSQAANVTFTAHAERTRVAFYSVYYNTRSDDHSSLCGPVIDDVRVRGLNAAAGLKASVGLVLSIVGMVGMVLL

SEQ ID NO: 9259 - protein, 393 aa, Brachypodium distachyon
MGLTLLGLCLAVLLLAPPSRLASAAAVEDGLLSNGDFETAPVGGFAKSASVSEGASTIPSWTINGTVELVSAGQHQGGMILIVPQGDHAVRLGNDAGIGQVVQVEKGSEYAITFSAARTCAQLESLNVSAGGVSQTVDLQTLYNIEGWDAYALAFQAVDEQANLEFRNPGMEDDPTCGPILDNVAIKKLFAPEKPKDNMVVNGDFEEGPWMFPNTSFGVLLPTNLDEQTSALPGWMIESNRAVRFVDSDQYTVPQGKRAIELLSGKEGIISQMVETTPQKVYSLTFTLGSAGDSCQPPMAVMAFAGDQAQNFHYSPMGNATSQAANVTFTARAERTRVALYSVYYNTRSDDHSSLCGPVIDDVRVWGLNGAAGLKASIGLLLGMVSVIGLMLF

SEQ ID NO: 9260 - protein, 394 aa, Festuca arundinacea
  misc_feature (23)..(23): Xaa can be any naturally occurring amino acid
  misc_feature (43)..(43): Xaa can be any naturally occurring amino acid
  misc_feature (47)..(47): Xaa can be any naturally occurring amino acid
  misc_feature (61)..(61): Xaa can be any naturally occurring amino acid
MERLAWLGLGVALLLLAPASRLXSAAAVEDGLLTNGDFETAPXGGFXKSASVSEGASTIPXWTINGTVELVSAGQHQGGMILIVPQGDHAVRLGNDAGIGQVVQVEKGSEYAITFSAARTCAQLEALNVSAGGVSQTVDLQTLYNIEGWDAYALAFQAVDEQATLEFRNPGMEDDPTCGPILDNVAIKKLFAPDKPKDSTVINGDFEEGPWMFPNTSFGVLLPTNLDEQTSAIPGWMIESNRAVRFVDSDQYSVPQGKRAIELLSGKEGIISQMVETTPQKVYSLTFTFGSAGDSCQPPMAVMAFAGDQAQNFHYSPMGNATSQAANVTFTARAERTRIALYSVYYNTRSDDHSSLCGPVVDDVRVWGLNGAAGLKASIGLLLGMVSVVGLMMF

SEQ ID NO: 9261 - protein, 392 aa, Leymus cinereus x Leymus triticoides
MGRGLALLGLALLLLAPSPRLASAAPVEDGLLINGDFETAPPGGFVKSASVSEGAAIPSWTINGTVELISAGQHQGGMILIVPQGDHAVRLGNDAGIGQVVQVEKGSEYAITFSAARTCAQLESLNVSAGSVSQTVDLQTLYSIEGWDAYALAFQAVDEQANLEFRNPGMEDDPTCGPILDNVAIKKLFSPDKPKENMVINGDFEEGPWMFPNTSFGVLLPTNLDEQTSALPGWMVESNRAVRFVDSDQYTVPQGKRAIELLSGKEGIIAQMVETTPQKAYSLTFTLGSAGDSCQPPMAVMAFAGDQAQNFHYAPMGNATSQAVNVNFTARAERTRVALYSIYYNTRSDDHSSLCGPVIDDIRVWGLNGAAGLKASIGMLIAMVSAIVLVLF

SEQ ID NO: 9262 - protein, 394 aa, Hordeum vulgare
MERGLALLGLGLALLLLAPSRRLASAAPVEDGLLINGDFETAPPGGFVKSSSVSEGAAIPSWTINGTVELISAGQHQGGMILIVPQGDHAVRLGNDAGIGQVVQVEKGSEYAITFSAARTCAQLESLNISAGSISQTVDLQTLYSIEGWDAYALAFQAVDEQANIEFRNPGMEDDPTCGPILDNVAIKKLFSPDKAKENMVINGDFEEGPWMFPNTSFGVLLPTNLDEQTSALPGWMIESNRAVRFIDSDQYTVPQGKRAIELLSGKEGIISQMVETTPQKAYILTFTLGSAGDSCQPPMAVMAFAGDQAQNFHYSPMGNATSQAVNVNFTARAERSRVALYSVYYNTRSDDHSSLCGPVIDDVRVWGLNGAAGLKASIGMLIAMVSVIVLVLF

SEQ ID NO: 9263 - protein, 394 aa, Hordeum vulgare
MERGLALLGLGLALLLLAPSRRLASAAPVEDGLLINGDFETAPPGGFVKSSSVSEGAAIPSWTINGTVELISAGQHQGGMILIVPQGDHAVRLGNDAGIGQVVQVEKGSEYAITFSAARTCAQLESLNISAGSISQTVDLQTLYSIEGWDAYALAFQAVDEQANIEFRNPGMEDDPTCGPILDNVAIKKLFSPDKAKENMVINGDFEEGPWMFPNTSFGVLLPTNLDEQTSALPGWMIESNRAVRFIDSEQYTVPQGKRAIELLSGKEGIISQMVETTPQKAYILTFTLGSAGDSCQPPMAVMAFAGDQAQNFHYSPMGNATSQAVNVNFTARAERSRVALYSVYYNTRSDDHSSLCGPVIDDVRVWGLNGAAGLKASIGILIAMVSVIVLVLF

SEQ ID NO: 9264 - protein, 394 aa, Triticum aestivum
MERGLALLGLGLALLLLAPSRRLASAAPVEDGLLINGDFETAPPGGFVKSASVSEGAAIPSWTINGTVELISAGQHQGGMILIVPQGDHAVRLGNDAGIGQVVQVEKGSEYAITFSAARTCAQLESLNISAGSVSQTVDLQTLYSIEGWDAYALAFQAVDEQASIEFRNPGMEDDPTCGPILDNVAIKKLFSPDKAKENMVINGDFEEGPWMFPNTSFGVLLPTNLDEQTSALPGWMIESNRAVRFVDSDQYTVPQGKRAIELLSGKEGIISQMVETTPQKAYTLTFTLGSAGDSCQPPMAVMAFAGDQAQNFHYAPMGNATSQAVNVNFTARAERTRVALYSVYYNTRSDDHSSLCGPVIDDVRVWGLNGAAGLKASIGLLIAMASVIVLVLF

SEQ ID NO: 9265 - protein, 395 aa, Secale cereale
MERGLALLLGLLPLLLLAPASRLASAAPVEDGLLINGDFETAPPGGFVKSASVSEGAAIPSWTINGTVELISAGQHQGGMILIVPQGDHAVRLGNDAGIGQVVQVEKGSEYSITFSAARTCAQLESLNISAGSVSQTVDLQTLYSIEGWDAYALAFQAVDEQANIEFRNPGMEDDPTCGPILDNVAIKKLFSPDKAKENMVINGDFEEGPWMFPNTSFGVLLPTNLDEETSALPGWMIESNRAVRFVDSDQYTVPQGKRAIELLSGKEGIISQMVETTPQKAYRLTFTLGSAGDSCQPPMAVMAFAGDQAQNFHYSPMGNATSQAVDVNFTARAERTRVALYSVYYNTRSDDHSSLCGPVIDDVRVWGLNGAAGLKASIGMLIAMASVIALVVLF

SEQ ID NO: 9266 - protein, 389 aa, Secale cereale
MERGLALLLGLLPLLLLASAAPVEDGLLINGDFETAPPGGFVKSASVSEGAAIPSWTINGTVELISAGQHQGGMILIVPQGDHAVRLGNDAGIGQVVQVEKGSEYSITFSAARTCAQLESLNISAGSVSQTVDLQTLYSIEGWDAYALAFQAVDEQANIEFRNPGMEDDPTCGPILDNVAIKKLFSPDKAKENMVINGDFEEGPWMFPNTSFGVLLPTNLDEETSALPGWMIESNRAVRFVDSDQYTVPQGKRAIELLSGKEGIISQMVETTPQKAYRLTFTLGSAGDSCQPPMAVMAFAGDQAQNFHYSPMGNATSQAVDVNFTARAERTRVALYSVYYNTRSDDHSSLCGPVIDDVRVWGLNGAAGLKASIGMLIAMVSVIVLVVLF

SEQ ID NO: 9267 - protein, 395 aa, Triticum aestivum
MERGLVALLGLGLALLLLAPSRRLASAAPVEDGLLMNGDFETAPPGGFVKSASVSEGAAIPSWMINGTVELISAGQHQGGMILIVPQGDHAVRLGNDAGIGQVVEVEKGSEYAITFSAARTCAQLESLNISAGSVSQTVDLQTLYSIEGWDAYALAFQAVDEQASIEFRNPGMEDDPTCGPILDNVAIKKLFSPDKAKENMVINGDFEEGPWMFANTSFGVLLPTNLDEQTSALPGWMIESNRAVRFVDSDQYTVPQGKRAIELLSGKEGIISQMVETTPQKAYTLTFTLGSAGDSCQPPMAVMAFAGDQAQNFHYAPMGNATSQAVNVNFTARAERTRVALYSVYYNTRSDDHSSLCGPVIDDVRVWGLNGAAGLKASIRMLIAMASVIVLVLF

SEQ ID NO: 9268 - protein, 126 aa, Secale cereale
MERGLALLLGLLPLLLLAPASRLASAAPVEDGLLINGDFETAPPGGFVKSASVSEGAAIPSWTINGTVELISAGQHQGGMILIVPQGDHAVRLGNDAGIGQVVQVEKGSEYSITFSAAGPARSWSH

SEQ ID NO: 9269 - protein, 389 aa, Secale cereale
MERGLALLLGLLPLLLLASAAPVEDGLLINGDFETAPPGGFVKSASVSEGAAIPSWTINGTVELISAGQHQGGMILIVPQGDHAVRLGNDAGIGQVVQVEKGSEYSITFSAARTCAQLESLNISAGSVSQTVDLQTLYSIEGWDAYALAFQAVDEQANIEFRNPGMEDDPTCGPILDNVAIKKLLSPDKAKENMVINGDFEEGPWMFPNTSFGVLLPTNLDEETSALPGWMIESNRAVRFVDSDQYTVPQGKRAIELLSGKEGIISQMVETTPQKAYRLTFTLGSAGDSCQPPMAVMAFAGDQAQNFHYSPMGNATSQAVDVNFTARAERTRVALYSVYYNTRSDDHSSLCGPVIDDVRVWGLNGAAGLKASIGMLIAMVSVIVLVVLF

SEQ ID NO: 9270 - protein, 368 aa, Zea mays
MAAAAHQVSAVIFDLDGTLLDTERATRDVLTEFLAAYGKVPDAGEEEKRLGQMYLESTTGIIRDYGLPLTVDEYSKAMYPLYLKRWQKAKPLPGVKRLVKHLHKNGVPLALASNSIRRNVDHKLPKLEDWGKCFSVILGGDQVPNGKPSPDIFLEAAKRLGANPSSCLVIEDSVVGVKGAKASGAKAVAVPSLQNQRNHYYIADVILYSLLDFQPEMWGLPPFEDRIQGVLPIDPLLSNARIGGKILNNIHWVISDDCAYEYIPDQISGIFLGWAKSKVHGFSKVIVATGWDFSQQTVERVMHVHFLDCSGTVETEPVKLLIIGYIRKLQSADDILQALSVTDEDRRIARDALDLPTFSEYANDLHLA

SEQ ID NO: 9271 - protein, 367 aa, Setaria italica
MAAAHQVSAVIFDLDGTLLDTERATRDVLNEFLASYEKVPDPEKEEKRLGQMYMESTTGIIRDYGLPLTVEEYSKAMHPLYLKRWQKAKPLPGVKRLVKHLYKNGVPLALASNSIRRNIDHKLPKLEDWGECFSVILGGDQVPNGKPSPDIFLEAAKRLGVNPSSCLVIEDSVVGVKGAKASGAKAVAVPSLQSQRKHYYIADIILYSLLDFDPELWGLPPFEDRVHGVLPIDPLLSTAQIGDRILNNLHRVISDVHTYECIPDQISGIYMGWARSKVHGFSKVVIGTGWDFSQQTVERVMVVEFLDSTGKIETEPVKLLVIGYIRKLQSTDDMLQALSVTDEDRSIARDGLDLPTFSEYAHDLHFP

SEQ ID NO: 9272 - protein, 367 aa, Panicum virgatum
MAAAHQVSAVIFDLDGTILDTERTTRDVLDEFLAAYGKVPDPEKEEKRLGQMYLESTTGIIRDYGLPLTVEEYSKAMHPLYLKRWQKAKPLPGVKRLVKHLFKNRVPLAIASNSVRRNIDHKVPKLEDWGECFSVILGGDQVPNGKPSPDIFLEAAKRLGVNPSSCLVIEDSVVGVKGAKASEAKVVAVPSLQSQRKHYNIADIILYSLLDFDPELWGLPPFEDRIQGVLPIDPLISTGQIGDRILNNLHRLISDERTYDCIPDQISGIYLGWAKLKVHGFSKVVIGTGWDFSQQTVERVMVVEFLDYSGQIETEPVKLLVIGYVRKLQSTDDILQALNVTDEDRSIARDALDLPTFSEYAHDIHFS

SEQ ID NO: 9273 - protein, 344 aa, Zea mays
MCEAPRLGNRAGAGDPAAADVDVVTTGGRRRIPAHSSVLASASPVLGSILERRLRKDRESGKPGRSVVRIRGVTDDAAAAFVRLLYAGRCGEDEDDDMEEHAVQVLVLAHAYQVPWLKRACEGAIGARLTADSVVDVLQLAGLCDAPRLHLRCARLLAKEFAAVERTEAWRFLQENDPWQELHVLQRLHEADMRRRKWRRKRAEQRVYMELSEAMDCLDHICTEGCTEVGPAGRAPAPAPCARYATCRGLQLLIRHFSQCHRKSCARCQRMWQLLRLHSALCDRTDRCNTPLCMRFKQQEQDKAAAKGGDDGDKWGLLVKKVKTARVFSSLANRKQMSTTTTQC

SEQ ID NO: 9274 - protein, 345 aa, Setaria italica
MCEAPRLRCDAGAGEAVAAADVDVVTTRGRRRIPAHSSVLATASPVLGCILERRLRKDRESGKKAGRSVVRIRGVTDDAAAAFVRLLYAGRCGDGEEEDMEKHAVQVLVLAHAYQVPWLKRACEGAIGARLTADSVVDVLQLAALCDAPRLHLRCTRLLAKEFAAVERTEAWRFLQENDPWQELQLLQRLHEADMRRRKWRRKRAEQRVYVELSEAMDCLDHICTEGCTEVGPAGRAPAPSPCARYATCRGLQLLIRHFSQCHRKSCARCQRMWQLLRLHSALCDRPDRCNTPLCTRFKQKEQEKAAVKAGDDGDKWGLLVKKVKAARVFSSLANRKQMSSTSQC

SEQ ID NO: 9275 - protein, 345 aa, Panicum virgatum
MCEAPRLRCCGAGDAAAADVDVDVVTTGGRRRIPARSSVLASASPVLASILERRLRKDRESGKAGRSVVRIRGVTDDAAAAFVRLLDAGRCGDGEEDDMEKYAVQVLVLAHAYQVPWLKRACEGAIGARLTADTVVDVLQLAALCDAPRLHLRCARLLAKEFAAVERTEAWRFLQENDPWQELQVLQGLHEADMRRRKWRRKRAEQRVYVELSEAMDCLDHICTEGCTEVGPAGRAPAPAPCARYATTCRGLQLLIRHFSQCHRKSCARCQRMWQLLRLHSALCDRPERCNTPLCKRFKQKEQEKAAGRAGDDGDKWGLLVKKVKAARVFSSLANRKQMTPTSRC

SEQ ID NO: 9276 - protein, 294 aa, Sorghum bicolor
MGSLPVPASAECAPQGRATVSASDLAPLFSAQRRHLDHFFDSLDMSQAAAFAQALIDAPGAVFFTGVGKSGIVACKIAQTLASLGFARAGFLAPVDALHGDIGALFPGDVLVLISKSGASDELLALAPCARAKGAYLISLTSAASGAECPLAAACDLNVHLPLQGEVCPFGLAPVTSTAIQMVFGDTVIAAIMEARRLSRDQYASNHPAGKIGKTLILQVKDVMKKQNELPLCKEGDMIMEQLTELTSKGCGCLLVVDEEHHLIGTFTDGDLRRTLKASGPAIFSLTVGEMCNR

SEQ ID NO: 9277 - protein, 294 aa, Panicum virgatum
MGSLPVNASPECAPQGRATVSASDLAPLFSAQRRHLDHFFDRLDMSQAAAFAQALLDAPGAVFFTGVGKSGIVARKIAQTLASLGFARAGFLAPVDALHGDIGALFPGDVLVLLSKSGASDELLALAPCARAKGAYLISLTSAASGADCPLAAACDLNVHLPLQGEVCPFGLAPVTSTAIQMVFGDTVVAAIMEARRLSRDQYACNHPAGKIGKTLILQVKDVMKKQNELPLCKEGDMIMDQLTELTSKGCGCLLVVDEEHHLIGTFTDGDLRRTLKASGPAIFNLTVGEMCNR

SEQ ID NO: 9278 - protein, 467 aa, Saccharum officinarum
MAAPTAAPLEEGKAKKVIRQVEFYFSDSNLPRDKFLRETVEQSDDGLVSLPLICSFSRMKSHLGLDADVKAETMPEETVLAVAEVLRRSPVLRISEDGKKIGRASELSKPDEIIEQVDSRTIAVSPLPYNVKLEDIQSFFTNYAKVNSVRLPRNIVNKKHFCGTALVEFSEEEEAKSIMDNALVFAGANLEIRPKKEFDAEQESKKEAYEKARPRKDNQDEGYPKGLIVAFKLKKTMVGSVVQQDNIDEGNDSATKLEVSSSMEKLSGQGPESTLESDGTKQGKSSDDMTKEKELNTAEAAESEKCIGDAPVESDKHGDSGSLSRDGKNISGNVNVKNQISREDLKGAFKKFGTVRYVDFSIGDNSGYLRFEDSKAAEKARMSAVLSDEGSLIIKDHIVTLEPVTGEAEKDYWNTIRGIQGKYKDSRSYKGRALKNQRGGKHFNRKRDRNPESEKNSNKTQKVEAAA

SEQ ID NO: 9279 - protein, 467 aa, Zea mays
MAAPAAAPLDEGKAKKVLRQVEFYFSDSNLPRDKFLRETVEQSDDGLVSLPLICSFSRMKSHLGLDADVKPETVPEETVLAVAEVLRPSPALRVSEDGKKIGRASELLKPDEIIEQVDSRTIAVSPLPCNVKQEDVQSFFTNYAKVNSVRLPRNIANKKHFCGTALVEFSEEEEAKRIMETALVFAGANLEIRPKKEFDAEQKSKKEAYEKTHLKKDNQYEGYQKGLIVAFKLEKATADTVVQQDNIDKENDSATKLDVSSSMEKPSGQGPEESILESDVIKQGMSSDDMTKEKDLNTGEATESEKCISDVPIESDKHGDSEPLSREGKIISGNVNVKNQISREDLKEAFKKFGAVRYVDFSIGDNSGYLRFEDSKAAEKARMSAVLADGGLIIKDHIVTLEPVTGEAEKDYWDTIRSIQGKYKDSRSYKGRASNNQRGGKRFNAKRDRNPDSEKNSNKARKVEAIA

SEQ ID NO: 9280 - protein, 455 aa, Panicum virgatum
MAAPAAAPLDESKAKSVLRQVEFYFSDSNLPRDKFLRETAEQSDDGLVSLALICSFSRMKSHLGLDASVKPETVPEETVLAVAEVLRRSPVLRVSEDGKKIGRASELLKPEEIIEQVDSRTVAASPLPYNVKLEDVQSFFAQYAKVNSVRLPRHIANKKHFCGTALVEFSEEEEAKKVLENSLVFSGANLEIRPKKEFDAEQEYKKEEHKKAHPVKDSQDEGYPKGLIVAFKLEKTMADFVQKNSVDKVDDSATKLETSNSMVNPSGEASEGIAESSDSKEEKSSENVTKEKEVNISETTESEKCIGDALVESEKRGDSESGNLKNSISREDLKETLKKFGTVRYVDFSIGDDSGYLRFEDSKGAEKARMAAVLADEGGLIIKDHIITLEPVTGEAEKDYWSTIRGIQGKYKDNRSYKGRAAKNYRGGKQFSGKRGRNPDSEKNSNKAQKVEAAA

SEQ ID NO: 9281 - protein, 331 aa, Zea mays
MAENTHGSGRHVLGDLTNVICKRAATSDLEKSTGGIKIRRIEKTGTRKEYDANAKASSIGKGIVFGHLFDDVAREKFQSHSIFQNSRVQHIAAEAAGLLSKEANDSKNHYASIGPLDLSDKEQDSSLESEDDYDDEDNDETNGELLHHFFSSELANKMSTNDGECLTQEEIVGSSGNQKPLSSLDATTGGDLPISSAQHASVRTGGLEEAVAPKSCACSFCLKAAFMWMDLHYQDARSRLSVLKKSIKFARSLEEKCRGNEYAANVAGYESKRAVGVEFELSQQQRSLFLYTENALVRESTQLHSAFVKLKELRENCKTDLETLSNSSMRK

SEQ ID NO: 9282 - protein, 331 aa, Setaria italica
MTESTHGSGRHVFGDLTNVLRKRPAPSDPEKSMGGVKIRRIEKDTATWKEFDEYAKNSSGGKGIVYGHLFDGVSKENFERPSIFRNSKVQHMAAEAAGLLSKEDSDLRNHCASIDSFDLSAKGQDSSLESEGDYDNEDDDETGGELGHFSSSELANKTAANDGECLTQEEIVGSSGNQKPLSSLDFTTGGDMASSSVQHASVRTSGSEEAVATKSCACSFCLKAALMWTDLHCQDARSRLSVLKKSIKFARLLEAKSKGDEYAANVAGYNSKRAVEMEFELSQQRRSLFLYTENALVRESTQLHSAFVKLKELRENCKTDVETIGNSSVGK

SEQ ID NO: 9283 - protein, 331 aa, Panicum virgatum
MAESTHGSGRHVFGDLTNVLCKRPAPSDLENSMGGIKIRRIEKDAGTWKEFDEYAKNSSRGKGIVYGHLFDGVAKENFERPSIFRNSKVQHMAAEAAGLLSKEDIDLRNRRASIDPFDLSDKEQDSSLESEGDYDEDDDGMDGELPGHFISSELANKTAANDSECLTQEEIVGSSGNQKPLCSLDFTTGGDMPSSSAQHASMRTSGSEAAVPTKSCACSFCLKAASMWTDLHYQDARSRLAVLKKSIKFARSLEAKSKGNEYAPNVAGHKSKQAVEMEFELSQQRRSLFLYTENALVRESAQLHSAFVKLKELREKCKTDLEMISSSSLGK

SEQ ID NO: 9284 - protein, 330 aa, Panicum virgatum
MAESTRGSGRHVFGDLTNVLRKRPAPSDLEKSMGGIKIRRFEKDAGTWREFDEYAKNSSRGKGIVYGHLFDGVAKENLERPSIFRDSKVQHMAAEAAGLLSKEDSDLQNCRASIDPFDLSDKEQDSSLESEGDYDEDDDEMDGELPGHFIGSELASKTAANDSECLTQEEIVGSSGNQKPLCSLEFTAGGDMPSFSVQHVSMRTNGSEAAVPTKSCACSFCLKAASMWTDLHYQDARSRLSVLKKSIKFARLLEAKSKGNEYAASVAGYKSKRAVEMEFELSQQWRSLFLYTENALVRESTQLHSAFVKLKELRENCKTDLEMVSSSLGK

SEQ ID NO: 9285 - protein, 183 aa, Saccharum officinarum
MAATTSSSRAASTTLLLLLCAAALAPGATAADDTGFTTFKLYFHDIVAGTSSPTAVRIAQAASSNTSSTSFGAVVAIDDPLTTGPTRASGTEIGRAQGTYTFADQKTFGLLMVMNFVFTGGEHNGSTLSIMGRNEVLSDIREMSIVGGSGKFRMAKGYVQAHTIDSGATSGETVVQYTVNVKV

SEQ ID NO: 9286 - protein, 171 aa, Zea mays
MAAAAALLLLLCAASLASAAADDGLTTFKVYFHDVVAGTNPTAVRIAQAASSNTSSTNFGAVVAIDDPLTTGPTRAAGTEVGRAQGTYTFADQQTFGLLMVMNFVFTAGEHNGSTLSILGRNEVLSDVREMSIVGGSGKFRMARGYVQAHTIDSGATSGTTVVQYTVNVKA

SEQ ID NO: 9287 - protein, 176 aa, Zea mays
MAGPTTTLLLLLLCSAGLASGATAADDSGFTTFKVYFHDIVAGTSPTAIRIAQGAASNTSSTSFGAMVAIDDPLTTGPTRAAGTEVGRAQGTYTFADQQTFGLLMVMDFVFTAGEHKGSTLSILGRNEVLSDVREMSIVGGSGKFRMARGYVQAHTIDSGFKSGETVVQYTVNVRA

SEQ ID NO: 9288 - protein, 176 aa, Setaria italica
MAMATTVLLLCAAVALAPTPSSAADDAAGFTTFKLYFHDIVGGTSPTAIRIAQAPSSNSSSTFFGAVVAIDDPLTSGPTRAAGTEVGRAQGTYTFADQKTFGLLMVMNFVFTAGEYNGSSLSILGRNEVINDVREMSIVGGSGKFRMARGYVQAHTIDSGATSGETVVQYTVNVKA

SEQ ID NO: 9289 - protein, 177 aa, Cenchrus ciliaris
  misc_feature (57)..(57): Xaa can be any naturally occurring amino acid
  misc_feature (69)..(69): Xaa can be any naturally occurring amino acid
MATTRSALLLLCAAAFVAALAPTPTSAADDFTTFKLYFHDVVGGTSPTAIRVAQAPXSNSSSTFFGAVXAIDDPLTTGPTRAAGTEIGRAQGTYTFADQKTFGLLMVMNFVFTAGEHNGSSLSILGRNEVLNDVREMSIVGGSGKFRMARGYVQAHTIDSGATSGTTVVQYTVNVKA

SEQ ID NO: 9290 - protein, 198 aa, Zea mays
TAPPALCSSLLSSRSWLGLPTRHLVGIRSRDLHFSPAGAGAPSPWTRKRYGKAWSPPQTVEKITGSTPARLHFYDPFVLSGVSIEAAEHGRLLCSFVVTPRLASPAGYLRSGVTATLADQLGSAVFFCSGLPSSGVSLEISVSFVDAAAVGEEIEVEGKLLRAGKSVGVVSVDFRKKKTGKLMAQARHTKYLVASSRL

SEQ ID NO: 9291 - protein, 154 aa, Zea mays
MGPEAVRKSLEPTATAEEITGSTPARLHFYDPFVLSGVRIEAAEHGRLLCSFVVTPRLASPVGYLRSGVTATLADQLGSAVFFCSGIPSSGVSIEISVSFVDSAAVGEEIEVEGKLLRAGKSVGVVSVDFRKKKTGKLMAQARHTKYLVASSKL

SEQ ID NO: 9292 - protein, 154 aa, Panicum virgatum
MDPDAVRRSLEPTASAEEITGSTPARLHFYDPFVLSGVSIEYAEHGRLLCSFVVAPRHASPAGYLRSGVTATLADQLGSAVFFCSGLRASGVSVEISVSFVDAATVGEEIEVEGKLLRAGKSVGVVSVDFRKKKTGKLMAQARHTKYLAVSSRL

SEQ ID NO: 9293 - protein, 154 aa, Panicum virgatum
  misc_feature (89)..(89): Xaa can be any naturally occurring amino acid
MDPDAVRRSLEPTASAEEITGSTPARLHFYDPFVLSGVSIEYAEHGRLLCSFVVAPRHASPAGYLRSGVTATLADQLGSAVFFCSGLRXSGVSLEISVSFVDAATVGEEIEVEGKLLRAGKSIGVVSVDFRKKKTGKLMAQARHTKYLAVSSKL

SEQ ID NO: 9294 - protein, 154 aa, Setaria italica
MDPEAVRRSLEPTASAEEITGSTPARLHFYDPFVLQGVSIESSEHGRLLCSFVVAPRHASPAGYLRSGVTATLADQLGSAVFYCSGLPRSGVSVEISVSFVDVATVGEEIEVEGKLLRAGKSVGVVSVDFRKKKTGKLMAQARHTKYLAVSSRL

SEQ ID NO: 9295 - protein, 154 aa, Panicum virgatum
MDPDAVRRSLEPTASAEEITGSTTARLHFYDPFVLHGVSIESAEHGRLLCSVVVAPRHASPAGYLRSGVTATLADQLGSAVFFCSGLRMSGVSLEISVSFVDAATVGEEIEVEGKLLRAGKSIGVVSVDFRKKKTGKLMAQARHTKYLAVSSKL

SEQ ID NO: 9296 - protein, 154 aa, Pennisetum glaucum
MDPEAVRRSLEPTASAEEITGSTPARLHFYDPFVLQGVSVESAEHGRLLCSFVVAPRHASPAGYLRSGVTATLADQLGSAVFFGSGLPRSGVSVEISVSFVDVATVGEEIEVEGKLLRAGKSVGVVSVDFRKKRTGKLMAQARHTKYLAVSSRL

SEQ ID NO: 9297 - protein, 112 aa, Cynodon dactylon
MDPEAVRRTLEPTASAEEITGSTPPRSHFYDPFVINGVSLEAAEHGRVLCSFVVSPRLASPAGYLRSGVTATLADQLGSAVFYCSGLVTSRPAGSLSRSASPSSTRLQSGKK

SEQ ID NO: 9298 - protein, 112 aa, Saccharum officinarum
MDPEAVRKSLEPTATAEKITGSTPARLHFYDPFVLSGVSIEAAEHGRLLCSFFVTPRLASPVGYLRSGVTATLADQLGSAVFFCSGLPSSGVSIEIKRLLCRRGCSRGGNRG

SEQ ID NO: 9299 - protein, 140 aa, Saccharum officinarum
MDGGGGDLRSTIKKWNVIYPVYLNSKKTVAEGRRIAAAKACPDPTCVEIADCCSHLKIPHAVELDKAYPRDFFQVGRVRVQLKKDDGSPVNPAIKTKKQLMIQIAELVPKHHGRTKKQEAATSSSAGGSSKNTKGGKKKK

SEQ ID NO: 9300 - protein, 140 aa, Cenchrus ciliaris
MDGGGGDLRSTIKKWNVIYPVYLNSKKTVAEGRRIAASKACPDPTCIEIADCCSHLKIPHAIELDKAYPRDFFQVGRVRVQLKKDDGSPVNPAIKTKKQLLIQIAELVPKHHGRTKKQESAPSSSAGGSSKNTKGGKKKK

SEQ ID NO: 9301 - protein, 139 aa, Saccharum officinarum
MDGGGDLRSTIKKWNVIYPVYLNSKKTVAEGRRIATAKACPDPTCIEIADCCSHLKIPHAIELDKAYPRDFFQVGRVRVQLKKDDGSPVNPAIKTKKQLMIQIAELVPKHHGRTKKQESAPSSSAGGSSKNTKGGKKKK

SEQ ID NO: 9302 - protein, 140 aa, Panicum virgatum
MDGGGGDLRSTIKKWNVLYPVYLNSKKTVAEGRRIAASKACPDPTCIEIADCCSHLKIPHAIELDKAYPRDFFQVGRVRVQLKKDDGSPVNPAIKTKKQLMIQIAELVPKHHGRTKKQESALSSSAGGSSKNTKGGKKKK

SEQ ID NO: 9303 - protein, 140 aa, Setaria italica
MDGGGGDLRSTIKKWNVIYPVYLNSKKTVAEGRRIAASKACPDPTCIEIADCCSHLKIPYAIELDKAYPRDFFQVGRVRVQLKKDDGSPVNPAIKTKKQLMIQIAELVPKHHGRTKKQESAPSSSASGSSKNTKGGKKKK

SEQ ID NO: 9304 - protein, 140 aa, Pennisetum glaucum
MDGGGGDLRSTIKKWNVIYPVYLNSKKTVAEGRRIAASNACPDPTCIEIADCCSHLKIPHAIELDKAYPRDFFQVGRVRVQLKKDDGSLVNPAIKTKKQLLIQIAELVPKHRGRTKKQESAPSSSAGGSSKNTKGGKKKK

SEQ ID NO: 9305 - protein, 140 aa, Panicum virgatum
MDSGGGDLRSTIKKWNVIYPVYLNSKKTVAEGRRIATSKACPDPTCIEIADCCSHLKIPHAIELDKAYPRDFFQVGRVRVQLKKDDGSPVNPAIKTKKQLMIQIAELVPKHHGRTKKQESAPSSSTGGSSKSTKGGKKKK

SEQ ID NO: 9306 - protein, 138 aa, Zea mays
MEDGGGDLRSTIKKWNIIYPVYLNSKKTVAEGRRIAAAKACPDPTCIEIADCCSHLKIPHAIELDKAYPRDFFQVGRVRVQLKKDDGSPVNPAIKTKKQLMIQVAELVPKHHGRTKKQEPAPNPGGSSKNTKGGKKKK

SEQ ID NO: 9307 - protein, 136 aa, Oryza sativa
MDGGDLRSSIKKWNVIYPVYLNSKKTVAEGRRIASGKACPDPTCVEIADCCSHLKIPHAIELDKAYPRDFFQVGRVRVQLKKDDGSPVNPAIKTKKQLMIQIAELVPKHHGRTKKQEPAASSTAGTSKGKGGKKKK

SEQ ID NO: 9308 - protein, 139 aa, Lolium multiflorum
MDVGGADLRSSIKKWKIIYPVYLNSKKTVAEGRRIAAAKACPDPTCIEIADSCAFLKIPRAIELDKAYPRDFFQVGRVRVQLTNDDGSPVNPAIRTKKQLMIQIAELVPKHHGRTKKQEPAAGPSVASSNNKKKNKNKK

SEQ ID NO: 9309 - protein, 366 aa, Saccharum officinarum
MGASGSKLEKALGDQFPEGERYFGLENFGNTCYCNSVLQALYFCIPFREQLLEYYANNKTPGDAEENLLTCLADLFMQISQAKKKTGVIAPKRFVQRVKKQNELFRSYMHQDAHEFLNFLLNELVDILEKESSAAKDSPQSSSPEKAPNGPVQPLANGVKKEPPVTLVHKNFQGILTNETRCLRCETVTARDETFLDLSVDIEQNSSITSCLKNFCSTETLNAEDKFFCDKCCSLQEAQKRMKIKKAPHILVIHLKRFKYIEQLGRYKKLSYRVVFPMELKLSNTSDDVDTEYSLFAVVVHVGSGPNHGHYVSLVKSHNHWLFFDDENVEMVEEQTLQTFFGSSHEYSGNTDHGYILFYEGLGGKS

SEQ ID NO: 9310 - protein, 366 aa, Setaria italica
MGASGSKLEKALGDQFPEGERYFGLENFGNTCYCNSVLQALYFCIPFREQLLEYYANNKNPGDAEENLLTCLADLFMQISQAKKKTGVIAPKRFVQRVKKQNELFRSYMHQDAHEFLNFLLNELVDILEKESSAAKDSPQSSSPEKAPNGPVQPLANGVKKEPPVTLVHKNFQGILTNETRCLRCETVTARDETFLDLSVDIEQNSSITSCLKNFCSTETLNAEDKFFCDKCCSLQEAQKRMKIKKAPHILVIHLKRFKYIEQLGRYKKLSYRVVFPMELKLSNTSDDVDTEYSLFAVVVHVGSGPNHGHYVSLVKSHNHWLFFDDENVEMVEEQTLQTFFGSSHEYSGNTDHGYILFYEGLGGKS

SEQ ID NO: 9311 - protein, 366 aa, Zea mays
MGASGSKLEKALGDQFPEGERYFGLENFGNTCYCNSVLQALYFCIPFREQLLEYYANNKTPGDVEENLLTCLADLFMQISQAKKKTGVIAPKRFVQRVKKQNELFRSYMHQDAHEFLNFLLNELVDILEKESSAAKDSPQSSSPEKAPNGPVQPLANGVKKEPPVTLVHKNFQGILTNETRCLRCETVTARDETFLDLSVDIEQNSSITSCLKNFCSTETLNAEDKFFCDKCCSLQEAQKRMKIKKAPHILVIHLKRFKYIEQLGRYKKLSYRVVFPMELKLSNTSDDVDTEYSLFAVVVHVGSGPNHGHYVSLVKSHNHWLFFDDENVEMVEEQTLQTFFGSSHEYSGNTDHGYILFYEGLGGKS

SEQ ID NO: 9312 - protein, 365 aa, Panicum virgatum
MGASGSKLEKALGDQFPEGERYFGLENFGNTCYCNSVLQALYFCIPFREQLLEYYANNKNPGDAEENLLTCLADLFMQISQAKKKTGVIAPKRFVQRVKKQNELFRSYMHQDAHEFLNFLLNELVDILEKESSAAKDSPQSSPEKAPNGPVQHLANGVKKEPPVTLVHKNFQGILTNETRCLRCETVTARDETFLDLSVDIEQNSSITSCLKNFCSTETLNAEDKFFCDKCCSLQEAQKRMKIKKAPHILVIHLKRFKYIEQLGRYKKLSYRVVFPMELKLSNTSDDVDTEYSLFAVVVHVGSGPNHGHYVSLVKSHNHWLFFDDENVEMVEEQTLQTFFGSSHEYSGNTDHGYILFYEGLGGKS

SEQ ID NO: 9313 - protein, 366 aa, Zea mays
MGASGSKLEKALGDQFPEGERYFGLENFGNTCYCNSVLQALYFCIPFREQLLEYYANNKTPGDAEENLLTCLADLFMQISQAKKKTGVIAPKRFVQRVKKQNELFRSYMHQDAHEFLNFLLNELVDILEKESSAAKDSPQSSSPEKAPNGPVQPLANGVKKEPPVTLVHKSFQGILTNETRCLRCETVTARDETFLDLSVDIEQNSSITSCLKNFCSTETLNAEDKFFCDKCCSLQEAQKRMKIKKAPHILVIHLKRFKYIEQLGRYKKLSYRVVFPMELKLSNSSDDVDTEYSLFAVVVHVGSGPNHGHYVSLVKSHNHWLFFDDENVEMVEEQTLQTFFGTSHEYSGNTDHGYILFYEGLGGKS

SEQ ID NO: 9314 - protein, 365 aa, Panicum virgatum
MGASGSKLEKALGDQFPEGERYFGLENFGNTCYCNSVLQALYFCIPFREQLLEYYANNKNPGDAEENLLTCLADLFMQISQAKKKTGVIAPKRFVQRVKKQNELFRSYMHQDAHEFLNFLLNELVDILEKESSAAKDSPHSSPEKAPNGPVQHLANGVKKEPPVTLVHKNFQGILTNETRCLRCETVTARDETFLDLSVDIEQNSSITSCLKNFCSTETLNAEDKFFCDKCCSLQEAQKRMKIKKAPHILVIHLKRFKYIEQLGRYKKLSYRVVFPMELKLSNTSDDVDTEYSLFAVVVHVGSGPNHGHYVSLVKSHNHWLFFDDENVEMVEEQTLQTFFGSSHEYSGNTDHGYILFYEGLGGKS

SEQ ID NO: 9315 - protein, 154 aa, Cynodon dactylon
MGASGSKLEKALGDQFPEGERYFGLENFGNTCYCNSVLQALYFCIPFREQLLEYYSNNKNPGDAEENLLTCLADLFMQISQAKKKTGVIAPKRFVQRVKKQNELFRSYMHQDAHEFLNFLLNELVDILEKESSAAKDSPQSTSPEKVPMVQFNL

SEQ ID NO: 9316 - protein, 365 aa, Oryza sativa
MGASGSKLEKALGDQFPEGERYFGLENFGNTCYCNSVLQALYFCIPFREKLLEYYANNKTPGDAEENLLTCLADLFMQVSQSKKKTGVIAPKRFVQRVKKQNELFRSYMHQDAHEFLNFLLNELVDILEKESNAAKDSPQSSSPEKVPNGPVQPLANGVRKEPPVTLVHKNFQGILTNETRCLRCETVTARDETFFDLSVDIEQNSSITSCLKNFCSTETLNAEDKFFCDKCCSLQEAQKRMKIKKAPHILVIHLKRFKYIEQLGRYKKLSYRVVFPMELKLSTSDDVDTEYSLFAVVVHVGSGPNHGHYVSLVKSHNHWLFFDDENVEMVEESTLQTFFGSSHEYSGNTDHGYILFYEGLGGKS

SEQ ID NO: 9317 - protein, 366 aa, Brachypodium distachyon
MGASGSKLEKALGDQFPEGERYFGLENFGNTCYCNSVLQALYFCTPFREQLLEYYANNKSPGDAEENLLTCLADLFMQVSQSKKKTGVIAPKRFVQRVKKQNELFRSYMHQDAHEFLNFLLNELVDILEKESSAAKDSPQSSSPEKVPNGPVQPLANGVKKEPPITLVHKNFQGILTNETRCLRCETVTARDETFFDLSVDIEQNSSITSCLKNFSSTETLNAEDKFFCDKCCSLQEAQKRMKIKKAPHILVIHLKRFKYIEQLGRYKKLSYRVVFPMELKISSTSDDVDTEYSLFAVVVHVGSGPNHGHYVSLVKSHNHWLFFDDENVEMVEESTLQTFFGSSHEYSGNTDHGYILFYEGLGGKS

SEQ ID NO: 9318 - protein, 368 aa, Unknown
  Sequence found in Organisms: Secale cereale, Triticum aestivum
MGASGSKLEKALGDQFPEGERYFGLENFGNTCYCNSVLQALYFCTPFREQLLEYYMNNKNPGDAEENLLTCLADLFMQVSQSKKKTGVIAPKRFVQRVKKQNELFRSYMHQDAHEFLNFLLNELVDILEKESSAAKDSPQSSSPEKVPNGPVQPLANGVKKEPPVTLVHKNFQGILTNETKCLRCETVTARDETFFDLSVDIEQNSSITSCLKNFSSTETLNAEDKFFCDKCCSLQEAQKRMKIKKAPHILVIHLKRFKYIEQLGRYKKLSYRVVFPMELKISSTSDDVDTEYSLFAVVVHVGSGPNHGHYVSLVKSHNHWLFFDDENVEMVEESTLQTFFGSSHEYSGNTDHGYILFYEGLGGKSLG

SEQ ID NO: 9319 - protein, 368 aa, Pseudoroegneria spicata
MGASGSKLEKALGDQFPEGERYFGLENFGNTCYCNSVLQALYFCTPFREQLLEYYTNNKNPGDAEENLLTCLADLFMQVSQSKKKTGVIAPKRFVQRVKKQNELFRSYMHQDAHEFLNFLLNELVDILEKESSAAKDSPQSSSPEKVPNGPVQPLANGVKKEPPVTLVHKNFQGILTNETKCLRCETVTARDETFFDLSVDIEQNSSITSCLKNFSSTETLNAEDKFFCDKCCSLQEAQKRMKIKKAPHILVIHLKRFKYIEQLGRYKKLSYRVVFPMELKISSTSDDVDTEYSLFAVVVHVGSGPNHGHYVSLVKSHNHWLFFDDENVEMVEESTLQTFFGSSHEYSGNTDHGYILFYEGLGGKSLG

SEQ ID NO: 9320 - protein, 368 aa, Hordeum vulgare
MGASGSKLEKALGDQFPEGERYFGLENFGNTCYCNSVLQALYFCTPFREQLLEYYTNNKNPGDAEENLLTCLADLFMQVSQSKKKTGVIAPKRFVQRVKKQNELFRSYMHQDAHEFLNFLLNELVDILEKESSAAKDSPQSSSPEKVPNGPVQPLANGVKKEPPVTLVHKNFQGILTNETKCLRCETVTARDETFFDLSVDIEQNSSITSCLKNFSSTETLNAEDKFFCDKCCSLQEAQKRMKIKKAPHILVIHLKRFKYIEQLGRYKKLSYRVVFPMELKMGSTSDDVDTEYSLFAVVVHVGSGPNHGHYVSLVKSHNHWLFFDDENVEMVEESTLQTFFGSSHEYSGNTDHGYILFYEGLGGKSLG

SEQ ID NO: 9321 - protein, 368 aa, Triticum aestivum
MGASGSKLEKALGDQFPEGERYFGLENFGNTCYCNSVLQALYFCTPFREQLLEYYMNNKNPGDAEENLLTCLADLFMQVSQSKKKTGVIAPKRFVQRVKKQNELFRSYMHQDAHEFLNFLLNELVDILEKESSAAKDSPQSSSPEKVPNGAVQPLANGVKKEPPVTLVHKNFQGILTNETKCLRCETVTARDETFFDLSVDIEQNSSITSCLKNFSSTETLNAEDKFFCDKCCSLQEAQKRMKIKKAPHILVIHLKRFKYIEQLGRYKKLSYRVVFPMELKISSTSDDVDTEYSLFAVVVHVGSGPNHGHYVSLVKSHNHWLFFDDENVEMVEESTLQTFFGSSHEYSGNTDHGYILFYEGLGGKCLG

SEQ ID NO: 9322 - protein, 367 aa, Musa acuminata
MGAAGSKLEKALGDQFPEGERYFGLENFGNTCYCNSVLQALYFCIPFREQLLDYYANNKNLGDVEENLLTCLADLFTQISSQKKKTGVIAPKRFVQRVKKQNEYFRSYMHQDAHEFLNFLLNELVDILEKESDAAKSSPETLSPSKKIANGPSHPVANGVQKEPLVTWVHKNFQGILTNETRCLRCETVTARDETFLDLSLDIEQNSSITSCLKNFSSTETLNAEDKFFCDKCCSLQEAQKRMKIKKPPHILVIHLKRFKYIEQLGRYKKLSYRVVFPMELKLTNTVEDADSEYSLFAVVVHVGSGPNHGHYVSLVKSHNHWLLFDDENVEMIDESTVQTFFGSSQEFSGNTDHGYILFYERLGGKS

SEQ ID NO: 9323 - protein, 369 aa, Aquilegia formosa
MGAAGSKLEKALGDQFPEGERYFGLENFGNTCYCNSVLQALYFCVPFREQLLDYYANNKTTGDVEENLLTCLADLFSQISSQKKKTGVIAPKRFVQRVKKQNELFRSYMHQDAHEFLNFLLNELVDILEKESNAAKISPEASSPSEKVANGPRTAQSNGVQKEPLVTWVHKNFQGILTNETRCLRCETVTARDETFLDLSLDIEQNSSITSCLKNFSSTETLNAEDKFFCDKCCSLQEAQKRMKIKKPPHILVIHLKRFKYIEQLGRYKKLSYRVVFPLELKLSNTVEDADSEYSLFAVVVHVGSGPNHGHYVSLVKSHNHWLFFDDENVEMIDESAVQTFFGSSQEYSSNTDHGYILFYESLATSSKS

SEQ ID NO: 9324 - protein, 367 aa, Elaeis guineensis
MGAAGSKLEKALGDQFPEGERYFGLENFGNTCYCNSVLQALYFCVPFREQLLEYYSNNKNLGETEENILTCLADLFTQISSQKKKTGVIAPKRFVQRVKKQNEYFRSYMHQDAHEFLNFLLNELVEVLEKESSAAKSSPETSSASEKTTNGPVHPQANGVRKEPLVTWVHKSFQGILTNETRCLRCETVTARDETFFDLSLDIEQNSSITSCLKNFSSTETLNAEDKFFCDKCCSLQEAQKRMKIKKPPHILVIHLKRFKYIEQLGRYKKLSYRVVFPMELKLNNTVDDADSEYSLFAVVVHVGSGPNHGHYVSLVKSHNHWLFFDDENVEMIDESIVQTFFGSAQEYSGNTDHGYILFYESLGGRS

SEQ ID NO: 9325 - protein, 369 aa, Vitis vinifera
MGAAGSKLEKALGDQFPEGERYFGLENFGNTCYCNSVLQALYFCVPFREQLLEYYTNNKNLADAEENLLTCLADLFMQISSQKKKTGVIAPKRFVQRLKKQNELFRSYMHQDAHEFLNFLLNELVDILEKEASASKSDPETSSPPEKTANGPKTAQANGVQKEPLVTWVHKNFQGILTNETRCLRCETVTARDETFLDLSLDIEQNSSITSCLKNFSSTETLNAEDKFFCDKCCSLQEAQKRMKIKKPPHILVIHLKRFKYIEQLGRYKKLSYRVVFPLELKLSNTVEDADSEYSLFAVVVHVGSGPNHGHYVSLVKSHNHWLFFDDENVEMIDESSVQTFFGSAQEYSSNTDHGYILFYESLATNDKS

SEQ ID NO: 9326 - protein, 366 aa, Elaeis guineensis
MGAAGSKLEKALGDQFPEGERYFGLENFGNTCYCNSVLQALYFCLPFREQLLEYYANNKTGGEAEDNLLTCLADLFTQISSQKKKTGVIAPKRFVQRVKKQNELFRSYMHQDAHEFLNFLLNELVDILEKENAAKTSPEISSSSEKIANGPSHPQGNGVRKEPVSTWVHKCFQGILTNETRCLRCETVTARDETFFDLSLDIEQNSSITSCLKNFSSTETLNAEDKFFCDKCCSLQEAQKRMKIKKPPNILVIHLKRFKYIEQLGRYKKLSYRVVFPLELKLSNTIDNADCEYSLFAVVVHVGSGPNHGHYVSLVKSHNHWLFFDDENVEMIDESMIQTFFGSTQEYSSNTDHGYILFYERLGGRS

SEQ ID NO: 9327 - protein, 369 aa, Manihot esculenta
MGAAGSKLEKALGDQFPEGERYFGLENFGNTCYCNSVLQALYFCVPFREQLLEYYANNKNSGDAEENLLTCLADLFTQISSQKKKTGVIAPKRFVQRLKKQNELFRSYMHQDAHEFLNFLLNELVDILEKEAQAAKSDPETSSPPEKTANGPKNAQANGVSKEPLVTWVHKNFQGILTNETRCLQCETVTARDETFFDLSLDIEQNSSITSCLKNFSSTETLNAEDKFFCDKCCSLQEAQKRMKIKKPPHILVIHLKRFKYIEQLGRYKKLSYRVVFPLELKLSNTMEDADIEYSLFAVVVHVGSGPNHGHYVSLVKSHNHWLFFDDENVEMIDESAVQTFFGSAQEYSSNTDHGYILFYESLGASSKS

SEQ ID NO: 9328 - protein, 369 aa, Ricinus communis
MGAAGSKLEKALGDQFPEGERYFGLENFGNTCYCNSVLQALYFCVPFREQLLEYYANNKSGGDAEENLLTCLADLFTQISSQKKKTGVIAPKRFVQRLKKQNELFRSYMHQDAHEFLNFLLNELVDILEKEAQAAKSDPETSSSPEKIPNGPKNGQANGVSKEPLVTWVHKNFQGILTNETRCLQCETVTARDETFFDLSLDIEQNSSITSCLKNFSSTETLNAEDKFFCDKCCSLQEAQKRMKIKKPPHILVIHLKRFKYIEQLSRYKKLSYRVVFPLELKLSNTVEDSDIEYSLFAVVVHVGSGPNHGHYVSLVKSHNHWLFFDDENVEMIDESAVQTFFGSSQEYSSNTDHGYILFYESLGASNKS

SEQ ID NO: 9329 - protein, 364 aa, Amborella trichopoda
MGAAGSKLEKALGDQFPEGERYFGLENFGNTCYCNSVLQALYFCVPFREQLLEYYGNNKTQGDADDNLLTCLAELFSQICSQKKKTGVIAPKRFVQRVKKQNELFRSYMHQDAHEFLNFLLNELVDILEKESNAAKASPETSSPSEKTANGPRSLQPNGVQKEPLVTWVHKNFQGILTNETRCLRCETVTARDETFLDLSLDIEQNSSITSCLRNFSSTETLNAEDKFFCDKCCSLQEAQKRMKIKKPPHILVIHLKRFKYIEQLGRYKKLSYRVVFPLELKLSNTVEDADSEYSLFAVVVHVGSGPNHGHYVSLVKSHNHWLFFDDENVEMIDESAVQTFFGSAQEYSSNTDHGYILFYESLK

SEQ ID NO: 9330 - protein, 361 aa, Carica papaya
MGAAGSKLEKALGDQFPEGERYFGLENFGNTCYCNSVLQALYFCVPFREQLLEYYANNKNVGDAEENLLTCLADLFTQISSQKKKTGVIAPKRFVQRLKKQNELFRSYMHQDAHEFLNFLLNELVDILEKEAQAAKSDQETSSPPEKIANGPKNHLANGVQKEPLVTWVHKNFQGILTNETKCLRCETVTARDETFFDLSLDIEQNSSITSCLKNFSSTETLNAEDKFFCDKCCSLQEAQKRMKIKKPPHILVIHLKRFKYIEQLGRYKKLSYRVVFPLELKLSNTVEDADIEYSLFAVVVHVGSGPNHGHYVSLVKSHNHWLFFDDENVEMIDESAVQTFFGSAQEYSSNTDHGYILFYE

SEQ ID NO: 9331 - protein, 369 aa, Gossypium raimondii
MGAAGSKLEKALGDQFPEGERYFGLENFGNTCYCNSVLQALYFCVPFREQLLEYYSSNKNGVDAEDNLLTCLADLFTQISSQKKKTGVIAPKRFVQRLKKQNELFRSYMHQDAHEFLNFLLNELVDILEKEAQAAKNDAETSSPSEKTANGPKNPQANGVKKEPLVTWVHKNFQGILTNETRCLRCETVTARDETFFDLSLDIEQNSSITSCLKNFSSTETLNAEDKFFCDKCCSLQEAQKRMKIKKPPHILVIHLKRFKYIEQLGRYKKLSYRVVFPLELKLSNTVEDADLEYSLFAVVVHVGSGPNHGHYVSLVKSHNHWLFFDDENVEMIDESAVQTFFGSAQEFSSNTDHGYILFYESLGAGNKS

SEQ ID NO: 9332 - protein, 318 aa, Chelidonium majus
MGAAGSKLEKALGDQFPEGERYFGLENFGNTCYCNSVLQALYFCVPFREQLLEYYANNKTPGDAEENLLTCLADLFTQISSQKKKTGVIAPKRFVQRVKKENELFRSYMHQDAHEFLNFLLNELVDILEKESRAAAAAKNSPETSSPAEKTANGPRNLQANGVHREPLVTWVHKNFQGLLTNETRCLRCETVTARDETFLDLSLDIEQNSSITSCLKNFSSTETLNAEDKFFCDKCCSLQEAQKRMKIKKPPQILVIHLKRFKYIEQLGRYKKLSYRVVFPLELKLSNTVEDADSEYSLFAVVVHVGSGPNHGHYVSL

SEQ ID NO: 9333 - protein, 369 aa, Malus domestica
MGAAGSKLEKALGDQFPEGERYFGLENFGNTCYCNSVLQALYFCVPFREQLLEYYSSNKSAGDAEENLLTCLADLFTQISSQKKKTGVIAPKRFVQRLKKQNELFRSYMHQDAHEFLNFLLNELVDILEKEAQAAKSDQETSSPPEKMGNGPKNVQANGTHKDPLVTWVHKNFQGILTNETRCLRCETVTARDETFFDLSLDIEQNSSITSCLKNFSSTETLNAEDKFFCDKCCSLQEAQKRMKIKKPPHILVIHLKRFKYIEQLGRYKKLSYRVVFPLELKLSNTVEDVESEYSLFAVVVHVGSGPNHGHYVSLVKSHNHWLFFDDENVEMIDESAVQTFFGSAQEYSSNTDHGYILFYESLGTSNKS

SEQ ID NO: 9334 - protein, 369 aa, Unknown
  Sequence found in Organisms: Citrus clementina, Citrus sinensis
MGAAGSKLEKALGDQFPEGERYFGLENFGNTCYCNSVLQALYFCVPFREQLLDYYSNNKNLGDAEENLLTCLADLFTQIRAQKKKTGVIAPKRFVQRLKKQNELFRSYMHQDAHEFLNFLLNELVDILEKEEAAKSDPESSSPSEKTANGPTNGLANGVRKEPLVTWVHKNFQGILTNETRCLRCETVTARDETFFDLSLDIEQNSSITSCLKNFSSTETLNAEDKFFCDKCCSLQEAQKRMKIKKSPHTLVIHLKRFKYIEQLGRYKKLSYRVVFPLELKLSNTAEDADIEYSLFAVVVHVGSGPNHGHYVSLVKSHNHWLFFDDENVEMIDESAVQTFFGSAQEYSSNTDHGYILFYESLGAGSNKS

SEQ ID NO: 9335 - protein, 369 aa, Gossypium hirsutum
MGAAGSKLEKALGDQFPEGERYFGLENFGNTCYCNSVLQALYFCVPFREQLLEYYSSNKNGVDAEDNLLTCLADLFTQISSQKKKTGVIAPKRFVQRLKKQNELFRSYMHQDAHEFLNFLLNELVDILEKEAQAAKNDAETSSPSEKTANGPKNPQANGVKKEPLVTWVHKNFQGILTNETRCLRCETVTARDETFFDLSLDIEQNSSITSCLKNFSSTETLNAEDKFFCDKCCSLQEAQKRMKIKKPPHILVIHLKRFKYIEQLGRYKKLSYRVVFPLELKLSNTVEDADLEYSLFAVVVHVGSGPNHGHYVSLVKSHSHWLFFDDENVEMIDESAVQTFFGSAQEFSSNTDHGYILFYESLGAGNKS

SEQ ID NO: 9336 - protein, 369 aa, Cajanus cajan
MGAAGSKLEKALGDQFPEGERYFGLENFGNTCYCNSVLQALYFCVPFREQLLEYYANNKSMADAEENLLTCLADLFSQISSQKKKTGVIAPKRFVQRLKKQNELFRSYMHQDAHEFLNFLLNELVDILEKEAQTAKNDQETSPPSEKAANGPKNGLANGAKKEPLVTWVHKNFQGILTNETRCLRCETVTARDETFFDLSLDIEQNSSITSCLKNFSSTETLNAEDKFFCDKCCSLQEAQKRMKIKKPPHILVIHLKRFKYIEQLGRYKKLSYRVVFPLELKLSDTAEDADIEYSLFAVVVHVGSGPNHGHYVSLVKSHNHWLFFDDENVEMIDESAVQTFFGSSQEYSSNTDHGYILFYESIGSGNKN

SEQ ID NO: 9337 - protein, 369 aa, Glycine max
MGAAGSKLEKALGDQFPEGERYFGLENFGNTCYCNSVLQALYFCVPFREQLLEYYANNKSITDAEENLLTCLADLFSQISSQKKKTGVIAPKRFVQRLKKQNELFRSYMHQDAHEFLNFLLNELVDILEKEAQAAKNDQETSPPSEKAANGPKNSLANGAKKEPLVTWVHKNFQGILTNETRCLRCETVTARDETFFDLSLDIEQNSSITSCLKNFSSTETLNAEDKFFCDKCCSLQEAQKRMKIKKPPHVLVIHLKRFKYIEQLGRYKKLSYRVVFPLELKLSDTAEDADIEYSLFAVVVHVGSGPNHGHYVSLVKSHNHWLFFDDENVEMIDESAVQTFFGSSQEYSSNTDHGYILFYESIGSGNRN

SEQ ID NO: 9338 - protein, 368 aa, Theobroma cacao
MGAAGSKLEKALGDQFPEGERYFGLENFGNTCYCNSVLQALYFCVPFREQLLEYYSSNKNVADAEENLLTCLADLFTQISSQKKKTGVIAPKRFVQRLKKQNELFRSYMHQDAHEFLNFLLNELVDILEKEAQAAKNDAETSSPPEKTANGPKNPQANGVLKEPLVTWVHKNFQGILTNETRCLRCETVTARDEIFFDLSLDIEQNSSITSCLKNFSSTETLNAEDKFFCDKCCSLQEAQKRMKIKKPPHILVIHLKRFKYIEQLGRYKKLSYRVVFPLELKLSNTVEDADSEYSLFAVVVHVGSGPNHGHYVSLVKSHNHWLFFDDENVEMIDESAVQTFFGSAQEYSSNTDHGYILFYESLGANRS

SEQ ID NO: 9339 - protein, 367 aa, Elaeis guineensis
MGAAGSKLEKALGDQFPEGERYFGLENFGNTCYCNSVLQALYFCLPFREQLLEYYANYKTGGEAEDNLLTCLADLFTQISSQKKKTGVIAPKRFVQRVKKQNEIFRSYMHQDAHEFLNFLLNELVDILEKESNAAKTSPDTSSSSENIANGPSHPQANGVQKEPVSTWVHKCFQGILTNETRCLRCETVTARDETFFDLSLDIEQNSSITSCLKNFSSTETLNAEDKFFCDKCCSLQEAQKRMKIKKPPNILVIHLKRFKYIEHLSRHKKLSYRVVFPLELKLSNTIDNADCEYSLFAVVVHVGSGPNHGHYVSLVKSHNHWLFFDDENVEMIDESIIQTFFGSTQEYSSNTDHGYILFYERLGGRS

SEQ ID NO: 9340 - protein, 367 aa, Eutrema halophilum
MGAAGSKLEKALGDQFPEGERYFGFENFGNTCYCNSVLQALYFCAPFREQLLEYCANNKSVADAEENLLTCLADLFSQISSQKKKTGVIAPKRFVQRLKKQNELFRSYMHQDAHEFLNYLLNELVDILEKETKATKMEIDISSSPEKIANGPKVPQANGVHKEPIVTWVHKIFQGILTNETRCLRCETVTARDETFLDLSLDIEQNSSITSCLKNFSSTETLHAEDKFFCDKCCSLQEAQKRMKIKKPPHILVIHLKRFKYIEQLGRYKKLSYRVVFPLELKLSNTVEEYVDIEYSLFAVVVHVGSGPNHGHYVSLVKSHNHWLFFDDENVEMIEESAVQTFFGSSQEYSSNTDHGYILFYESLGTR

SEQ ID NO: 9341 - protein, 368 aa, Prunus mume
MGAAGSKLEKALGDQFPEGERYFGLENFGNTCYCNSVLQALYFCVPFREQLLEYYSSNKSTGDAEENLLTCLADLFTQISSQKKKTGVIAPKRFVQRLKKQNELFRSYMHQDAHEFLNFLLNELVDILEKEAQAAKSDQETSPPEKMVNGPKNAQANGSHKDPLVTWVHKNFQGILTNETRCLRCETVTARDETFFDLSLDIEQNSSITSCLKNFSSTETLNAEDKFFCDKCCSLQEAQKRMKIKKPPHILVIHLKRFKYIEQLGRYKKLSYRVVFPLELKLSNTVEDAESEYSLFAVVVHVGSGPNHGHYVSLVKSHNHWLFFDDENVEMIDESAVQTFFGSAQEYSSNTDHGYILFYESLGTSNKS

SEQ ID NO: 9342 - protein, 369 aa, Malus domestica
MGAAGSKLEKALGDQFPEGERYFGLENFGNTCYCNSVLQALYFCVPFREQLLEYYSSNKSAGDAEENLLTCLADLFTQISSQKKKTGVIAPKRFVQRLKKQNELFRSYMHQDAHEFLNFLLNELVDILEKEAQAAKSDQETTSPPEKMGNGPKNVQANGTHKDPLVTWVHKNFQGILTNETRCLRCETVTARDEIFLDLSLDIEQNSSITSCLKNFSSTETLNAEDKFFCDKCCSLQEAQKRMKIKKPPHILVIHLKRFKYIEQLGRYKKLSYRVVFPLELKLSNTVEDAESEYSLFAVVVHVGSGPNHGHYVSLVKSHNHWLFFDDENVEMIDESAVQTFFGSAQEYSSNTDHGYILFYESLGTSNKS

SEQ ID NO: 9343 - protein, 369 aa, Gossypium hirsutum
MGAAGSKLEKALGDQFPEGERYFGLENFGNTCYCNSVLQALYFCVPFREQLLEYYSSNKNGVDAEDNLLTCLADLFTQISSQKKKTGVIAPKRFVQRLKKQNELFRSYMHQDAHEFLNFLLNELVDILEKEAQAAKNDAETSSPSEKTANGPKNPQANGVKKEPLVTWVHKNFQGILTNETRCLRCETVTARDETFFDLSLDIEQNSSITSCLKNFSSTETLNAEDKFFCDKCCSLQEAQKRMKIKKPPHILVIHLKRFKYIEQLGRYKKLSYRVVFPLELKLSNTVEDADLEYSLFAVVVHVGSGPNHGHYVSLVKSHNHWLFFDDENVEMIDESAVQTFFGSAQEFSSNTDHGYILFYESLGAGNRS

SEQ ID NO: 9344 - protein, 369 aa, Prunus persica
MGAAGSKLEKALGDQFPEGERYFGLENFGNTCYCNSVLQALYFCVPFREQLLEYYSSNKSTGDAEENLLTCLADLFTQISSQKKKTGVIAPKRFVQRLKKQNELFRSYMHQDAHEFLNFLLNELVDILEKEAQAAKSDQETSSPPEKMVNGPKNAQANGSHKDPLVTWVHKNFQGILTNETRCLRCETVTARDETFFDLSLDIEQNSSITSCLKNFSSTETLNAEDKFFCDKCCSLQEAQKRMKIKKPPHILVIHLKRFKYIEQLGRYKKLSYRVVFPLELKLSNTVEDAESEYSLFAVVVHVGSGPNHGHYVSLVKSHNHWLFFDDENVEMIDESAVQTFFGSAQEYSSNTDHGYILFYESLGTSNKS

SEQ ID NO: 9345 - protein, 369 aa, Glycine max
MGAAGSKLEKALGDQFPEGERYFGLENFGNTCYCNSVLQALYFCVPFREQLLEYYGNNKSILDGEENLLTCLADLFSQISSQKKKTGVIAPKRFVQRLKKQNELFRSYMHQDAHEFLNFLLNELVDILEKEAQAAKTDQETSPPSEKAVNGPKNGQANGVHKEPLVTWVHKNFQGILTNETRCLQCETVTARDETFLDLSLDIEQNSSITSCLKNFSSTETLNAEDKFFCDKCCSLQEAQKRMKIKKPPHILVIHLKRFKYMEQLGRYKKLSYRVVFPLELKLSNTVEDADIEYSLFAVVVHVGSGPNHGHYVSLVKSHNHWLFFDDENVEMIDESAVQTFFGSSQEYSSNTDHGYILFYESLGSGNRS

SEQ ID NO: 9346 - protein, 369 aa, Glycine max
MGAAGSKLEKALGDQFPEGERYFGLENFGNTCYCNSVLQALYFCVPFREQLLEYYANNKSIADAEENLLTCLADLFSQISSQKKKTGVIAPKRFVQRLKKQNELFRSYMHQDAHEFLNFLLNELVDILEKEAQSAKNDQETSPPSEKAANGPKNGLANGAKKEPLVTWVHKNFQGILTNETRCLRCETVTARDETFFDLSLDIEQNSSITSCLKNFSSTETLNAEDKFFCDKCCSLQEAQKRMKIKKPPHILVIHLKRFKYIEQLGRYKKLSYRVVFPLELKLSDTAENSDIEYSLFAVVVHVGSGPNHGHYVSLVKSHNHWLFFDDENVEMIDESAVQTFFGSSQEYSSNTDHGYILFYESIGSGNRN

SEQ ID NO: 9347 - protein, 176 aa, Amsonia hubrichtii
MGAAGSKLEKALGDQFPEGERYFGLENFGNTCYCNSVLQALYFCVPFREHLIEYYSNNKNLADAEENLLTCLADLFMQISSQKKKTGVIAPKRFVQRLKKQNEIFRSYMHQDAHEFLNYLLNELVDILERSHVLQKVILKLLLHLKRFQMDQQIIMLVVHRRSLLSPGCTKISRAF

SEQ ID NO: 9348 - protein, 366 aa, Musa acuminata
MGAAGSKLEKVLGDQFPEGERYFGLENFGNTCYCNSVLQALYFCIPFREQLLDYYANNKNLGDAEENLLMCLADLFSQISSQKKKTGVIAPKRFVYRVKKQNEIFRGYMHQDAHEFLNFLLNELVDILEKESNALKSPPEALSPSEKISNGPSHPVMNGVRKEPIVTWVHKNFQGILTNETRCLCCETVTARDEMFFDLSLDIEQNSSITSCLKNFCSTETLNAEDKFFCDKCCSLQEAQKRMKIKKPPHILVIHLKRFKYMEQLGRYKKLSYRVVFPMELKLNTAEDADSEYILFAVVVHVGSGPNHGHYVSLVKSHNHWLMFDDDNIEMIDESTVQTFFGSSQEYPGNTDHGYILFYECLGGKS

SEQ ID NO: 9349 - protein, 366 aa, Unknown
  Sequence found in Organisms: Solanum tuberosum, Solanum phureja
MGATGSKLEKALGDQFPEGERYFGLENFGNTCYCNSVLQALYFCVPFREQLLEYYANNKSPPEAEENLLTCLAELFSQISSQKKKTGVIAPRRFVQRVRKQNELFRGYMHQDAHEFLNFLLNELVDILEKESHAAKSLAASSPEKVSNGTCNGHANGVKKEPLVTWVHKNFQGILTNETRCLRCETVTARDETFFDLSLDIEQNSSITSCLKNFSSTETLNAEDKFFCDKCCSLQEAQKRMKIKKPPHILVIHLKRFKYMEQLGRYKKLSYRVVFPLELKLSNTTENTDSEYSLFAVVVHVGSGPNHGHYVSLVKSHNHWLFFDDENAEIIDESAVQTFFGSAQEYSSNTDHGYILFYESLAASKS

SEQ ID NO: 9350 - protein, 368 aa, Unknown
  Sequence found in Organisms: Gossypium hirsutum, Gossypium raimondii
MGAAGSKLEKALGDQFPEGERYFGLENFGNTCYCNSVLQALYFCVPFREQLLEYYSNYKNGADAEENLLICLADLFTQISSQKKKTGVIAPKRFVQRLKKQNELFRSYMHQDAHEFLNFLLNELVDILEKEARTAKNEAETSPPEKVANGPKNPQANGVQKEPLVTWVHKNFQGILTNETRCLRCETVTARDETFFDLSLDIEQNSSITSCLKNFSSTETLNAEDKFFCDKCCSLQEAQKRMKIKKPPHILVIHLKRFKYIEQLGRYKKLSYRVVFPLELKLSNTVEDADSEYSLFAVVVHVGSGPNHGHYVSLVKSHNHWLFFDDENVEMIDESAVQTFFGSAQEYSSNTDHGYILFYESLGANKNS

SEQ ID NO: 9351 - protein, 367 aa, Lotus japonicus
MGATGSKLEKALGDQFPEGERYFGLENFGNTCYCNSVLQALYFCVPFREQLLEYYGNNKSIGDPEENLLTCLADLFSQISSQKKKTGVIAPKRFVQRLKKQNELFRSYMHQDAHEFLNFLLNELVDILEKEAQAAKTDPDTSPPSEKVANGFKNGHVNGGQKEPLVTWVHKNFQGILTNETRCLQCETVTARDETFFDLSLDIEQNSSITSCLKNFSSTETLNAEDKFFCDKCCSLQEAQKRMKIKKPPHILVIHLKRFKYMEQLGRYKKLSYRVVFPLELKLSNTVEDADIEYSLFAVVVHVGSGPNHGHYVSLVKSHNHWLFFDDENVEMIDESAVQTFFGSAQEYSSNTDHGYILFYETLGDKN

SEQ ID NO: 9352 - protein, 369 aa, Glycine max
MGAAGSKLEKALGDQFPEGERYFGLENFGNTCYCNSVLQALYFCVPFREQLLEYYGNNKSILDGEENLLTCLADLFSQISSQKKKTGVIAPKRFVQRLKKQNELFRSYMHQDAHEFLNFLLNELVDILEKEAQAAKTDQETSPPSEKAVNGPKNGQANGVHKEPLVTWVHKNFQGILTNETRCLQCETVTARDETFLDLSLDIEQNSSITSCLKNFSSTETLNAEDKFFCDKCCSLQEAQKRMKIKKPPHILVIHLKRFKYMEQLGRYKKLSYRVVFPLELKLSNTVEDADIEYSLFAVVVHVGSGPNHGHYVSLVKSHNHWLFFDDENVEMIDESAVQTFFGSSQEYSSNTDHGYILFYESIGSGNRS

SEQ ID NO: 9353 - protein, 369 aa, Fragaria vesca
MGAAGSKLEKALGDQFPEGERYFGLENFGNTCYCNSVLQALYFCVPFREQLLEYYSNSKNIGDAEENLLTCLADLFTQISSQKKKTGVIAPKRFVQRLKKQNELFRSYMHQDAHEFLNFLLNELVDILEKEAQAAKSDQETSSPPEKLANGPKNGQANGSHKDPLVTWVHKNFQGILTNETRCLRCETVTARDETFFDLSLDIEQNSSITSCLKNFSSTETLNAEDKFFCDKCCSLQEAQKRMKIKKPPHVLVIHLKRFKYIEQLGRYKKLSYRVVFPLELKLSNTVEDAESEYSLFAVVVHVGSGPNHGHYVSLVKSHNHWLFFDDENVEMIDESAVQTFFGSAQEYSSNTDHGYILFYESLGTSNKS

SEQ ID NO: 9354 - protein, 370 aa, Castanea mollissima
MGAAGSKLEKALGDQFPEGERYFGLENFGNTCYCNSVLQALYFCVPFREQLLDYFANNKSIGDVEENLLTCLADLFSQISSQKKKTGVIAPKRFVQRLKKQNELFRSYMHQDAHEFLNFLLNELVDILEKEAQAVKSDPETSSPSDKIANGPKNAQANGALKEPLVTWVHKNFQGILTNETRCLRCETVTARDETFFDLSLDIEQNSSITSCLKNFSSTETLNAEDKFFCDKCCSLQEAQKRMKIKKPPHILVIHLKRFKYIEQLGRYKKLSYRVVFPLELKLSNTMEDADSEYSLFAVVVHVGSGPNHGHYVSLVKSHNHWLFFDDENVEMIDESAVQTFFGSAQEYSSNTDHGYILFYECLGSTSNKS

SEQ ID NO: 9355 - protein, 370 aa, Euphorbia peplus
MGAAGSKLEKALGDQFPEGERYFGLENFGNTCYCNSVLQALYFCVPFREQLLEYYANNKNSGDAEDNLLTCLADLFTQISSQKKKTGVIAPKRFVQRLKKQNEIFRSYMHQDAHEFLNYLLNELVDTLEKEGQAAKSDPESSSSPEKTANGPKNGLANGISKEPLVTWVHKNFQGILTNETRCLQCETVTARDETFFDLSLDIEQNSSITSCLKNFSSTETLNAEDKFFCDKCCSLQEAQKRMKIKKPPHILVIHLKRFKYIEQLSRYKKLSYRVVFPLELKLSNTVEDTDIEYSLFAVVVHVGSGPNHGHYVSLVKSHNHWLFFDDENVEMIDESAVQTFFGSAQEYSSNTDHGYILFYENLGASSNKN

SEQ ID NO: 9356 - protein, 370 aa, Quercus alba
MGAAGSKLEKALGDQFPEGERYFGLENFGNTCYCNSVLQALYFCVPFREQLLDYYANNKSIGDVEENLLTCLADLFSQISSQKKKTGVIAPKRFVQRLKKQNELFRSYMHQDAHEFLNFLLNELVDILEKEAQVVKSDPETSSPSDKIANGPKNAQANGALKEPLVTWVHKNFQGILTNETRCLRCETVTARDETFFDLSLDIEQNSSITSCLKNFSSTETLNAEDKFFCDKCCSLQEAQKRMKIKKPPHILVIHLKRFKYIEQLGRYKKLSYRVVFPLELKLSNTMEDADSEYSLFAVVVHVGSGPNHGHYVSLVKSHNHWLFFDDENVEMIDESAVQTFFGSAQEYSSNTDHGYILFYECLGSTSNKS

SEQ ID NO: 9357 - protein, 370 aa, Populus trichocarpa
MGAAGSKLEKALGDQFPEGERYFGLENFGNTCYCNSVLQALYFCAPFREQLLEYYANSKNIGDAEENLLTCLADLFTQISSQKKKTGVIAPKRFVQRLKKQNELFRSYMHQDAHEFLNFLLNELVDILEKEAQAVKSETETSSPPEKTANGPKHAQANGVSKEPLVTWVHKNFQGILTNETRCLQCETVTARDETFFDLSLDIEQNSSITSCLKNFSSTETLNAEDKFFCDKCCSLQEAQKRMKIKKPPHILVIHLKRFKYIEQLGRYKKLSYRVVFPLELKLSNTVEDADIEYSLFAVVVHVGSGPNHGHYVSLVKSHNHWLFFDDENVEMIDESAVQTFFGSAQEYSSNTDHGYILFYESIGASNNKS

SEQ ID NO: 9358 - protein, 369 aa, Solanum phureja
MGAAGSKLEKALGDQFPEGERYFGLENFGNTCYCNSVLQALYFCVPFREQLLDYYSNNKNLADADENLLTCLADLFMQISSQKKKTGVIAPKRFVQRLKKQNEIFRSYMHQDAHEFLNYLLNELVDILEKVASAAKSDQETSSPTEKIANGPTSVHANGVKKEPLVTWVHKNFQGILTNETKCLRCETVTARDETFLDLSLDIEQNSSITSCLKNFSSTETLNAEDKFFCDKCCSLQEAQKRMKIKKPPHILVIHLKRFKYIEQLGRYKKLSYRVVFPLELKLSNTVEDADAEYSLFAVVVHVGSGPNHGHYVSLVKSHNHWLFFDDENVEMIDESAVQTFFGSAQEYSSNTDHGYILFYERVSNGSTS

SEQ ID NO: 9359 - protein, 369 aa, Trigonella foenum-graecum
MGAAGSKLEKALGDQFPEGERYFGLENFGNTCYCNSVLQALYFCVPFREQLLEYYGNNKTLGDAEENLLTCLADLFSQISSQKKKTGVIAPKRFVQRLKKQNELFRSYMHQDAHEFLNFLLNELVDILEKEAQAVKSDPETPTPSEKVANGFKNGHANGPQKEPLITWVHKNFQGILTNETRCLQCETVTARDETFFDLSLDIEQNSSITSCLKNFSSTETLNAEDKFFCDKCCSLQEAQKRMKIKKPPHILVIHLKRFKYMEQLGRYKKLSYRVVFPLELKLSNTVEDSDIEYSLFAVVVHVGSGPNHGHYVSLVKSHNHWLFFDDENVEMIDESAVQTFFGSPQEYSTNTDHGYILFYESLGPGNSN

SEQ ID NO: 9360 - protein, 369 aa, Citrullus lanatus
MGATGSKLEKALGDQFPEGERYFGLENFGNTCYCNSVLQALYFCVPFREQLLDYYSNNKSIGDAEENLLTCLADLFTQISSQKKKTGVIAPKRFVQRLKKQNEIFRSYMHQDAHEFLNFLLNELVDILEKETHATKSDAESSSPSEKISNGPKTGQANGAQKEPLVTWVHKNFQGLLTNETRCLRCETVTARDETFLDLSLDIEQNSSITSCLKNFSSTETLNAEDKFFCDKCCSLQEAQKRMKIKKPPRILVIHLKRFKYIEQLGRYKKLLYRVVFPLELKLSNTMEDADSEYSLFAVVVHVGSGPNHGHYVSLVKSHNHWLFFDDENVEMIDESVVQTFFGSAQEYSSNTDHGYILFYESIGTGNKS

SEQ ID NO: 9361 - protein, 370 aa, Vigna unguiculata
MGAAGSKLEKALGDQFPEGERYFGLENFGNTCYCNSVLQALYFCVPFREQLLEYYGNNKSILDGEENLLTCLADLFSQISSQKKKTGVVAPKRFVQRLKKQNELFRSYMHQDAHEFLNFLLNELVDILEKESQAVKAADQETSPPSEKAVNGPKNGQANGVHKEPLVTWVHKNFQGILTNETRCLQCETVTARDETFLDLSLDIEQNSSITSCLKNFSSTETLNAEDKFFCDKCCSLQEAQKRMKIKKPPHILVIHLKRSKYMEQLGRYKKLSYRVVFPLELKLSNTVEDADIEYSLFAVVVHVGSGPNHGHYVSLVKSHNHWLFFDDENVEMIDESAVQTFFGSSQEYSSNTDHGYILFYESLGSGNRN

SEQ ID NO: 9362 - protein, 368 aa, Gossypium hirsutum
MGAAGSKLEKALGDQFPEGERYFGLENFGNTCYCNSVLQALYFCVPFREQLLEYYSSHKIGADAEDNLLTCLADLFTQINSQKKKTGVIAPKRFVQRLKKQNELFRSYMHQDAHEFLNFLLNELVDILEKEDQAAKKEGETLSPSEKTVNGPKNPQANGVQKEPLVTWVHKNFQGILTNETRCLRCETVTARDEAFFDLSLDIEQNSSITSCLKNFSSTETLNAEDKFFCDKCCSLQEAQKRMKIKKPPHILVIHLKRFKYIEQLGRYKKLSYRVVFPLELKLSNTVEDADSEYSLFAVVVHVGSGPNHGHYVSLVKSHNHWLFFDDENVEMIDESAVQTFFGSAQEYSSNTDHGYILFYESLCANKS

SEQ ID NO: 9363 - protein, 368 aa, Gossypium raimondii
MGAAGSKLEKALGDQFPEGERYFGLENFGNTCYCNSVLQALYFCVPFREQLLEYYSSHEIGADAEDNLLTCLADLFTQINLQKKKTGVIAPKRFVQRLKKQNELFRSYMHQDAHEFLNFLLNELVDILEKEDQAAKKEGGTSSPSEKTVNGPKNPQANGVQKEPLVTWVHKNFQGILTNETRCLRCETVTARDEAFFDLSLDIEQNSSITSCLKNFSSTETLNAEDKFFCDKCCSLQEAQKRMKIKKPPHILVIHLKRFKYIEQLGRYKKLSYRVVFPLELKLSNTVEDADSEYSLFAVVVHVGSGPNHGHYVSLVKSHNHWLFFDDENVEMIDESAVQTFFGSAQEYSSNTDHGYILFYESLCANKS

SEQ ID NO: 9364 - protein, 369 aa, Ambrosia trifida
MGATGSKLEKALGDQFPEGERYFGLENFGNTCYCNSVLQALYFCVPFREQLLEYYGNIKNPGDTEENLLTCLAELFMQISTQKKKTGVIAPKRFVQRVKKENELFRGYMHQDAHEFLNFLLNELVDILEKEANASKGSKEHSSPSEKIPNGVHVPQANGVRKEPLVTWVHKNFQGILTNETKCLRCETVTARDETFLDLSLDIEQNSSITSCLKNFSSTETLNAEDKFFCDKCCSLQEAQKRMKIKKPPHILVIHLKRFKYMEQLGRYKKLSYRVVFPLELKLTNTMEDADCEYSLFAVVVHVGSGPNHGHYVSLVKSHNHWLFFDDENVEMIDESAVQTSFGSAQEYASNTDHGYILFYESLATNSGH

SEQ ID NO: 9365 - protein, 369 aa, Ambrosia trifida
MGATGSKLEKALGDQFPEGERYFGLENFGNTCYCNSVLQALYFCVPFREQLLEYYGNIKNPGDTEENLLTCLAELFMQISTQKKKTGVIAPKRFVQRVKKENELFRGYMHQDAHEFLNFLLNELVDILEKEANASKGSKEHSSPSEKIPNGIHVPQANGVRKEPLVTWVHKNFQGILTNETKCLRCETVTARDETFLDLSLDIEQNSSITSCLKNFSSTETLNAEDKFFCDKCCSLQEAQKRMKIKKPPHILVIHLKRFKYMEQLGRYKKLSYRVVFPLELKLTNTMEDADCEYSLFAVVVHVGSGPNHGHYVSLVKSHNHWLFFDDENVEMIDESAVQTSFGSAQEYASNTDHGYILFYESLATNGGH

SEQ ID NO: 9366 - protein, 365 aa, Arabidopsis thaliana
MGAAGSKLEKALGDQFPEGERYFGFENFGNTCYCNSVLQALYFCAPFREQLLEHYANNKADAEENLLTCLADLFSQISSQKKKTGVIAPKRFVQRLKKQNELFRSYMHQDAHEFLNYLLNELVEILEKETQATKADNETSSSPEKIANVLKAPLANGVHKEPIVTWVHKIFQGILTNETRCLRCETVTARDETFLDLSLDIEQNSSITSCLKNFSSTETLHAEDKFFCDKCCSLQEAQKRMKIKKPPHILVIHLKRFKYMEQLGRYKKLSYRVVFPLELKLSNTVDEYVDIEYSLFAVVVHVGSGPNHGHYVSLVKSHNHWLFFDDESVEIIEESAVQTFFGSSQEYSSNTDHGYILLYESLGTR

SEQ ID NO: 9367 - protein, 370 aa, Vigna unguiculata
  misc_feature (210)..(210): Xaa can be any naturally occurring amino acid
  misc_feature (260)..(260): Xaa can be any naturally occurring amino acid
MGAAGSKLEKALGDQFPEGERYFGLENFGNTCYCNSVLQALYFCVPFREQLLEYYGNNKSILDGEENLLTCLADLFSQISSQKKKTGVVAPKRFVQRLKKQNELFRSYMHQDAHEFLNFLLNELVDILEKESQAVKAADQETSPPSEKAVNGPKNGQANGVHKEPLVTWVHKNFQGILTNETRCLQCETVTARDETFLDLSLDIEQNSSXTSCLKNFSSTETLNAEDKFFCDKCCSLQEAQKRMKIKKPPHILVIHLKRXKYMEQLGRYKKLSYRVVFPLELKLSNTVEDADIEYSLFAVVVHVGSGPNHGHYVSLVKSHNHWLFFDDENVEMIDESAVQTFFGSSQEYSSNTDHGYILFYESLGSGNRN

SEQ ID NO: 9368 - protein, 369 aa, Arachis hypogaea
MGAAGSKLEKALGDQFPEGERYFGLENFGNTCYCNSVLQALYFCVPFREQLLDYYANNKSMADAEENLLTCLADLFSQISSQKKKTGVIAPKRFVQRLKKQNELFRSYMHQDAHEFLNFLLNELVDILEKEAQSAKDDQDPLPPSEKVANGPIAGPVNGTKKEPLVTWVHKNFQGILTNETRCLQCETVTARDETFFDLSLDIEQNSSITSCLKNFSSTETLNAEDKFFCDKCCSLQEAQKRMKIKKPPQILVIHLKRFKYIEQLGRYKKLSYRVVFPLELKLSDTVEDADIEYSLFAVVVHVGSGPNHGHYVSLVKSHNHWLFFDDENVEMIDESAVQTFFGSSQEYSSNTDHGYILFYESTASGHKS

SEQ ID NO: 9369 - protein, 368 aa, Cajanus cajan
MGAAGSKLEKALGDQFPEGERYFGLENFGNTCYCNSVLQALYFCVPFREQLLDYYGNNKSLDAEENLLTCLADLFSQISSQKKKTGVIAPKRFVQRLKKQNELFRSYMHQDAHEFLNFLLNELVDILEKEAQAAKTDQETSPPSEKIVNGPKNGQANGVHKEPLVTWVHKNFQGILTNETRCLQCETVTARDETFFDLSLDIEQNSSITSCLKNFSSTETLNAEDKFFCDKCCSLQEAQKRMKIKKPPHILVIHLKRFKYMEQLGRYKKLSYRVVFPLELKLSNTVEEADIEYSLFAVVVHVGSGPNHGHYVSLVKSHNHWLFFDDENVEMIDESAVQTFFGSSQEYSSNTDHGYILFYESLGSGNRN

SEQ ID NO: 9370 - protein, 370 aa, Populus trichocarpa
MGAAGSKLEKALGDQFPEGERYFGLENFGNTCYCNSVLQALYFCVPFREHLLEYYGNGKSIGDAEENLLTCLADLFTQISSQKKKTGVIAPKRFVQRLKKQNELFRSYMHQDAHEFLNFLLNELVDILEKEAQAVKSDPETSSPPEKIANGPKHAQANGVSKEPLVTWVHKNFQGILTNETRCLQCETVTARDETFFDLSLDIEQNSSITSCLKNFSSTETLNAEDKFFCDKCCSLQEAQKRMKIKKPPHILVIHLKRFKYIEQLGRYKKLSYRVVFPLELKLSNTVEDADIEYSLFAVVVHVGSGPNHGHYVSLVKSHNHWLFFDDENVEMIDESAVQTFFGSAQEYSSNTDHGYILFYESIGASNNKS

SEQ ID NO: 9371 - protein, 366 aa, Nicotiana benthamiana
MGATGSKLEKALGDQFPEGERYFGLENFGNTCYCNSVLQALYFCVPFREQLLEYYANNKSPAEAEENLLTCLAELFSQISSQKKKTGVIAPRRFVQRVRKQNELFRGYMHQDAHEFLNFLLNELVDILEKESHASKSLTASSPEEVANGSCYGKSNGVKKEPLVTWVHKNFQGILTNETRCLRCETVTARDETFFDLSLDIEQNSSITSCLKNFSSTETLNAEDKFFCDKCCSLQEAQKRMKIKKPPHILVIHLKRFKYMEQLGRYKKLSYRVVFPLELKLSNTIENTDSEYSLFAVVVHVGSGPNHGHYVSLVKSHNHWLFFDDENAEIIDESAVQTFFGSAQEYSSNTDHGYILFYESLAASKS

SEQ ID NO: 9372 - protein, 369 aa, Phaseolus coccineus
MGAAGSKLEKALGDQFPEGERYFGLENFGNTCYCNSVLQALYFCVPFREQLLEYYGNNKSTLDGEENLLTCLADLFSQISSQKKKTGVVAPKRFVQRLKKQNELFRSYMHQDAHEFLNFLLNELVDTLEKESKAAKTDQETSPPSEKAVNGPKNGQANGVHEEPLFTWVHKNFQGLLTNETRCLRCETVTARDEIFLDLSLDIEQNSSITSCLKNFSSTETLNAEDKFFCDKCCSLQEAQKRMKIKKPPHILVIHLKRFKYMEQLGRYKKLSYRVVFPLELKLSNTVEDADIEYSLFAVVVHVGSGPNHGHYVSLVKSHNHWLFFDDENVEMIDESAVQTFFGSSQEYSSNTDHGYILFYESLGSGNRN

SEQ ID NO: 9373 - protein, 369 aa, Cannabis sativa
MGAAGSKLEKALGDQFPEGERYFGLENFGNTCYCNSVLQALYFCVPFREQLLEYYSNTKSIGDAEENLLTCLADLFSQISSQKKKTGVIAPKRFVQRLKKQNELFRSYMHQDAHEFLNFLLNELVDILEKEAQATKSDKESLSPPDTVANGPRNGQVNGTQKEPLVTWVHKNFQGLLTNETRCLRCETVTARDETFFDLSLDIEQNSSITSCLKNFSSTETLNAEDKFFCDKCCSLQEAQKRMKIKKPPHILVIHLKRFKYIEQLGRYKKLSYRVVFPLELKLSNTVEDADSEYSLFAVVVHVGSGPNHGHYVSLVKSHNHWLFFDDENVEMIDESAVQTFFGSAQEYSSNTDHGYILFYESLGSSNKS

SEQ ID NO: 9374 - protein, 367 aa, Cirsium arvense
MGAAGSKLEKALGDQFPEGERYFGLENFGNTCYCNSVLQALYFCVPFREQLLEYYSNNKSFADAEENLLTCLADLFTQISSQKKKTGVIAPKRFVQRLKKQNEIFRSYMHQDAHEFLNYLLNELVDILEKESHAAKSDPESSSSSEQIANGLKSALTNGHMREPLVTWVHKNFQGILTNETRCLRCETVTARDETFLDLSLDIEQNSSITSCLKNFSSTETLNAEDKFFCDKCCSLQEAQKRMKIKKPPQILVIHLKRFKYIEQLGRYKKLSYRVVFPLELKLSNTVEDADAEYSLFGVVVHVGSGPNHGHYVSLVKSHNHWLFFDDENVEMIDESAVQTFFGSAQEYSSNTDHGYILFYERVDTTS

SEQ ID NO: 9375 - protein, 366 aa, Cucumis sativus
MGATGSKLEKALGDQFPEGERYFGLENFGNTCYCNSALYFCVPFREQLLDYYSNNKSIGDAEENLLTCLADLFTQISSQKKKTGVIAPKRFVQRLKKQNEIFRSYMHQDAHEFLNFLLNELVDILEKEAHAIKSDAESSSPPEKISNGPKTGQANGAQKEPLVTWVHKNFQGLLTNETRCLRCETVTARDETFLDLSLDIEQNSSITSCLKNFSSTETLNAEDKFFCDKCCSLQEAQKRMKIKKPPHILVIHLKRFKYIEQLGRYKKLLYRVVFPLELKLSNTMEDADSEYSLFAVVVHVGSGPNHGHYVSLVKSHNHWLFFDDENVEMIDESVVQTFFGSAQEYSSNTDHGYILFYESIGTGNKS

SEQ ID NO: 9376 - protein, 366 aa, Helianthus annuus
MGATGSKLEKALGDQFPEGERYFGLENFGNTCYCNSVLQALYFCVPFREQLLEYYGNGKNTGDVEENLLTCLAELFMQISTQKKKTGVIAPKRFVQRVKKENELFRGYMHQDAHEFLNFLLNDLVDILEKEAAKGPAEGLSPPQKIVNGPHGGHVNGVKKEPLVTWVHKNFQGILTNETRCLRCETVTARDETFLDLSLDIEQNSSITSCLKNFSSTETLNAEDKFFCDKCCSLQEAQKRMKIKKPPHILVIHLKRFKYMEQLGRYKKLSYRVVFPLELKLTNTMEDADCEYSLFAVVVHVGSGPNHGHYVSLVKSHNHWLFFDDENVEMIEESAIQTAFGSAQEYASNTDHGYILFYESLANNSS

SEQ ID NO: 9377 - protein, 369 aa, Helianthus annuus
MGATGSKLEKALGDQFPEGERYFGLENFGNTCYCNSVLQALYFCVPFREQLLEYYGNVKNPGDVEENLLTCLAELFMQISTQKKKTGVIAPKRFVQRVKKENELFRGYMHQDAHEFLNFLLNELVDILEKEANSAKASKELSSPPEKIPNGIHVAHANGVRKEPLVTWVHKNFQGILTNETKCLRCETVTARDETFLDLSLDIEQNSSITSCLKNFSSTETLNAEDKFFCDKCCSLQEAQKRMKIKKPPHILVIHLKRFKYMEQLGRYKKLSYRVVFPLELKLTNTMEDADCEYSLFAVVVHVGSGPNHGHYVSLVKSHNHWLFFDDENVEMIDESAVQTSFGSAQEYASNTDHGYILFYESLAANNDH

SEQ ID NO: 9378 - protein, 226 aa, Ambrosia trifida
MGATGSKLEKALGDQFPEGERYFGLENFGNTCYCNSVLQALYFCVPFREQLLEYYGNVKNPGDVEENLLTCLAELFMQISTQKKKTGVIAPKRFVQRVKKENELFRGYMHQDAHEFLNFLLNELVDILEKEANSAKGSKELSPPPEKIPNGIHVAHANGVRKEPLITWVHKNFQGILTNETKCLRCETVTARDETFLDLSLDIEQNSSITSCLKNFSSTETLNAEV

SEQ ID NO: 9379 - protein, 369 aa, Nicotiana benthamiana
MGAAGSKLEKALGDQFPEGERYFGLENFGNTCYCNSVLQALYFCVPFREQLLEYFSNSKNLADADENLLTCLADLFMQISSQKKKTGVIAPKRFVQRLKKQNEIFRSYMHQDAHEFLNYLLNELVDILEKEASAAKTDQETSSPTEKIANGPTSIHVNGDKKEPLVTWVHKNFQGILTNETKCLCCETVTARDETFLDLSLDIEQNSSITSCLKNFSSTETLNAEDKFFCDKCCSLQEAQKRMKIKKPPHILVIHLKRFKYIEQLGRYKKLSYRVVFPLELKLSNTVEDADAEYSLFAVVVHVGSGPNHGHYVSLVKSHNHWLFFDDENVEMIDESAVQTFFGSAQEYSSNTDHGYILFYERVSNGSTS

SEQ ID NO: 9380 - protein, 369 aa, Cicer arietinum
MGAAGSKLEKALGDQFPEGERYFGLENFGNTCYCNSVLQALYFCVPFREQLLEYYGNNKSIGDVEENLLTCLADLFSQISSQKKKTGVIAPKRFVQRLKKQNELFRSYMHQDAHEFLNFLLNELVDILEKEAQAAKTDPETPPPSEKVANGLKNGHANGPQKEPLITWVHKNFQGILTNETRCLQCETVTARDETFFDLSLDIEQNSSITSCLKNFSSTETLNAEDKFFCDKCCSLQEAQKRMKIKKPPHILVIHLKRFKYMEQLGRYKKLSYRVVFPLELKLSNTVEDADSEYSLFAVVVHVGSGPNHGHYVSLVKSHNHWLFFDDENVEIIDESAVQTFFGSPQEYSTNTDHGYILFYESLGPGNKN

SEQ ID NO: 9381 - protein, 369 aa, Cirsium arvense
MGATGSKLEKALGDQFPEGERYFGLENFGNTCYCNSVLQALYFCVPFREQLLEYYGNVKNPGDVEENLLTCLAELFMQISTQKKKTGVIAPKRFVQRVKKENELFRGYMHQDAHEFLNFLLNELVDILEKETNAAKGSKEHSSPPEKITNGLHVPLANGVRKEPLVTWVHKNFQGILTNETKCLRCETVTARDETFLDLSLDIEQNSSITSCLKNFSSTETLNAEDKFFCDKCCSLQEAQKRMKIKKPPHILVIHLKRFKYMEQLGRYKKLSYRVVFPLELKLTNTMEDADCEYSLFAVVVHVGSGPNHGHYVSLVKSHNHWLFFDDENAEMIDESAVQTSFGSAQEYASNTDHGYILLYESLAANNTS

SEQ ID NO: 9382 - protein, 369 aa, Solanum lycopersicum
MGAAGSKLEKALGDQFPEGERYFGLENFGNTCYCNSVLQALYFCVPFREQLLDYYSNNKSLADADENLLTCLADLFMQISSQKKKTGVIAPKRFVQRLKKQNEIFRSYMHQDAHEFLNYLLNELVDILEKEASPTKSDQETSSPTEKNANGPTSVHDNGDKKEPLVTWVHKNFQGILTNETKCLRCETVTARDETFLDLSLDIEQNSSITSCLKNFSSTETLNAEDKFFCDKCCSLQEAQKRMKIKKPPHILVIHLKRFKYIEQLGRYKKLSYRVVFPLELKLSNTVEDADAEYSLFAVVVHVGSGPNHGHYVSLVKSHNHWLFFDDENVEMIDESAVQTFFGSAQEYSSNTDHGYILFYERVPNGSTS

SEQ ID NO: 9383 - protein, 366 aa, Solanum lycopersicum
MGATGSKLEKALGDQFPEGERYFGLENFGNTCYCNSVLQALYFCVPFREQLLEYYANNKGPPEAEENLLTCLAELFSQISSQRKKTGVIAPRRFVQRVRKQNELFRGYMHQDAHEFLNFLLNELVDILEKESHGAKSSAATSPEKVSNGTCNGHANDVKEEPLVTWVHKNFQGILTNETRCLRCETVTARDETFFDLSLDIEQNSSITSCLKNFSSTETLNAEDKFFCDKCCSLQEAQKRMKIKKPPHILVIHLKRFKYMEQLGRYKKLSYRVVFPLELKLSNTTENTDSEYSLFAVVVHVGSGPNHGHYVSLVKSHNHWLFFDDENAEIIDESAVQTFFGSAQEYSSNTDHGYILFYESLAASKS

SEQ ID NO: 9384 - protein, 375 aa, Vaccinium corymbosum
MGATGSRLEKALGDQFPEGERYFGLENFGNTCYCNSVLQALYFCVPFREQLLDYYATNKNPGDAEENLLTCLADLFTQINSQKKKTGVIAPKRFVQRVRKQNEVFRGYMHQDAHEFLNFLLNELVDILEKESHAVKTSTETSPPSEKIANGPKNHEANGVKKEPLVTWVHKNFQGILTNETRCLRCETVTARDETFLDLSLDIEQNSSITSCLKNFSSTETLNAEDKFFCDKCCSLQEAQKRMKIKKPPQVLVIHLKRFKYMENLGRYKKLSYRVVFPLELKLSNTTEDNDSEYSLFAVVVHVGSGPNHGHYVSLVKSHNHWLFFDDENVEIIDESAVQTFFGPLRSIRATRIMGTFSSMRVLLLIVRIRKGIFV

SEQ ID NO: 9385 - protein, 183 aa, Ambrosia trifida
MGATGSKLEKALGDQFPEGERYFGLENFGNTCYCNSVLQALYFCVPFREQLLEYYGNVKNPGDVEENLLTCLAELFMQISTQKKKTGVIAPKRFVQRVKKENELFRGYMHQDAHEFLNFLLNELVDILEKEANSAKGSKELSPPPEKIPNGIHVAHANGVRKEPLITWVHKTFRVYLQMKQSV

SEQ ID NO: 9386 - protein, 221 aa, Ambrosia trifida
MGATGSKLEKALGDQFPEGERYFGLENFGNTCYCNSVLQALYFCVPFREQLLEYYGNVKNPGDVEENLLTCLAELFMQISTQKKKTGVIAPKRFVQRVKKENELFRGYMHQDAHEFLNFLLNELVDILEKEANSAKGSKELSPPPEKIPNGIHVAHANGVRKEPLITWVHKNFQGILTNETKCLRCETVTARDETFLDLSLDIEQNSSITSCLKTSAPPRP

SEQ ID NO: 9387 - protein, 183 aa, Flaveria ramosissima
MGATGSKLEKALGDQFPEGERYFGLENFGNTCYCNSVLQALYFCVPFREQLLEYYGNVKNPGDVEENLLTCLAELFMQISTQKKKTGVIAPKRFVQRVKKENELFRGYMHQDAHEFLNFLLNELVDILEKEANSAKGLKEHSSPPEKIPNGTHVAQANGVRKEPLVTWVHKTSRVYLQTKQSV

SEQ ID NO: 9388 - protein, 367 aa, Cirsium arvense
MGATGSKLEKALGDQFPEGERYFGLENFGNTCYCNSVLQALYFCVPFREQLLEYYGNSKSPGDVEENLLTCLAELFMQISTQKKKTGVIAPKRFVQRVKKENELFRGYMHQDAHEFLNFLLNELVDILEKETGKGLVENLSPPEKITNGPHAGLVNGAKKEPLVTWVHKNFQGILTNETRCLRCETVTARDETFLDLSLDIEQNSSITSCLKNFSSTETLNAEDKFFCDKCCSLQEAQKRMKIKKPPHILVIHLKRFKYMEQLGRYKKLSYRVVFPLELKLTNTMEDADCEYSLFAVVVHVGSGPNHGHYVSLVKSHNHWLFFDDENVEMIDESAVQTSFGSAQEYASNTDHGYILFYESLAANKTS

SEQ ID NO: 9389 - protein, 369 aa, Flaveria ramosissima
MGATGSKLEKALGDQFPEGERYFGLENFGNTCYCNSVLQALYFCVPFREQLLEYYGNVKNPGDVEENLLTCLAELFMQISTQKKKTGVIAPKRFVQRVKKENELFRGYMHQDAHEFLNFLLNELVDILEKEANSAKGLKEHSSPPEKIPNGTHVAQANGVRKEPLVTWVHKNFQGILTNETKCLRCETVTARDETFLDLSLDIEQNSSITSCLKNFSSTETLNAEDKFFCDKCCSLQEAQKRMKIKKPPHILVIHLKRFKYMEQLGRYKKLSYRVVFPLELKLTNTMEDADCEYSLFAVVVHVGSGPNHGHYVSLVKSHNHWLFFDDENVEMIDESAVQTSFGSAQEYASNTDHGYILFYESLATNNDH

SEQ ID NO: 9390 - protein, 370 aa, Eutrema parvulum
MGAAGSKLEKALGDQFPEGERYFGFENFGNTCYCNSVLQALYFCVPFREQLLEYYSSNKSVPDAEENLMTCLADLFSQISSQKKKTGVIAPKRFVQRLKKQNELFRSYMHQDAHEFLNYLLNEVVDILEKEAKATKTEHETSSSSSPDKIANGPKVPLANGVHKEPIVTWVHNIFQGILTNETRCLRCETVTARDETFLDLSLDIEQNSSITSCLKNFSSTETLHAEDKFFCDKCCSLQEAQKRMKIKKPPHILVIHLKRFKYIEQLGRYKKLSYRVVFPLELKLSNTVEPYADVEYSLFAVVVHVGSGPNHGHYVSLVKSHNHWLFFDDENVEMIEESAVQTFFGSSQEYSSNTDHGYILFYESLGPTK

SEQ ID NO: 9391 - protein, 240 aa, Ambrosia trifida
MGAAGSKLEKALGDHFPEGERYFGLENFGNTCYCNSVLQALYFCVPFREQLLEYYGNGKNTGDVEENLLTCLAELFMQISTQKKKTGVIAPKRFVQRVKKENELFRGYMHQDAHEFLNFLLNDLVDILEKEAAKGPAEALSPPQKIVNGPHGGQVNGVKKEPLVTWVHKNFQGILTNETRCLRCETVTARDETFLDLSLDIEQNSSITSCLKNFSSTETLNAEDKFSVINAAVCRKHKRG

SEQ ID NO: 9392 - protein, 357 aa, Humulus lupulus
MGAAGSKLEKALGDQFPEGERYFGLENFGNTCYCNSVLQALYFCVPFREQLLEYYSNSKNIGDAEENLLTCLADLFSQISSQKKKTGVIAPKRFVQRLKKQNELFRSYMHQDAHEFLNFLLNELVDILEKEAQAAKSDQESSSPPDTVANGPRNGMVNGTKKEPLVTWVHKNFQGILTNETRCLRCETVTARDETFFDLSLDIEQNSSITSCLKNFSSTETLNAEDKFFCDKCCSLQEAQKRMKIKKPPHILVIHLKRFKYIEQLGRYKKLSYRVVFPLELKLSNTVEDADSEYSLFAVVVHVGSGPNHGHYVSLVKSHNHWLFFDDENVEMIDESAVQTFFGSAQEYSSNTDHGYI

SEQ ID NO: 9393 - protein, 371 aa, Brassica napus
MGAAGSKLEKALGDQFPEGERYFGFENFGNTCYCNSVLQALYFCVPFREQLLEYYTSNKSVADAEENLMTCLADLFSQISSQKKKTGVIAPKRFVQRLKKQNELFRSYMHQDAHEFLNYLLNEVVDILEKEAKATKTEHKTSSSSSSPEKIANGPKAPLANGVHKEPVVTWVHNIFQGILTNETRCLRCETVTARDETFLDLSLDIEQNSSITSCLKNFSSTETLHSEDKFFCDKCCSLQEAQKRMKIKKPPHILVIHLKRFKYMEQLGRYKKLSYRVVFPLELKLSNTVEPYTDVEYSLFAVVVHVGSGPNHGHYVSLVKSHNHWLFFDDENVEMIEESAVQTFFGSSQEYSSNTDHGYILFYESLGPTK

SEQ ID NO: 9394 - protein, 369 aa, Centaurea maculosa
  misc_feature (207)..(207): Xaa can be any naturally occurring amino acid
MGATGSKLEKALGDQFPEGERYFGLENFGNTCYCNSVLQALYFCVPFREQLLEYYGNVKNPGDVEENLLTCLAELFMQISTQKKKTGVIAPKRFVQRVKKENELFRGYMHQDAHEFLNFLLNELVDILEKETNAAKGSKEHSSPPEKMTNGLHVPHANGVRKEPLVTWVHKNFQGILTNETKCLRCETVTARDETFLDLSLDIEQNXSITSCLKNFSSTETLNAEDKFFCDKCCSLQEAQKRMKIKKPPHILVIHLKRFKYMEQLGRYKKLSYRVVFPLELKLTNTMEDADCEYSLFAVVVHVGSGPNHGHYVSLVKSHNHWLLFDDENVEMIDESAVQTSFGSAQEYASNTDHGYILLYESLATNNMS

SEQ ID NO: 9395 - protein, 367 aa, Elaeis guineensis
MGTAGSKLERSLGDQFPEGERYFGLENFGNTCYCNSVLQALYFCVPFREQLLEYYANNKNIRETEENLLICLADLFTQISSQKKKTGVISPKRFVQRVKKQNEYFRSYMHQDAHEFLNFLLNELVEVLEKESDAAEGSPGTSSPSEKFTNAARHPLANGVSKEPLVTWVHKSFQGILTNETRCLQCETVTARDEAFFDLSLDIEQNSSITSCLQNFSSTETLNAEDKFFCDKCCSLQEAQKRMKIKKPPHVLVIHLKRFKYIEQLGRNKKLSYRVVFPMELKLNDTVDGADSEYSLFAVVVHVGSGTNHGHYVSLVKSHNHWLFFDDENVEMTDESTVQTFFGSAQEYSGNTDHGYILFYESLGGRS

SEQ ID NO: 9396 - protein, 367 aa, Phaseolus coccineus
MGASGSKLEKALGDQFPEGERYFGLENFGNTCYCNSVLQALYFCVPFREQLLEFYANNKNLADGEENLLSCLADLFSQISSQKKKTGVIAPKRFVQRLKKQNELFRSYMHQDAHEFLNFLLNELVDILEKEAKRKEEETSPPSEKAANGPNNGLPNGAEKKPLKTWVHKNFQGILTNETRCLRCETVTARDETFFDLSLDIEQNSSITSCLKNFSSMETLNAEDKFCCDKCCSLQEAQKRMKIKKPPHILVIHLKRFKYIEQLGRYKKLSYRVVFPLELKLSDTVEDSDIEYSLFAVVVHVGSGPNHGHYVSLVKSHNHWLFFDDENVEMIDESAVQTFFGSSQEYSSNTDHGYILFYESIGSGNKN

SEQ ID NO: 9397 - protein, 369 aa, Lactuca sativa
MGAAGSKLEKALGDQFPEGERYFGLENFGNTCYCNSVLQALYFCVPFREQLLEYYSSNKSFADAEENLLTCLADLFTQITSQKKKTGVIAPKRFVQRLKKQNEIFRSYMHQDAHEFLNYLLNELVDILEKESRAAKSDPESCSSSEQIPNGIKTSHINGHVREPLITWVHKNFQGILTNETRCLRCETVTARDETFLDLSLDIEQNTSITSCLKNFSSTETLNAEDKFFCDKCCSLQEAQKRMKIKKPPQILVIHLKRFKYIEQLGRYKKLSYRVVFPLELKLSNTVEDTDAEYSLFAVVVHVGSGPNHGHYVSLVKSHNHWLFFDDENVEMIDESAVQTFFGSAQEYSSNTDHGYILFYERVDVGTTS

SEQ ID NO: 9398 - protein, 371 aa, Arabidopsis lyrata
MGAAGSKLEKALGDQFPEGERYFGFENFGNTCYCNSVLQALYFCVPFREQLLEYYTSNKSVADAEENLMTCLADLFSQISSQKKKTGVIAPKRFVQRLKKQNELFRSYMHQDAHEFLNYLLNEVVDILEKEAKATKTEHETSSSSSPEKIANGLKVPQANGVVHKEPIVTWVHNIFQGILTNETRCLRCETVTARDETFLDLSLDIEQNSSITSCLKNFSSTETLHAEDKFFCDKCCSLQEAQKRMKIKKPPHILVIHLKRFKYIEQLGRYKKLSYRVVFPLELKLSNTVEPYADVEYSLFAVVVHVGSGPNHGHYVSLVKSHNHWLFFDDENVEMIEESAVQTFFGSSQEYSSNTDHGYILFYESLGPAK

SEQ ID NO: 9399 - protein, 371 aa, Arabidopsis thaliana
MGAAGSKLEKALGDQFPEGERYFGFENFGNTCYCNSVLQALYFCVPFREQLLEYYTSNKSVADAEENLMTCLADLFSQISSQKKKTGVIAPKRFVQRLKKQNELFRSYMHQDAHEFLNYLLNEVVDILEKEAKATKTEHETSSSSSPEKIANGLKVPQANGVVHKEPIVTWVHNIFQGILTNETRCLRCETVTARDETFLDLSLDIEQNSSITSCLKNFSSTETLHAEDKFFCDKCCSLQEAQKRMKIKKPPHILVIHLKRFKYIEQLGRYKKLSYRVVFPLELKLSNTVEPYADVEYSLFAVVVHVGSGPNHGHYVSLVKSHNHWLFFDDENVEMIEESAVQTFFGSSQEYSSNTDHGYILFYESLGPTK

SEQ ID NO: 9400 - protein, 370 aa, Eutrema halophilum
MGAAGSKLEKALGDQFPEGERYFGFENFGNTCYCNSVLQALYFCVPFREQLLEYYTSNKSVADAEENLMTCLADLFSQISSQKKKTGVIAPKRFVQRLKKQNELFRSYMHQDAHEFLNYLLNEVVDILEKEAKSTKTELETSSSSSPEKIANGPKVPQPNGVHKEPIVTWVHNIFQGILTNETRCLRCETVTARDETFLDLSLDIEQNSSITSCLKNFSSTETLHAEDKFFCDKCCSLQEAQKRMKIKKPPHILVIHLKRFKYIEQLGRYKKLSYRVVFPLELKLSNTVEPYADVEYSLFAVVVHVGSGPNHGHYVSLVKSHNHWLFFDDENVEMIEESAVQTFFGSSQEYSSNTDHGYILFYESLGRTK

SEQ ID NO: 9401 - protein, 329 aa, Cirsium arvense
MGAAGSKLEKALGDQFPEGERYFGLENFGNTCYCNSVLQALYFCVPFREQLLEYYSNSKSLADAEENLLTCLADLFTQISSQKKKTGVIAPKRFVQRLKKQNEIFRSYMHQDAHEFLNYLLNELVDILEKESHAAKSDPESSSSSEQIANGLKSAHSNGHMREPLVTWVHKNFQGILTNETRCLRCETVTARDETFLDLSLDIEQNSSITSCLKNFSSTETLNAEDKFFCDKCCSLQEAQKRMKIKKPPQILVIHLKRFKYIEQLGRYKKLSYRVVFPLELKLSNTVEDADAEYSLFGVVVHVGSGPNHGHYVSLVKSHNHWLFLMMKM

SEQ ID NO: 9402 - protein, 254 aa, Zostera marina
MGAAGSKLEKALGEQFPEGERYFGLENFGNTCYCNSVLQALYFCVPFREKLLEYYSNNKTPLDAEDNLLTCLADLFTQISSQKKKTGIIAPKRFVQKVKKQNELFRSYMHQDAHEFLNFLLNELVDILEKESSNSVKNSLAASSASQSVKIVNGPQLPLANSGKNEPLVTWVHKNFQGTLTNETRCLRCETVTARDETFLDLSLDIEQNSSITSCLKNFSSTETLNAEDKFFCDKCCSLQEAQKRMKIKNHHTF

SEQ ID NO: 9403 - protein, 369 aa, Artemisia annua
MGATGSKLEKALGDQFPEGERYFGLENFGNTCYCNSVLQALYFCVPFREQLLEYYANVKNPGDVEENLLTCLAELFMQISTQKKKTGVIAPKRFVQKVKKENELFRGYMHQDAHEFLNFLLNELVEILEKEYNATKASKEHSPPLDKIANGIHGPQANGVRKEPLVTWVHKNFQGILTNETKCLRCETVTARDETFLDLSLDIEQNSSITSCLKNFSSTETLNAEDKFFCDKCCSLQEAQKRMKIKKPPHILVIHLKRFKYMEQLGRYKKLSYRVVFPLELKLTNTMEDADCEYSLFAVVVHVGSGPNHGHYVSLVKSHNHWLFFDDENVEMIDESAVQTAFGSAQEYASNTDHGYILFYESIATSNDK

SEQ ID NO: 9404 - protein, 368 aa, Eucalyptus grandis
MGAAGSKLEKALGDSFPEGERYFGLENFGNTCYCNSVLQALYFCVPFRDQLLDYYANNKSLGDEDNLLACLADLFTQISSQKKKTGVIAPKRFVQRLKKQNELFRSYMHQDAHEFLNFLLNEIVDTLEKEAQAAKNDQETSSPAEKTANGPKNAHANGGPKEQLDTWVHKNFQGILTNETRCLRCETVTARDETFFDLSLDIEQNSSITSCLKNFSSTETLNAEDKFFCDKCCSLQEAQKRMKIKKPPQILVIHLKRFKYIEQLGRYKKLSYRVVFPLELKLSNTVEDADSEYSLFAVVVHVGSGPNHGHYVSLVKSHNHWLFFDDENVEMIDESAVQTFFGSAQEYSSNTDHGYILFYERLGNGHMS

SEQ ID NO: 9405 - protein, 367 aa, Flaveria ramosissima
MGATGSKLEKALGDQFPEGERYFGLENFGNTCYCNSVLQALYFCVPFREQLLDYYGNVKNPGDAEENLLTCLAELFMQITTQKKKTGVIAPKRFVQRVKKENELFRGYMHQDAHEFLNFLLNDLVDILEKETAKGAAENLSPPKKIVNGLHGDQVNGVKKEPLVTWVHKNFQGILTNETRCLRCETVTARDETFLDLSLDIEQNSSITSCLKNFSSTETLNAEDKFFCDKCCSLQEAQKRMKIKKPPHILVIHLKRFKYMEQLGRYKKLSYRVVFPLELKLTNTMEDADCEYSLFAVVVHVGSGPNHGHYVSLVKSHNHWLFFDDENVEMIEESAIQNAFGSAQEYASNTDHGYILFYESLANNPGL

SEQ ID NO: 9406 - protein, 372 aa, Unknown
  Sequence found in Organisms: Brassica napus, Brassica rapa
MGAAGSKLEKALGDQFPEGERYFGFENFGNTCYCNSVLQALYFCVPFREQLLEYYTSNKSVADSEENLMTCLADLFSQISSQKKKTGVIAPKRFVQRLKKQNELFRSYMHQDAHEFLNYLLNEVVDILEKEAKATTKPERETSSSSSPEKIANGPKAPLANGVHKEPVVTWVHNIFQGILTNETRCLRCETVTARDETFLDLSLDIEQNSSITSCLKNFSSTETLHAEDKFFCDKCCSLQEAQKRMKIKKPPHILVIHLKRFKYMEQLGRYKKLSYRVVFPLELKLSNTVEPYTDVEYSLFAVVVHVGSGPNHGHYVSLVKSHNHWLFFDDENVEMIEESAVQTFFGSSQEYSSNTDHGYILFYESLGPTTK

SEQ ID NO: 9407 - protein, 127 aa, Flaveria ramosissima
MKIKKPPHILVIHLKRFKYMEQLGRYKKLSYRVVFPLELKLTNTMEDADCEYSLFAVVVHVGSGPNHGHYVSLVKSHNHWLFFDDENVEMIDESAVQTSFGSAQEYASNTDHGYILFYESLATNNDH

SEQ ID NO: 9408 - protein, 371 aa, Brassica rapa
MGAAGSKLEKALGDQFPEGERYFGFENFGNTCYCNSVLQALYFCVPFREQLLEYYTSNKSVADAEENLMSCLADLFSQISSQKKKTGVIAPKRFVQRLKKQNELFRSYMHQDAHEFLNYLLNEVVDILEKEAKATNTEHKTSSSSSSPEKIANGPKAPLANGVHKEPVVTWVHNIFQGILTNETRCLRCETVTARDETFLDLSLDIEQNSSITSCLKNFSSTETLHSEDKFFCDKCCSLQEAQKRMKIKKPPHILVIHLKRFKYMEQLGRYKKLSYRVVFPLELKLSNTVEPYTDVEYSLFAVVFHVESGPNHGHYVSLVKSHNHWLFFDDENVEMIEESAVQTFFGSSQEYSSNTDHGYILFYESLGPTK

SEQ ID NO: 9409 - protein, 366 aa, Sesamum indicum
MGAAGSKLEKALGDQFPEGERYFGLENFGNTCYCNSVLQALYFCVPFREQLLEYYSNNKNPADVEENLLTCLADLFLQISSQKKKTGVLAPKRFVQRLKKQNEIFRSYMHQDAHEFLNYLLNELVDILEKEARASKSDQEISHKIANGPTTISSNGPQKEPLITWVHKNFQGILTNETRCLRCETVTARDETFLDLSLDIDQNSSITSCLKNFSSTETLNAEDKFFCDKCCSLQEAQKRMKIKRPPQILVIHLKRFKYIEQLGRYKKLSYRVVFPLELKLSNTVEDADAEYSLFAVVVHVGSGPNHGHYVSLVKSHNHWLFFDDENVEMIDESAVQTFFGSAQEYSSNTDHGYILFYERLAASSTS

SEQ ID NO: 9410 - protein, 367 aa, Arnica chamissonis
ATGSKLEKALGDQFPEGERYFGLENFGNTCYCNSVLQALYFCVPFREQLLEYYGNIKNPGDIEENLLTCLAELFMQISTQKKKTGVIAPKRFVQRVKKENELFRGYMHQDAHEFLNFLLNELVDILEKEANSSKGSKEHSSPPEKIPNGIHVAQANGVRKEPLVTWVHKNFQGILTNETKCLRCETVTARDETFLDLSLDIEQNSSITSCLKNFSSTETLNAEDKFFCDKCCSLQEAQKRMKIKKPPRILVIHLKRFKYMEQLSRYKKLSYRVVFPLELKLTNTMEDADCEYSLFAVVVHVGSGPNHGHYVSLVKSHNHWLFFDDENVEMIDESAVQTSFGSAQEYASNTDHGYILFYESLATNNDH

SEQ ID NO: 9411 - protein, 366 aa, Avena sativa
MGAASSRLEKALGEQFPEGERYFGLENFGNTCYCNSVLQALYFCVPFREQLLEYYANNKSTGDGEENMLTCLADLFSQISNQKKKTGVIAPKRFIQRLKKQNELFRSYMHQDAHEFLNFLLNELVDILEKECNAAKEPPQNSSSNKNLNGPVNGQANGSHKEPDTTWVHKCFQGILTNQTRCLRCETVTDRDETFLDLSLDIEQNSSITSCLKNFSSTETLNAEDKFFCDKCCSLQEAQKRMKIKKPPNILVIHLKRFKYIEQLGRYKKLSYRVVFPLELKLINTVDNSDLEYSLFAVLVHVGSGPNHGHYISLVKSHNHWLFFDDENVEMTDESMVQTFFGSAQEFSGNTDNGYILFYESVAKTN

SEQ ID NO: 9412 - protein, 311 aa, Silene vulgaris
MGAAGSKLEKALGEQFPEGERYFGLENFGNTCYCNSVLQALYFCVPFREQLLEYYTSNKNTVDAEENLLTCLADLFSQINSQKKKTGVIAPKRFVQRLKKQNELFRSYMHQDAHEFLNFLLNELVDILEKEAKAAKSDQETVSSEKLANGPGSVQVNAPQKEPLVTWVHKNFQGILTNETRCLRCETVTARDETFFDLSLDIEQNSSITSCLKNFSSTETLNAEDKFFCDKCSSLQEAQKRMKIKKPPHILVIHLKRFKYIEQLGRYKKLSYRVVFPLELKLSETVEDTDREYSLFAVVVHVGSGPTMDTM

SEQ ID NO: 9413 - protein, 368 aa, Lactuca sativa
MGAAGSKLEKALGDQFPEGERYFGLENFGNTCYCNSVLQALYFCVPFREQLLEYYEKVKNPDVEENLLTCLAELFTQISTQKKKTGVIAPKRFVQRVKKENELFRGYMHQDAHEFLNFLLNELVDILEKETKGTKEHSSPPEKIPNGIHMPQANGVRKEPLVTWVHKNFQGILTNETKCLRCETVTARDETFLDLSLDIEQNSSITSCLKNFSSTETLNAEDKFFCDKCCSLQEAQKRMKIKKQPHILVIHLKRFKYMEQLGRYKKLSYRVVFPLELKLTNTMEDADCEYSLFAVVVHVGSGPNHGHYVSLVKSHNHWLFFDDENVEMIDESAVQTSFGSAQEYVSNTDHGYILFYESLAGNNNNITC

SEQ ID NO: 9414 - protein, 372 aa, Papaver somniferum
KLEKALGDQFPEGERYFGLENFGNTCYCNSVLQALYFCVPFREQLLEYYANNKNPGDPEENLLTCLADLFTQISSQKKKTGVIAPKRFVQRVKKENELFRSYMHQDAHEFLNFLLNELVDILEKESRAAAAKNSPETSSPPEKTANGPKSLQVNGVHREPLVTWVHKNFQGILTNETRCLRCETVTARDETFLDLSLDIEQNSSITSCLKNFSSTETLNAEDKFFCDKCCSLQEAQKRMKIKKPPQILVIHLKRFKYIEQLSRYKKLSYRVVFPLELKLSNTVEDADSEYSLFAVVVHVGSGPNHGHYVSLVKSHNHWLFFDDENVEMIDESAVQTFFGSAQEYTSNTDHGYILFYERVGTTTMSTTSSSQT

SEQ ID NO: 9415 - protein, 366 aa, Triphysaria pusilla
MGAAGSKLEKALGDQFPEGERYFGLENFGNTCYCNSVLQALYFCVPFREQLLEYYSNNKTPADAEENLLTCLADLFLQITSQKKKTGVHAPKRFVQRLKKQNEIFRSYMHQDAHEFLNYLLNELVDILEKEARATKGDQEVPQKISNGPTNISSNSPQKEPVITWVHKNFQGILTNETRCLCCETVTARDETFLDLSIDIEQNSSITSCLKNFSSTETLNADDKFFCDKCCSLQEAQKRMKIKRPPQILVIHLKRFKYIEQLGRYKKLSYRVVFPLELKLSNTVEDPDAEYSLFAVVVHVGSGPNHGHYISLVKSHNHWLFFDDENVEMIDESAVQTFFGSAQEYSSNTDHGYILFYERLVAGSPI

SEQ ID NO: 9416 - protein, 284 aa, Raphanus sativus
  misc_feature (219)..(219): Xaa can be any naturally occurring amino acid
  misc_feature (233)..(233): Xaa can be any naturally occurring amino acid
MGAAGSKLEKALGDQFPEGERYFGFENFGNTCYCNSVLQALYFCVPFREQLLEYYTSNKSVADAEENLMTCLADLFSQISSQKKKTGVIAPKRFVQRLKKQNELFRSYMHQDAHEFLNYLLNEVVDILEKEAKATTKPERETSSSSSPEKIANGPKAPQANGVVHKEPVVTWVHNIFQGILTNETRCLRCETVTARDETFLDLSLDIEQNSSITSCLKXFSSTETLHAEDKFXCDKCCSLQEAQKRMKIKKPPHILVIHLKRFKYMEQLGRYKKLSYRVVSLWS

SEQ ID NO: 9417 - protein, 366 aa, Utricularia gibba
MGATGSKLEKALGDQFPEGERYFGLENFGNTCYCNSVLQALYFCVPFREQLLEYYSTNKGPSDAEENLLTCLADLFLQISTQKKKTGVLAPKRFVQRLRKQNEIFRSYMHQDAHEFLNYLLNELVDIVEKEAGAVKSDQETSQNIANGPKNGVSNGHHKEPLITWVHKSFQGLLTNETRCLCCETVTARDETFLDLSLDIEQNSSITSCLKNFSSTETLNAEDKFFCDKCCSLQEAQKRMKIKRPPQILVIHLKRFKYIEQLGRYKKLSYRVVFPMELKLSNTVEDADAEYSLFAVVVHVGSGPNHGHYVSLVKSHNHWLFFDDENVEMIDESAVQTFFGSSQEYSSNTDHGYILLYERLVASTSS

SEQ ID NO: 9418 - protein, 366 aa, Brachypodium distachyon
MGAAGSRLEKALGEQFPEGERYFGLENFGNTCYCNSVLQALYFCVPFREQLLEYYANNKGAGDGEENMLTCLADLFSQISNQKKKTGVIAPKRFIQRLKKQNELFRSYMHQDAHEFLNFLLNELVDILEKECNATKEPPQNSSLQKNSNGPINGQPNGSHRELDTTWVHKCFQGILTNQTRCLRCETVTDRDETFLDLSLDIEQNSSITSCLKNFSSTETLNAEDKFFCDKCCSLQEAQKRMKIKKPPNILVIHLKRFKYIEQLGRYKKLSYRVVFPLELKLINTVDNSDLEYSLFAVLVHVGSGPNHGHYISLVKSHNHWLFFDDENVEMTDESMVQTFFGSAQEFSGNTDNGYILFYESVAKTS

SEQ ID NO: 9419 - protein, 366 aa, Oryza sativa
MGAASSRLEKALGEQFPEGERYFGLENFGNTCYCNSVLQALYFCVPFREQLLEYYANNKSTGDVEDNMLTCLADLFSQISNQKKKTGVIAPKRFIQRLKKQNEIFRSYMHQDAHEFLNFLLNELVDILEKESKVVAEPCENSSLKKNSNGPINVQLNGTKKEPVPTLVHKCFQGILTNETRCLRCETVTDRDETFFDLSLDIEQNSSITSCLKNFSSTETLNAEDKFFCDKCCSLQEAQKRMKIKKPPNILVIHLKRFKYIEQLGRYKKLSYRVVFPLELKLINTVDNSDLEYSLFAVLVHVGSGPNHGHYISLVKSHNHWLFFDDENVEMTDESMVQTFFGSAQEFSGNTDNGYILFYESLAEKS

SEQ ID NO: 9420 - protein, 370 aa, Pinus pinaster
MGNSGSKLEKALGDQFPEGERYFGLENFGNTCYCNSVLQALYFCPPFREHLLEYYGHNKTTVEAEENLLTCLADLFTQINSQKKKTGVIAPKRFVQRVKKENELFRSYMHQDAHEFLNFLLNELVDILEKEASANQKLSGSLTQPEKKMNGSINGLANGSQQPPVLTWVHKIFQGTLTNETRCLRCETVTARDETFLDLSLDIEQNSSITSCLRNFSSTYMLNADDKFFCDKCCSLQEAQKRMKIKIPPRILVIHLKRFKYIEQLGRYKKLSYRVVFPMELKLCNTTDDAPGSDSEYSLFAVVVHVGSGPNHGHYISLVKSHNHWLFFDDENVEMIDESVVQTFFGSAQEYSNNTDHGYILFYESLNNKL

SEQ ID NO: 9421 - protein, 364 aa, Lactuca sativa
MGAAGSKLEKALGDQFPEGERYFGLENFGNTCYCNSVLQALYFCVPFREQLLEYYSSNKSFADAEENLLTCLADLFTQITSQKKKTGVIAPKRFVQRLKKQNEIFRSYMHQDAHEFLNYLLNELVDILEKESRAAKSDPESCSSSEQIPNGIKTSHINGHVREPLITWVHKNFQGILTNETRCLRCETVTARDETFLDLSLDIEQNTSITSCLKNFSSTETLNAEDKFFCDKCCSLQEAQKKNERSEPPQILVIHLKRFKYIEQLGRYKKLSYRVVFPLELKLSNTVEDTDAEYSLFAVVVHVGSGPNHGHYVSLVKSHNHWLFFDDENVEMIDESAVQTFFGSAQEYSSNTDHGYILFYERVD

SEQ ID NO: 9422 - protein, 370 aa, Mimulus guttatus
NGCSRFEARESIGVTNFLKASGILDSRISATLAIANSVLQALYFCVPFREQLLEYYSNNKNPADAEENLLTCLADLFLQISSQKKKTGVLAPKRFVQRLKKQNEIFRSYMHQDAHEFLNYLLNELVEILEKEAQATKTEPEGSEKIANGPTNISSNGSPEEPLITWVHKNFQASFGILTNETRCLRCETVTARDETFLDLSIDIEQNSSITSNLKNFSSTETLNADDKFFCDKCCSLQEAQKRLKIKRPPQILVIHLKRFKYIEQLGRYKKLSYRVVFPLELKLSNTVEDTEAEYSLFAVVVHVGSGPNHGHYISLVKSHNHWLFFDDENVEMIDESAVQTFFGSAQEYSSNTDHGYILFYERLITGSTS

SEQ ID NO: 9423 - protein, 261 aa, Mimulus guttatus
MHQDAHEFLNYLLNELVEILEKEAQATKTEPEGSEKIANGPTNISSNGSPEEPLITWVHKNFQASFGILTNETRCLRCETVTARDETFLDLSIDIEQNSSITSNLKNFSSTETLNADDKFFCDKCCSLQEAQKRLKIKRPPQILVIHLKRFKYIEQLGRYKKLSYRVVFPLELKLSNTVEDTEAEYSLFAVVVHVGSGPNHGHYISLVKSHNHWLFFDDENVEMIDESAVQTFFGSAQEYSSNTDHGYILFYERLITGSTS

SEQ ID NO: 9424 - protein, 370 aa, Pinus taeda
MGNSGSKLEKALGDQFPEGERYFGLENFGNTCYCNSVLQALYFCPPFREHLLEYYGHNKTMVEAEENLLTCLADLFTQINSQKKKTGVIAPKRFVQRVKKENELFRSYMHQDAHEFLNFLLNELVDILEKEASANKKLSGSLTQPEKKMNGSINGLANGSHQPSVLTWVHKIFQGTLTNETRCLRCETVTARDETFLDLSLDIEQNSSITSCLRNFSSTYMLNADDKFFCDKCCSLQEAQKRMKIKIPPRILVIHLKRFKYIEQLGRYKKLSYRVVFPMELKLCNTTDDAPGSDSEYSLFAVVVHVGSGPNHGHYISLVKSHNHWLFFDDENVEMIDESVVQTFFGSAQEYSNNTDHGYILFYESLDNKF

SEQ ID NO: 9425 - protein, 370 aa, Picea glauca
MGSSGSKLEKALGDQFPEGERYFGLENFGNTCYCNSVLQALYFCLPFREHLLEYYGHNKTTVEAEENLLTCLADLFTQINSQKKKTGVIAPKRFVQRVKKQNELFRSYMHQDAHEFLNFLLNELVDILEKEASANKRLSGSLTQPEKKMNGSINGLTNGSQQPPVLTWVHKIFQGTLTNETRCLRCETITARDETFLDLSLDIEQNSSITSCLRNFSSTYMLNADDKFFCDKCCSLQEAQKRMKIKIPPRILVIHLKRFKYIEQLGRYKKLSYRVVFPMELKLCNTTDDAPGSDAEYSLFAVVVHVGSGPNHGHYVSLVKSHNHWLFFDDENVEMIDESVVQTFFGSAQEYSNNTDNGYILFYESLDHKF

SEQ ID NO: 9426 - protein, 355 aa, Brassica rapa
MGVAGSKLEKALGEQFPEGERYFGFENFGNTCYCNSVLQALYFCAPFREQLLEYYSTNNKNVENLLTCLADLFYQISSQKKKTGVIAPKRFVQRLKKQNVLFRSYMHQDAHEFLNYLLNELDDILEKEAKTDNETSSNGPKLLQENGVHKEPTVTWVHKIFQGILTNETRCLRCETVTARDETFLDLSLDIEQNSSITSCLNNFCSTETLHSEDKFFCDKCCSLQEAQKRMKIKKPPHILVIHLKRFKYIEQLGRYKKLSYRVVFPLELKLDNTVEEYADIEYSLFAVVVHVGTGPNHGHYVSLVKSHNHWLFFDDENVEMIEESAVQTFFGSSQEYSSNTDHGYILFYERLGTR

SEQ ID NO: 9427 - protein, 366 aa, Saccharum officinarum
MGAAGSRLEKALGEQFPEGERYFGLENFGNTCYCNSVLQALYFCVPFRDQLLEYYANNKNTGDVEENMLTCLADLFSQISNQKKKTGVIAPKRFIQRLKKQNEIFRSYMHQDAHEFLNFLLNELVDILEKEHNAARESLQNLSFPKNSNGPIDGQPNGSHKELAATWVHKCFQGILTNETRCLRCETVTDRDETFFDLSLDIEQNSSLTSCLKNFSSTETLNAEDKFFCDKCCSLQEAQKRMKIKKPPNILVIHLKRFKYIEQLQRYKKLSYRVVFPLELKLLNTVDNLDLEYSLFAVVVHVGSGPNHGHYISLVKSHNHWLFFDDENVEMTDESMVQAFFGSPQEFSGNTDNGYILFYESLAERS

SEQ ID NO: 9428 - protein, 318 aa, Avena sativa
SRGERYFGLENFGNTCYCNSVLQALLFLHSVQGAITGILYEQQNPGDAEENLLTCLADLFMQVSQSKKKTGVIAPKRFVQRVKKQNELFRSYMHQDAHEFLNFLLNELVDILEKESSAAKDSPQSSSPEKVPNGIVQPLANGVRKEPPVTLVHKNFQGILTNETRCLRCETVTARDETFFDLSVDIEQNSSITSCLKNFSSTETLNAEDKFFCDKCCSLQEAQKRMKIKKAPQILVIHLKRFKYIEQLGRYKKLSYRVVFPMELKIGSTSDDVDTEYSLFAVVVHVGSGPNHGHYVSPVKSHNHWLFFDDENVEMVEE

SEQ ID NO: 9429 - protein, 366 aa, Setaria italica
MGAASSRLEKALGEQFPEGERYFGLENFGNTCYCNSVLQALYFCVPFRDQLLEYYASNKSTGDVEENMLTCLADLFSQISNQKKKTGVIAPKRFIQRLKKQNEIFRSYMHQDAHEFLNFLLNELVDILEKEHNAARESLQNLSLQKNSNGPINGLPNGCHKESAATWVHKCFQGILTNETRCLRCETVTDRDETFFDLSLDIEQNSSITSCLKNFSSTETLNAEDKFFCDKCCSLQEAQKRMKIKKPPNILVIHLKRFKYIEQLQRYKKLSYRVVFPLELKLLNTVDNSDLEYSLFAVVVHVGSGPNHGHYISLVKSHNHWLFFDDENVEMTDESMVQAFFGSPQEFSGNTDNGYILFYESLAEKS

SEQ ID NO: 9430 - protein, 366 aa, Zea mays
MGAAGSRLEKALGEQFPEGERYFGLENFGNTCYCNSVLQALYFCVPFRDQLLEYYANNKNTGDVEENMLTCLADLFSQISSQKKKTGVIAPKRFIQRLKKQNEIFRSYMHQDAHEFLNFLLNELVDILEKEHNAARESLQNLSLQKNSNGPIDGQPNGSHKELAVTWVHKCFQGILTNETRCLRCETVTDRDETFFDLSLDIEQNSSLTSCLKNFSSTETLNAEDKFFCDKCCSLQEAQKRMKIKKPPNILVIHLKRFKYIEQLQRYKKLSYRVVFPLELKLLNTVDNSDLEYSLFAVVVHVGSGPNHGHYISLVKSHNHWLFFDDENVEMTDESMVQAFFGSPQEFSGNTDNGYILFYESLAERS

SEQ ID NO: 9431 - protein, 348 aa, Manihot esculenta
YFGLENFGNTCYCNSVLQALYFCVPFREQLLEYYANNKNTGDAEENLLTCLADLFTQISSQKKKTGVIAPKRFVQRLKKQNELFRSYMHQDAHEFLNFLLNELVDILEKEAQAAKSDPETSSPPEKIANGPNNSQANGVSKEPLVTWVHKNFQGILTNETRCLQCETVTARDETFFDLSLDIEQNSSITSCLKNFSSTETLNAEDKFFCDKCCSLQEAQKRMKIKKPPHILVIHLKRFKYIEQLGRYKKLSYRVVFPLELKLSNTMEDADIEYSLFAVVVHVGSGPNHGHYVSLVKSHNHWLFFDDENVEMIDESAVQTFFGSAQEYSSNTDHGYILFYESLGASSKS

SEQ ID NO: 9432 - protein, 372 aa, Musa acuminata
MGATGSKLEKALGEQFPEGERYFGLENFGNTCYCNSVLQVLYFCIPFREQLLDYYENNKNVGDAEENLLTCLADLFSQISSQKKKTGVISPRRFVQRVKKQNELFRSYMHQDAHEFLNFLLNELVDTLERESNAANSSPEASSSSSSSSSEKVANGPSNPPVNGLRKDPFVTWVHDSFQGILTNETRCLRCETVTARDETFFDLSLDIEQNSSITSCLKNFSSTETLNAEDKFFCDKCCSLQEAQKRMKIKKPPSILVIHLKRFKYIEHLGRNKKLSYRVVFPMELKLMNTVEDPDTEYSLFAVVVHIGTGPNHGHYVSLVKSHNHWLYFDDETVEMIDELTMHKYFGSSQEYPSNTEHGYILFYESLGKSS

SEQ ID NO: 9433 - protein, 371 aa, Ceratodon purpureus
MGSSGSKLEKALGDQFPEGERYFGLENFGNTCYCNSVLQALYFCVPFRDQLLEYCGQNKAVQETEENLLTCLSELFTQINSQKKKTGVIAPKRFVQRVKKQNELFRSYMHQDAHEFLNFLLNELVDILEKEAKAAKSNSGPQASPEKAVANGSVNGLSNGNHKEPIVTWVHKIFQGTLTNETRCLRCETITARDETFLDLSLDIEQNSSITSCLRNFSSTETLNAEDKFFCDKCCSLQEAQKRMKIKSPPRILALHLKRFKYIEQLGRYKKLSYRVVFPLELKLCNTTDDAPGSEAEYSLFAVVVHVGSGPNHGHYVSLVKSHNHWLFFDDENVEIIDESIVQTFFGSTQEYSNNTDHGYILFYESLEQKN

SEQ ID NO: 9434 - protein, 366 aa, Hordeum vulgare
MGAASSRLEKALGEQFPEGERYFGLENFGNTCYCNSVLQALYFCVPFREQLLEYYANNKSASDGEENMLTCLADLFSQISNQKKKTGVIAPKRFIQRLKKQNELFRSYMHQDAHEFLNFLLNELVDILEKECKANKEPSQNSSSNKNSNGPVNGQPNGSHKEPDTTWVHKCFQGILTNQTKCLRCETVTDRDETFLDLSLDIEQNSSITSCLKNFSSTETLNAEDKFFCDKCCSLQEAQKRMKIKKQPNILVIHLKRFKYIEQLGRYKKLTYRVVFPLELKLMNTVDNSDLEYSLFAVLVHVGSGPNHGHYISVVKSHNHWLFFDDETVEMTDESMVQTFFGSAQEFSGNTDNGYILFYESLAKTS

SEQ ID NO: 9435 - protein, 371 aa, Physcomitrella patens
MGASGSKLEKALGDQFPEGERYFGLENFGNTCYCNSVLQALYFCVPFRDQLLEHCGQSKPVAEAEENLLTCLSELFSQINSQKKKTGVIAPKRFVQRVKKQNELFRSYMHQDAHEFLNFLLNELVDILEREAKAAKSNSGCETSPGKVVGNGSVSGLANGTHKEAVVTWVHKIFQGILTNETRCLRCETITARDETFLDLSLDIEQNSSITSCLRNFSSTETLNAEDKFFCDKCCSLQEAQKRMKIKSAPRILALHLKRFKYIEQLGRYKKLSYRVVFPLELKLCNTTDDAPGSEAEYSLFAVVVHVGSGPNHGHYVSLVKSHNHWLFFDDENVEIIDESIVQTFFGSTQEYSNNTDHGYILFYESLEQKS

SEQ ID NO: 9436 - protein, 369 aa, Picea glauca
MGTTGSRLEKALGDQFPEGERYFGLENFGNTCYCNSVLQALYFCVPFREQLLEYYSRTKTGREIEENLLTCLADLFTQIYSQKKKTGVIAPKRFVQRVKKENENFRSYMHQDAHEFLNFLLNELVDILEKEANAAEKLSGNLNQQEKAINGKINGTSNGTQQQPVTWVHKIFQGTLTNETRCLCCETITARDETFLDLSLDIEQNSSITSCLRNFSSTETLNAEDKFFCDKCCSLQEAQKRMKIKIPPRILVIHLKRFKYIEQLGRYKKLSYRVVFPMELKLCNTTDDAPGSDAEYSLFAVVVHVGSGPNHGHYVSLVKSHNHWLFFDDENVEMIDESVVQTFFGSTQEYSNNTDHGYILFYESLVQGS

SEQ ID NO: 9437 - protein, 197 aa, Cichorium intybus
VELEKALGDQFPEGERYFGLENFGNTCYCNSVLQALYFCVPFREQLLEYYSSNKTFTDAEENLLTCLADLFTQITSQKKKTGVIAPKRFVQRLKKQNEIFRSYMHQDAHEFLNYLLNELVDILEKESRAVKSDLESSSSSEQIPNGLNNSHTNGHIKEPLVTWVHKNFQGILTNETRCLRCETVTARDETFLDLSID

SEQ ID NO: 9438 - protein, 366 aa, Triticum aestivum
MGAASSRLEKALGEQFPEGERYFGLENFGNTCYCNSVLQALYFCVPFREQLLEYYANNKSASDGEENMLTCLADLFSQISNQKKKTGVIAPKRFIQRLKKQNELFRSYMHQDAHEFLNFLLNELVDILEKECKANKETPQNSSSNKSSNGPINGQPNGSHKEPETTWVHKCFQGILTNQTKCLRCETVTDRDETFLDLSLDIEQNSSITSCLKNFSSTETLNAEDKFFCDKCCSLQEAQKRMKIKKQPNILVIHLKRFKYIEQLGRYKKLTYRVVFPLELKLMNTVDNSDLEYSLFAVLVHVGSGPNHGHYISVVKSHNHWLFFDDETVEMTDESMVQTFFGSVQEFSGNTDNGYILFYESVAKTS

SEQ ID NO: 9439 - protein, 371 aa, Physcomitrella patens
MGASGSKLEKAFGDQFPEGERYFGLENFGNTCYCNSVLQALYFCVPFRDQLLEHCGQSKPVAEAEENLLTCLSELFSQINSQKKKTGVIAPKRFVQRVKKQNELFRSYMHQDAHEFLNFLLNELVDILEREAKAAKSNSGCETSPGKVVGNGSVSGLANGTHKEAVVTWVHKIFQGILTNETRCLRCETITARDETFLDLSLDIEQNSSITSCLRNFSSTETLNAEDKFFCDKCCSLQEAQKRMKIKSAPRILALHLKRFKYIEQLGRYKKLSYRVVFPLELKLCNTTDDAPGSEAEYSLFAVVVHVGSGPNHGHYVSLVKSHNHWLFFDDENVEIIDESIVQTFFGSTQEYSNNTDHGYILFYESLEQKS

SEQ ID NO: 9440 - protein, 366 aa, Triticum aestivum
MGAASSRLEKALGEQFPEGERYFGLENFGNTCYCNSVLQALYFCVPFREQLLEYYANNKSASDGEENMLTCLADLFSQISNQKKKTGVIAPKRFIQRLKKQNELFRSYMHQDAHEFLNFLLNELVDILEKECKANKETPQNSSSNKSSNGPINGQPNGSHKEPETTWVHKCFQGILTNQTKCLRCETVTDRDETFLDLSLDIEQNSSITSCLKNFSSTETLNAEDKFFCDKCCSLQEAQKRMKIKKQPNILVIHLKRFKYIEQLGRYKKLTYRVVFPLELKLMNTVDNSDLEYSLFAVLVHVGSGPNHGHYISVVKSHNHWLFFDDETVEMTDESMVQTFFGSAQEFSGNTDNGYILFYESVAKTS

SEQ ID NO: 9441 - protein, 409 aa, Brachypodium distachyon
MAKPARSPTADAPPPAVERSRSAVGSGLRSLASAASGFLDRWSVVGTGVSRLEKALGDQFPEGEHYFGLENFGNTCYCNSVLQALYFCIPFREQLLEYYAKDRNPGDAEENLLTCLAELFAQISLSKKKTGVISPKRFVHRVRKQNESFRSYMHQDAHEFLNFLLNEIVDILEKEFSMMKDSPETTSPEGASNGDINHLANGVGKEPLVTWVHKDFQGILTNETKCLMCETITAKDETFLDLSIDIEQNSSLTSCLKNFFSTETLNAEDKFFCDKCCSLQEAQKRMKIKKAPQILVIHLKRFKFVEQLSRHKKLSYRVVYPMELKLSSTSNDVDCEYSLFAVVVHLGSGPNQGHYVSQIKSCDHWLSFDDDNVEKIQESTLQTFYGSSHEYAGNTDHGYILFYERIVKS

SEQ ID NO: 9442 - protein, 343 aa, Pennisetum glaucum
AEENLLTCLADLFMQISQAKKKTGVIAPKRFVQRVKKQNELFRSYMHQDAHEFLNFLLNELVDILEKESSAAKDSPQSSSPEKAPNGPVQPLANGVKKEPPVTLVHKNFQGILTNETRCLRCETVTARDETFLDLSVDIEQNSSITSCLKNFCSTETLNAEDKFFCDKCCSLQEAQKRMKIKKAPHILVIHLKRFKYIEQLGRYKKLSYRVVFPMELKLSNTSDDVDTEYSLFAVVVHVGSGPNHGHYVSLVKSHNHWLFFDDENVEMVEEQTLQTFFGSSHEYSGNTDHGYILFYEGELGCFPWPSLFLFHLFSLWSMQVHSCTYTAAISHLHGKWPIEEVV

SEQ ID NO: 9443 - protein, 273 aa, Brassica napus
ALGDQFPEGERYFGFENFGNTCYCNSVLQALYFCVPFREQLLEYYTSNKSVADAEENLMTCLADLFSQISSQKKKTGVIAPKRFVQRLKKQNELFRSYMHQDAHEFLNYLLNEVVDILEKEAKATKTEHKTSSSSPSPEKIANGPKAPLANGVHKEPVVTWVHNIFQGILTNETRCLRCETVTARDETFLDLSLDIEQNSSITSCLKNFSSTETLHSEDKFFCDKCCSLQEAQKRMKIKKPPHILVIHLKRFKYMEQLGRTRSYLTELSPLWS

SEQ ID NO: 9444 - protein, 370 aa, Pseudotsuga menziesii
MGSSGSKLEKALGDQFPEGERYFGLENFGNTCYCNSVLQALYFCLPFREQLLEYYGHNKTTVEAEENLLTCLADLFTQINSQKKKTGVIAPKRFVQRVKKENELFRSYMQQDAHEFLNFLLNELVDILEKEASTNKRLSGNLTQPEKKINGSINGLTNGSHQAPVLTWVHKIFQGTLTNETRCLRCETITARDETFLDLSLDIEQNSSITSCLRNFSSTYVLNADDKFFCDKCCSLQEAQKRMKIKTPPRILGIHLKRFKYIEQLGRYKKLSYRVAFPMELKLCNTTDDAPGSDAEYSLLAVVVHVGSGPNHGHYVSLVKSHNHWLFFDDENVEMIDESVVQTFFGSAQEYSNNTDHGYILFYESLDHKS

SEQ ID NO: 9445 - protein, 71 aa, Amorphophallus konjac
NFGNTCYCNSVLQALYFCVPFREQLLDYYANNKNPGDAEENLLTCLADLFTQISSQKKKQVSLPQSVLCKE

SEQ ID NO: 9446 - protein, 259 aa, Silene vulgaris
MHQDAHEFLNFLLNELVDILEKESSAAKDNTDGSSTETVPNGPRNGETNGATAQEPLATWVHKNFQGILTNETKCLRCETVTARDETFFDLSLDIEQNSSITSCLKNFSSTETLNAEDKFFCDKCCSLQEAQKRMKIRKPPHILVIHLKRFKYIESLGRYKKLSYRVVFPLELKLSNTMEDADSEYSLFAVVVHVGTGPNHGHYVSLVKSHNHWLFFDDENVDIIDESAVQTFFGSAQEFSSNSEHGYILLYERVTPKF

SEQ ID NO: 9447 - protein, 118 aa, Orobanche aegyptiaca
MGVTGSKLEKALGDQFPEGERYFGLENFGNTCYCNSVLQALYFCVPFREQLLEYYSKNQGEADENILTCLADLFSQISSQKKKTGVIAPKRFVHRVRRENENFRGYMHQDAHEFLNFC

SEQ ID NO: 9448 - protein, 361 aa, Pennisetum glaucum
SRLEKALGEQFPEGERYFGLENFGNTCYCNSVLQALYFCVPFRDQLLEYYASNKSTGDVEENMLTCLADLFSQISNQKKKTGVIAPKRFIQRLKKQNEIFRSYMHQDAHEFLNFLLNELVDILEKEHNAARESLQNLSLQKNTNGPINGLPNGCHKESAATWVHKCFQGILTNETRCLRCETVTDRDETFFDLSLDIEQNSSITSCLKNFSSTETLNAEDKFFCDKCCSLQEAQKRMKIKKPPNILVIHLKRFKYIEQLQRYKKLSYRVVFPLELKLLNTVDNSDLEYSLFAVVVHVGSGPNHGHYISLVKSHNHWLFFDDENVEMTDESMVQAFFGSPQEFSGNTDNGYILFYESLAEKS

SEQ ID NO: 9449 - protein, 366 aa, Secale cereale
MGAASSRLEKALGEQFPEGERYFGLENFGNTCYCNSVLQALYFCVPFREQLLEYYANNKSASDGEENMLTCLADLFSQISNQKKKTGVIAPKRFIQRLKKQNELFRSYMHQDAHEFLNFLLNELVDILEKECKANKESSQNSSSNKNSNGPSNGQPNGSHKEPDTTWVHKCFQGILTNQTKCLRCETVTDRDETFLDLSLDIEQNSSITSCLKNFSSTETLNAEDKFFCDKCCSLQEAQKRMKIKKQPNILVIHLKRFKYIEQLGRYKKLTYRVVFPLELKLMNTVDNSDLEYTLFAVLVHVGSGPNHGHYISVVKSHNHWLFFDDETVEMTDESMVQTFFGSAQEFSGNTDNGYILFYESVAKTS

SEQ ID NO: 9450 - protein, 366 aa, Panicum virgatum
MGAASSRLEKALGEQFPEGERYFGLENFGNTCYCNSVLQALYFCVPFRDQLLEYYASNKNTGDGEENMLTCLADLFSQISNQKKKTGVIAPKRFIQRLKKQNEIFRSYMHQDAHEFLNFLLNELVDILEKEHNAERESLQNISLQKNSNGPINGQPNGSHKELAATWVHKCFQGILTNETRCLRCETVTDRDETFFDLSLDIEQNSSITSCLKNFSSTETLNAEDKFFCDKCCSLQEAQKRMKIKKPPNILVIHLKRFKYIEQLQRYKKLSYRVVFPLELKLLNTVDNSDLEYSLFAVVVHVGSGPNHGHYISLVKSHNHWLFFDDENVEMTDESMVQAFFGSPQEFSGNTDNGYILFYGSLAEKS

SEQ ID NO: 9451 - protein, 369 aa, Pinus taeda
MGTTGSRLEKALGDQFPEGERYFGLENFGNTCYCNSVLQALYFCVPFREQLLDYYSRTKTGRETEENLLTCLADLFTQIYSQKKKTGVIAPKRFVQRVKKENENFRSYMHQDAHEFLNFLLNELVDILEKEANAAEKLSGNLNQQEKVVNGKMNGTSNGNHQQPVTWVHKIFQGTLTNETRCLCCETITARDETFLDLSLDIEQNSSITSCLRNFSSTETLNAEDKFFCDKCCSLQEAQKRMKIKIPPRILVIHLKRFKYIEQLGRYKKLSYRVVFPMELKLCNTTDDAPGSDAEYSLFAVVVHVGSGPNHGHYVSLVKSHNHWLFFDDENVEMIDESVVQTFFGSTQEYSNNTDHGYILFYESLVQGS

SEQ ID NO: 9452 - protein, 369 aa, Pseudotsuga menziesii
MGTTGSRLEKALGDQFPEGERYFGLENFGNTCYCNSVLQALYFCVPFREQLLDYYSRAKAGRESEENLLTCLADLFTQINSQKKKTGVIAPKRFVQRVKKENENFRSYMHQDAHEFLNFLLNELVDILEKEANAAEKLSGNLNQPEKVINGKINGTSNGTQQQPVTWVHKIFQGTLTNETRCLCCETITARDETFLDLSLDIEQNSSITSCLRNFSSTETLNAEDKFFCDKCCSLQEAQKRMKIKMPPRILVIHLKRFKYIEQLGRYKKLSYRVVFPMELKLCNTIDDAPGSDAEYSLFAVVVHVGSGPNHGHYVSLVKSHNHWLFFDDENVEMIDESVVQTFFGSTQEYSNNTDHGYILFYESLVQGS

SEQ ID NO: 9453 - protein, 366 aa, Sorghum bicolor
MGAAGSRLEKALGEQFPEGERYFGLENFGNTCYCNSVLQALYFCVPFRDQLLEYYANNKNTGDVEENMLTCLADLFSQISNQKKKTGVIAPKRFIQRLKKQNEIFRSYMHQDAHEFLNFLLNELVDILEKEHNAAREPLQNLPFQKNSNGTIDGQPNGSHKELAATWVHKCFQGILTNETRCLRCETVTDRDETFFDLSLDIEQNSSLTSCLKNFSSTETLNAEDKFFCDKCCSLQEAQKRMKIKKPPNILVIHLKRFKYIEQLQRYKKLSYRVVFPLELKLLNTVDNSDLEYSLFAVVVHVGSGPNHGHYISLVKSHNHWLFFDDENVEMTDESMVQAFFGSPQEFSGNTDNGYILFYESLAERS

SEQ ID NO: 9454 - protein, 312 aa, Raphanus sativus
  misc_feature (224)..(224): Xaa can be any naturally occurring amino acid
MDVAGSKLEKALGEQFPEGERYFGFENFGNTCYCNSVLQALYFCAPFREQLLDYYSTNNKSEEENHLLTCLADLFSQISGQKKKTGVIAPKRFVQRLKKQNVLFRSYMHQDAHEFLNYLLNELGDILEKEAKAAKTDNKTSSSPEKISNGPKLLQPNGAHKEPTVTWVHKIFQGILTNETRCLRCETVTARDETFLDLSLDIEQNSSITSCLKSFCSTETLHSXDKFFCDKCCSLQEAQKRMKIKKPPHILVIHLKRFKYIEQLGRYKKLSYRVVFPLELKLSNTVEDYADTEYSLLQLWFISETVPTMVTM

SEQ ID NO: 9455 - protein, 366 aa, Triticum aestivum
MGAASSRLEKALGEQFPEGERYFGLENFGNTCYCNSVLQALYFCVSFREQLLQYYANNKSASDGEENMLTCLADLFSQISNQKKKTGVIAPKRFIQRLKKQNELFRSYMHQDAHEFLNFLLNELVDILEKECKANKETPQNSSSNKSSNGPINGQPNGSHKEPETTWVHKCFQGILTNQTKCLRCETVTDRDETFLDLSLDIEQNSSITSCLKNFSSTETLNAEDKFFCDKCCSLQEAQKRMKIKKQPNILVIHLKRFKYIEQLGRYKKLTYRVVFPLELKLMNTVDNSDLEYSLFAVLVHVGSGPNHGHYISVVKSHNHWLFFDDETVEMTDESMVQTFFGSAQEFSGNTDNGYILFYESVAKTS

SEQ ID NO: 9456 - protein, 90 aa, Cephalotaxus harringtonia
MKIKIPPRILVIHLKRFKYIEQLGRYKKLSYRVVFPMELKLCNTTDDAPGSDAEYSLFAVVVHVGSGPNHGHYISLVKSHNHWLFLMMKM

SEQ ID NO: 9457 - protein, 364 aa, Lippia dulcis
MGVAGSKLEKALGDQFPEGERYFGLENFGNTCYCNSVLQALYFCVPFREQLLEYYSDNKNQGEVDENILTCLAELFSQISSQKKKTGVIAPKRFVYRIRKENENFRGYMHQDAHEFLNYLLNELVDILEKESHKVPSLPQNSSQEVAVNGLSNGHTNGVKEPLVTWVHKNFQGILTNETRCLRCETVTARDETFLDLSLDIEQNSSITSCLKNFSSTETLNAEDKFFCDKCCSLQEAQKRMKIKKPPRVLVIHLKRFKYMENRHRKLSYRVVFPLELKLSNTMEDADSEYSLFAVVVHVGSGPNHGHYVSLVKSHNHWLFFDDENVEIVDESAIQTFFGSAQEYSSNTDHGYILFYESLQNENK

SEQ ID NO: 9458 - protein, 372 aa, Valeriana officinalis
MGAAGSKLEKALGDQFPEGERYFGLENFGNTCYCNSVLQALYFCVPFREQLIEYYSNNKSLTDSEENLLTCLADLFMQITSQKKKTGVIAPKRFVQRLKKQNDVFRSYMHQDAHEFLNYLLNELVDILEKELTNAAKNNNINNNSETPPSPPENIANGPKSVHANGVAQKEPLVTWVHKNFQGLLTNETKCLRCETVTARDETFLDLSLDIEQNSSITSCLKNFSSTETLNAEDKFFCDKCCSLQEAQKRMKIKKSPQILVIHLKRFKYMEQLSRYKKLSYRVVFPLELKLSSSDAKDSDAEYSLFAVVVHVGSGPNHGHYVSLVKSHNHWLFFDDENVEMIDESAVQTIFGSAQEYSSNTDHGYILFYERV

SEQ ID NO: 9459 - protein, 367 aa, Artemisia annua
MGAQGSKLEKVLGDQFPEGERYFGLENFGNTCYCNSVLQALYFCVPFREQLLEYYGNVKNPADVEENLLTCLAELFMQISTQKKKTGVVAPKRFVHRVKKENELFRGYMHQDAHEFLNFLLNELADILEKELAKVPVENLSPPDKITNGPDGGPVNGGKKEPLVTWVHKSFQGILTNETRCLRCETVTARDETFLDLSLDIEQNSSITSCLKNFSSTETLNAEDKFFCDKCCSLQEAQKRMKIKRPPNILVIHLKRFKYMEHLSRYKKLSYRVVFPLELKLTNTMEDADCEYSLFAVVVHVGSGPNHGHYVSLVKSHNHWLFYDDENVEIIDESAVQTAFGSAQEFASNTDHGYMLFYESIDTNKLS

SEQ ID NO: 9460 - protein, 371 aa, Physcomitrella patens
MGASSSKLEKVLGDQFPEGERYFGLENFGNTCYCNSVLQALYFCVPFREQLLEYCGQKKPVAESEENLLTCLSELFTQINSQKKKTGVIAPKRFVQRVRKQNELFRSYMHQDAHEFLNFLLNELVDILVKEAQAANSNSGSHTSPEKVVGNGATNGLANGNHKEPVVTWVHKIFQGTLTNETRCLRCETITARDETFLDLSLDIEQNSSITSCLRNFSSTETLNAEDKFFCDKCCSLQEAQKRMKIKSPPRILALHLKRFKYIEQLGRYKKLSYRVVFPLELKLCNTTDDAPGSEAEYSLFAVVVHVGSGPNHGHYVSLVKSHNHWLFFDDENVEIIDESIVQTFFGSTQEYSNNTDHGYILFYESLDQKK

SEQ ID NO: 9461 - protein, 369 aa, Abies balsamea
MGTTGSRLEKALGDQFPEGERYFGLENFGNTCYCNSVLQALYFCVPFREQLLDYYIRTKAGREMDENLLTCLADLFTQIYSQKKKTGVIAPKRFVQRVKKENENFRSYMHQDAHEFLNFLLNELVDILEKEANAAEKLSGNLNQQEKAINGKINGTSNGTQQQPATWVHKIFQGTLTNETRCLCCETITARDETFLDLSLDIEQNSSITSCLRNFSSTETLNAEDKFFCDKCCSLQEAQKRMKIKIPPRILVIHLKRFKYIEQLGRYKKLSYRVVFPMELKLCNTTDDAPGSDAEYSLFAVVVHVGSGPNHGHYVSLVKSHNHWLFFDDENVEMIDESVVQTFFGSTQEYSNNTDHGYILFYESLVQGS

SEQ ID NO: 9462 - protein, 358 aa, Vinca minor
EKALGDQFPEGERYFGLENFGNTCYCNSVLQALYFCVPFREKLLEYYANNNKNPLEAEENLLTCLAELFSQISSQKKKTGVIAPKRFVQRVRKQNEVFRGYMHQDAHEFLNFLLNELVDILEKESQAAKCAPSRERMADEKNKIYENGTKEPLVTWVHKNFQGILTNETRCLRCETVTARDETFFDLSLDIEQNSSITSCLKNFSSTETLNAEDKFFCDKCCSLQEAQKRMKIKKPPQILVIHLKRFKYMEQLGRYKKLSYRVVFPLELKLNNTMENADTEYSLFAVVVHVGSGPNHGHYVSLVKSHNHWLYFDDENVEMIDESSVQTFFGSAQEYSSNTDHGYILFYECLSTNDKRG

SEQ ID NO: 9463 - protein, 368 aa, Triphysaria pusilla
MGVAGSKLEKALGDQFPEGERYFGLENFGNTCYCNSVLQALYFCVPFRDQLLEYYTNNKNQGETDENILTCLAELFSQISSQKKKTGVIAPKRFVHRVRRENENFRGYMHQDAHEFLNFLLNELVDILEKESRKLTSAPQTCSDESTENGPSNGHINGAEKKPLVTWVHKNFQGILTNETRCLRCETVTARDETFLDLSLDIEQNSSITSCLKNFSSTETLNAEDKFFCDKCRSLQEAQKRMKIKKPPQILVIHLKRFKYMEQLNRHKKLSYRVVFPLELKLSNTMEDADSEYTLFAVVVHVGSGPNHGHYVSLVKSHNHWLFFDDENVEMVDESAIQTFFGSAHEYSGSNDHGYILFYESSASDDKC

SEQ ID NO: 9464 - protein, 386 aa, Zea mays
MDGLLSKLRSLDAYPKVNEDFYSRTLSGGIITLVSSAVMLLLFVSELRLYLHAVTETTLRVDTSRGETLRINFDVTFPALQCSIISLDAMDISGQEHLDVKHDVFKQRIDAHGNVIATRQDVVGGMKMEAPLQHHGGRLEHNETYCGSCYGAQESDDQCCNTCEDVREAYRKKGWGVSNPDLLDQCKREGFLQSIKDEEGEGCNIYGFIEVNKVAGNFHFAPGKSFQQSNVHVHDLLPFQKDSFNVSHKINRLSFGEYFPGVVNPLDGANWVQHSSYGMYQYFIKVVPTVYTDINEHIILSNQFSVTEHFRSGESGRMQALPGVFFFYDLSPIKVTFTEQHVSFLHFLTNVCAIVGGVFTVSGIIDSFVYHSQRAIKKKMEIGKFN

SEQ ID NO: 9465 - protein, 386 aa, Panicum virgatum
MDGLLSKLRSLDAYPKVNEDFYSRTLSGGIITLASSVVMLLLFVSELRLYLHAVTETTLRVDTSRGEQLRINFDVTFPALQCSIISLDAMDISGQEHLDVKHDIFKQRIDAHGNVIATRQDAVGGMKMEKPLQHHGGRLEHNETYCGSCYGAQESDDQCCNTCEDVREAYRKKGWGVSNPDLLDQCKREGFLQSIKDEEGEGCNIYGFIEVNKVAGNFHFAPGKSFQQSNVHVHDLLPFQKDSFNVSHKINKLSFGDYFPGVVNPLDGAQWVQHSSYGMYQYFIKVVPTAYTDINDHIILSNQFSVTEHFRSSESGRIQALPGVFFFYDLSPIKVTFTEQHVSFLHFLTNVCAIVGGVFTVSGIIDSFVYHGQRAIKKKMEIGKFN

SEQ ID NO: 9466 - protein, 386 aa, Panicum virgatum
MDGLLTKLRSLDAYPKVNEDFYSRTLSGGIITLASSVVMLLLFVSELRLYLHAVTETTLRVDTSRGEMLRINFDVTFPALQCSIISLDAMDISGQEHLDVKHDIFKQRIDAHGNVIATRQDAVGGMKMEKPLQHHGGRLEHNETYCGSCYGAQESDDQCCNTCEDVREAYRKKGWGVSNPDLLDQCKREGFLQSIKDEESEGCNIYGFIEVNKVAGNFHFAPGKSFQQSNVHVHDLLPFQKDSFNVSHKINKLSFGEYFPGVVNPLDGAQWVQHSSYGMYQYFIKVVPTVYTDINDHIILSNQFSVTEHFRSSESGRIQALPGVFFFYDLSPIKVTFTEQHVSFLHFLTNVCAIVGGVFTVSGIIDSFVYHGQRAIKKKMEIGKFN

SEQ ID NO: 9467 - protein, 386 aa, Setaria italica
MDGLLSKLRNLDAYPKVNEDFYSRTLSGGIITLASSVVMLLLFVSELRLYLHAVTETTLRVDTSRGEKLRINFDVTFPALQCSIISLDAMDISGQEHLDVKHDIFKQRIDPHGNVIATRQDAVGGMKMEKPLQHHGGRLEHNETYCGSCYGAQESDDQCCNTCEDVREAYRKKGWGVSNPDLLDQCKREGFLQSIKDEEGEGCNIYGFIEVNKVAGNFHFAPGKSFQQSNVHVHDLLPFQKDSFNVSHKINKLSFGEHFPGVVNPLDRAQWVQHSSYGMYQYFIKVVPTVYTDINDRIILSNQFSVTEHFRSSESGRIQALPGVFFFYDLSPIKVTFTEQHVSFLHFLTNVCAIVGGVFTVSGIIDSFVYHGQRAIKKKMEIGKFN

SEQ ID NO: 9468 - protein, 386 aa, Oryza sativa
MEGLLSKLRSLDAYPKVNEDFYSRTLSGGIITLASSVVMLLLFVSELRLYLHAVTETTLRVDTSRGETLRINFDVTFPALQCSIISLDAMDISGQEHLDVKHDIFKQRIDVHGNVIATKQDAVGGMKVEQPLQRHGGRLEHNETYCGSCYGAEESDEQCCNSCEDVREAYRKKGWGVSNPDLIDQCKREGFLQSIKDEEGEGCNIYGFLEVNKVAGNFHFAPGKSFQKANVHVHDLLPFQKDSFNVSHKINKLSFGQRFPGVVNPLDGAQWMQHSSYGMYQYFIKVVPTVYTDINEHIILSNQFSVTEHFRSSESGRIQAVPGVFFFYDLSPIKVTFTEQHVSFLHFLTNVCAIVGGVFTVSGIIDSFVYHGQRAIKKKMEIGKFN

SEQ ID NO: 9469 - protein, 386 aa, Hordeum vulgare
MDGLLSKLRSLDAYPKVNEDFYSRTLSGGAITLASSFIMLLLFVSELRLYLHAVTETTLRVDTSRGEKLRINFDITFPALQCSIISVDVMDISGQEHLDVKHDVFKQRIDAHGNVIATKQDAVGGMKVEKPLQHHGGRLEHNETYCGSCYGAQESPEQCCNSCEDVREAYRKKGWGVSNPDSIDQCKSEGFLQTIKDEEGEGCNIYGFLEINKVAGNFHFAPGKSFQQSNVHVHDLLPFQKDSFNLSHKINKLSFGEPFPGVINPLDGAQWIQHSSYGMAQYFVKVVPTVYSHINEQIILSNQFSVTEHSRSGDSGRVQALPGVFFFYDLSPIKVTFTERHVSFLHFLTNVCAIVGGVFTVSGIIDSFVYHGQRAITKKRELGKFT

SEQ ID NO: 9470 - protein, 386 aa, Brachypodium distachyon
MDGLMSKLRNLDAYPKVNEDFYSRTLSGGVITLASSFVMLLLFVSELRLYLHAVTETTLRVDTSRGEKLRINFDITFPALQCSIISIDVMDISGQEHLDVKHDVFKQRIDANGNVIATKQDAVGGMKVEKPLQMHGGRLEHNETYCGSCYGAEEPGEQCCNSCEDVREAYRKKGWGVSNPDSIDQCKREGFLQTIKDEEGEGCNIYGFVEINKVAGNFHFAPGKSFQQSNVHVHDLLPFQKDSFNVSHKINKLSFGEPFPGVVNPLDGAHWFQHSPYGMYQYFVKVVPTVYSHINEQIILSNQFSVTEHARSSESVRMQALPGVFFFYDLSPIKVTFTERHVSFLHFLTNVCAIVGGVFTVSGIIDSFVYHGQRAITKKREIGKFN

SEQ ID NO: 9471 - protein, 386 aa, Secale cereale
MDGLLSKLRSLDAYPKVNEDFYSRTLSGGAITLASSFIMLLLFVSELRLYLHTVTETTLRVDTSRGEKLRINFDITFPALQCSIISVDVMDISGQEHLDVKHDVFKQRIDAHGNVIATKQDAVGGMKVEKPLQHHGGRLEHNETYCGSCYGAQESPEQCCNSCEDVREAYRKKGWGVSNPDSIDQCKTEGFLQKIKDEEGEGCNIYGFLEINKVAGNFHFAPGKSFQQSNVHVHDLLPFQKDSFNLSHKINKLSFGEPFPGVINPLDGAQWIQHSSYGMAQYFVKVVPTVYSHLNEQIILSNQFSVTEHSRSGDSGRVQALPGVFFFYDLSPIKVTFTERHVSFLHFLTNVCAIVGGVFTVSGIIDSFVYHGQRAITKKRELGKFT

SEQ ID NO: 9472 - protein, 386 aa, Triticum aestivum
MDGLLSKLRSLDAYPKVNEDFYSRTLSGGAITLASSFIMLLLFVSELRLYLHAVTETTLRVDTSRGEKLRINFDITFPALQCSIISVDVMDISGQEHLDVKHDVFKQRIDAHGNVIATKQDAVGGMKVEKPLQHHGGRLEHNETYCGSCYGAQESPEQCCNSCEDVREAYRKKGWGVSNPDSIDQCKSEGFLQTIKDEEGEGCNIYGILEINKVAGNFHFAPGKSFQQSNVHVHDLLPFQKDSFNLSHKINKLSFGEPFPGVINPLDGAQWIQHSSYGMAQYFVKVVPTVYSHLNEQIILSNQFSVTEHSRSGDSGRVQALPGVFFFYDLSPIKVTFTERHVSFLHFLTNVCAIVGGVFTVSGIIDSFVYHGQRAITKKRELGKFT

SEQ ID NO: 9473 - protein, 386 aa, Festuca arundinacea
  misc_feature (65)..(65): Xaa can be any naturally occurring amino acid
  misc_feature (258)..(258): Xaa can be any naturally occurring amino acid
MDGLLSKLRSLDAYPKVNEDFYSRTLSGGLITLASSLVMLLLFLSELRLYLHAATETTLRVDTSXGEKLRINFDITFPALQCSIISVDVMDISGQEHLDVKHDVFKQRIDANGKVISTKQDAVGGMKVEKPLQHHGGRLEHNETYCGSCYGAQESDEQCCNSCEDVREAYRKKGWGVSNPDSIDQCKSEGFLQSIKDEEGEGCNIYGFLEINKVAGNFHFAPGKSFQQSNVHVHDLLPFQKDSFNLSHKINKLTFGEXFPGVVNPLDGAHWVQPSSYGMYQYHIKVVPTVYSHLNKQIILSNQFSVTEHARSGDSGRIQALPGVFFFYDLSPIKVTFTEHHRSFLHFLTNVCAIVGGVFTVSGIIDSFVYHGQRAITKKRELGKFN

SEQ ID NO: 9474 - protein, 386 aa, Aristolochia fimbriata
MDGVFKKLRTLDAYPKINEDFYSRTLSGGVITVTSSIVMLLLFLSELRLYLHAVTETKLVVDTSRGETLRINFDVTFPALPCSIVSLDAMDISGEQHLDVRHDIFKRRIDAHGNVIESRPDGIGSPKIDKPLQRHGGRLEQNETYCGSCYGAEASDEDCCNSCEEVREAYRKKGWGLSDPDLIDQCKREGFLQQIKEEEGEGCNIYGYLEVNKVAGNFHFAPGKSFQQSNVHVHDLLAFQKDSFNVSHKINRLAFGDYFPGVVNPLDGVEWTQQTSYGMYQYFIKVVPSVYTDINGHKIQSNQFSVTEHFRGTEFGRIQAIPGVFFFYDLSPIQVTFTEQHVSFLHFLTNVCAIVGGVFTVSGIIDSFVYHGQRAVKKKMEIGKFS

SEQ ID NO: 9475 - protein, 386 aa, Ricinus communis
MEGIMNKLRNLDAYPKINEDFYSRTLSGGVITLASSILMLLLFISELRLYIHAVTETKLAVDTSRGETLRINFDVTFPALPCSILSLDAMDISGEQHLDVKHDIIKKRLDSHGNVIEARQDGIGAPKIENPLQRHGGRLEHNETYCGSCYGAEASDEDCCNSCEDVREAYRKKGWALSNPDLIDQCKREGFLQRIKDEEGEGCNIYGFLEVNKVAGNFHFAPGKSFQQSNVHVHDLLAFQKDSFNISHKINRLAFGDYFPGVVNPLDGVHWTQETPSGMYQYFIKVVPTVYTDVSGYTIQSNQFSVTEHFRSAEAGRLQSLPGVFFFYDLSPIKVTFTEEHVSFLHFLTNVCAIVGGVFTVSGILDSFIYHGQKAIKKKMEIGKFS

SEQ ID NO: 9476 - protein, 386 aa, Populus trichocarpa
MEGLMSKLRNLDAYPKINEDFYSRTLSGGVITLASSVVMFLLFFSELRLYLHAVTETKLVVDTSRGETLRINFDVTFPALPCSILSLDAMDISGEQHLDVKHDIIKKRLDFHGNVIEARQDGIGAPKIEKPLQRHGGRLEHNETYCGSCYGAEASDEDCCNSCEDVREAYRKKGWAVTNPDLMDQCKREGFLQKIKDEEGEGCNIYGFLEVNKVAGNFHFAPGKSFQQSGVHVHDLLAFQKDSFNITHKINRLTFGEYFPGVVNPLDGVQWTQETPSGMYQYFIKVVPTVYTDVSGHTIQSNQFSVTEHFRGTDIGRLQSLPGVFFFYDLSPIKVTFTEEHVSFLHFLTNVCAIVGGVFTVSGILDTFIYHGQKAIKKKMEIGKFS

SEQ ID NO: 9477 - protein, 386 aa, Populus trichocarpa
MEGLMSKLRNLDAYPKINEDFYSRTLSGGVITLASSIVMFLLFFSELRLYLHAVTETKLVVDTSRGETLRINFDVTFPALPCSILSLDAMDISGEQHLDVKHDIIKKRLDFHGNVIEARQDGIGAPKIEKPLQRHGGRLEHNETYCGSCYGAEASDEDCCNSCEDVREAYRKKGWAVTNPDLMDQCKREGFLQKIKDEEGEGCNIYGFLEVNKVAGNFHFAPGKSFQQSGVHVHDLLAFQKDSFNITHKINRLTFGEYFPGVVNPLDGVQWTQETPSGMYQYFIKVVPTVYTDVSGHTIQSNQFSVTEHFRGTDIGRLQSLPGVFFFYDLSPIKVTFTEEHVSFLHFLTNVCAIVGGVFTVSGILDTFIYHGQKAIKKKMEIGKFS

SEQ ID NO: 9478 - protein, 386 aa, Theobroma cacao
MDGIMNKLRNLDAYPKINEDFYSRTLSGGVITLVSSVVMFFLFFSELRLYLHAVTETKLVVDTSRGETLRINFDVTFPALACSILSLDAMDISGEQHLDVRHDIIKKRLDAHGNVIESRQDGIGAPKIEKPLQRHGGRLEHNETYCGSCYGAEASDDDCCNSCEDVREAYRKKGWALSNPDLVDQCKREGFLQKIKDEEGEGCNIYGFLEVNKVAGNFHFAPGKSFQQSNVHVHDLLAFQKDSFNISHKINRLAFGDYFPGVVNPLDGVHWTQEQPSGMYQYFIKVVPTVYTDVSGHTIQSNQFSVTEHFKGAEINRLQSLPGVFFFYDLSPIKVTFTEQHVSFLHFLTNVCAIVGGVFTVSGILDSFIYHGQRAIKKKIEIGKYS

SEQ ID NO: 9479 - protein, 386 aa, Tropaeolum majus
MDGIMNKLRNLDAYPKINEDFYSRTLSGGVITLASSVVMFLLFFSELRLYLHAITETKLIVDTSRGETLRINFDVTFPALPCSILSVDAMDISGEQHLDVRHDIIKKRIDSHGNVIEERQDGIGAPKIEKPLQRHGGRLEHNETYCGSCFGAEASDDECCNNCEEVREAYRKKGWAVSNPDLIDQCKREGFLQKIKDEEGEGCNIYGFLEVNKVAGNFHFAPGKSFQQSGVHVHDLLAFQKDSFNISHKINRLAFGDYFPGVVNPLDNVQWTQDSPSGMYQYFIKVVPTVYTDVSGHTIQSNQFSVTEHFRNAELGRLQALPGVFFFYDLSPIKVTFTEEHVSFLHFLTNVCAIVGGVFTVSGILDSFVYHGQKAIKKKMELGKFS

SEQ ID NO: 9480 - protein, 386 aa, Cajanus cajan
MDSIMSKLRNLDAYPKINEDFYSRTLSGGVITLASSIIMLLLFFSELWMYLHAVTETKLIVDTSRGETLRINFDVTFPALPCSILSLDAMDISGEQHLDVKHDIIKKRLDSHGNVIETRQEGIGAPKIEKPLQRHGGRLEHNETYCGSCYGAEASDDECCNSCEDVREAYRKKGWALSNPDLIDQCKREGFLQRIKDEEGEGCNVYGFLEVNKVAGNFHFAPGKSFQQSGVHVHDLLAFQKDSFNLSHHINRLAFGEYFPGVVNPLDNVHWTQETPSGMYQYFIKVVPTVYTDVIGHTIQSNQFSVTEHFRTGDVGRLQSLPGVFFFYDLSPIKVTFIEENVSFLHFLTNVCAIVGGVFTVSGILDSFVYHGQRAIKKKMELGKFN

SEQ ID NO: 9481 - protein, 386 aa, Glycine max
MDSIMSKLRNLDAYPKINEDFYSRTLSGGVITLASSILMLLLFFSELRLYLHAVTETKLVVDTSRAETLRINFDVTFPALPCSILSLDAMDISGEQHLDVKHDIIKKRLDSHGNVIETRQEGIGAPKIEKPLQRHGGRLEHNETYCGSCYGAEESDDDCCNSCEDVREAYRKKGWALSNPDLIDQCKREGFLQRIKDEEGEGCNVYGFLEVNKVAGNFHFAPGKSFQQSGVHVHDLLAFQKDSFNLSHHINRLAFGEYFPGVVNPLDNVHWTQETPSGMYQYFIKVVPTVYTDVSGHTIQSNQFSVTEHFRTGDVGRLQSLPGVFFFYDLSPIKVTFTEENVSFLHFLTNVCAIVGGIFTVSGILDSFIYHGQRAIKKKMELGKFN

SEQ ID NO: 9482 - protein, 386 aa, Phaseolus coccineus
MEGIMSKLRNLDAYPKINEDFYSRTLSGGVITLASSIIMLLLFFSELRLYLQSVTETKLVVDTSRGETLRINFDVTFPALPCSILSLDAMDISGEQHLDVKHDIIKKRLDSHGNVIETRQEGIGAPKIEKPLQRHGGRLEHNETYCGSCFGAEASDDDCCNSCEDVREAYRKKGWALSNPDLIDQCKREGFLQRIKDEDGEGCNVYGFLEVNKVAGNFHFAPGKSFQQSGVHVHDLLAFQKDSFNLSHHINRLSYGEYFPGVVNPLDNVHWIQETPSGMYQYFIKVVPTVYTDVNGHAIQSNQFSVTEHFRTGDVGRLQSLPGVFFFYDLSPIKVTFTEEHVSFLHFLTNVCAIVGGIFTVSGILDSFIYHGQRAIKKKMELGKFN

SEQ ID NO: 9483 - protein, 386 aa, Fagus grandifolia
MDNIMSKLRNLDAYPKINEDFYSRTLSGGVITLASSIVMLLLFFSELRLYLHAVTETTLVVDTSRGETLRINFDVTFPALPCSILSLDAMDISGEQHLDVKHDIIKKRLDTHGNVIEERQDGIGGPKIEKPLQKHGGRLEHNETYCGSCFGAEAADEECCNSCEEVREAYRKKGWALSNPDLIDQCKREGFLQRIKDEEGEGCNIYGFLEVNKVAGNFHFAPGKSFQQSGVHVHDLLAFQKDSFNISHKINRLAYGDYFPGVVNPLDGVQWTQHSPSGMYQYFIKVVPTVYTDLSGYTIQSNQFSVTEHFRNAEIGLLQSLPGVFFFYDLSPIKVTFKEEHISFLHFLTNVCAIVGGVFTVSGILDSFIYHGQKAIKKKMEIGKFS

SEQ ID NO: 9484 - protein, 386 aa, Tabernaemontana elegans
MDNLMSKIRSLDAYPKINEDFYSRTLSGGVITLASSIVMLLLFVSELRLYLHSVTETKLVVDTSRGERLRINFDVTFPALPCSMLSLDAMDISGEQHLDVRHDILKKRIDAHGNVIETRQDGIGAPKIERPLQRHGGRLEQNETYCGSCYGAETSDDDCCNNCEEVREAYRKKGWALSNPDLIDQCKREGFLERIKEEEGEGCNVYGFLDVNKVAGNFHFAPGKSFQQANVHVHDLLAFQKDSFNISHKINRLTFGEYFPGVVNPLDGVEWTQQTPNGMYQYFIKVVPTVYTDISGHTIQSNQFSVTEHFKGAEVGRLQSLPGVFFFYDLSPIKVTFKEEHVSFLHFLTNVCAIVGGVFTVSGIVDSFVYHGQRAIKKKMEIGKFS

SEQ ID NO: 9485 - protein, 386 aa, Aquilegia formosa
MNNLFSKLRNLDAYPKINEDFYSRTLSGGVITIASSIVMLLLFISELSLYLHAVTETQLVVDTSRGETLRINFDVTFPALPCSVVSVDAMDISGEQHLDVRHDIIKKRIDVHGNVIETRQDGIGGPKIEKPLQRHGGRLEHNETYCGSCYGAEASDEECCNSCEEVREAYRKKGWGLQNPDLIDQCKREGFLQRIKDEDGEGCNVYGSLEVNKVAGNFHFAPGKSFQQSGVHVHDLLAFQKDSFNISHKINRLTFGAYFPGVVNPLDGVQWVQETPHGMYQYFIKVVPTVYTDISGHTIQTNQFSVTEHFRNTEFGRSQALPGVFFFYDLSPIKVTFSEQHVSFLHFLTNVCAIVGGVFTVSGIVDSFIYHGQKAIKKKIEIGKFS

SEQ ID NO: 9486 - protein, 386 aa, Cannabis sativa
MDNIMSKLRNLDAYPKINEDFYSRTLSGGVITIASSVVMLLLFLSELRLYLHAVTETKLVVDTSRGETLRINFDVTFPALPCSILSLDAMDISGEQHLDVKHDVIKKRIDSHGNVIETRQDGIGAPKIDKPLQRHGGRLEHNETYCGSCYGAEASDDDCCNNCEEVREAYRKKGWALSNPDMIDQCKREGFLQRIKDEEGEGCNVYGFLEVNKVAGNFHFAPGKSFQQSNIHVHDLLSFQKDSFNISHKINRLTFGDYFPGVVNPLDGVQWSQATPSGMYQYFIKVVPTVYTDVTGHAIQSNQFSVTEHFRTSEFGNLQFLPGVFFFYDLSPIKVTFAEEHISFLHFLTNVCAIVGGVFTVSGILDSFIYHGQKAIKKKMEIGKFS

SEQ ID NO: 9487 - protein, 386 aa, Vitis vinifera
MDNIINKLRNLDAYPKINEDFYSRTLSGGVITLASSIFMLLLFISELRLYLHAVTETKLVVDTSRGETLRINFDVTFPALPCSILSLDAMDISGEQHLDVRHDIIKKRIDAHGSVIEARQDGIGSPKIEKPLQKHGGRLEHNETYCGSCYGAEASDDDCCNNCEEVREAYRKKGWAMSNPDLIDQCKREGFLQRIKDEEGEGCNIYGFLEVNKVAGNFHFAPGKSFQQSNIHVHDLLAFQKDSFNISHKINRLAFGDYFPGVVNPLDGVQWIQATPSGMYQYFIKVVPTVYTHVSGHTISTNQFSVTEHFRNAELGRLQSLPGVFFFYDLSPIKVTFTEEHVSFLHFLTNVCAIVGGVFTVSGILDSFIYHSQKAIKKKIEIGKFS

SEQ ID NO: 9488 - protein, 386 aa, Prunus mume
MENMMSKLRNLDAYPKINEDFYSRTLSGGVITLASSIVMLLLFLSELRLYLHAVTETRLVVDTSRGETLRINFDVTFSALPCSILSLDAMDISGEQHLDVKHDIIKKRLDSHGNVIESRPDGIGAPKIEKPLQRHGGRLEHNETYCGSCYGAEAADEDCCNSCEDVREAYRKKGWAISNPDVIDQCKREGFLQRIKDEEGEGCNIYGFLEVNKVAGNFHFAPGKSFQQSNVHVHDLLAFQKDSFNISHTINRLSFGDYFPGVVNPLDGVHWAQATPSGMYQYFIKVVPTVYTDVSGHTIQSNQFSVTEHFRGTEVGNLQYLPGVFFFYDLSPIKVTFTEEHISFLHFLTNVCAIVGGVFTVSGILDSFIYHGQKAIKKKMEIGKFS

SEQ ID NO: 9489 - protein, 334 aa, Panicum virgatum
MDGLLTKLRSLDAYPKVNEDFYSRTLSGGIITLASSVVMLLLFVSELRLYLHAVTETTLRVDTSRGETLRINFDVTFPALQCSIISLDAMDISGQEHLDVKHDIFKQRIDAHGNVIATRQDAVGGMKMEKPLQHHGGRLEHNETYCGSCYGAQESDDQCCNTCEDVREAYRKKGWGVSNPDLLDQCKREGFLQSIKDEEGEGCNIYGFIEVNKVAGNFHFAPGKSFQQSNVHVHDLLPFQKDSFNVSHKINKLSFGEYFPGVVNPLDGAQWVQHSSYGMYQYFIKVVPTVYTDINDHIILSNQFSVTEHFRSSESGRIQALPGVFFFMTFPQSR

SEQ ID NO: 9490 - protein, 386 aa, Euonymus alatus
MEGLVNRLRSLDAYPKINEDFYSRTLSGGVITLTSSIVMLLLFVSELRLYLHAVTETKLVVDTSRGETLHINFDITFPALPCSILSLDAMDISGEQHLDVKHDIIKKRLDVHGNTIESRQDGIGAPKIEKPLQRHGGRLEHNETYCGSCYGAESADDDCCNSCEDVREAYRKKGWAISNPDLIDQCKREGFLQRIKDEEGEGCNIYGFLEVNKVAGNFHFAPGKSFHQAGVHVHDLLAFQKDSFNISHKINRLTFGEYFPGVMNPLDGVHWTHETPNGMYQYFIKVVPTVYTDVSGHTIQSNQFSVTEHFRSAEFGRFQSLPGVFFFYDLSPIKVTFAEEHVSFLHFLTNMCAIVGGVFTVSGILDSFVYHGQRAIKKKMELGKFS

SEQ ID NO: 9491 - protein, 386 aa, Carica papaya
MDGIMNKLRNLDAYPKINEDFYSRTLSGGVITLASSIVMFLLFFSELRLYLHAVTETKLVVDTSRGEILRVNFDVTFPALPCSILSVDAMDISGEQHLDVKHDIIKKRIDSHGNVIEARQDGIGAPKIDKPLQRHGGRLEHNETYCGSCYGAEVTDEDCCNSCEEVREAYRKKGWALSNPDLIDQCKREGFLQRIKDEEGEGCNIYGFLEVNKVAGNFHFAPGKSFQQSGVHVHDLLAFQKDSFNISHKINRLAFGDYFPGVVNPLDGVHWTQETPSGMYQYFIKVVPTVYTDVSGHTIQSNQFSVTEHFKNAEVGRLQSLPGVFFFYDLSPIKVTFTEEHVSFLHFLTNVCAIVGGVFTVSGILDSFIYHGQKAIKKKMELGKFN

SEQ ID NO: 9492 - protein, 386 aa, Prunus persica
MENMMSRLRNLDAYPKINEDFYSRTLSGGVITLASSIVMLLLFLSELRLYLHAVTETKLVVDTSRGETLRINFDVTFSALPCSILSLDAMDISGEQHLDVKHDIIKKRLDSHGNVIESRPDGIGAPKIEKPLQRHGGRLEHNETYCGSCYGAEAADEDCCNSCEDVREAYRKKGWAISNPDVIDQCKREGFLQRIKDEEGEGCNIYGFLEVNKVAGNFHFAPGKSFQQSNVHVHDLLAFQKDSFNISHTINRLSFGDYFPGVVNPLDGVHWAQATPSGMYQYFIKVVPTVYTDVSGHTIQSNQFSVTEHFRGTEVGNLQYLPGVFFFYDLSPIKVTFTEEHISFLHFLTNVCAIVGGVFTVSGILDSFIYHGQKAIKKKMEIGKFS

SEQ ID NO: 9493 - protein, 386 aa, Musa acuminata
MEGLFGKLRNLDAYPKINEDFYSRTLSGGIITIVSSIVMFLLFISELRLYLHAVTETKLIVDTSRGETLRINFDVTFPALSCSMLSLDAMDISGEEHLDVRHDIIKKRLDSHGNIIESRQDGIGSPKIEKPLQRHGGRLEHNETYCGSCYGAEVSDEDCCNSCEEVREAYRKKGWGLSDPEIIDQCKREGFLQRIKDEDGEGCNIYGFLEVKKVAGNFHFAPGKSFQQSNMHVHDLLPFQKESFNISHKINRLSFGEYFPGAINPLDGVQWVQHAPYGMYQYFIKVVPTVYTDIRGRTIQSNQFSVTEHFRSDDIGRLQYLPGVFFFYDLSPIKVTFTEGHVSFLHFLTNVCAIVGGVFTVSGILDSFIYHGQRAIKKKIEIGKFS

SEQ ID NO: 9494 - protein, 386 aa, Malus domestica
MENIMSKLRNLDAYPKINEDFYSRTLSGGVITLASSIVMLLLFLSELRLYLHAVTESKLVVDTSRGETLRINFDVTFAALPCSILSLDAMDISGEQHLDVKHDIIKKRLDSHGNVIESRPDVIGAPKIDKPLQRHGGRLEHNETYCGSCYGAEAADEDCCNSCEDVREAYRKKGWAISNPDLIDQCKREGFLQRIKDEEGEGCNIYGFLEVNKVAGNFHFAPGKSFQQSNVHVHDLLAFQKDSFNISHTINRLSFGDYFPGVVNPLDGVHWTQDNPSGMYQYFIKVVPTVYTDVSGHTIQSNQFSVTEHYRGTEMGNLQFLPGVFFFYDLSPIKVTFTEEHISFLHFLTNVCAIVGGVFTVSGILDSFIYHGQKAIKKKMEIGKFS

SEQ ID NO: 9495 - protein, 386 aa, Gossypium hirsutum
MDGIMNKIRNLDAYPKINEDFYSRTLSGGVITVVSSVVMFLLFFSELRLYLHAATETKLVVDTSRGETLRINFDVTFPALACSIVSVDAMDISGEQHLDVKHDIIKKRLDAHGNVIESRPDGIGAPKIEKPLQRHGGRLEHNETYCGSCYGAEAADDDCCNSCEDVREAYRKKGWALSNPDLIDQCKREGFLQKIKDEEGEGCNIYGFLEVNKVAGNFHFAPGKSFQQSNVHVHDLLAFQKDSFNLSHKINRLAFGDYFPGVVNPLDSVHWTQEQPSGMYQYFLKVVPTVYTDVSGHTIQSNQFSVTEHFKGAEVGRLQSLPGVFFFYDLSPIKVTFTEQHVSFLHFLTNVCAIVGGVFTVSGILDSFIYHGQKAIKKKMEIGKLS

SEQ ID NO: 9496 - protein, 386 aa, Gossypium raimondii
MDGIMNKIRNLDAYPKINEDFYSRTLSGGVITVVSSVVMFLLFFSELRLYLHAATETKLVVDTSRGETLRINFDVTFPALACSIVSVDAMDISGEQHLDVKHDIIKKRLDAHGNVIESRPDGIGAPKIEKPLQRHGGRLEHNETYCGSCYGAEAADDDCCNSCEDVREAYRKKGWALSNPDLIDQCKREGFLQKIKDEEGEGCNIYGFLEVNKVAGNFHFAPGKSFQQSNVHVHDLLAFQKESFNLSHKINRLAFGDYFPGVVNPLDSVHWTQEQPSGMYQYFLKVVPTVYTDVSGHTIQSNQFSVTEHFKGAEVGRLQSLPGVFFFYDLSPIKVTFTEQHVSFLHFLTNVCAIVGGVFTVSGILDSFIYHGQKAIKKKMEIGKFS

SEQ ID NO: 9497 - protein, 385 aa, Humulus lupulus
DGIMSKLRNLDAYPKINEDFYSRTLSGGVITIASSIVMLLLFLSEIRLYLHAVTETKLVVDTSRGETLRINFDVTFPALPCSILSLDAMDISGEQHLDVKHDVIKKRLDSHGNVIETRQDGIGAPKIDKPLQRHGGRLEHNETYCGSCYGAEASDEDCCNNCEEVREAYRKKGWALSNPDMIDQCKREGFLQRIKDEEGEGCNVYGFLEVNKVAGNFHFAPGKSFQQSNIHVHDLLSFQKDSFNISHKINRLAFGDYFPGVVNPLDGVQWTQQTPSGMYQYFIKVVPTVYTDVTGHAIQSNQFSVTEHFRTSEFGNLQFLPGVFFFYDLSPIKVTFAEEHISFLHFLTNVCAIVGGVFTVSGILDSFIYHGQKAIKKKMEIGKFS

SEQ ID NO: 9498 - protein, 386 aa, Glycine max
MESIISKLRNLDAYPKINEDFYSRTLSGGVITLASSILMLLLFYSELRLYLHAVTETKLVVDTSRAETLRINFDVTFPALPCSILSLDAMDISGEQRLDVKHDIIKKRLDSRGNVIETRQEGIGAPKIEKPLQRHGGRLEHNETYCGSCYGSEVSDDDCCNSCEDVREAYRKKGWALSNPDLIDQCKREGFLQRIKDEEGEGCNVYGFLEVNKVAGNFHFAPGKSFQQSGVHVHDLLAFQKDSFNLSHHINRLTFGEYFPGVVNPLDNVHWTQETPSGMYQYFIKVVPTVYTDVSGHTIQSNQFSVTEHFRTGDMGRLQSLPGVFFFYDLSPIKVTFTEENVSFLHFLTNVCAIVGGIFTVSGILDSFIYHGQRAIKKKMELGKFN

SEQ ID NO: 9499 - protein, 364 aa, Amsonia hubrichtii
DSVMGKIRSLDAYPKINEDFYSRTLSGGVITLTSSIVMLLLFVSELRLYLHSVTETKLVVDTSRGERLRINFDVTFPALPCSMLSLDAMDISGEQHLDVRHDIIKKRIDARGNVIETRQDGIGAPKIENPLQRHGGRLEHNETYCGSCYGAEASDDDCCNNCEQVREAYRKKGWAMSNPDLIDQCKREGFLQRIKDEEGEGCSVYGFLDVNKVAGNFHFAPGKSFQQANVHVHDLLAFQKDSFNISHKINRLTFGEYFPGVVNPLDGVEWIQQTPNGMYQYFIKVVPTVYTDITGHTIQSNQFSVTEHFKGADIGRLQSLPGVFFFYDLSPIKVTFKEEHVSFLHFLTNVCAIVGGVFYCFGDN

SEQ ID NO: 9500 - protein, 74 aa, Linum usitatissimum
MDGMMSKLRSLDAYPKINEDFYSRTLSGGLITLASSVVMLLLFISELRLYLHTVTETKLVVDTSRGETLRIILM

SEQ ID NO: 9501 - protein, 108 aa, Fragaria vesca
MENMMSKLRNLDAYPKINEDFYSRTLSGGVITLASSVVMLLLFLSELQLYLHAVTETKLVVDTSRGETLRINFDVTFAALPCSILSLDAMDISGEQHLDVKHDIIKKE

SEQ ID NO: 9502 - protein, 386 aa, Gossypium hirsutum
MDGIMNKIRNLDAYPKINEDFYSRTLSGGVITVVSSVVMFLLFFSELRLYLHAATETKLVVDTSRGETLRINFDVTFPALACSIVSVDAMDISGEQHLDVKHDIIKKRLDAHGNVIEARPDGIGAPKIEKPLQRHGGRLEHNETYCGSCYGAEAADDDCCNSCEDVREAYRKKGWALSNPDLIDQCKREGFLQKIKDEEGEGCNIYGFLEVNKVAGNFHFAPGKSFQQSNVHVHDLLAFQKESFNLSHRINRLAFGDYFPGVVNPLDSVHWTQEQPSGMYQYFLKVVPTVYTDVSGHTIQSNQFSVTEHFKGAEVGRLQSLPGVFFFYDLSPIKVTFTEQHVSFLHFLTNVCAIVGGVFTVSGILDSFIYHGQKAIKKKMEIGKFS

SEQ ID NO: 9503 - protein, 386 aa, Quercus alba
MDNIMSKLRSLDAYPKINEDFYSRTLSGGLITLVSSIVMLLLFFSELRLYLHAVTDTTLVVDTSRGETLRINFDVTFPALPCSILSLDAMDISGEQHLDVKHDIIKKRLDTHGDVIEERQDGIGSPKIEKPLQKHGGRLEHNETYCGSCYGAETSDEECCNNCEDVREAYRKKGWALSNPDVIDQCKREGFLQRIKDEEGEGCNIYGFIEVNKVAGNFHFAPGKSFHQSGVHVHDLLAFQKDSFNVSHKITRLSFGDYFPGVVNPLDNVKWIQETPSGMYQYFIKVVPTVYTDVSGHTIQSNQFSVTEHFRNAEIGHLQSLPGVFFFYDLSPIKVTYKEEHTSFLHFLTNVCAIVGGVFTVSGILDSFIYHGQRAIKKKIELGKFS

SEQ ID NO: 9504 - protein, 377 aa, Populus trichocarpa
MDGLMSKLRNFDAYPKINEDFYSRTLSGGVITLASSIVMFLLFFSELRLYLHAVTETKLVVDTSRGETLRINFDVTFPALPCSILSLDAMDISGEQHLDVKHDIIKKRLDSHGNVIESRQDGIGAPKIEKPLQRHGGRLEHNETYCDEDCCNSCEEVREAYQKKGWAVTNPDLMDQCKREGFLQRIKDEEGEGCNIYGFLEVNKVAGNFHFAPGKSFQQSGVHVHDLLAFQKDSFNTSHKINRLAFGEYFPGVVNPLDGVQWTQETPSGMYQYFIKVVPTVYTDVSGHTIQSNQFSVTEHFRGADIGRLQSLPGVFFFYDLSPIKVTFTEEHVSFLHFLTNVCAIVGGVFTVSGILDSFIYHGQKAIKKKMEIGKFS

SEQ ID NO: 9505 - protein, 386 aa, Arachis hypogaea
MDSIMSKLRNLDAYPKINEDFYSRTLSGGVITLASSVLMILLFISELRLYLHASTETKLIVDTSRGETLRINFDITFPALPCSMLSVDAMDISGEQHLDVRHDIIKKRLDTQGNVIGTRQDGIGSPKIENPLQKHGGRLEHNETYCGSCYGAEESDDDCCNSCEDVREAYRKKGWAVSNPDLIDQCKREGFLQRIKEEDGEGCNIYGFLEVNKVAGNFHFAPGKSFQQSGVHVHDLLAFQKDSFNLSHHINRLAFGDYFPGVVNPLDRAHWTQKTPSGMYQYFIKVVPTVYSDVRGHTIQTNQFSVTEHFKTGDVGRFQSLPGVFFFYDLSPIKVTFTEEPVSFLHFLTNVCAIVGGVYTVSGILDSFIYHGQRAIKKKMELGKFN

SEQ ID NO: 9506 - protein, 386 aa, Rhizophora mangle
MDGIMNRLRNIDAYPKINEDFYSRTLFGGVITLVSSFVMLLLFISELRLYLHAVTETKLVVDTSRGETLRINFDVTFSALPCSILSLDAMDISGEQHLDVKHDIIKRRLDSHGNVIEARQDGIGAPKIESPLQRHGGRLEHNETYCGSCYGAEASDEDCCNSCEDVREAYRKKGWALSNPDLIDQCKREGFLQRIKEEDGEGCNIYGFLEVNKVAGNFHFAPGKSFQQSNVHVHDLLAFQKDSFNITHKINRLTFGEYFPGVVNPLDGVQWTQEAPNGMYQYFIKVVPTVYSDVNGNTIQSNQFSVTEHFRSSEAGHFQYVPGVFFFYDLSPIKVTFTEEHVSFLHFLTNVCAIVGGVFTVSGMLDSFIYHGQRAIKKKIELGKFS

SEQ ID NO: 9507 - protein, 385 aa, Amborella trichopoda
MDVLNKLRHLDAYPKINEDFYSRTLSGGLITIFSSIFMLLLFFSELRLYLHAATETKLMVDTSRGETLRINFDVTFPALPCSILSLDAMDISGEQHLDVKHDIIKKRIDAHGNVIEARADGIGAPKIEKPLQRHGGRLEQNETYCGSCYGAEGSDDECCNSCEEVREAYRKKGWGLTNPDLIDQCKREGFLQRIKEEDGEGCNIYGFLEVNKVAGNFHFAPGKSFQQSHIHVHDLLAFQKDNFNISHKINRLAFGDYFPGAVNPLDGVHWEQKAPSGMYQYFIKVVPTVYTDIKGNTIQSNQFSVTEHFRNSEFGHGQTLPGVFFFYDLSPIKVTFVETHVSFLHFLTNVCAIVGGIFTVSGIIDSFIYHGQRAIKKKMEIGKFS

SEQ ID NO: 9508 - protein, 386 aa, Musa acuminata
MEGVFGKLRNLDAYPKINEDFYSRTLSGGIITIVSSIVMFLLFISELRLYLHAVTETKLVVDTSRGESLRINFDVTFPALSCSMLSLDAMDISGEEHLDVRHDIIKKRLDSHGNVIETRQDGIGSPKIEKPLQRHGGRLEHNETYCGSCYGAEASDEDCCNSCEEVREAYRKKGWGLSNPDLVDQCKREGFLEKIKNEEGEGCNVYGFLEVKKVGGNFHFAPGKSFQQSNMHVHDLLPFQKESFNISHKINKLAFGEYFPGVVNPLDGVQWVQHTPNGMYQYFIKVVPTVYTDINGRTIQSNQFSVTEHFKSDDTGRLQSVPGVFFFYDLSPIKVTFMEGHVSFLHFLTNVCAIVGGIFTVSGILDSFIYHGQRAIKKKMEIGKFS

SEQ ID NO: 9509 - protein, 386 aa, Olea europaea
MESLFGKIRNLDAYPKINEDFYSRTLSGGLITIASSIFMLLLFISELRLYLHAVTETKLVVDTSRGERLRINFDVTFPALPCSILSVDAMDISGEQHLDVRHDIIKKRIDAHGNVIETRQDGIGHPKIEKPLQRHGGRLDHNETYCGSCYGAEASDDDCCNSCEEVREAYRKKGWAMSNPDLIDQCKREGFLQQIKEEEGEGCNIYGFLDVNKVAGNFHFAPGKSFQQSNVHVHDLLAFQKDSFNISHKINRLAFGDYFPGVINPLDGVLWVQQTPNAMYQYFLKVVPTVFTDVNGNTIQSNQFSVTEHVRGSEVGHLQSLPGVFFFYDLSPIKVTFTETHVSFLHFLTNVCAIVGGVFTVSGIIDSCVYHGQKAIKKKMEIGKFS

SEQ ID NO: 9510 - protein, 386 aa, Mimulus guttatus
MESIIGKLRSLDAYPKINEDFYSRTLSGGVITLASSIVMLLLFISELRLYLHSVTETKLVVDTSRGERLRINFDVTFPALACSMVSLDAMDISGEQHLDVRHDIIKKRIDAHGNVIETRPDTIGGPKIERPLQRHGGRLEHNETYCGSCFGAETSEDECCNNCEEVREAYRKKGWALSNPDLVDQCKREGFLQMIKDEDGEGCNIYGFLDVNKVAGNFHFAPGKSFQQSNVHVHDLLAFQKDSFNISHTINRLAFGDYFPGVVNPLDGVEWIQQTPNAMYQYFLKVVPTVFTDVNGHAIQSNQFSVTEHVKGSELGRLQTLPGAFFFYDLSPIKVTFTETHVSFLHFLTNVCAIVGGVFTVSGIIDSFVYHGQKAIKKKMEIGKFS

SEQ ID NO: 9511 - protein, 386 aa, Cicer arietinum
MDSIMSKLRNLDAYPKINEDFYSRTLSGGVITLASSILMLLLFFSELRLYLHAATETKLIVDTSRGETLRINFDVTFPALACSILSLDAMDISGEQHLDVRHDIIKKRIDSHGNVIETRQDGIGSPKIEKPLQRHGGRLEQNETYCGSCYGAELSDEECCNSCEEVREAYRKKGWALSNPDVIDQCKREGFLQRIKEEEGEGCNVYGFLEVNKVAGNFHFAPGKSFQQSGVHVHDLLAFQKESFNLSHHINRLAFGDYFPGVVNPLDRVHWTQETPTGMYQYFIKVVPTVYTDVSGHTIQSNQFSVTEHFRTGDVGHFQSLPGVFFFYDLSPIQVTFTEEHVSFLHFLTNVCAIVGGIFTVSGILDSFIYHGQKAIKKKMELGKFN

SEQ ID NO: 9512 - protein, 386 aa, Brassica rapa
MAGILNKLRNLDAYPKINEDFYSRTLSGGVITLVSSVVMFLLFFSELRLYLHSVTETKLVVDTSRGETLRINFDMTFPALACSILSVDAMDISGELHLDVKHDVVKRRLDSHGNIIESRQDGIGAAKIEKPLQKHGGRLEHNETYCGSCYGAEAEEHDCCNSCEDVREAYRKKGWGVTNPDLIDQCKREGFLQRVKDEEGEGCNIYGFLEVNKVAGNFHFAPGKSFHQGGVHVHDLLAFQKDSFNISHKINRLTFGDYFPGVVNPLDKVQWSQDTPNAMYQYFIKVVPTVYTDISGHTIQSNQFSVTEHVKSSEAGQLQSLPGVFFFYDLSPIKVTFTEEHISFLHFLTNVCAIVGGVFTVSGIIDAFIYHGQKAIKKKMEIGKFS

SEQ ID NO: 9513 - protein, 386 aa, Citrus sinensis
MDAIMNKIRSLDAYPKINEDFYSRTFSGGVITLVSSIVMLLLFFSELRLYLNAVTETKLLVDTSRGETLRINFDVTFPALPCSILSVDAMDISGEQHLDVKHDIFKKRLDSQGNVIESRQDGIGAPKIDKPLQRHGGRLEHNETYCGSCYGAESSDEDCCNNCEEVREAYRKKGWALSNPDLIDQCKREGFLQRIKEEEGEGCNIYGFLEVNKVAGNFHFAPGKSFHQSGVHVHDILAFQRDSFNISHKINKLAFGEHFPGVVNPLDGVRWTQETPSGMYQYFIKVVPTVYTDVSGHTIQSNQFSVTEHFRSSEQGRLQTLPGVFFFYDLSPIKVTFTEEHVSFLHFLTNVCAIVGGVFTVSGIIDAFIYHGQRAIKKKIEIGKFS

SEQ ID NO: 9514 - protein, 386 aa, Rosa hybrid cultivar
MENMMSRLRNLDAYPKINEDFYSRTLSGGVITLVSSIVMLLLFLSELQLYLHAVTETKLVVDTSRGETLRINFDVTFAALPCSILSLDAMDISGEQHLDVKHDIIKKRIDSNGNVIESRPDGIGAPKIDKPLQRHGGRLEHNETYCGSCYGAEANDEDCCNNCEEVREAYRKKGWAISNPDLIDQCKREGFLQKIKDEEGEGCNIYGFLEVNKVAGNFHFAPGKSFQQSNVHVHDLLAFQKDSFNISHTINRLSFGDYFPGVVNPLDGVHWTQDNPSGMYQYFIKVVPTVYTDVRGHTIQSNQFSVTEHYRGTEIGNLQFLPGVFFFYDLSPIKVTFTEEHISFLHFLTNVCAIVGGVFTVSGILDSFIYHGQKAIKKKMEIGKFS

SEQ ID NO: 9515 - protein, 353 aa, Cicer arietinum
MDSIMSKLRNLDAYPKINEDFYSRTLSGGVITLASSILMLLLFFSELRLYLHAATETKLIVDTSRGETLRINFDVTFPALACSILSLDAMDISGEQHLDVRHDIIKKRIDSHGNVIETRQDGIGSPKIEKPLQRHGGRLEQNETYCGSCYGAELSDEECCNSCEEVREAYRKKGWALSNPDVIDQCKREGFLQRIKEEEGEGCNVYGFLEVNKVAGNFHFAPGKSFQQSGVHVHDLLAFQKESFNLSHHINRLAFGDYFPGVVNPLDRVHWTQETPTGMYQYFIKVVPTVYTDVSGHTIQSNQFSVTEHFRTGDVGHFQSLPGVFSSMTFLRFRLLLQKNMSHSYIFLLMCAP

SEQ ID NO: 9516 - protein, 303 aa, Zea mays
MAASPALVSLTPAVSRHPHLLFCSPCPPPRHIRLAPPTATPASDGNGLGPGPGPGVFLSPRALSQLDELAAFRYEHAFPHGLLTVRALSRGPDDDAVAEALVRLLASSFSETVRWAPAQRYAQLLTFVIRRYLHDRRGLAPHAAVLVGFYRPADADAGADNANAAPEDDEGEGGDEGEMACTAEVSFDAVGAPGAPPTPTPPLNFPYICNMTVKTPLRRRGIGKQLLKACEDLVFKMNAKRRVYLHCRIIDQVPFNMYTKAGYSIVQTDSILVWLSLQKRKYLMSKELPQASVVSETSTKNFE

SEQ ID NO: 9517 - protein, 303 aa, Panicum virgatum
MAASPALLSLTPAVSGHPHLLFSRCPSPRHLRLAPPAASPTPGGSPGPGVFLSPRALSQLDELAAFRYEHAFPHGLLTVRALTRGPEDDAVAEALVRLLASSFSETVRWAPAQRYAQLLTFVIRRYLHERRGLAPHAAVLVGFYRPADAGAADATGDDGDEGSDDGGGKDEGEMACTAEVSFDAVGAPGAPPTPTPPLDFPYICNMTVKTAFRRRGIGKQLLKACEDLVIKMDAKRRVYLHCRIIDQVPFNMYRKAGYNIVETDNILVWLSLQKRKYLMSKELPQASVVESSTKDFDDNILTR

SEQ ID NO: 9518 - protein, 304 aa, Panicum virgatum
MAAAPALLSLTPAVSRHAHLHFSRCPSPRHLRLAPPAAAPTPGGSPGPGVFLSPRALSQLDELAAFRYEHAFPHGLLTVRALTRGPEDDAVAEALVRLLASSFSETVRWAPAQRYEQLLTFVIRRYLHERRGLAPHAAVLVGFYRPADAVDAADATEDDGDEGSEDGGGKDEGEMACTAEVSFDAVGAPGAPPTPTPPLDFPYICNMTVKTALRRRGIGKQLLKACEDLVIKMDAKRRVHLHCRIIDQVPFNMYRKAGYNIVETDNILVWLSLQKRKHLMSKELPQASVVEPSTKDFDDNILTR

SEQ ID NO: 9519 - protein, 306 aa, Setaria italica
MAALPALVSLTPAVSRHSYLLFSRCPSPRPRHLRLILPAAAAPSPGGSPGPGVFLSPRALSQLDELAAFRYEHAFPHGLLTVRALTRGPEDDAVAEALVRLLASSFSETVRWAPAQRYAQLLTFVIRRYLHERRGLAPHAAVLVGFYRPADAAADSTGDDGDEGGEDGEGKDEGEMACTAEVSFNAVGAPGAPPTPTPPLDFPYICNMTVKTALRRRGLGKQLLKACEDLVIKMDARRCVYLHCRVIDQVPFNIYRKAGYNIVQTDSILVWLSLQKRKYLMSKELPQASAVSESTTKDFDDNILTC

SEQ ID NO: 9520 - protein, 62 aa, Saccharum officinarum
SKLKFTKERVGCYLLEILVICLLIGVLFGLGVFRHGYDRIKDLGRNHTCFDCNTTARYQLTD

SEQ ID NO: 9521 - protein, 164 aa, Panicum virgatum
MCRGSVHTARQPRDSILITAQRRKGAAASLALSLSRTRTRTALPLGLAVASLAERYRRHTAEVTGRQLPGSLAPIRGRARGFASTTRERDRGRGRPEPRRRSTRQPPAMCKLKFTKERVGCYLLVILVIVLIIGVLFGLGVFRHGYDRIKDLGRNHTCFDCNRY

SEQ ID NO: 9522 - protein, 61 aa, Zea mays
MCELKFTKERVGCYLLVVLVIVLLVGVLFGLGVFRHGYDRFKDLGRNHTCFDCNTTGTNRV

SEQ ID NO: 9523 - protein, 116 aa, Panicum virgatum
RAIPSPYRRGDRATIAWQPCTDKRPRERFCINHQREREREIDRGRGRPEPRRRSTRQPPAMCKLKFTKERVGCYLLVILVIVLIIGVLFGLGVFRHGYDRIKDLGRNHTCFDCNRY

SEQ ID NO: 9524 - protein, 82 aa, Panicum virgatum
QPPEREIDRGRGRPEPRRRSTRQPPAMCKLKFTKERVGCYLLVILVIVLIIGVLFGLGVFRHGYDRIKDLGRNHTCFDCNRY

SEQ ID NO: 9525 - protein, 379 aa, Saccharum officinarum
MAASSGTRSVRLLLLSLLGFCVALSHQESSSSTDSCTTAKVAVASLVPFDSTSFHCTAAWKQQDFVLRYKNTGPSEWSFILSAPDKGSYVAVGFSGKGAMVGSSAVVGWASNGRGTVKQYYLGGKSPEDCAPNKGLLKLVRNRSVVVSRSGRLYLAFQLSTDYPQPYLIFAVGPDGNLPQSDSLRLPMHQSMASRSFNYTSGMSYNTAGSGGDAAFPTERKHGLLGMMGWGVLMPIGMITARYFRQLDPCWFYTHMAIQVSGYAVGIAGVVLGFRLNEDGLKNVDVHKALGIAILAMASLQVLAILARPDKTSKVRRFWNWYHHNIGRATILLAIGNIFLGLSIAQEISAYIVSYGVFVAVWVVAVAAFEMKRCYADDD

SEQ ID NO: 9526 - protein, 378 aa, Zea mays
MAASSGTRSVRLLVLLLCLLGFCVALSHQESAADSCARAKVAVASLVPFDSTSFRCTAAWKQQDFVLRYKNTGPSEWSFILSAPDRGSYVAVGFSGKGAMVGSSAVVGWAANGRGTVKQYYLGGKSPEECAPNRGLLKLVRNRTAVASRSGRLYLAFQLSTDYPQPYLIYAVGPDGSLPQSDSLRLPAHQNMASRSFNYTSGLSYNVAGSGDAAFPPERKHGLLGMMGWGVLMPIGMITARYFRQLDPCWFYTHMAIQVAGYAVGIAGIVLGFRLSEDGLRNVDVHKALGIAILAMASLQVMAILARPDKTSKVRRFWNWYHHNIGRAAILLAIGNIFLGLSIAQETSAYIVSYGVFVAVWVLAVAAFEMKRCYADDD

SEQ ID NO: 9527 - protein, 377 aa, Setaria italica
MAAPSARLLLLSLLGFCVALSHQESSSSSSTDSCGAAKLAVASLVPFDSTAFRCVAAWKQQDFVLRYKNTAPSEWSFVLSAPDKGSYVAVGFSGKGAMVGSSAVVGWASNGKGTVKQYYLDGKSPDDVAPNRGLLKLVKNKSVVVSHSGRLYVAFQLSTDYPQPYLIFAVGPDGNLPPSSTLRLPMHQNMASRAFNYTSGISSNAGGSGDNAAFPPEGKHGLLAMMGWGVLMPIGMITARYFRQLDPCWFYTHMAIQVSGFAIGIAAVVLGFRLNEDGLKNVDVHKALGIAILAMASLQVMAILARPDKTSKVRRFWNWYHHNIGRAAILLAIGNIFLGLSIAQETNAYIVSYGVFVAVWVVAVAAFEMKRCYADDD

SEQ ID NO: 9528 - protein, 375 aa, Pennisetum glaucum
MAAPSAARLVLLTLLGFCVALSHQEDSCGAAKLAVASLVPFDTTAFRCAAAWKQQDFILRYKNTAPSEWSFVLSAPEKGSYVAVGFSGKGAMVGSSAVVGWASNGKGTVKQYYLDGKSPDDVAPNRGLLKLVKNKSVVVSHSGRLYVAFQISTDYPQPYLIFAVGPDGNLPPSSTLRLQMHQSMASRAFNYTSGMLYSNNAGGGSGDNAAFPAERKHGLLGMMGWGVLMPIGMITARYFRQLDPCWFYTHMAIQVSGFAIGIAGVVLGFRLNQDGLKNVDVHKALGIAILAMASLQVMAILARPDKTSKVRRFWNWYHHNIGRAAILLAIGNIFLGLSIAQETNAYIVSYGVFVAVWVVAVAAFEVKRCYADDDD

SEQ ID NO: 9529 - protein, 431 aa, Panicum virgatum
MAASSGASSPSARLLLLLSLLGFCVALSSQESSSSSSTDSCGAAKLAVASLVPFDTAGFRCAANWKQQDFVLRYKNTGPSEWSFVLSAPDKGSYVAVGFSGKGAMVGSSAVAGWASDGRGTVKQYYLAGKSPDEVAPNRGLLKLVRDKSAVVSHSGRLYLAFQLSTDYPQPYLIYAVGPDGNLPPSSTLQLPMHQSMASRAFNYTSRDVLRRRLQRRDVPAGAEARAAGHDGVGRADAHRHDHRALLPATGPVLVLHPPGHPGVRLRHRHRGRRPRLPPQRGRAQERGRAQGARRRHPRHGVAPGAGDPGAAGQDVQGAAVLELVPPQHRARGDPGGRRQRLPGPLHRAGDQRLHCLLRRLRRRLGGRRRRLRGQALLRRRRLIRRPARPPGRQAGRQAGSDTVRQSRSGQTGHGTKLTDGRRMKRSRPVT

SEQ ID NO: 9530 - protein, 300 aa, Setaria italica
MSEQLKRDYEIGEEIGRGRFGVVHRCVSRATGEPFAVKSVDRSALADDLDRALAELEPKLAQLAGAGGANPGVVQVRAVYEDDAWTHTVMDLCTGPDLLDWVRLRRGAPVPEPDAARVVAQLAEALAGCHRAGVVHRDVKPDNVLLDLDDDPAGEGAPPRVRLADFGSAAWLGGGGGEGARRGSVEGLVGTPHYVAPEVVAGGEYGEKVDVWSAGVVAYVLLSGGALPFGGETPAEVFAAVLRGSLRFPPALFAGVSPAAKDLMRRMMCRDASRRFSAEQVLRHPWIQSGGGAREVVQPT

SEQ ID NO: 9531 - protein, 293 aa, Zea mays
MTEQLNREYDIGDEIGRGRFGVVRRCVSRATGDAFAVKSVDRSLLGDDLDRALAELEPKLARLAGGEGDGNPGVLQVRAVYEDDAWTHTVMDLCTGPDLLDWIRLRRGAPVPEPDAARVVAQLAEALAGCHRRGVVHRDVKPDNVLLDVDPAGEAPPRVRLADFGSAAWLGEGARGRAEGLVGTPHYVAPEVVAGGEYGEKVDVWSAGVVMYALLSGGALPFGGETAADVFAAVLRGSLRFPPALFAGVSPAAKDLMRRMMCRDVSRRFSAEQVLRHPWIQSGGGGRELVRPT

SEQ ID NO: 9532 - protein, 299 aa, Panicum virgatum
MSEQLRREYEIGEEIGRGRFGVVRRCASRATGEPFAVKSVDRSALADDLDRALAGLEPKLARLAGAGGANPGVVQVRAVFEDEAWTHTVMDLCTGPDLLDWVRLRRGAPVPEPAAARVVAQLAEALAGCHRAGVVHRDVKLDNVLLDLDDDDPAGEEDAAPRVRLADFGSASWLGAGAGGRGAAEGLVGTPHYVAPEVVAGGEYGEKVDVWSAGVVAYALLSGGALPFGGETPAEVFAAVLRGGLRFPPALFAGVSPAAKDLMRRMMCRDVSRRLSAEQVLRHPWIQSGGGAQEAVQPT

SEQ ID NO: 9533 - protein, 296 aa, Panicum virgatum
MSEQLGREYEIGEEIGRGRFGVVRRCASRATGEPFAVKSVDRSALADDLDRALAGLEPKLARLAAAGGANPGVVQVRAVFEDEAWTHTVMDLCAGPDLLDWVRLRRGAPVPEPAAARVVAQLAEALAGCHRAGVVHRDVKPDNVLLDLDEDGPAGEGAAPRVRLADFGSAAWLGAGGRGAAEGLVGTPHYVAPEVVAGGEYGEKVDVWSAGVVAYALLSGGALPFGGETPAEVFAAVLRGGLRFPPALFAGVSPAAKDLMRRMMCRDVSRRLSAEQVLRHPWIQSGGGAQEAVQPT

SEQ ID NO: 9534 - protein, 289 aa, Triticum aestivum
MSEELERDYEIGEEIGRGRFGVVRRCASRSTGDLYAVKSVDRSLLADDLDRGLAELEPKLAQLAAAGNPGVVQVHAVYEDDAWTHVVMDLCAGPDLLDWVRLRHGAPVPEPEAAAVAAQLAEALAICHRRGVAHRDVKPDNVLLDAPDGGGEGPVRARLADFGSAALVGGGEGARGLVGTPHYVAPEVVAGGEYGEKADVWSAGVVLYVLLTGGALPFSGETASDVFAAVLRGSPRFPPRLFAGVSPLAKDLMRRMMCRDVSRRFSAEQVLRHPWIVSGGGAREAVQPT

SEQ ID NO: 9535 - protein, 292 aa, Oryza sativa
MSGELKRDYEIGEEIGRGRFGVVHRCTSRATGEAFAVKSVDRSQLADDLDRELAELEPKLAQLAAAGNPGVVQVHAVYEDDAWTHMVMDLCSGPDLLDWIRLRRGAPVPEPVAAAVVAQLAEALAHCHRRGVAHRDVKPDNILLDVVDDGIDGGGTPRARLADFGSAAWVGESGGSAEGLVGTPHYVAPEVVAGGEYGEKADVWSAGVVLYVLLSGGALPFGGETAAEVLASVLRGSVRFPPRLFAGVSPAAKDLMRRMMCRDTWRRFSAEQVLGHPWIVSGGGARAMEQPT

SEQ ID NO: 9536 - protein, 232 aa, Oryza sativa
MSEELKRDFEIGEEIGRGRFGVVHRCASRSTGEAYAVKSVDRSRLSDDLDRSLAALEPKLARLAAAGNPGVVQVHAVYEDDDWTHTVMDLCTRPDILDWVRLRCGKPVPEPDATAVVAQIAEALALCHRRGVAHRDVKPDNVLLDATGDGPPRVRLADFGSAAWVGDGISAEGARGDSRTTSRPRWSPGASTGRRPTCGARGWSCTCSSPAARSRSAARRPPTCSPPSCGAT

SEQ ID NO: 9537 - protein, 289 aa, Triticum aestivum
MSEELERDYEIGEEIGRGRFGVVRRCASRSTGDLYAVKSVDRSRLDDDLDRGLAELEPKLAQLAAAGNPGVVQVHAVYEDEAWTHVVMDLCAGPDLLDWVRLRHGAPVPEPEAAAVAAQLAEALAICHRRGVAHRDVKPDNVLLDAPDGGGEGPVRARLADFGSAALVGGGEGARGLVGTPHYVAPEVVTGGEYGEKADVWSAGVVLYVLLTGGALPFSGETASDVFAAVLRGSPRFPPRLFAGVSPLAKDLMRRMMCRDVSRRFSAEQVLRHPWIVSGGGAREAVQPT

SEQ ID NO: 9538 - protein, 512 aa, Zea mays
MDSPLLSTPALLALSLLLLALYIARRRRGGGKNRNYPPVAGTVFHQLLHFRRLMEYQTELAHRYRTFRMLTPTCNYVYTVEPANVEYILKTNFGNYGKGAMIHDVMEDLLGDGIFNVDGARWRHQRKVASHEFSTRVLRDYSSGVFRDTAAELAGIVAVAARGAGPGERPLDVADLLMRSTLDSMFKVGFGVDLGSLSGCGDDEGAAAFARAFDDASEQVLYRFFDPSWKVKRLLGVSSEGAMKGSIRTIDQFVYGVIDRKIKQMGRDQEFAKKEDILSRFLMERESDPGCFDNKYLRDIILNFVIAGRDTTAGTLSWFLYVLCRNQHVQDRVAREVRAAATGDRDDVGVQEFVTCLTEDAISRMRYLHAVLTETLRLYPAVPIDVKYCFSDDTLPDGYAVKKGDMVNYQPYQMGRMKFLWGADAEEFRPERWINDDGVFVNESPFKFTAFQAGPRVCLGKEFAYRQMKIFAAVLVYAFRFEMWEANATMGYRPMLTLKMDGPLYVRASLRQ

SEQ ID NO: 9539 - protein, 508 aa, Setaria italica
MDSPLSQPALLALSLLFLLALHLARRRRGRGRNRNYPPVAGTVLHQLLNFGRLVEYQTELARRYRTFRMLTPTCNYVYTVEPANVEYMLKTNFANYGKGATMHDVLEDLLGDGIFNVDGARWRHQRKVASHEFSTRVLRDYSSGVFRDTAAELAGIVAAAARGDGGIRVDIADLLMRSTLDSIFKIGFGVGLGSLSGCSKEGAAFARAFDDASEQVLYRFFDVFWKAKRLLNVSSEAAMKHSVRTINDFVYAVIDRKIEQMGRNHQEFAKKEDILSRFLLERERDPGCFDNKYLRDIILNFVIAGRDTTAGTLAWFLYMLCRNLHIQEKIALEVRAATTGDRDVGVQEFVAFLTEDAISKMQYLHAALTETLRLYPAVPIDVKYCFSDDTLPDGYAVRKGDMVNYQPYPMGRMKFLWGVDAEEFRPERWLDDDGVFVPESPFKFTAFQAGPRICLGKEFAYRQMKIFAAVLLYLFRFEMWDASAIMGYRPMLTLKMDGPLYVRASLRR

SEQ ID NO: 9540 - protein, 509 aa, Panicum virgatum
MDSPLGRPALLALSVLLLVALYLARRRRARGKNRKYPPVAGTVLHQLLNFDRLVEYQTELARRYGTFRMLTPTCNYVYTVEPANVEYILKTNFANYGKGVMTHDVLEDLLGDGIFNVDGAKWRHQRKVASHEFSTRVLRDYSSAVFRDTAAELTGIVAAAARGDGERVDIADLLMRSTLDSIFKIGFGVNLGSLSGCSKEGAAFARAFDDASEQVLYRFFDLFWKVKRFFSISSEAAMKRSVRTINDFVYAVIDRKIEQMGRNHQEFAKKEDILSRFLLERERDPGCFDNKYLRDIILNFVIAGRDTTAGTLAWFLYELCRNQRIQEKIAEEVRAATVTGDGGVGAQELVACLTEDAIGKMQYLHAALTETLRLYPAVPIDVKYCFSDDTLPDGYAVNQGDMVNYQPYPMGRMKFLWGADAEEFRPERWLGDDGVFVPESPFKLTAFQAGPRICLGKEFAYRQMKIFAAVLVYLFRFEMWDADATVGYRPMLTLKMDGPLYVRASLRRR

SEQ ID NO: 9541 - protein, 509 aa, Panicum virgatum
MDSPLGRPALLALSVLLLVALYLARRRRARGKNRKYPPVAGTVLHQLLNFDRLVEYQTELARRYGTFRMLTPTCNYVYTVEPANVEYILKTNFANYGKGVMTHDVLEDLLGDGIFNVDGAKWRHQRKVASHEFSTRVLRDYSSAVFCDTAAELTGIVAAAARGDGERVDIADLLMRSTLDSIFKIGFGVNLGSLSGCSKEGAAFARAFDDASEQVLYRFFDLFWKVKRFFSISSEAAMKRSVRTINDFVYAVIDRKIEQMGRNHQEFAKKEDILSRFLLERERDPGCFDNKYLRDIILNFVIAGRDTTAGTLAWFLYELCRNQRIQEKIAEEVRAATVTGDGGVGAQELVACLTEDAIGKMQYLHAALTETLRLYPAVPIDVKYCFSDDTLPDGYAVNQGDMVNYQPYPMGRMKFLWGADAEEFRPERWLDDDGVFVPESPFKLTAFQAGPRICLGKEFAYRQMKIFAAVLVYLFRFEMWDADATVGYRPMLTLKMDGPLYVRASLRRR

SEQ ID NO: 9542 - protein, 508 aa, Panicum virgatum
MDSPLSRPALLALSLLLLALYLARRHLARGKNRTYPPVAGTVLHQVLNFGRLVEYQTELSRRYPTFRMLTPTCNYVYTVEPANVEYILKTNFANYGKGVMTHDVMEDLLGDGIFNVDGAKWRHQRKVASHEFSTRVLRDYSSAVFRDTAAELAGIVAAAARGAGERLDISDLLMRSTLDSIFEIGFGVNLGSLTGSSEEGAAFARAFDDASEQVLYRFFDLFWKVKRFFSIASEAAMKRSVRTIDGFVYAVIDRKIEQMGRNHQEFAKKEDILSRFLLERERDPGCFDNKYLRDIILNFVIAGRDTTAGTLAWFLYELCRNQRVQEKIAEEVRAATATGDRDVGAQELVACLTEDAIGKMQYLHAALAETLRLYPAVPMDVKYCFSDDTLPDGYAVNQGDMVNYQPYPMGRMKFLWGADAEEFRPERWLNDDGVFVPESPFKFTAFQAGPRICLGKEFAYRQMKIFAAVLLHLFRLEMWDADATVGYRPMLTLKMDGPLYVRASLRRP

SEQ ID NO: 9543 - protein, 508 aa, Panicum virgatum
MDSPLSRPALLALSLLLLALYLARRHLARGKNRTYPPVAGTVLHQVLNFGRLVEYQTELSRRYPTFRMLTPTCNYVYTVEPANVEYILKTNFANYGKGVMTHDVMEDLLGDGIFNVDGAKWRHQRKVASHEFSTRVLRDYSSAVFRDTAAELAGIVAAAARGAGERLDISDLLMRSTLDSIFEIGFGVNLGSLTGSSEEGAAFARAFDDASEQVLYRFFDLFWKVKRFFSIASEAAMKRSVRTIDGFVYAVIDRKIEQMGRNHQEFAKKEDILSRFLLERERDPGCFDNKYLRDIILNFVIAGRDTTAGTLAWFLYELCRNQRVQEKIAEEVRAATATGDRDVGAQELVACLTEDAIGKMQYLHAALAETLRLYPAVPMDVKYCFSDDTLPDGYAVNQGDMVNYQPYPMGRMKFLWGADAEEFRPERWLNDDGVFVPESPFKFTAFQAGPRICLGKEFAYRQMKIFAAVLLHLFRLEMWDADATVGYRPMLTLKMDGPLFVRASLRRP

SEQ ID NO: 9544 - protein, 509 aa, Panicum virgatum
MDSPPIQPALLALTLVLLLAALYIARRRRARGDNRKYPPVAGTVLHQLLNFGRLVEYQTELSRRYRTFRMLTPACNYVYTVEPANVEYILKTNFANYGKGSTLHDLAEDLLGDGIFNVDGAKWRHQRKVASHEFSTRVLRDYSSAVFRDTAAELAGIVAAAARGAGERLDISDLLMRSTLDSIFKVGFGVSLGVLSGSSEEGAAFARAFDDASEQVLHRFLDPFWKAKRFLNLSSEAAMKRSLRTFNDFVYAVIDRKIEQMGRDQQEFAKKEDILSRFLLERERDPGCFDNKYLRDIILNFVIAGRDSTAGTLVWFLYVLCSNEAVQDRIAEEVRAAATGDRDVGAQELAASLTEDAIGKMQYLHAALTETLRLYPAVPVDVKCCFSDDTLPDGYAVNEGDMVHYQPFPMGRMEFLWGADAEEFRPERWLDGDGGVFVPESSFKFTAFQAGPRVCLGKEFAYRQMKVFAAVLLYLFRFEMWDANATIGYRAMLTLKMDRPLYVRASLRR

SEQ ID NO: 9545 - protein, 512 aa, Setaria italica
MDSLPLSLTVLLPLSLALLLALHLARQRRGAGGKNRKYPPVAGTVLHQLLNYDRLMEYQTELSRRHRTFRVLTPTGNDVYTVDPANVEHVLKTSFADYGKGATMHDVMEDLLGDGIFNVDGDKWRHQRKVASHEFSVRVLRDYSSGVFRDTATELAGIVAAAARGDGGIRVDIADLLMRSTLDSIFKVGFGVNLGSLSGCSKEGAEFARAFDDASEQVMYRFFDLLWKAKRLLNVSSEAAMKRSVRTINDFVYAVIDRKIEQMSSDQQEFAKKEDILSRFLLEREQDPGCFDNKYLRDIILNFVIAGRDTTAGTLAWFLYVLCRNQHIQEKVAREVRTAAATGDRDVGAQEFVASLTEDAISKMQYLHAALTETLRLYPAVPIDLKCCFSDDTLPDGYALKKGDAVHYQPYAMGRMDFLWGADAEEFRPERWLDDDGVFVPESPFKFTVFQAGPRICLGKEFAYRQMKIFAAVLLYLFRFEMWDANTTEGYRPMLTLKMDGPLYVRASPRRA

SEQ ID NO: 9546 - protein, 235 aa, Triticum aestivum
MDSPLSQQPTLLALSLLLLALYLARRALLGKRRNYPPVAGTMLHQLLNFGRLAEYQTELSQRYRTFRMLTPTCSYVYTVEPANVEYILRTNFANYGKGTMTHDVLEDLLGDGIFNVDGAMWRHQRKVASFEFSTRVLREYSSGVFRDTAAGSRASWPPPPPPGRGSTCTTCSCGRRWTRSSRSGSESTSAGCPSPARRARRSPGRSTTPTSRCCTGSSTRSGRPRGCSTSRRRRP

SEQ ID NO: 9547 - protein, 507 aa, Zea mays
MDSPPLQPTVFSLILALVLVLYLALRRRGGGKNRSYPPVAGTVLHQLFNFGRLMEYQTALSRRYRTFRMLTPTCSYIYTVEPANVEYILKTNFGNYGKGSTLHELSEDLLGDGIFNVDGAKWRHQRKVASHEFSTRVLRDYSTGVFRDTAAELAGIVAAAAAAGEKLDMQELLMRSTLDSIFKVGFGVNLGVLSGSSEEGAAFAKAFDDASEQVLHRFLDPFWKAKRFLNLSSEAAMKRSLRTINDFVYAVVDRKIEQMGRDQQEFAKKEDILSRFLVERESDPGCFDNKYLRDIILNFVIAGRDTTAGTLSWFLYVLCKNQSIQDRIAQEVRAATSGDGGGLGAPELVACLTEDAISKMHYLHAALTETLRLYPSVPIDVKCCFSDDTLPDGYAVKKGDMVNYQPYQMGRMRFLWGADAEEFRPERWLDDAGVFVPESPFKFTAFQAGPRVCLGKEFAYRQMKIFAAVLLYLFRFEMWDANATVGYRAMLTLKIDRPLYLRTSLRR

SEQ ID NO: 9548 - protein, 511 aa, Secale cereale
MDSPLNQQPTLLALSLLLLALYLARRALLGKRRNYPPVAGTMLHQLLNFGRLAEYQTELSQRYRTFRMLTPTCNYVYTVEPGNVEYILRTNFANYGKGTMTHDVLEDLLGDGIFNVDGAMWRHQRKVASFEFSTRVLREYSSGVFRDTAAELAGIVAAAAGAGERVDMQDLFMRSTLDSIFTIGFGVSLGALSGSSQESAAFARAFDDANEQVLYRFFDPLWKAKRLLNVSSEAAMKRSVRTINDFVYAVIDRKIEQMGRDEHEFAKKEDILSRFLLEREKDPGCFDNKYLRDIILNFVIAGRDTTAGTLSWFLYVLCRDQRIQDKVAREVREATTGDRQDAGSVQEFVARLTEDAIGSMHYLHAALTETLRLYPAVPVDVKCCFSDDTLPDGHAVSRGDMVNYQPFAMGRMKFLWGDDAEEFRPERWLDDDGVFVPESPYKFTAFQAGPRICLGKEFAYRQMKTFAATLLYLFRFEMWDRGSTVGYRPMLTLKMDGPLYVRASPRRSTGN

SEQ ID NO: 9549 - protein, 508 aa, Hordeum vulgare
MGSPLSQQPTLLALSLLLLALYLARHALLGKRRKYPPVAGTMLHQLFNFGRLAEYQTELSQRYRTFRMLTPTCNYVYTVEPANVEYILRTNFANYGKGTMTHDVLEDLLGDGIFNVDGAMWRHQRKVASFEFSTRVLREYSSGVFRDTAAQLAGIVAAAAAAGERADMQDLFMRSTLDSIFTIGFGVSLGALSGSSQESAAFARAFDDANEQVLYRFFDPLWKAKRLLNVSSEAAMKRSVRTINDFVYAVIDKKMEQMGRDQQEFAKKEDILSRFLLEREKDPGCFDNKYLRDIILNFVIAGRDTSAGTLSWFLYVLCSKQRIQDKIAREVREATTGDRHVGAQELTACLTEDAISNMPYLHAALTETLRLYPAVPIDVKYCFSDDTLPDGHAVRKGDMVNYQPYPMGRMKFLWGDDAEEFRPERWLDGDGVFVPESPYKFTAFQAGPRICLGKEFAYRQMKIFAAVLLYLFRFEMWEGESTVGYRPMLTLKMDGPLNVRASPRRASG

SEQ ID NO: 9550 - protein, 507 aa, Setaria italica
MDSPPSQPALLALTLVLLLALYLARRRRAAGKNRKYPPVAGTVLHQLFNFGRLVEYQTELARRHRTFRMLTPTSNYIYTVEPGNIEYILKTNLANYGKGSALHELAEDLLGDGIFNVDGAKWRHQRKVASHEFSTRVLRDYSSAVFGDTAAELAGIVAAAARGAGERLDISDLLMRSTLDSIFKVGFGVSLGVLSGSSEEGVAFARAFDNASEQVLHRFLDPFWKAKRLLNFSSEAAMKRWLRTINAFIYAVIDRKIEQMGRDQQEFAKKEDILSRFLLERERDPGCFDNKYIRDIILNFVIAGRDTTAGTLSWFLYVLCRNQAIQDRIAEEVRAAATGGRDVGAQELVACLTEDAIGKMHYLHAALTETLRLYPAVPVDVKCCFSDDTLPDGYAVNKGDMVNYQPFPMGRMEFLWGADAEEFRPERWLDGDGVFVTESPFKFTAFQAGPRVCLGKEFAYRQMKIFVAVLLSMYRFEMWDADATVGYRAMLTLKMDRPLYVRASLRR

SEQ ID NO: 9551 - protein, 508 aa, Sorghum bicolor
MDSPPGQPTVVTLILALLLVLYLALRRRAGAGGAKNRSYPPVAGTVLHQLFNFGRLMEYHTELSRRYRTFRMLTPSSSYIYTVEPANVEYILKTNFSNYGKGSKVHEVGEDLLGDGIFSVDGAKWRHQRKVASHEFSTRVLRDYSTGVFRDTAAELAGIVAADAGEKVDMQDLLLRSTLDSIFTVGFGVRLGVLSGSSKEGAAFAKAFDDASEQVLHRFLDPFWKAKRFLNFSLETAMKRSVRTINDFVYAVVDKKIEQMGRDQQEFAKKEDILSRFLVERESDPGCFDNKYLRDIILNFVIAGRDTTAGTLSWFLYVLCRNQHIQDKVAEEVRAAATSGDGDLGAPELVACLTDDAIGKMHYLHAALTETLRLYPAVPIDVKCCFSDDTLPDGYAVNKGDMVHYQPYQMGRMQFLWGADAEEFRPERWLDDGGVFVPESPFKFTAFQAGPRVCLGKEFAYRQMKIFAAVLLYLFRFEMWDANATVGYRAMLTLKMDGPLYVRASLRR

SEQ ID NO: 9552 - protein, 511 aa, Brachypodium distachyon
MDSLLALSLLLLALYLARRALLGNKGRKNYPPIAGTVLHQLLNFGRLVEYQTELSRKHRTYRMLTPTCSYVYTVEPANVEHILRTNFANYGKGAMTHDVLEDLLGDGIFNVDGAKWRHQRKAASFEFSTRVLREYSTGVFRDTAAELAGIVAVAAARGERAVDMQDLLMRSTLDSIFQIGFGVRLGALSGSNEEGAAFARAFDDASEQVLYRFFDLLWKAKRLLNVSSEAAMKRSVRTINDFVYAVIDKKIEQMARDQHEFAKKEDILSRFLLEREKDPGCFDNKYLRDIILNFVIAGRDTSAGTLSWFLYVLCNNQHIQDKVAREVREATGTGDSDAAPAGVQEFIECLDEDAISKMQYLHAALTETLRLYPAVPIDVKYCFSDDTLPDGHAIRKGDMVNYQPYPMGRMKFLWGDDAEEFRPERWLDDDGAFVPESPYKFTAFQAGPRICLGKEFAYRQMKIFAAVLLYLFRFEMWERNSTMGFRPMLTLKMDGPLNVRVLPRRPSGQLA

SEQ ID NO: 9553 - protein, 514 aa, Zea mays
MMKGGGGKETLTASFLRFLLLLLLPLTALYFFYTLHLLLTSASSAASNCAPDAVSVSRMSANLTAVAEKQLPPSTVAGSTSTTLQHVVFGIAASSRFWDKRKEYIKVWWRPRGAMRGYVWLDRKVRESNMSTARTGLPAIRISSDTSAFPYTHRRGHRSAIRISRIVSETFRLGLPGVRWFVMGDDDTVFFPDNLLTVLNKFDHRQPYYIGSLSESHLQNIYFSYGMAYGGGGFAISRPLAEALARMQDGCLRRYPALYGSDDRIQACMAELGVPLTKHPGFHQYDVYGDLLGLLASHPVAPIVTLHHLDVVKPLFPDARSRPSAVRRLFDGPVKLDTAGLMQQSICYDSANRWTVSVAWGFTVLVARGIMSPREMEMPARTFLNWYRRADYTAYAFNTRPLARSPCQKPAVYYLSSARREALRGGETTVTRYERWRHPNETRPACRWDITDPDAHLDHIIVLKKPDPGLWERSPRRNCCRVVSSPKDGKSGEKTMTIDVGVCREGEFSQVAGA

SEQ ID NO: 9554 - protein, 513 aa, Zea mays
MMKGGGGKETLTASFLRFLLLLLLPLTAFYFLYTLQLLLTSASSAASNCVPDAVSVSRVSANLTAAEKQLPPPAAAVSTATTLQHVVFGIAASSRFWDKRKEYIKVWWRPRGAMRGYVWLDRKVRESNMSTARTGLPDIRISSDTSAFPYTHRRGHRSAIRISRIVSETFRLDLPGVRWFVMGDDDTVFFPDNLLTVLNKFDHRQHYYIGSLSESHLQNIYFSYGMAYGGGGFAISRPLAEALARMQDGCLRRYPALYGSDDRIQACMAELGVPLTKHPGFHQYDVYGDLLGLLASHPVAPIVTLHHLDVVKPLFPEVRSRAAAVRRLFDGPVKLDTAGLMQQSICYDGANRWTVSVAWGFTVLVARGIMSPREMEMPARTFLNWYRRADYTAYAFNTRPLARSPCQKPAVYYLSSARRAALRGGVTTETRYDRWRHPNETRPACRWDITDPDAHLDHIVVLKKPDPGLWDRSPRRNCCRVVSSPKDGKNGEKTMTIDVGVCREGEFSQVAGA

SEQ ID NO: 9555 - protein, 527 aa, Setaria italica
MKGGGGKETVTATLLRFLLLLLLPLTALYFFYTLHLLLTSASSSAASNCMPDSTAAAATTASVSVSRMSANLTAAAVEAEKRPTAAAAASTATTLQHVVFGIAASSRFWDKRKDYIRVWWRPRGAMRGYVWLDRAVRESNMSTARTGLPAIRISSDTSAFPYTHRRGHRSAIRISRIVSETFRLGLPGVRWFVMGDDDTVFFPDNLLAVLNKFDHRQPYYIGSLSESHLQNIYFSYGMAYGGGGFAISRPLAEALSRMQDGCLRRYPALYGSDDRIQACMAELGVPLTKHPGFHQYDVYGDLLGLLASHPVAPIVTLHHLDVVKPLFPDARSRPAAVRRLFDGPVKLDAAGLMQQSICYDGANRWTVSVAWGFAVLVARGVMSPREMEMPARTFLNWYRRADYTAYAFNTRPLARSPCQKPAVYYLSSSARRAAERGGGETTVTRYERWRHPNETRPACRWDIADPDAHLDHIVVLKRPDPGLWDRSPRRNCCRVVSSPKEGKNGEKTMTIDVGVCREGEFSQVAGV

SEQ ID NO: 9556 - protein, 515 aa, Panicum virgatum
MKGGGGKETVTATFLRSLLLLLLPLTALYFFYTLHLLLATASPAASNCPPDSSVSVSRASANLTAAAEEKRPGSAAAAPAATTLRHLVFGIAASSRLWDKRKEYIKVWWRPRGAMRGYVWLDRAVRESNMSTARTGLPAIRISSDTSAFPYTHRRGHRSAIRISRIVSETSRLGLPGVRWFVMGDDDTVFFPDNLLTVLNKFDHRQPYYIGSLSESHLQNIYFSYGMAYGGGGFAISRPLAEALARMQDGCLHRYPALYGSDDRIQACMAELGVPLTKHPGFHQYDVYGDLLGLLAAHPVAPLVTLHHLDVVKPLFPDARSRPAAVRRLFDGPVKLDTAGLMQQSICYDGDNRWTVSVAWGFAVLVARGVMSPREMEMPARTFLNWYPRADYTAYAFNTRPMARSPCQKPAVYYLSSARRAADRGGGETTVTRYERWRHPNETRPACRWDIADPDAHLDHIVVFKRPDPGLWDRSPRRNCCRVVSSPMEGKSGDKKMTIDVGVCREGEFSQVAAV

SEQ ID NO: 9557 - protein, 295 aa, Zea mays
MAYGGGGFAISRPLAEALAQMQDGCLRRYPALYDSDDRIQACMAELGVPLTKHLGFHQYDMYGDLLCLLASHPVAPIVTLHHLDVVKPLFPDARSCPSVVRRLFDGPVKLDTAGLMQQSICYDSTNRWTVSVAWGFTVLVVRGIMSPREMEMLARTFLNWYRRADYTTYAFNTRPLARSPCQKPAVYYLSSARHEALRGGETTVTRYERWRHPNETRPACRWDITDPDAHLDHIIVLKKPDPGLWERSPRRNCCRVVSSPKDGKSWEKTMTIDVGICREGEFSQVAGALAFIRDR

SEQ ID NO: 9558 - protein, 203 aa, Zea mays
MAELGVLLTKHLGFHQYDVYGDLLGLLASHPVAPIVMLHHLDVVKPLFPDARSRPSAVRRLFDGPVKLDTAGLMQQSICYDSANRWTVSVAWGFTVLVVRGIMSPREMEMSARTFLNWYRRADYTAYAFNTRPLARSPCQKPVVYYLSSEQREALHGGETTVTRYERWRHPNETRPACRWDITDPDAHLDHIIVLKKPDPRLW

SEQ ID NO: 9559 - protein, 524 aa, Oryza sativa
MKGGGGGGKEAVTASILRFLLLLLLPLTALYFFYTLHLLLASAASSSSSSCPPDAASSSSSVRLSTNGTSAGAAAVTVAAGKKAPAAASTETTLQHVVFGIAASSRFWDKRKEYIKVWWRPRGAMRGYVWLDREVRESNMSTARTGLPAIRISSDTSGFPYTHRRGHRSAIRISRIVSETFRLGLPGVRWFVMGDDDTVFFPDNLLTVLNKFDHRQPYYIGSLSESHLQNIYFSYGMAYGGGGFAISRPLAEALARMQDGCIRRYPALYGSDDRIQACMAELGVPLTKHPGFHQYDVYGDLLGLLAAHPVAPIVTLHHLDVVQPLFPNAKSRPAAVRRLFDGPIELDPAGIMQQSICYDGGNRWTVSVAWGFAVLVSRGVMSPREMEMPARTFLNWYRRADYTAYAFNTRPLARSPCQKPAVYYLSSARRAAALRGGDTTVTRYERWRRANETRPACRWNIADPDAHLDHIVVLKKPDPGLWDRSPRRNCCRVLSSPKEGKKGGDKTMTIDVGVCRDGEFSQVV

SEQ ID NO: 9560 - protein, 518 aa, Triticum aestivum
MKGGSGGGKESATGSFLRFLLLLLLPLTALYFFYTLHLLLASAASSSAASCPPDPTAVSSRVSTNRTAAAVVDNKAAPAAAAASTATTLQHVVFGIAASSRFWDKRKEYIKVWWRPRGAMRGYVWLDREVRESNMSTARTGLPAIKISSDTSAFPYTHRRGHRSAIRISRIVSETFRLGLPGVRWFVMGDDDTVFFPDNLLTVLNKFDHRQPYYIGSLSESHLQNIYFSYGMAYGGGGFAISRPLAEALARIQDGCISRYPALYGSDDRIQACMAELGVPLTKHPGFHQYDVYGDLLGLLAAHPVAPIVTLHHLDVVQPLFPNAPARPAAVRRLFSGPVKLDPAGIMQQSICYDGANRWTVSVAWGFAVLVSRGVTSPREMEMPARTFLNWYRRADYTAYAFNTRPLARTPCHKPAVYYLSSARSAEAARGGETTVTRYERWRPANETRPACRWNITDPDAHLDHIVVLKRPDPGIWDRSPRRNCCRVLSSPKVGKEGKKTMTIDVGVCRDGEFSQVV

SEQ ID NO: 9561 - protein, 516 aa, Hordeum vulgare
MKGGGGGGGGKETVTGSFLRFLLLLLLPLTALYFFYTLHLLLASAASSSSAASCPPDSAAVTSRVSTNRTAAAVVDNKAAASTATTLQHVVFGIAASSRFWDKRKEYIKVWWRPRSAMRGYVWLDREVRESNMSTARTGLPAIKISSDTSAFPYTHRRGHRSAIRISRIVSETFRLGLPGVRWFVMGDDDTVFFPDNLLTVLNKFDHRQPYYIGSLSESHLQNIYFSYGMAYGGGGFAISRPLAEALARIQDGCIRRYPALYGSDDRIQACMAELGVPLTKHPGFHQYDVYGDLLGLLAAHPVAPIVTLHHLDVVQPLFPNAPARPAAVRRLFNGPVKLDPAGIMQQSICYDGANRWTVSVAWGFAVLVSRGVTSPREMEMPARTFLNWYRRADYTAYAFNTRPLARTPCHKPAVYYLSSARGAEAALGGETTVTRYDRWRPANETRPACRWNITDPDAHLDHIVVLKRPDPGIWDRSPRRNCCRVLSSPKVGKEGKKTMTIDVGVCRDGEFSQVV

SEQ ID NO: 9562 - protein, 520 aa, Brachypodium distachyon
MKGGGGGGKETATGSFLRFLLLLLLPITALYFFYTLHLLLASAASSSASSSSSSCTPDSLAISRRTFTNRTASENDKAAPAAAAAASMAPTTLQHVVFGIAASSRFWDKRKEYIKVWWRPRGAMRGYVWLDREVRESNMSTARTGLPAIKISSDTSAFPYTHRRGHRSAIRISRIVSETFRLGLPGVRWFVMGDDDTVFFPENLLTVLNKFDHRQPYYIGSLSESHLQNIYFSYGMAYGGGGFAISRPLAEALARIQDGCIRRYPALYGSDDRIQACMAELGVPLTKHPGFHQYDVYGDLLGLLAAHPVAPIVTLHHLDVVQPLFPRAASRPAAVRRLFNGPVRLDQSGIMQQSICYDGANRWTVSVAWGFAVLVSRGVTSPREMEMPARTFLNWYRRADYTAYAFNTRPLARTPCHKPAVYYMSSAARSAAGAGGGETTVTRYERWRPANETRPACRWNITDPDAHLDHIVVLKKPDPGIWDRSPRRNCCRVLTSPKEGKKTMTIDVGVCREGEFSQVV

SEQ ID NO: 9563 - protein, 399 aa, Zea mays
MASEGNKDVPHEALTVDHSSISGSKRKRGRPRKYEYPVNELPQKVQPIQSAPPLLHCTQDGSSLASHASGGGAHGNWSAQPRNSANASLQGNSGKDDFLGKHFVGKLTKKVPGFSLITVKVKDNQVLKGWVPDEINLRPITPKDDLAPELPMLRPSQVRKRASAIHMQPALPVPMHLENVTLAKPLQMRRPVEKTIAKHAVPLASRPYISSGVVAAIPISVAPINPEMRTSARQDAELVIPQSSVSAVPIKFVCPASVPCKQLANQNEFTGNKSVDEVQKDSESPNVTKESPVKAEKPNIALVDVVAKDSLGEGQQLNDQVTDVVRDFSGQTQNVDVTMSDEIKIASGARDKPNSANCEQQSSKEPSDITEQSEQLKTETDVQKGVDASDDIHPAHDEQ

SEQ ID NO: 9564 - protein, 303 aa, Zea mays
MPSTSLAVPTGAVGVAGSRRYPFISNRSASSAPRLRRAPRLVMVSASASLEALIFDCDGVILESEHLHRQAYNDAFANFGVRCPPGSADLLYWDEAFYDNLQNRIGGGKPKMRWYFGENGWPPSKIFETPPSTDSDKEKLVDIIQDWKTERYKEIINSGTVKPRPGVLQLMDEVKDAGIKLAVCSAATKSSVIMCLENLIGLERFNGLDCFLAGDDVKLKKPDPTIYITASEKLGVESKNCLVVEDSVIGLQAAKGAGMSCIITYTPSTASQDFKDAIATYPDLNNVRLEDLKLLLQKTLVTG

SEQ ID NO: 9565 - protein, 312 aa, Panicum virgatum
MASTSLFLPTTAGAATARRHPFSSLRTTHYQVPSTRLHRAPRLVVVSAAASPASPASSLDALIFDCDGVILESENLHRQAYNDAFAHFGVRCPPASADPLYWDEAFYDELQNRIGGGKPKMRWYFGENGWPSSKIFETPPSTDSDKEKLVDIIQDWKTERYKETIKSGTVEPRPGVLRLMDEVKGAGIKLAVCSAATKSSVIMCLENLIGLERFNGLDCFLAGDDVKLKKPDPTIYITAAEKLGVESKNCLVVEDSVIGLLAAKGAGMSCIITYTPSTASQDFTDAIATYPDLSNVRLEELKLLLQKTLVTG

SEQ ID NO: 9566 - protein, 312 aa, Panicum virgatum
MASTSLFLPTAAGASTARRRPFSSLRTPYQVPTARLHRAPRLAVVSAAASPASPASSSLDALIFDCDGVILESENLHRQAYNDAFAHFGVRCPPASADTLYWDEAFYDELQNRIGGGKPKMRWYFGENGWPSSKIFETPPSADSDKEKLIDIIQDWKTERYKEIIKSGTVEPRPGVLQLMDEVKGAGIKLAVCSAATKSSVIMCLENLIGLERFNGLDCFLAGDDVKLKKPDPTIYITAAEKLGVESKNCLVVEDSVIGLLAAKGAGMSCIITYTPSTASQDFTDAIATYPDLSNVRLEDLKLLLQKTLVTG

SEQ ID NO: 9567 - protein, 313 aa, Setaria italica
MAWTSLFLPTTAGATAAATGSRHPSFSHRSHCRVPMTRLRRAPRLVVSASASPASPASSLDALIFDCDGVILESEHLHRQAYNDAFAHFGVRCPPASADPLYWDEAFYDELQNRIGGGKPKMRWYFGENGWPSSNIFETPPSTDSDKEKLVDIIQDWKTERYKEIIKSGTVEPRPGVLRLMDEVKGAGIKLAVCSAATKSSVIMCLENLIGLERFKGLDCFLAGDDVKLKKPDPTIYVTAAEKLGVQSKNCLVVEDSVIGLLAAKGAGMSCIITYTPSTASQDFTDAIATYPDLSDVRLEDLKLLLQKTLVTG

SEQ ID NO: 9568 - protein, 315 aa, Festuca arundinacea
  misc_feature (307)..(307): Xaa can be any naturally occurring amino acid
MPPMASTSLFIPASFAPATAVASARRSFSSHRSSPSTVPSVRLRRASSSLVVFASASPPRSLDALIFDCDGVILESEHLHRQAYNDAFAHFGVRCPPAANAPLDWDEAFYDILQNRIGGGKPKMRWYFGENGWPSSNIFETPPSSDSDKEKLVDIIQDWKTERYKEIIKSGTVEPRPGVLRLMDEVRGAGIKLAVCSAATKSSVVLCLENLIGLERFTGLDCFLAGDDVKQKKPDPSIYVTAAKKLGVESKNCLVVEDSVIGLQAAKGAGMSCIITYTPSTANQDFKDAIATYPDLSNARLEDLKLXLQESLITG

SEQ ID NO: 9569 - protein, 312 aa, Triticum aestivum
MASTSLLVPTSFTPAAVAATARRSFFSHRPPSSLPAVRLRLPRTSSLVVSASASPPRSLDALIFDCDGVILESEHLHRQAYNDAFAHFGVRCPPAADAPLYWDEAFYDDLQNRIGGGKPKMRWYFGENGWPSSKILETAPSSDEDREKLVDVIQDWKTERYKAIIKSGTVEPRPGVLRLMDEVKGAGIKLAVCSAATKSSVVLCLENLLGLERFNGLDCFLAGDDVKVKKPDPSIYITAAKKLGLESKNCLVVEDSVIGLQAAKGAGMSCIITYTPSTSNQDFKDAIATYPDLSNVRLEDLKLLLQESLVTG

SEQ ID NO: 9570 - protein, 314 aa, Brachypodium distachyon
MASTSLLTPVSFPTAAATARRSFSTHRSPSGALPRLRLRPRSRRASGLAVSASAASPPLSLDALIFDCDGVILESEHLHRQAYNDAFAHFGVRCPPAADAPLDWDEAFYDDLQNRIGGGKPKMRWYFGENGWPSSKLFETPPSSDSDKEKLVDIIQDWKTERYKEIIKSGTVEPRPGVLRLMDEVKGAGIKLAVCSAATKSSVVLCLENLIGLERFNGLDCFLAGDDVKLKKPDPSIYITAAKKLGVESKNCLVVEDSVIGLQAAKGAGMSCIITYTPSTANQDFKDAIATYPDLSNVRFEDLRLLLQEAVVTG

SEQ ID NO: 9571 - protein, 123 aa, Saccharum officinarum
MDILLGSGRFLARRPPLALVPRCSRGSPDKSGSDKGETSTDWDKAWTTFKNKGKRTLFSDFSPNKYVTWNPRRSEYPLSEEVDPIKRTERSNLMLWTSPQFTLVGAIIIVLTLLIYTLVVPPK

SEQ ID NO: 9572 - protein, 123 aa, Pennisetum glaucum
MDILLGSGRFLARRPPLALVPRCSRGTPDKGGSDKGETSTDWDKAWSSFKNKGKRTLFSDFSPNKYVTWNPRRSEYPLSEEVDPIKRTERSNLMLWTSPQFTLVGAIIIVLTLLIYTLVVPPK

SEQ ID NO: 9573 - protein, 119 aa, Triticum aestivum
MDILLGSGRFLARRLPPLALVPRCSRGSPDKSGSDKGETSTDWDKAWASFKNKGKRTLFSDFSPNKYVTWNPRRSEYPLSEEVDPIKRTERSNLMLWTSPQFTLVGAIIIVLTLLIYTL

SEQ ID NO: 9574 - protein, 123 aa, Setaria italica
MDILLGSGRFLARRPPLALVPRCSRGTPDKGGSDKGETSTDWDKAWSTFKNKGKRTLFSDFSPNKYVTWNPRRSEYPLAEEVDPIKRTERSNLMLWTSPQFTLVGAIIIVLTLLIYTIVVPPK

SEQ ID NO: 9575 - protein, 123 aa, Panicum virgatum
MDILLGSGRFLARRPPLALVPRCSRGTPDKGPSDKGETSTDWDKAWSTFKKKGKRTLFSDFSPNKYVTWNPRRSEYPLSEEVDPIKRTERSNLMLWTSPQFTLVGAIIIVLTLLIYTLVVPPK

SEQ ID NO: 9576 - protein, 123 aa, Panicum virgatum
MDILLGSGRFLARRPPLALVPRCSRGTPDKGPSDKGETSTDWDKAWSTFKKKGKRTLFSDFSPNKYVTWNPRRSEYPVSEEVDPIKRTERSNLMLWTSPQFTLVGAIIIVLTLLIYTLVVPPK

SEQ ID NO: 9577 - protein, 124 aa, Zea mays
MDVLLGSGRFLARRPPLALVPRCSRGSPDKSGSDKGETSADWDKAWSAFKKKGKRTLFSDFSPDKYVTWNPRRSEYPLSEEVDPIKRTERSNLMLWTSPQFTLVGAIIIVLTLLIYTLVVPPPK

SEQ ID NO: 9578 - protein, 67 aa, Panicum virgatum
MDILLGSGRFLARRPPLALVPRCSRGTPDKGPSDKGKRSLPTGTRLGPHLRRKGKEPYFQISHQTSM

SEQ ID NO: 9579 - protein, 123 aa, Zea mays
MDILLGSGRFLARRTPLMLVPRCSRGSRDRSGSDKGETSADWDKAWAKFKKKGKRTLFSDFSPDKYVTWNPRRSEYPLSEEVDPIKRTERSNLMLWTSPQFTLVGAIIIVLTLLIYTLVVPPK

SEQ ID NO: 9580 - protein, 124 aa, Zea mays
MDVLLGSGRFLARRPPLALVPRCSRGSPDKSGSDKGETSADWDKAWSAFKKKGKRTLFSDFSPDKYVTWNPQRSEYPLSEEVDPIKRTERSNLMLWTSPQFTLVGAIIIVLTLLIYTLVVPPPK

SEQ ID NO: 9581 - protein, 124 aa, Zea mays
MDVLLGSGRFLARRPPLALVPRCSRGSPDKSGSDKGETSADWDKAWSAFKKKGKRTLFSDFSPDKYVIWNPRRSEYPLSEEVDPIKRSERSNLMLWTSPQFTLVGAIIIVLTLLIYTLVVPPPK

SEQ ID NO: 9582 - protein, 123 aa, Cynodon dactylon
MDILLGSGRFLARRTPLALVPRCSKGRPDKGGRDKGNTSTDWDKAWTTFKNKGKRTLFSDFSPDKYVSWNPRRSEYPLSEEVDPIKRTERSNLMLWTSPQFTLVGAIIIVLTLLIYTLVVPPK

SEQ ID NO: 9583 - protein, 57 aa, Sorghum bicolor
MQHLGSSQTSDFSSFRLEQFPSFDSCGLLQCRSNKKEIGSVLKLQTIILAFLRYQAV

SEQ ID NO: 9584 - protein, 124 aa, Triticum aestivum
MGILLVSGRFLARRPPLALAPRCSRGSPDKRGRDEGDTSSTDWDKAWSTFKKKGKKTLFSEFSPNKYVTWNPRRSEYPLSEEVDPIKRAERSNLMLWTSPRFTLVGAIIIVSALLIYTLVVPPK

SEQ ID NO: 9585 - protein, 125 aa, Unknown
  Sequence found in Organisms: Oryza sativa, Triticum aestivum
MDTLLGSGRFLARRPPLALAPRCSRGSPEKGGGSDKGDTSSTDWDKAWSTFKKKGKKTLFSEFSPNKYVSWNPRRSEYPLSEEVDPIRRTERSNLMLWTSPKFTLVMAIVIVSTLLIYTIVVPPK

SEQ ID NO: 9586 - protein, 124 aa, Brachypodium distachyon
MGILLVSGKFLARRPPLSLAPRCSRGSPDKGGSDKGDTSSTDWDKAWSTFKKKGKKTLFSEFSPNKYVTWNPQRSEYPLSEEVDPIKRAEKSNLMLWTSPTFTLVGAIIIVLALLIYTLVVPAK

SEQ ID NO: 9587 - protein, 124 aa, Secale cereale
MGILLVSGRFLARRPPLALAPRCSRGSPDKRGRDEGDTSSTDWDKAWSTFKKKGKKTLFSEFTPNKYVTWNPPRSEYPLSEEVDPIKRAERSNLMLWTSPRFTLVGAIIIVSALLIYTLVVPPK

SEQ ID NO: 9588 - protein, 124 aa, Hordeum vulgare
MGILLVSGRFLARRPALALAPRCSRGSPDKRGRDEGDTSSTDWDKAWSTFKKKGKKTLFSEFTPNKYVTWNPRRSEYPLSEEVDPIKRAERSNLMLWTSPRFTLVGAIIIVSALLIYTIVVPPK

SEQ ID NO: 9589 - protein, 124 aa, Triticum aestivum
MGILLVSGRFLARRPALALAPRCSRGSPDKRGRDEGDSSSTDWDKAWSTFKKKGKKTLFSEFSPNKYVTWNPRRSEYPLSEEVDPIKRAERSNLMLWTSPRFTLVGAIIIISALLIYTLVVPPK

SEQ ID NO: 9590 - protein, 124 aa, Avena sativa
MGILLVSGRFLARRPSLALAPRCSGGSPDKRGRDEGDTSSTDWDKAWSTFKKKGKKTLFSEFSPNKYVTWNPRRSEYPLSEEVDPIKRAERSNLMLWTSPRFTLVGAIIIVLALLIYTILVPAK

SEQ ID NO: 9591 - protein, 194 aa, Saccharum officinarum
MATSFQGTTTKCTACDKTVYLVDKLTADNRIYHKACFRCHHCKGTLKLANYNSFEGVLYCRPHFDQLFKRTGSLDKSFEGTPKVVKPERNAGNENAVKVSSAFAGTREKCVGCSKTVYPIERVTVNNTMYHKSCFKCCHGGCTISPSNYIAHEGKLYCKHHHIQLIKEKGNFSQLENDHEKTSQAGSLEDEEEY

SEQ ID NO: 9592 - protein, 195 aa, Zea mays
MATSFQGTTTKCTACDKTVYLVDKLTADNRIYHKACFRCHHCKGTLKLANYNSFEGVLYCRPHFDQLFKRTGSLDKSFEGTPKVVKPERNVGNENATKVSSAFAGTREKCVGCSKTVYPTERVTVNNTMYHKSCFKCCHGGCTISPSNYIAHEGKLYCKHHHIQLIKEKGNFSQLENDHEKTSQAGSLEEDEQEY

SEQ ID NO: 9593 - protein, 195 aa, Setaria italica
MATSFQGTTTKCTACDKTVYLVDKLTADNRVYHKACFRCHHCKGTLKLANYNSFEGVLYCRPHFDQLFKRTGSLDKSFEGTPKVVKPERNVENENAIKVSSVFAGTREKCVGCSKTVYPIERVTVNNTMYHKSCFKCCHGGCTISPSNYIAHEGKLYCKHHHIQLIKEKGNFSQLENDHEKTSQAGSLEDEEAEY

SEQ ID NO: 9594 - protein, 195 aa, Saccharum officinarum
MATSFQGTTTKRTACDKTVYLVDKLTADNRIYHKACFRCHHCKGTLKLANYNSFEGVLYCRPHFDQLFKRTGSLDKSFEGTPKVVKPERNVGNENATKVSSAFAGTREKCVGCSKTVYPTERVTVNNTMYHKSCFKCCHGGCTISPSNYIAHEGKLYCKHHHIQLIKEKGNFSQLENDHEKTSQAGSLEEDEHEY

SEQ ID NO: 9595 - protein, 193 aa, Panicum virgatum
MATSFQGTTTKCTACDKTVYLVDKLTADNRVYHKACFRCHHCKGTLKLANYNSFEGVLYCRPHFDQLFKRTGSLDKSFEGTPKVVKPERKNENAIKVSSAFAGTREKCVGCSKTVYPIERVTVNNTMYHKSCFKCCHGGCTISPSNYIAHEGKLYCKHHHIQLIKEKGNFSQLENDHEKTSQAGSLEDEEAEY

SEQ ID NO: 9596 - protein, 195 aa, Pennisetum glaucum
MATSFQGTTTKCTACDKTVYLVDKLTADNRVYHKACFRCHHCKGTLKLANYNSFEGVLYCRPHFDQLFKRTGSLDKSFEGTPKVVKPERNVDNENAIKVSSVFAGTREKCVGCSKTVYPIERVTVNNTMYHKSCFKCCHGGCTISPSNYIAHEGKLYCKHHHIQLIKEKGNFSQLENDHEKTSQAGSLEDEEADY

SEQ ID NO: 9597 - protein, 193 aa, Panicum virgatum
MATSFQGTTTKCTACDKTVYLVDKLTADNRVYHKACFRCHHCKGTLKLANYNSFEGVLYCRPHFDQLFKRTGSLDKSFEGTPKVVKPERKNENAIKVSTAFAGTREKCVGCSKTVYPIERVTVNNTMYHKSCFKCCHGGCTISPSNYIAHEGKLYCKHHHIQLIKEKGNFSQLENDHEKTSQAGSLEDEEAEY

SEQ ID NO: 9598 - protein, 196 aa, Zea mays
MATSFQGTTTKCTACDKTVYLVDKLTADNRVYHKACFRCHHCKGTLKLANYNSFDGVLYCRPHFDQLFKRTGSLDKSFQGTPKVVKPERNVGNENATKVSSAFAGTREKCVGCSKTVYPIERVTVNNTMYHKCCFKCCHGGCTISPSNYIAHEGKLYCKHHHVQLIKEKGNFSQLENDHEKTSQAGSLEDDEEEEY

SEQ ID NO: 9599 - protein, 196 aa, Triticum aestivum
MATSFQGTTTKCNACDKTVYLVDKLTADNRVYHKACFRCHHCKGTLKLANYNSFEGVLYCRPHFDQLFKRTGSLDKSFEGTPKVVKPERNVGNENATKVSSAFAGTREKCFGCSKTVYPIERVTVNNTMYHKSCFKCCHGGCTISPSNYIAHEGKLFCKHHHTQLIKEKGNFSQLENDHDKTSQSAGSVDDEDSEY

SEQ ID NO: 9600 - protein, 196 aa, Hordeum vulgare
MATSFQGTTTKCNACDKTVYLVDKLTADNRVYHKACFRCHHCKGTLKLANYNSFEGVLYCRPHFDQLFKRTGSLDKSFEGTPKVVKPERNVGNENAIKVSSAFAGTREKCFGCSKTVYPIERVTVNNTMYHKSCFKCCHGGCTISPSNYIAHEGKLFCKHHHTQLIKEKGNFSQLENDHDKTSQSAGSVDDEDSEY

SEQ ID NO: 9601 - protein, 196 aa, Brachypodium distachyon
MATSFQGTTTKCNACDKTVYLVDKLTADNRVYHKACFRCHHCKGTLKLANYNSFEGVLYCRPHFDQLFKRTGSLDKSFEGTPKVVKPERNVENENAIKVSSAFAGTREKCVGCNKTVYPIERVTVNNTMYHKSCFKCCHGGCTISPSNYIAHEGKLFCKHHHIQLIKEKGNFSQLENDSEKTSQSAGSVDDEESDY

SEQ ID NO: 9602 - protein, 195 aa, Oryza sativa
MATSFQGTTTKCMACDKTVYLVDKLTADNRVYHKACFRCHHCKGTLKLANYNSFEGVLYCRPHFDQLFKRTGSLDKSFEGTPKVVKPEKTVENENAIKVSSAFAGTREKCVGCNKTVYPIERVTVNNTMYHKSCFKCCHGGCTISPSNYIAHEGKLYCKHHHIQLIKEKGNFSQLENDHEKASQSGSVEDEDSEY

SEQ ID NO: 9603 - protein, 196 aa, Triticum aestivum
MATSFQGTTTKCNACDKTVYLVDKLTADNRVYHKACFRCHHCKGTLKLANYNSFEGVLYCRPHFDQLFKRTGSLDKSFEGTPKVVKPERNVGNENATKVSSAFAGTREKCFGCTKTVYPIERVTVNNTMYHKSCFKCCHGGCTISPSNYIAHEGKLFCKHHHTQLIKEKGNFSQLENDHDKTSQSAGSVDDEDSEY

SEQ ID NO: 9604 - protein, 196 aa, Pseudoroegneria spicata
MATSFQGTTTKCNACDKTVYLVDKLTADNRVYHKACFRCHHCKGTLKLANYNSFEGVLYCRPHFDQLFKRTGSLDKSFEGTPKVVKPERNVGNENAIKVSSAFAGTREKCFGCNKTVYPIERVTVNNTMYHKSCFKCCHGGCTISPSNYIAHEGKLFCKHHHTQLIKEKGNFSQLENDHDKTSQSAGSVDDEDSEY

SEQ ID NO: 9605 - protein, 196 aa, Triticum aestivum
MATSFQGTTTKCNACDKTVYLVDKLTADNRVYHKACFRCHHCKGTLKLANYNSFEGVLYCRPHFDQLFKRTGSLDKSFEGTPKVVKPERNVGNENAIKVSSAFAGTREKCFGCTKTVYPIERVTVNNTMYHKSCFKCCHGGCTISPSNYIAHEGKLFCKHHHTQLIKEKGNFSQLENDHDKTSQSAGSVDDEDSEY

SEQ ID NO: 9606 - protein, 196 aa, Secale cereale
MATSFQGTTTKCNACDKTVYLVDKLTADNRVYHKACFRCHHCKGTLKLANYNSFDGVLYCRPHFDQLFKRTGSLDKSFEGTPKVVKPERNVGNENAIKVSSSFAGTREKCFGCTKTVYPIERVTVNNTMYHKSCFKCCHGGCTISPSNYIAHEGKLFCKHHHTQLIKEKGNFSQLENDHDKTSQSAGSVDDEDSEY

SEQ ID NO: 9607 - protein, 195 aa, Eragrostis curvula
  misc_feature (7)..(7): Xaa can be any naturally occurring amino acid
  misc_feature (86)..(87): Xaa can be any naturally occurring amino acid
  misc_feature (106)..(106): Xaa can be any naturally occurring amino acid
MATKIQXTTTKCTACDKTVYLVDKLTADNRIYHKACFRCHHCKGTLKLANYNSFEGVLYCRPHFDQLFKRTGSLDKSFEGTPKVVXXERTVENENAIKVSSAFAGXREICVGCSKKVYPIERVTVNGTMYHKSCFKCCHGGCTISPSNYIAHEGKLYCKHHHIQLIKEKGNFSQLENDQEKASQAGSLEDEESDY

SEQ ID NO: 9608 - protein, 191 aa, Festuca arundinacea
MATSFQGTTTKCNACDKTVYLVDKLTADNRVYHKACFRCHHCKGTLKLANYNSFEGVLYCRPHFDQLFKRTGSLDKSFEGTPKVVKPERNVENENAIKVSSSFAGTREKCFGCSKTVYPIERVTVNNTMYHKSCFKCSHGGCTISPSNYIAHEGKLFCRHHHTQLIKEKGNFSQLENDHEKSSQSAGSVDD

SEQ ID NO: 9609 - protein, 196 aa, Avena sativa
MATSFQGTTTKCNACDKTVYLVDKLTADNRVYHKACFRCHHCKGTLKLANYNSFEGVLYCRPHFDQLFKRTGSLDKSFEGTPKVVKPERNLENENAIKVSSSFAGTREKCFGCSKTVYPIERVTVNNTMYHKSCFKCSHGGCTISPSNYIAHEGKLFCRHHHTQLIKEKGNFSQLENDQEKSSQSAGSVDEEESEY

SEQ ID NO: 9610 - protein, 196 aa, Cynodon dactylon
MATSFKGTTTKCTACDKTVYLVDKLTADNRVYHKACFRCHHCKGSLKGIVICKLEGVLYCRPHFDQLFKRTGSLDKSFEGTPKVVKPERNVENENAIKVSSAFAGTREICVGCNKKVYPIERVTVNGTMYHKSCFKCCHGGCTISPSNYVAHEGKLYCKHHHVQLIKEKGNFSQLENDHEKASQAGSMEDDEESEY

SEQ ID NO: 9611 - protein, 187 aa, Musa acuminata
MAFQGTTTKCMACDKTVYLVDKLTADNRVYHKACFRCHHCKGTLKLGNYNSFEGVLYCRPHFDQLFKMTGSLDKSFEGTPKVVKPEKYVDNENANKVSSAFAGTQEKCVGCSKTVYPIERVTVNGTAYHKSCFKCCHGGCVISPSNYIAHEGKLYCKHHHIQLFKEKGNYSQLENDEAEAKSESSAA

SEQ ID NO: 9612 - protein, 193 aa, Musa acuminata
MAFQGTTTKCTACDKTVYLVDKLTADNRIYHKACFRCHHCKGTLKLGNYNSFEGVLYCRPHFDQLFKMTGSLDKSFEGTPKIVKPEKHVENENASKVSSAFAGTREKCVGCNKTVYPIERVTVNGTAYHKSCFKCSRGGCVISPSNYIAHEGRLYCKHHHIQLFKEKGNYSQLENGEEKISCEATACAEASAA

SEQ ID NO: 9613 - protein, 195 aa, Musa acuminata
MAFQGTTTKCTACTKTVYLVEKLTADNRVYHKACFRCHHCKGTLKLGNYNSFEGVLYCRPHFDQIYKSTGSLDKSFEGTPKVVKPEKFVDNENANKVSSAFAGTREKCVGCKKTVYPIERVTVNGTAYHKSCFKCSHGGCTISPSNYIAHEGTLYCKHHHIQLIKQKGNYSKLEDEKEKTSDEAASPPQEEESDA

SEQ ID NO: 9614 - protein, 195 aa, Phalaenopsis aphrodite
MAFAGTTQKCMACDKTVYLVDKLTADNRIYHKACFRCHHCKGTLKLGNYNSFDGVLYCKPHFDQIFKRTGSLEKSFEGTPKVVKPEKHVDNEKPTASKVSSAFAGTREKCVGCNKTVYPIERVTVNGTPYHKSCFKCSYGGCVISPSNYIAHEGKLYCKHHHVQLIKEKGNLSQLENDHGKLVVETSVSPTAMEA

SEQ ID NO: 9615 - protein, 196 aa, Theobroma cacao
MATFAGTQQKCMACDKTVYLVDKLTADNRVFHKACFRCHHCKGTLKLSNYNSFEGVLYCRPHYDQLFKRTGSLDKSFEGTPKIVKPEKHIENENAQKVVNLFGGTREKCVGCNKTVYPIEKVTVNGTPYHKSCFKCTHGGCTISPSNYIAHEGKLYCKHHHIQLFKEKGNYSQLESDREKTPMNEKLTSMEIAAES

SEQ ID NO: 9616 - protein, 195 aa, Lotus japonicus
MAFAGTTQKCMACDKTVYLVDKLTADNRVFHKACFRCHHCKGTLKLSNYNSFEGVLYCRPHFDQLFKRTGSLDKSFEGTPKVAKPERNIDNEKPAAAKVSSMFGGTRDKCAGCQKTVYPTEKVTVNGTPYHKSCFKCCHGGCVISPSNYIAHEGKLYCKHHHIQLIKEKGNLSQLEGDHEKNVVQGEINGDKVAA

SEQ ID NO: 9617 - protein, 195 aa, Elaeis guineensis
MAFQGTQTKCTACSKTVYLVDKLTADNRIYHKACFRCHHCQGTLKLGNYNSFEGVLYCRPHFDQLFKRTGSLDKSFEGTPKVVKPEKPVDTEKPAANRVSSQFAGTREKCFGCKKTVYPIERVTVNGTAYHKSCFKCTHGGCVISPSNYIAHEGRLYCKHHHIQLFKEKGNYSQLETDQEKMGNEAPTSAEELES

SEQ ID NO: 9618 - protein, 196 aa, Vigna unguiculata
MAFAGTTQKCMACDKTVYLVDKLTADNRVFHKACFRCHHCKGTLKLSNYNSFEGVLYCRPHFDQLFKRTGSLDKSFEGTPKVAKPEKNLEEKPGAAKVSSMFGGTRDKCAGCQKTVYPTEKVTVNGTPYHKSCFKCCHGGCVISPSNYIAHEGKLYCKHHHIQLIKEKGNLSQLEGDHEKSENNGKINGEEVAAEA

SEQ ID NO: 9619 - protein, 195 aa, Saccharum officinarum
MALSASLRISLIVAFFGILAFILGVIAENKKPASGTPIPGKDVVICKFPSDPTLAMGSLSIVALVVAAIVGHVAIFFPYSGKSVPRGALFQSTSLSVFFVVAELVSALAFAMLLWATVTEGLHRSKNIHHDMNYQCPTAKTGLFGGAAFLALDAALFWLVCQMLALNARADYLDEDDNKGEYGQVYAAEVDGSKV

SEQ ID NO: 9620 - protein, 195 aa, Panicum virgatum
MALSSPIRISLIVSFFGILAFVLGVIAENKKPAAGTPIPGKDVVICKFPSDPTLAMGSLSIVALVVVAIVGHVAIFFPYSGKSVPRGALFQSTSLTVFFVVAELVSGLAIAMLLWATVTEGLHRTNTIHHDMNYQCPTAKTGLFGGAAFLALDAALFWLVCQMLALNARADYLDEDDNKGEYGQVYAAEVDASKV

SEQ ID NO: 9621 - protein, 195 aa, Setaria italica
MALSSPIRISLIVSFFGILAFVLGVIAENKKPAAGTPIQGKDVVICKFPSDPTIAMGSLSLVALVVAAIVGHVAIFFPYSGKSVPRGALFQSTSLTVFFVVAELVSALAIAMLLWATVTEGLHRSNTIHHDMTYQCPTAKTGLFGGAAFLALDAALFWLVCQMLALNARADYLDEDDNKGEYGQVYAAEVDGSKV

SEQ ID NO: 9622 - protein, 195 aa, Panicum virgatum
MALSSPIRISLIVSFFGILAFVLGVIAENKKPAAGTPIPGKDVVICKFPSDPTLAMGSLSLAALVVAAVVGHVAIFFPYSGKSVPRGALFQSTSLTVFFVVAELVSGLAIAMLLWATVTEGLLRSNTIHHDMNYQCPTAKTGLFGGAAFLALDAALFWLVCQMLALNARADYLDEDDNKGEYGQVYAAEVDASKV

SEQ ID NO: 9623 - protein, 195 aa, Pennisetum glaucum
MALSSPIRISLIVSFFGILAFVLGVVAENKKPAAGTPIHGKDVVICKFPSDPTIAMGSMSLVALVVAAIIGHVAIFFPYSGKSVPRGALFESTSLTVFFVVAELVSALAIAMLLWATVTEGLHRSNTIHHDMTYQCPTAKTGLFGGAAFLALDAALFWLVCQMLALNARADYLDEDDDKGDYGQVYAAEVDGSKV

SEQ ID NO: 9624 - protein, 195 aa, Cynodon dactylon
MALSSPQRIALIVAFFGILAFVLGVVAENKKPPYGTPIKGKDVVICKFPSDPTIAMGSLSIVALVFAAIVGHVSIFHSYSGKSVPRGALFQSTSLSVFFVVAELVSALAFAMLLWATVTESLHRTNNIHKDMEYQCPTAKTGLFGGAAFLALDASLFWLVCQMLALNARADYLDEDDNKGEYGQVYAAEVDGSKV

SEQ ID NO: 9625 - protein, 195 aa, Eragrostis curvula
MALSSPQRIALIVAFFGLLAFVLGVIAENKKPAYGTPIQGKDVVICKFPNDPTIAMGSLSIVALILAAIIGHVAIFHPYSGKSVPRRALFQSTSLSVFFVVAELVSALAFAMLLWATVTESLHRSNSIHHNMDYKCPTAKTGLFGGAAFLALDASLFWLVCQMLALNARADYLDEDDTKGEYGQVYTSEADGSKV

SEQ ID NO: 9626 - protein, 195 aa, Brachypodium distachyon
MATSAQRIALTVSLFGVLAFLLGVIAENKKPPYGTPIKGKDVVICKFPSDPTIAMGSLSLVALVLAAIIGHVAIFYPYKGKSVPRGALFQSTSLSVFFVVAELVSALAFAMLLWATITEGHHRTSNIHHDMDTQCPTAKTGLFGGAAFLALDAALFWLVCQMLALNARADYLDEDDDDKGEYGQVYAADAEGSKV

SEQ ID NO: 9627 - protein, 195 aa, Festuca arundinacea
  misc_feature (59)..(59): Xaa can be any naturally occurring amino acid
MGFTSAQRIALTVSLFGILAFLLGVIAENKKPPYGTPIKGKDVVICKFPSDPTIAMGSXSIVALVLAAIIGHVSIFFPYKGKSVPRGALFQSTSLSVFFVIAELVSALAFAMLLWATITESHHRTSNIHHDMDTQCPTAKTGLFGGAAFLALDAALFWLVCQMLALNARADYLDEDDDKGEYGQVYAAGGDGSKV

SEQ ID NO: 9628 - protein, 196 aa, Pseudoroegneria spicata
MALTSAQRIALTVSLFGLLAFLLGVVAENKKPPYGTPIKGKDVVICKFPSDPTIAMGSLSIVALVLAAFIGHVAIFYPYKGKSVPRGALFQSTSLSVFFVVAELVSALAFAMLLWATITEGHHRTSNVHHDMDTLCPTAKTGLFGGAAFLALDAALFWLVCQMLALNARADYLDEDEDDKGEYGQVYAADADGTKV

SEQ ID NO: 9629 - protein, 196 aa, Hordeum vulgare
MGLTSAQRIALTVSLFGLLAFLLGVVAENKKPPYGTPIKGKDVVICKFPSDPTVAMGSLSIVALVLAAIIGHVAIFYPYKGKSVPRGALFQSTSLSVFFVIAELVSALAFAMLLWATITEGHHRTSNVHHDMDTLCPTAKTGLFGGAAFLALDAALFWLVCQMLALNARADYLDEDEDDKGEYGQVYAADADGTKV

SEQ ID NO: 9630 - protein, 196 aa, Leymus cinereus x Leymus triticoides
MGLTSAQRIALSVSLFGLLAFLLGVVAENKKPPYGTPIKGKDVVICKFPSDPTIAMGSLSIAALVLAAIIGHVAIFYPYKGKSVPRGALFQSTSLSVFFVVAELVSALAFAMLLWATITEGHHRTSNVHHDMDTLCPTAKTGLFGGAAFLALDAALFWLVCQMLALNARADYLDEDDDDKGEYDQVYAADADGTKV

SEQ ID NO: 9631 - protein, 198 aa, Triticum aestivum
MGLTSAKGIALTVSLFGLLAFLLGVIAENKKPPYGTPIKGKDVVICKFPSDPTIAMGSLSIVALVLAAFIGHVAIFYPYKGKSVPRGALFQSTSLSVFFVIAELVSALAFAMLLWATITEGRHRTSNIHHDMDTLCPTAKTGLFGGAAFLALDAALFWLVCQMLALNARADYLDEDEDEDDKGEYGQVYATDADGTKV

SEQ ID NO: 9632 - protein, 197 aa, Secale cereale
MALLTSAQRIALTVSLFGLLAFLLGVIAENKKPPYGTPIKGKDVVICKFPSDPTIAMGTLSIVALVLAAFIGHIAIFYPYKGKSVPRGALFQSTSLSVFFVIAELVSALAFAMLLWATITEGHHRTSNVHHDMDTLCPTAKTGLFGGAAFLALDAALFWLVCQMLALNARADYLDEDEDDKGEYGQVYAADADGTKV

SEQ ID NO: 9633 - protein, 196 aa, Avena sativa
MALLTSAQRITFTVSLFGLLAFLLGVIAENKKPPYGTPIKGKDVVICRFPSDPTVALGSVSIVALVLAAIIGHVSIFYPYKGKSVPREALFQSTSLSVFFVIAELVSALAFAMLLWATITESHHRTSNIHHDMDTQCPTAKTGLFGGAAFLALDAALFWLVCQMLALNARADYLDEDDDKGEYGQVYAADADGSKV

SEQ ID NO: 9634 - protein, 194 aa, Oryza sativa
MALTSAQRIALTVSFFGLLSFLLGVIAENKKPPYGTPIKGKDVVICKFPSDPTIAMGSLSVVSLVLTTIVGHAAIFYPYKSKSVPRGALFRSASLSAFFVIAELVSALAFAMLLWATVTEGLHRSNNIHHDLDTQCPTAKTGLFGGAAFLALDAALFWLVCQMLALNARSDYLDEDDKGDYGQVFASDVDGTKV

SEQ ID NO: 9635 - protein, 198 aa, Triticum aestivum
MGLTSAKGIALTVSLFGLLAFLLGVIAENKKPPYGTPIKGKDVVICKFPSDPTIAMGSLSIVALVLAAFIGHVAIFYPYKGKSVPRGALFQSTSLSVFFVIAELVSALAFAMLLWATITEGHHRTSNVHHDMDTLCPTAKTGLFGGAAFLALDAALFWLVCQMLALNARADYLDEDEDEDDKGEYGQVYAADADGTKV

SEQ ID NO: 9636 - protein, 294 aa, Saccharum officinarum
MLRGGTSMLGIVNFITFLISIPILGGGIWLASRANSTDCIRFLQWPIIIVGLVLMVISLMGFAGACYRQTWLLRLYLFAMFFVVLALLFFIVFAFAVTDRGDGQVVMNRRFPEYQLSDYGGWLRDRVADPQYWATISACLRDGHACAGMKRLARDPNTGMLVPETPAMFYGRNLSPIQSGCCKPPTSCAFTYMNETYWTQNPGVPTVINDPDCSRWSNDQQMLCFQCDSCKAGVLAGIKKSWRKVAILNIVVLIILVIVYVAGCAAFRNAKRIENDEPIGMARMTKSHPSRFQF

SEQ ID NO: 9637 - protein, 294 aa, Zea mays
MLRGGSSVLGIINFITFLISIPILGGGIWLASRANSTDCIRFLQWPIIIVGLVLMVISLMGFAGACYRQTWLLRLYLFAMFFVVLALLFFIVFAFAVTDRGDGQVVMNRRFPEYQLSDYGGWLRDRVADPQYWATISACLRDGHACAGMRRLARDPNTGMLVPETSTMFYGRNLSPIQSGCCKPPTSCAFSYMNETYWTQNPSVPTVTNDPDCKRWSNDQQTLCFQCDSCKAGVLAGIKKSWRKVAVLNIVVLIILVIVYVAGCAAFRNAKRIENGEAVGMARMTKSHPSRFQF

SEQ ID NO: 9638 - protein, 293 aa, Setaria italica
MLRGGTSVLGIVNFITFLISIPILGGGIWLASRANSTDCIRFLQWPIIVVGLVLMVISLMGFAGACYRQTWLLRLYLFAMFFVVLALLFFIVFAFAVTDRGDGQVVMNRRFLEYQLSDYSGWLRERVADPQYWATISACLRDGHACSGMRRFARDPNTGMRVPETPDMFYGRNLSPIQSGCCKPPSSCAFTYNNETYWTPNPGVPVISDPDCNRWNNDQQTLCFQCDSCKAGVLAGIKKSWRKVAILNIVVLIILVIVYVAGCAAFRNAKRIENDEPIGMARMTKSQPSRFQF

SEQ ID NO: 9639 - protein, 293 aa, Pennisetum glaucum
MLRGGSSVLGIVNFITFLISIPILGGGIWLASRANSTDCIRFLQWPIIVVGLVLMVISLMGFAGACYRQTWLLRLYLFAMFFVVLALLFFIVFAFAVTDRGDGQVVMNRRFLEYQLSDYSGWLRERVADPQYWATISACLRDGHACSGMRRYARDPNTGMLVPETPDMFYSRNLSPIQSGCCKPPSSCAYTYNNETYWTQNPGVPVISDPDCNRWSNDQQTLCFQCDSCKAGVLAGIKKSWRKVAILNIVVLIILVIVYVAGCAAFRNARRIDNDEPIGMARMTKSHPSRFQF

SEQ ID NO: 9640 - protein, 293 aa, Panicum virgatum
MLRGGTSVLGIVNFITFLISIPILGGGIWLASRANSTDCIRFLQWPIIIVGLVLMVISLMGFAGACYRQTWLLRLYLFAMFFVVLALLFFIVFAFAVTDRGDGQVVMNRRFLEYQLSDYSGWLRDRVADPEYWATISACLRDGHACSGMRRYARDPNTGMRVPETPDLFYARNLSPIQSGCCKPPSSCGFTYNNETYWTPNPGVPAISDPDCNRWSNDQQTLCFQCNSCKAGVLAGIKKSWRKVAILNIVVLIILVIVYVAGCAAFRNAKRIENDEPIGMARMTKSQPSRFQF

SEQ ID NO: 9641 - protein, 292 aa, Panicum virgatum
MLRGGTSMLGIVNFITFLISIPILGGGIWLASRANSTDCIRFLQWPIIVVGLVLMVISLMGFAGACYRQTWLLRLYLFAMFFVVLALLFFIVFAFAVTDRGDGQVVMNRRFLEYQLSGYRGWLRDRVADPQYWATISACLRDGHACSGMRRFGRAPNTGMLVPETSDMFYARNLSPIQSGCCKPPTSCGFTYNNETYWTPNPGVPISDADCNRWSNDQRTLCFQCDSCKAGVLAGIKKSWRKVAILNIVVLIILVIVYVAGCAAFRNAKRIDNDEPIGMARMTKSQPSRFQF

SEQ ID NO: 9642 - protein, 294 aa, Oryza sativa
MLRGGTSLLGIVNFVTFLISIPILGGGIWLASRANSTDCIRFLQWPIIAIGLAVMVVSLMGFAGACYRQTWLLRLYLFAMFFIVVALLFFIVFAFAVTDRGDGQVVMNRRFLEYQLSDYNGWLRDRVADPAYWATISACLRDGRACAAMRRFARDPNTGMLVPETPSMFYARDLSPIQSGCCKPPTSCAYNYVNETFWTANPGVPTVVNDVDCSKWSNDQQTLCFQCDSCKAGVLAGIKKSWRKVAILNIVVLIILVIVYVAGCAAFRNARRIENDEPFGMARMTKTQPSRFQF

SEQ ID NO: 9643 - protein, 294 aa, Brachypodium distachyon
MRHGGTSVLGVVNFVTFLASIPVLGGGIWLASRANSTDCIRFLQWPIIIIGLAVMVVSLAGFAGACYRQTWLLRLYLFAMFFVVVALLFFIVFAFAVTDRGDGQVVMNRRFLEYQFSDYNGWLRNRVADPEYWATISACLRDGHACEGMKRRARDPNTGMLVPEPPSMFFGRNLSPIQSGCCKPPTSCAFTYVNETYWTPNPGVQTVVSDPDCQKWNNDQQTLCFQCDSCKAGVLAGIKKSWRKVAIINIVMLIILVIVYVAGCAAFRNAKRMDNDEPYGMARMTKSQPSRFQF

SEQ ID NO: 9644 - protein, 294 aa, Triticum aestivum
MHGGGSKMLGVVNFITFLASIPVLGGGIWLASRANTTDCIRFLQWPIIIIGLAVMVVSLMGFAGACYRQTWLLRIYLFAMFFIVVALLFFIVFAFAVTDRGEGQVVMNRRFLEYQLSDYNGWLRNRVADPEYWATISACLRDGRACASMRRPARDPNTGMLVTEPPVMFYGRNLSPIQSGCCKPPTSCAFTYNNETYWSANPGVPTVVTDPDCLKWSNDQQTLCFQCDSCKAGVLAGIKKSWRKVAIINIVVLIILIIVYVAGCAAFRNAKRDDNDESYGMARMTKSRPSRFQF

SEQ ID NO: 9645 - protein, 294 aa, Triticum aestivum
MHGGGSKMLGVVNFITFLASIPVLGGGIWLASRANSTDCIRFLQWPIIIIGLAVMVVSLMGFAGACYRQTWLLRIYLFAMFFIVVALLFFIVFAFAVTDRGEGQVVMNRRFLEYQLSDYNGWLRNRVADPEYWATISACLRDGRACASMRRPARDHNTGMLVTEPPVMFYGRNLSPIQSGCCKPPTSCAFTYNNETYWSANPGVPTVVTDPDCLKWSNDQQTLCFQCDSCKAGVLAGIKKSWRKVAIINIVVLIILIIVYVAGCAAFRNAKRDDNDESYGMARMTKSRPSRFQF

SEQ ID NO: 9646 - protein, 294 aa, Secale cereale
MHGGGSKMLGVVNFITFLASIPVLGGGIWLASRANSTDCIRFMQWPVIIIGLAVMVVSLMGFAGACYRQTWLLRIYLFAMFFIVVALLFFIVFAFAVTDRGEGQVVMNRRFLEYQLSDYNGWLRNRVADPEYWATISACLRDGRACASMRRPARDPNTGMLVTEPPVMFYGRNLSPVQSGCCKPPTSCAFTYNNETYWSANPGVPTVVTDPDCLKWSNDQQTLCFQCDSCKAGVLAGIKKSWRKVAIINIVVLIILIIVYVAGCAAFRNAKRDDNDESYGMARMTKSRPSRFQF

SEQ ID NO: 9647 - protein, 294 aa, Pseudoroegneria spicata
  misc_feature (142)..(142): Xaa can be any naturally occurring amino acid
MHGGGSKMLGVVNFITFLASIPVLGGGIWLASRANSTDCIRFLQWPIIIIGLAVMVVSFMGFAGACYRQTWLLRIYLFAMFFIVVALLFFIVFAFAVTDRGEGQVVMNRRFLEYQLSDYNGWLRNRVADPEYWATISACLRXGRACASMRRAVRDPNTGMLVPEPPSMFYGRDLSPIQSGCCKPPTSCAFTYNNETYWSANPGVPTMVTDPDCLKWSNDQQTLCFQCDSCKAGVLAGIKKSWRKVAIINIVMLIILVIVYVAGCAAFRNAKRDDNDESYGMARMTKSQPSRFQF

SEQ ID NO: 9648 - protein, 294 aa, Hordeum vulgare
MHGGGSKMLGVVNFITFLASIPVLGGGIWLASRANTTDCIRFLQWPIIIIGLAVMVVSLMGFAGACYRQTWLLRIYLFAMFFIVVALLFFIVFAFAVTDRGEGQVVMNRRFLEYQLSDYNGWLRGRVADPDYWATISACLRDGHACRSMRRPVRDPNTGMLVLEPAVVFYGRDLSPIQSGCCKPPTSCAFTYNNETYWSANPGVPTVVTDPDCLKWSNDQQTLCFQCDSCKAGVLAGIKKSWRKVAIINIVVLIILVIVYVAGCAAFRNAKRDDNDESYGMARMTKSRPSRFQF

SEQ ID NO: 9649 - protein, 291 aa, Avena sativa
MRGGTNMLGIVNFITFLASIPVLGGGIWLASRANSTDCIRFLQWPIIVIGLAVMVVSLMGFAGACYRQTWLLRVYLFAMFFIVVALLFFIVFAFAVTDRGEGQVVMNRRFLEYQLSDYNGWLRSRVADPQYWATIAACLREGRACAGMKRMGRDPYTGMLQPETPAMFFNRDLSPIQSGCCKPPSSCGYNYINETAWSSVTNTPMADPDCYKWSNDQQTLCFGCDSCKAGVLAGIKKSWRKVAIINIVVLIILVIVYVAGCAAFRNAKRMDNDESYGMARMTKSRPSRFQF

SEQ ID NO: 9650 - protein, 357 aa, Zea mays
MTTRCCLVVATLLAALLSVSASLEFGFYNKTCPSAETIVQQTVAAAFTNNSGVAPALLRMHFHDCFVRGCDGSVLIDSTANNKAEKDSIPNSPSLRFFDVVDRAKASLEARCPGVVSCADILAFAARDSVVLTGGLGYKVPSGRRDGRISNATQALNELPPPFFNATQLVDNFASKNLSLEDMVVLSGAHTIGVSHCSSFAGINNTGDRLYNFSGSSDGIDPALSKAYAFLLKSICPSNSGRFFPNTTTFMDLITPAKFDNKYYVGLTNNLGLFESDAALLTNATMKALVDSFVRSEATWKTKFAKSMLKMGQIEVLTGTQGEIRRNCRVINPANAAADVVLARQPGSSGSTGVATS

SEQ ID NO: 9651 - protein, 363 aa, Sorghum bicolor
MTTATTTTMKRRFLRFATVLASLLSATACLDVGFYDQTCPTAETVVQQTVAAAFTNNSGVAPALIRMHFHDCFVRGCDGSVLIDSTANNTAEKDAPPNNPSLRFFDVVDSAKAALEAQCPGVVSCADVLAFAARDSVVLSGGLGYQVPAGRRDGLISTATEALNNLPPPFFNATQLAASFASKNLTVEDLVVLSGAHTLGVSHCSSFAGVGNLGDRLYNFSGSSDGTDPALSKAYAFLLKSICPSNSSQFFPNTTTFMDLITPEKFDNKYYVGLTNNLGLFKSDVALLTNATMKALVDSFVRSEATFRTKFARSMLKMGQIEVLTGTQGEIRLNCRVINPANAAADVLADQSGSSGFTGVAAS

SEQ ID NO: 9652 - protein, 360 aa, Zea mays
MTTTKRHCLRFTTVLATTLLSATAACLDVGFYDRTCPTAETIVQQTVAAAFRNNSGVAPALIRMHFHDCFVRGCDGSVLIDTVGNLTAEKDAPPNNPSLRFFDVVDRAKASLEAQCPGVVSCADVLAFAARDSVVLSGGLGYQVPAGRRDGRISNDTEALNNLPPPFFNATELADRFASKNLTIEDLVVLSGAHTIGVSHCSGFAGPTDLNGPVDRLYNFSSPDGIDPTLSKAYAFLLKSICPANTSQFFPNTTVFMDLITPERFDNKYYVGLTNNLGLFKSDVALLTNATMKALVDSFVRSEATFRTKFARSMIKMGQIEVLTGTQGEIRRNCRVINPVSATDDVVLARPSGFTGVAAS

SEQ ID NO: 9653 - protein, 522 aa, Zea mays
MASVRPCVSVKPAVRPVRYRSTRAGPAGLGRLRVCSCSLALGGDGGCTRSSGRSVDVSGAGLGLLGGDGLRIHRRGGREVLAMCSASFDGVRPAAVASAVQPVPAFPERAKVVSLVAAIMLLCNADRVVMSVAVVPFAAQYGWSSSFVGIVQSSFLWGYVLSSMVGGALADKYGGKKVMAGAAALWSLATILTPWAASRSTIMLLAVRALFGLAEGVAFPTMSTFLPKWFPTHERATAVAISMGGFHLGNVISFLATPIIMSHIGLSGTFAFFASLGYLWLSVWMMNVESDPIDSHTISKSELQLILDGRIGSKVQGSKFPSLRELFSKTQFLAVTLANVVNNWGYFVLLSWMPVYFNTVYNINLKQAAWFSAIPWAVMAMSGYVAGASADFLIKSGFSIGLVRKIMQSIGFMGPCVSLLCLRFAQTPSVAAVLMTIALSLCSFSQAGYMCNIQDIAPKYAGSLHGLTNGIGTVAAIVSTIGIGYFVQWLGSFQAFLTLTAALYFSATIFYNVYATGDLIFD

SEQ ID NO: 9654 - protein, 535 aa, Setaria italica
MAPVRSCVSVKTAVSPVRYRSTRVGAAGLGAPGRLRICSSSVASAADARGDGGCAASSSGRGVVVNGGLGVLGGDGPRIRRRDVVATCSASFDGVRPVPAAAAAVASAVQPAVASSSAFPERAKVVALVAAIMLLCNADRVVMSVAVVPMAAQYGWSSSFVGIVQSSFLWGYVCSSMVGGALADKYGGKKVMAGAAALWSLATILTPWAASRSTTMLLAVRALFGLAEGVAFPTMSTFLPKWFPTQERATAVGISMGGFHLGNVISFLATPIIMSHIGLTGTFAFFASLGYLWLSVWMFNVESDPIDSRTISKSELQFILDGRSGSKVKGSKGPSLRELFSKFEFLAVTIANVVNNWGYFVLLSWMPVYFKTVYNVNLKQAAWFSAIPWAVMAMSGYVAGASADFLIKSGFSIGLVRKIMQSIGFMGPGVSLLCLRFAQTPSVAAVLMTIALSLSSFSQAGYFCNIQDIAPKYAGSLHGLTNGIGTVAAIVSTIGTGYFVQWLGSFQAFLTLTAALYFSATIFYNVYATGDLIFD

SEQ ID NO: 9655 - protein, 516 aa, Zea mays
MASVRSCASVKSAVRSPVSYRSTRAVAAGSGRLRVRSSSLQALAGCASGGGGFGLLGSDDGPRVRRGGREVLATCSASFDGVRPAVVAGAAAQPGSAAFPERAKVVALVATIMLLCNADRVVMSVAVVPLAAQHGWSSSFVGIVQSSFLWGYVFSSMVGGALADRYGGKKVMAGAAALWSLATILTPWAASRSTIMLLAVRALFGLAEGVAFPTMSTFLPKWFPTHERATAVGISMGGFHLGNVISFLATPIIMSHIGLSGTFAFFASLGYLWISVWMMNVESDPLDSHTISKSELQLILAGRAGSKVQGSNKFPSLRELFSRTEFLAVTLANVVNNWGYFVLLSWMPVYFKTVYNVNLKQAAWFSAIPWAVMAMSGYVAGASADFLIKSGFPIGLVRKIMQSIGFMGPCVALLCLRFAQTPSVAAVLMTIALSLSSFSQAGYFCNIQDIAPKYAGSLHGMTNGIGTVAAIVSTIGTGYFVQWLGSFQAFLTLTAALYFSATVFYNVYATGDLIFD

SEQ ID NO: 9656 - protein, 535 aa, Panicum virgatum
MAPVVRSCVSVKAAASPVRYRSTRVGAAGLGAPGRLRVCSSSVALGGDACGDGGRAASISGRGVVVSGGTGSLGGGGPSVRRRDVAASGSASFDGVRPVPVPGAAAVASAVQPAVASAFPERAKVVALVAAIMLICNADRVVMSVAVVPMAAQYGWSSSFVGIVQSSFLWGYVFSSMVGGALADKYGGKKVMAGAAALWSLATILTPWAASRSTIMLLAVRALFGLAEGVAFPTMSTFLPKWFPTQERATAVGISMGGFHLGNVISFLATPIIMSHIGITGTFAFFASLGYLWLLVWMFNVESDPVDSRTISKSELQFILAGRSGSKAKGSKCPSLRELFSKLEFLAVTVANVVNNWGYFVLLSWMPVYFKTVYNVNLKQAAWFSAIPWAVMAMSGYVAGASADFLIKSGFSIGLVRKIMQSIGFMGPGVSLLCLRFAQTPSVAAVLMTTALSLSSFSQAGYFCNVQDIAPKYAGSLHGLTNGIGTVAAIVSTIGAGYFVQWLGSFQAFLTLTAALYFSATVFYNVYATGDLVFD

SEQ ID NO: 9657 - protein, 535 aa, Oryza sativa
MASIRSCVSVNPAAAVTPVKYKSARVGAAGLDPKGLRISCSSSSSSLAAGGGDGCRDAGCASSSGRGSGVVGSVGDGWWGRRGGQRERAVAAMCSAGMEGVRHGAAAVASVPAASASALPERAKVVALVAAVMLLCNADRVVMSVAVVPFAAQYGWSSSFLGIVQSSFLWGYVFSSMVGGALADRYGGKKVMAGAAALWSLATFLTPWAASQSTIMLLAIRALFGLAEGVAFPTMSTFLPKWFPTHERATAVGISMGGFHLGNVISFLATPIIMSHIGLAGTFAFFASLGYLWLSVWLFNVESDPLDSRTISKSELQLILAGRSASKIQGSKFPSLREILSKIEMWAIIVANVVNNWGYFVLLSWMPVYFKTVYNVNLKQAAWFSAIPWAVMALSGYVAGASADFLIKSGFSVALVRKIMQSIGFIGPGVSLLCLRFAQTPSVAAVLMTIALSLSSFSQAGYFCNVQDIAPKYAGSLHGLTNGIGTVAAIVSTIGTGYFVQWLGSFQAFLTLTAVLYFSATVFYNTYATGDLIFD

SEQ ID NO: 9658 - protein, 529 aa, Hordeum vulgare
MASVRSCVSVKPAAGPARYRSARVGAVSLEPTRLRISASSSSSLGSAADGCGRGVGCATASSSGRGDAVVGLVGDGGRARRRGGREVVATCSASLEGVRHGGAAAAVASVPALPERAKVVALVAAVMLLCNADRVVMSVAVVPLAAQHGWSSSFVGIVQSSFLWGYVFSSMVGGALADRYGGKKVMAGAAALWSLATFLTPWAASQSATMLLAVRVLFGVAEGVAFPTMSTFLPKWFPTHERATAVGLSMGGFHLGNVVSFLATPIIMSHIGLAGTFAFFASLGYLWLSVWLLNVESDPIDSRTISKSELQLILAGRSKSKVKGSKSPSLREVFSKMEMWAIIVANVINNWGYFVLLSWMPVYFKTVYNVNLKQAAWFSAIPWGVMALSGYVAGASADFMIKSGLSIVRVRKIMQSIGFIGPGVSLLCLRFAQTPSIAAVIMTAALGLSSCSQAGYFCNVQDIAPKYAGSLHGMTNGIGTVAAIVSTVGAGYFVQWLGSFQAFLTLTAVLYFSATVFYNIYATGDLIFD

SEQ ID NO: 9659 - protein, 267 aa, Zea mays
MWPLCVISEKLFRMAGDDGAQGAAGSPYPDGRISLARRSYYIDVPHVQQAFTWDCGLACVLMVLRTLGIDCCDGIADLERLCRTTSIWTVDLAYLLNKFSVSFSFCTVTLGANPQYSAESFYREQLQEDIDRVDELFGKALDAGISIQCRSITAYDIAFLLLSGHCIAIALVDKSKLNLPCMSDHDVQQHNDEPDYMGHYVVICGYDADDCEFEIRDPASSRKRERVTMKSLDEARKSFGTDEDILLVSLTGKSGMKLSRKLLACSM

SEQ ID NO: 9660 - protein, 269 aa, Setaria italica
MWPLCIISEKLFKMAGDDDGGGQGPGSPSADGQIPLARRSYYVDVPHVQQAFTWDCGLACVLMVLRTLGIDCCDGIADLERLCRTTSVWTVDLAYLLNKFAVSFSFFTVTIGANPQYSAETFYREQLEEDIDRVDELFGKALDAGISIQCRSISAYEIAFLLLSGHCIAIALVDKSKLNSSWMNGVHDVQQLNEDSDYMGHYVIICGYDADDCEFEIRDPASSRKRERVTMKSLDEARKSFGTDEDILLVSLTGKSGMKLTRKFLAGSM

SEQ ID NO: 9661 - protein, 268 aa, Panicum virgatum
MWPLCVISEKLFRMAGDDGGHGPGSPSADYAQIPLARRSYCVDVPHVQQAFTWDCGLACVLMVLRTLGIHCCHGIADLERLCRTTSIWTVDLAYLLNKFSVSFSFFTVTLGANPQYSAESFYREQLQEDIDRVDELFGKALEAGISIQCRSISAYDIAFLLLSGHCIAIALVDKSKLNSSWMNDVHDVQQLNEDSDYMGHYVVICGYDADDCEFEIRDPASSRKRERVTMKSLDEARKSFGTDEDILLVSLTGKSGMKVTRKFLAGSM

SEQ ID NO: 9662 - protein, 265 aa, Panicum virgatum
MWPLCVISEKLFRMAGDDGGHGPGSPSADYAQIPLARRSYCVDVPHVQQAFTWDCGLACVLMVLRTLGIHCCHGIADLESLCRTTSIWTVDLAYLLNKFSVSFSFFTVTLGANPQYSAESFYREQLQEDIDRVDELFGKALEAGISIQCRSISAYDIAFLLLSGHCIAIALVDKSKLNSSWMNDVQQLNEDSDYMGHYVVICGYDADDCEFEIRDPASSRKRERVKMKSLDEARKSFGTDEDILLVSLTGKSGMKVTRKFLAGSM

SEQ ID NO: 9663 - protein, 265 aa, Panicum virgatum
MWPLCVISEKLFRMAGDDGGHGTGSPSADYAQVPLARRSYCVDVPHVQQAFTWDCGLACVLMVLRTLGIHCCHGIADLESLCRTTSIWTVDLAYLLNKFSVSFSFFTVTLGANPQYSAESFYREQLQEDIDRVDELFGKALEAGISIQCRSISAYDIAFLLLSGHCIAIALVDKSKLNSSWMNDVQQLNEDSDYMGHYVVICGYDADDCEFEIRDPASSRKRERVKMKSLDEARKSFGTDEDILLVSLTGKSGMKVTRKFLAGSM

SEQ ID NO: 9664 - protein, 268 aa, Brachypodium distachyon
MWPLCFISDKLFKVAGDDCGEGPGAALPPGSQIPLARRSYRVDVPHVQQAFTWDCGLACVLMVLRTLGVDCCDGIADLGKLCHTTSIWTVDLAYLLHKFRVSFSFFTVTIGANPQYSAETFYREQLQEDIDRVDELFGKAVDAGISIQCRSISAYDIAFLLLSGHCIAIALVDKSKLISSWMNDVHDVQQFNEDSDYMGHYVVICGYDADACEFEIRDPASSRKREMVPMKSLEEARKSFGTDEDILLVSLTGKNGMKLSRKLPDSSL

SEQ ID NO: 9665 - protein, 268 aa, Hordeum vulgare
MWPLCFISDRLFKVPGDDGGEGPGAPLPPDGRIPLARRSYFIDVPHVQQAFTWDCGLACVLMVLRTLGLDCCHGIAELEKLCRTTSVWTVDLAYLLHKFSVNFSFFTVTIGANPQYSGETFYREQLQEDIDRVDELFGKALDAGISIQCRSISAYDIAFLLLSGHCIAIALVDKSKLNSSWMNDVHDMQQFDEDSDYMGHYVVICGYDADTCEFEIRDPASSRKREMVPMKSLDEARKSFGTDEDILLVSLTGKNGTKLSRKLPAGSP

SEQ ID NO: 9666 - protein, 270 aa, Triticum aestivum
MWPLCFISDRLFKVPGDDGGDGDGPGAPLPPDGRIPLARRSYFIDVPHVQQAFTWDCGLACVLMVLRTLGLDCCHGIAELEKLCRTTSVWTVDLAYLLHKFSVNFSFFTVTIGANPQYSAETFYREQLQEDIDRVDELFGKALDAGISIQCRSISAYDIAFLLLSGHCIAIALVDKSKLNSSWMNDVHDMQQFDEDSDYMGHYVVICGYDADACEFEIRDPASSRKREMVPMKSLDEARKSFGTDEDILLVSLTGKNGTKLSRKLPVGSP

SEQ ID NO: 9667 - protein, 268 aa, Leymus cinereus x Leymus triticoides
MWPLCFISDKLFKVPGDDGGEGPGAPLPPDGRIPLARRSYFIDVPHVQQAFTWDCGLACVLMVLRTLGLDCCHGIAELEKLCRTTSVWTVDLAYLLHKFSVNFSFFTVTIGANPQYSAETFYREQLQEDIDRVDELFGKALDAGISIQCRSISAYDIAFLLLSGQCIAIALVDKSKLNSSWMNDVHDMQQFDENSDYMGHYVVICGYDADACEFEIRDPASSRKREMVPMKSLDEARKSFGTDEDILLVSLTGKTGTRLSRKLPVGSP

SEQ ID NO: 9668 - protein, 268 aa, Triticum aestivum
MWPLCFISDRLFKVPEDGGGDGPGAPLPPDGRIPLARRSYFIDVPHVQQAFTWDCGLACVLMVLRTLGLDCCHGIAELEKLCRTTSVWTVDLAYLLHKFSVNFSFFTVTIGANPQYSAETFYREQLQEDIDRVDELFGKALDAGISIQCRSISAYDIAFLLLSGHCIAIALVDKSKLNSSWMNDVHDMQQFDEDSDYMGHYVVICGYDADACEFEIRDPASSRKREMVPMKSLDEARKSFGTDEDILLVSLTGKNGMKLSRKLPVGSP

SEQ ID NO: 9669 - protein, 270 aa, Oryza sativa
MWPLGFFSERLFKVAGEGDGGEGADDSPPAPDGRVPLARRSYYVDVPHVQQAFTWDCGLACVLMVLRTLGMDCCDGIADLEKLCRTTSIWTVDLAYLLNRFSVCFSFFTVTLGANPQYSAETFYREQLQEDIDRVDELFGRALEAGISIQCRSISAYDIAFLLLSGHCIAIALVDKTKLNSSWSNDLQDMQQFSEDSDYMGHYVVICGYDADACEFEIRDPASSRQRERVSMKSLDQARKSFGTDEDIILVSLTGKIGMKLSRKLLVGSL

SEQ ID NO: 9670 - protein, 268 aa, Triticum aestivum
MWPLCFISDRLFKVPEDGGGDGPGAPLPPDGRIPLARRSYFIDVPHVQQAFTWDCGLACVLMVLRTLGLDCCHGIAELEKLCRTTSVWTVDLAYLLHKFSVNFSFFTVTIGANPQYSAETFYREQLQEDIDRVDELFGKALDAGISIQCRSISAYDIAFLLLSGHCIAIALVDKSKLNSSWMNDVHDMQQFDEDSDYMGHYVVICGYDADACEFEIRDPASSRKREMVPMKSLDEARKSFGTDEDILLVSLTGKNGTKLSRKLPVGSP

SEQ ID NO: 9671 - protein, 248 aa, Pennisetum glaucum
GQGLESPSADGLIPLARRSYYVDVPHVQQAFTWDCGLACVLMVLRTLGIDCCDGIADLERLCRTTSVWTVDLAYLLNKFAVSFSFFTVTLGANPQYSAETFYREQLEEDIDRVDDLFVKALDAGINIQHRSISAYEIAFLLLSGHCIAIALVDKSKLNSSWMNDVHDVQQVNEDSDYMGHYVIICGYDADDCEFEIRDPAISRKRERVTMKSLDEARKSFGTDEDIILVSLTGKSGMKLTRKFLAGSM

SEQ ID NO: 9672 - protein, 270 aa, Triticum aestivum
MWPLCFISDRLFRVPGDDAGDGDGPGAPPPPDGRIPLARRSYFIDVPHVQQAFTWDCGLACVLMVLRTLGLDCCHGIAELEKLCRTTSVWTVDLAYLLHKFSVNFSFFTVTIGANPQYSAETFYREQLQEDIDRVDELFGKALDAGISIQRRSISAYDIAFLILSGHCIAIALVDKSKLNSSWMNDVHDMQQFDEDSDYMGHYVVICGYDADACEFEIRDPASSRKREMVPMKSLDEARKSFGTDEDILLVSLTGKNGTKLSHKLPVGSP

SEQ ID NO: 9673 - protein, 269 aa, Secale cereale
MWPLCFISDRLFKVPGDGGDDDGPGAPLPPDGRIPLARRSYFIDVPHVQQAFTWDCGLACVLMVLRTLGLDCCHGIAELEKLCRTTSVWTVDLAYLLHKFSVNFSFFTVTIGANPQYSAETFYREQLQEDIDRVDELFGKALDSGISIQRRSISAYDIAFLILSGHCIAIALVDKSKLNSSWMNDVHDMQQFDEDSDYMGHYVVICGYDADACEFEIRDPASSRKREMVPMKNLDEARKSFGTDEDILLVSLTGKNGTKLSRKLPVGSP

SEQ ID NO: 9674 - protein, 155 aa, Triticum aestivum
MWPLCFISDRLFRVPGDDAGDGDGPGAPPPPDGRIPLARRSYFIDVPHVQQAFTWDCGLACVLMVLRTLGLDCCHGIAELEKLCRTTSVWTVDLAYLLHKFSVNFSFFTVTIGANPQYSAETFYREQLQEDIDRVDELFGKALDAGISIQIHQCV

SEQ ID NO: 9675 - protein, 1000 aa, Zea mays
METLKRKAVDSPGDAYQASSLKPPLAAAAVEPRAPTTLAAAEPVACVHDVSYPEGYDPSASTSRAIAGGADASEPAKKFPFQLDPFQAEAIRCLDNGESVMVSAHTSAGKTVVALYAIAMSLRNQQRVIYTSPIKALSNQKYREFKEEFSDVGLMTGDVTIEPNASCLVMTTEIWRSMQYKGSEVMREVAWVIFDEVHYMRDRERGVVWEESIVMAPKNSRFVFLSATVPNAKEFADWVAKVHKQPCHIVYTDYRPTPLQHYVFPSGGDGLYLVVDEKGKFREDSFQKALNALVPASDSAKKKENGKRQKFTMAGTSSEESDIFKMVKMIIQRQYDPVILFSFSKRECEFLAMQMAKMDLNEDDEKANIETIFWSAMDMLSDDDKKLPQVSNMLPLLKRGIGVHHSGLLPILKEVIEILFQEGLIKCLFATETFSIGLNMPAKTVVFTNVRKFDGDRFRWLSSGEYIQMSGRAGRRGIDLRGICILMVDEKMEPSTAKMMLKGSADSLNSAFHLSYNMLLNQMRSEDGDPEKLLRHSFYQFQADRSLPDLEKQIKELESERNSMVIEEAESLKDYYDLLQQHRSLKKDVHDIVLSPKHVLPFLQPGRLVRIEYSTDEPANFSIDENVTWGIIINFEKVKSHGEDKRPEDSDYTVDVLTRCSVTKDNSGKKTMKVVPLKARGEPVVVSLSLSQIDGLSSIRMYIPKDLIPVEVRENTLRKVEEVLLRFAKDGVPLLDPEEDMKVQSKSFRKATRRIEALESLFEKHDIRNSPHIQQKLKVFHAKQELSAKIKSIKKTMRSSTALAFKDELKARKRVLRRLGYVTSDDVVEVKGKVACEISSADELTLTELMFSGALKDATVEQVVALLSCFVWQEKLQDAPKPREELDLLFYQLQETARRVANLQLECKIQIDVESFVNSFRPDIMEAVYSWARGSKFYQIMEMTQVFEGSLIRAIRRLEEVLQQLILASKSIGETELEAKLEEAVNKIKRDIVFAASLYL

SEQ ID NO: 9676 - protein, 999 aa, Setaria italica
METLKRKAQDGPAAADNASPLKAARSDATEPPARTTLAAAEPVACVHDVSYPEGYDASASASRLLAGGAEGSEPAKKFPFQLDPFQAEAIRCLDNGESVMVSAHTSAGKTVVALYAIAMSLRNQQRVIYTSPIKALSNQKYREFKEEFSDVGLMTGDVTIEPNASCLVMTTEIWRSMQYKGSEVMREVAWVIFDEVHYMRDRERGVVWEESIVMAPKNSRFVFLSATVPNAKEFADWVAKVHKQPCHIVYTDYRPTPLQHYVFPSGGDGLYLVVDEKGKFREDSFQKALNALVPASDSDKKKENGKWQKAIIAGKSSEESDIFKMVKMIIQRQYDPVILFSFSKRECEFLAMQMAKMDLNEDDEKANIETIFWSAMDLLSDDDKKLPQVSNMLPLLKRGIGVHHSGLLPILKEVIEILFQEGLIKCLFATETFSIGLNMPAKTVVFTNVRKFDGDRFRWLSSGEYIQMSGRAGRRGIDQRGICILMVDEKMEPSTAKMMLKGSADSLNSAFHLSYNMLLNQMRSEDGDPEKLLRYSFYQFQADRALPDLEKQIKELELERNSMVIEEEESLKDYYELLQQYKSLKKDVRDIVLSPKHVLPFLQPGRLVRLEYSTDEPATFSIDENITWGIIINFEKVKSHGEDRRPEDSDYTVDVLTRCSVSKDSSGKKAMKIVPLKERGEPVVISLPLSQVDGLSSIRMYIPKDLLPVEARENTLRKVEEVLSRFAKDGVPLLDPEEDMKVQSKSFRKATRRIEALESLFEKHDIRSSPHIQQKLKVLHAKQELSAKIKSIKKTMRSSTALAFKDELKARKRVLRRLGYVTSDDVVEVKGKVACEISSADELTLTELMFSGTLKDATVEQMVALLSCFVWQEKLQDAPKPREELDLLFYQLQETARRVANLQLECKIQIDVESFVNSFRPDIMEAVYSWAKGSKFYQIMEMTQVFEGSLIRAIRRLEEVLQQLILASKSIGETELEAKLEEAVSKIKRDIVFAASLYL

SEQ ID NO: 9677 - protein, 999 aa, Panicum virgatum
METLKRKAPDGPAPADNASPLKAPRADAAEPPARSTLAAAEPIACVHDVSYPEGYDAAASASRVLAGGAERSEPAKKFPFQLDPFQAEAIRCLDNGESVMVSAHTSAGKTVVALYAIAMSLRNQQRVIYTSPIKALSNQKYREFKEEFSDVGLMTGDVTIEPNASCLVMTTEIWRSMQYKGSEIMREVAWVIFDEVHYMRDRERGVVWEESIVMAPKNSRFVFLSATVPNAKEFADWVAKVHKQPCHIVYTDYRPTPLQHYVFPSGGDGLYLVVDEKGKFREDSFQKALNALVPASGGDKKKENGKWQKGIVAGKSSEESDIFKMVKMIIQRQYDPVILFSFSKRECEFLAMQMAKMDLNEDDEKANIETIFWSAMDLLSDDDKKLPQVSNMLPLLKRGIGVHHSGLLPILKEVIEILFQEGLIKCLFATETFSIGLNMPAKTVVFTNVRKFDGDRFRWLSSGEYIQMSGRAGRRGIDQRGICILMVDEKMEPSTAKMMLKGSADSLNSAFHLSYNMLLNQMRSEDGDPEKLLRFSFYQFQADRALPDLEKQIKELESDRNSMVIEEEESLKDYYDLLQQYRSLKKDVRDIVLSPKHVLPFLQPGRLVRILYSTDGSSTFSIDENVTWGIIINFEKVKSSGEDRRPEDSDYTVDVLTRCSVMKDSSGKKTMKIIPLKERGEPVVISLPLSQIDGLSSIRMYIPKDLLPVEARENTLRKVEEVLSRFAKDGVPLLDPEEDMKVQSKSFRKATRRIEALEGLFEKHDIRSSPHIQQKLKVLHAKQELSAKIKSIKKTMRSSTALAFKDELKARKRVLRRLGYVTSDDVVEVKGKVACEISSADELTLTELMFSGTLKDATVEQMVALLSCFVWQEKLQDAPKPREELDLLFYQLQETARRVANLQLECKIQIDVESFVNSFRPDIMEAVYSWAKGSKFYQIMEMTQVFEGSLIRAIRRLEEVLQQLILASKSIGETELEAKLEEAVSKIKRDIVFAASLYL

SEQ ID NO: 9678 - protein, 993 aa, Brachypodium distachyon
METLKRKAPEVPAARANSPTKAPRDDDAPAAPAASEPVACVHDVSYPEGYDASTSSRIVAGGGEGVAPAKTFPFKLDPFQSEAIRCLDNGESVMVSAHTSAGKTVVALYVIAMSLRNQQRVIYTSPIKALSNQKYREFKEEFSDVGLMTGDVTIEPNASCLVMTTEIWRSMQYKGSEVMREVAWVIFDEVHYMRDRERGVVWEESIVMAPKNSRFVFLSATVPNAKEFADWVAKVHKQPCHIVYTDYRPTPLQHYVFPSGGDGLYLVVDENGKFREDSFQKSLNVLAPASGGDKKRENGKRQKGISAGKPGEESDIFKMVKMIIQRQYDPVILFSFSKRECEFLAMQMAKMDLNEDDEKVNIETIFWSAMDLLSDDDKKLPQVSNMLPLLKRGIGVHHSGLLPILKEVIEILFQEGLIKCLFATETFSIGLNMPAKTVVFTNVRKFDGDRFRWLSSGEYIQMSGRAGRRGIDDRGICILMVDDKMEPSTAKMMLKGGADSLNSAFHLSYNMLLNQMRCEDGDPEKLLRHSFYQFQADRALPDLEKRVRELEIERNSMVIDEEESLKDYYDLLEQYKTLKKDVRDIVLSPKYVLPFLQSGRLVRVQFSTDEQPTFSIDENVTWGIIINFEKVKTQAEDRKPEDCDYAVDILTRCSVNKDISGKKTMKIIPLKDRGEPVVISLPLSQIDGLSSVRMYIPKDLLPVEARENTLRKVEEVISRFAKDGIPLLDPEEDMEVKSSSYRKATRRIEALESLFEKHDVRNSPHIQQRLKIFHAKKEISAKIKSIKKTMRASTALAFKDELKARKRVLRRLGYITSEDVVEVKGKVACEISSADELTLTELMFSGALKDATVEQMVALLSCFVWQEKLQDAPKPRDELDLLFYQLQETARRVANLQLECKIQIDVETFVNSFRPDVMEAVYSWARGSKFHQIMEMTQVFEGSLIRAIRRLEEVLQQLILASKSIGETELEAKLEEAVSKIKRDIVFAASLYL

SEQ ID NO: 9679 - protein, 776 aa, Oryza sativa
MPRSLLTGWLRECFISQVHKQPCHIVYTDYRPTPLQHYVFPSGGDGLYLVVDEKSKFREDSFQKGLNALVPASENDKKRENGKWQKGLLTGKPSEDSDIFKMVKMIIQRQYDPVILFSFSKRECEFLAMQMAKMDLNDDDEKANIETIFWSAMDLLSDDDKKLPQVSNMLPLLKRGIGVHHSGLLPILKEVIEILFQEGLIKCLFATETFSIGLNMPAKTVVFTNVRKFDGDRFRWLSSGEYIQMSGRAGRRGIDQRGICILMVDEKMEPSTAKMILKGSADSLNSAFHLSYNMLLNQIRCEDGDPEKLLRHSFYQFQADRVLPDLEKQVKELELERNSMIIEEEENLKSYYDLLQQYKNLKKDVRDIVHSPKYVLPFLQPGRLARVQYSTDEQSTFSIDENITWGVTINFEKVKTHSEDRRPEDSDYTVDVLTRCSVSKDKSGKKTMKIIPLKDRGEPVVISLPLSQIDGLSSIRMHIPKDLLPVEARENTLRKVDEVISRFAKDGIPLLDPEEDMKVQSSSFRKASRRIEALESLFEKHDVHNSPHIKQKLKVLHAKQELSTKIKAIKRTMRSSTALAFKDELKARKRVLRRLGYITSEDVVEVKGKVACEISSADELTLTELMFSGTLKDATVEQMVALLSCFVWQEKLQDAPKPREELDLLFFQLQETARRVANLQLDCKIQIDVESFVNSFRPDIMEAVYSWAKGSKFYQIMEMTQVFEGSLIRAIRRLEEVLQQLILASKSIGETQLEAKLEEAVSKIKRDIVFAASLYL

SEQ ID NO: 9680 - protein, 881 aa, Secale cereale
MSLRNQQRVIYTSPIKALSNQKYREFKEEFSDVGLMTGDVTIEPNASCLVMTTEIWRSMQYKGSEVMREVAWVIFDEVHYMRDRERGVVWEESIVMAPKNSRFVFLSATVPNAKEFADWVAKVHKQPCHIVYTDYRPTPLQHYVFPAGGDGLYLVVDENGKFREDSFQKSLNVLAPASGSDKKRENGKRQKGLVSAGKTNEESDIFKMVKMIIQRQYDPVILFSFSKRECEFLAMQMAKMDLNGDDEKVNIETIFWSAMDLLSDDDKKLPQVSNMLPLLKRGIGVHHSGLLPILKEVIEILFQEGLIKCLFATETFSIGLNMPAKTVVFTNVRKFDGDRFRWLSSGEYIQMSGRAGRRGIDQRGICILMVDEKMEPSTAKMMLKGGADSLNSAFHLSYNMLLNQLRSEDGDPEKLLRHSFYQFQADRALPDLEKQVRELEIERSSMVIEDEESVKDYYDLLQQYRTLKKDVRDIVLSPKYVLPFLQSGRLVRVQYSTDESTFSIDENVSWGIIINFEKVKINAEERRPEDCDYTVDVLTRCSVIKDISGKKTMKVIPLKSRGEPVVISLPLSQIDGLSSVRMYIPKDLLPVEARENTLRKVEEVLSRFAKDGVPLLDPEEDMEVKSSSYRKAARRIEALESLFEKHDIRNAPHIQQKLNVLHAKQEIKAKIKSIKKTMRASTALAFKDELKARKRVLRRLGYITSEDVVEIKGKVACEISSADELTLTELMFSGTLKDATVEQMVALLSCFVWQEKLQDAPKPREELDLLFYQLQETARRVANLQLECKIQIDVESFVNSFRPDVMEAVYSWARGSKFHQIMEMTQVFEGSLIRAIRRLEEVLQQLIPASQSIGETQLEAKLEEAVSKIKRDIVFAASLYL

SEQ ID NO: 9681 - protein, 995 aa, Eucalyptus grandis
MGSLKRKSIGDSGGEALPPAKQLREDGAAGEGVACVHDVSYPEGYVPEAEPPRSSSSQDRPAPAKEFPFTLDPFQSEAIKCLDSGESVMVSAHTSAGKTVVALYAIAMSLQNKQRVIYTAPIKALSNQKYREFKEEFSDVGLMTGDVTIEPNASCLVMTTEIWRSMQYKGSEIMREVAWIIFDEVHYMRDRERGVVWEESIVMAPKNSRFVFLSATVPNAKEFADWVAKVHQQPCHIVYTDYRPTPLQHYVFPSGGDGLYLVVDEKGKFREDSFQKALNALVPAGESDKKRENGKWQKSLVTGRVGEESDIFKMVKMIIQRQYDPVICFSFSKRECEFLAMQMAKMDLNEDDEKVNIETIFWSAMDMLSDDDKKLPQASVTNMLPLLKRGIGVHHSGLLPILKEVIEILFQEGLIKCLFATETFSIGLNMPARTVVFTNVRKFDGDKFRWISSGEYIQMSGRAGRRGIDKRGICILMVDEKLEPPTAKMMLKGSADSLNSAFHLSYNTLLNQLRCEDGDPENLLRNSFYQFQADRAIPDLQKQAKDLEEERDSIVIQEEESLKSYYDLLQQYKSLKKDVRDIALSPKYSLPFLQPGRLVSIECTSSDKSGSSFSMEDQATWGVIINFERVRSASEDSGNIKPEDSNYKVDVLTRCVVRRDGIAKKSINVVPLKEPGEPAVVSVPLLQINSLSSVRLVIPKDLLPLEVRENTLKKVLEVLSRFAKEGMPLLDPEEDMKIQSHSYRKAVRRIEALESLFDKHEIAKSPLIEEKLRVLNRKQELTAKIKSIKKAMRSSSVLAFKDELKARKRVLRRLGYITSDNVVELKGKVACEISSADELTLTELMFNGVLKDVKVEEMVSLLSCFVWREKLQDATKPREELDLLFMQLQDTARRVAKVQLECKVQIDVESFANSFRPDIMEAVYAWAKGSKFYEIMEITQVFEGSLIRAIRRLEEVLQQLILAAKSIGETDLESKFEEAVLKIKRDIVFAASLYL

SEQ ID NO: 9682 - protein, 994 aa, Vitis vinifera
MGSLKRKSTEDPSVERLSPQKQQREDSASLNTLEESVACIHDVSYPEGYEPRSSFSSSPRKDSKPAKEFPFTLDPFQSEAIKCLDAEESVMVSAHTSAGKTVVALYAIAMSLQNNQRVIYTSPIKALSNQKYREFKEEFSDVGLMTGDVTIEPNASCLVMTTEIWRSMQYKGSEIIREVAWVIFDEVHYMRDRERGVVWEESIVMAPRNSRFVFLSATVPNAKEFADWVAKVHQQPCHIVYTDYRPTPLQHYIFPSGGDGLYLVVDEKGKFREDSFQKALNALVPAGEGDKKRENGKRQKGLVVGRAGEESDIFKMVKMIIQRQYDPVILFSFSKRDCEFLAMQMARMDLNDDNEKVNIETIFWSAMDMLSDDDKKLPQVSNMLPLLKRGIGVHHSGLLPILKEVIEILFQEGLIKCLFATETFSIGLNMPAKTVVFTNVRKFDGDKFRWISSGEFIQMSGRAGRRGIDERGICILMVDEKLEPSTAKMMLKGSADCLNSAFHLSYNMLLNQMRSEDGDPEKLLRNSFYQFQADRAIPDLEKQAKNLEEERDSIIIEEEDSLENYYNLIQQYKSLKKDVRDIVFSPRYCLPFLQPGRLVCIQCTKTEENSPSFCIKDQTTWAVIINFERVKGTEDDVSRKPEDADYMVDVLTRCTVSRDGVLKKTIKIVSLKEPGEPVVVTVPISQIDGLSSVRLIISKDLLPLEARENTLKKVSEVLSRFAKEGMPLLDPEEDMKVQSSQYRKAVRRIEALESLFDKHEVAKSPLIEQKLKVLHMKKELTAKIKSIKRTMRSSTALAFKDELKARKRVLRKLGYVTSDNVVELKGKVACEISSADELTLTELMFNGVFKDIKVEDMVSLLSCFVWREKLQDAQKPKDELELLFTQLQDTARRVAKVQLESKVQIDVESFVNSFRPDIMEAVHAWAKGSKFYQIMEITQVFEGSLIRAIRRLEEVLQQLIQAAKSIGETELEAKFEEAVSKIKRDIVFAASLYL

SEQ ID NO: 9683 - protein, 994 aa, Citrullus lanatus
MGSSKRKLVDDAPRQSSPKQHRANARANVEDEPVACVHDVSYPEGSFNPLPSSSISSTGEKLEPAKVFPFSLDPFQSEAIKCLETGESVMVSAHTSAGKTVVALYAIAMSLRNKQRVIYTSPIKALSNQKYREFKEEFSDVGLMTGDVTIDPNASCLVMTTEIWRSMQYKGSEVTREVAWIIFDEVHYMRDRERGVVWEESIVMAPKNARFVFLSATVPNAKEFADWVAKVHHQPCHIVYTDYRPTPLQHYIFPSGGEGLYLVVDEKGHFREDSFQKALNALVPVSDSDKKKENNGKWQKSLTLGKTGEESDIFKMVKMIIQRQYDPVILFSFSKRECEFLAMQMAKLDLNGDDEKANIETIFWSAMDMLSDDDKKLPQVSNMLPLLKRGIGVHHSGLLPILKEVIEILFQEGLIKCLFATETFSIGLNMPAKTVVFSNVRKFDGDKFRWLSSGEYIQMSGRAGRRGIDKRGICILMVDEKLEPSTAKMMLKGNADCLNSAFHLSYNMLLNQIRSEDGDPENLLRNSFYQFQADRNIPNLEKRVKSLEEERDSIVIEEEDNLKNYYDLLKQYKSLKKDIRDIVLSPRYCLPFLQPGRLVSIECNSNDEISSTFSIKDQVTWGLIINFQRVKGVSEDDASMKPESANYTVDILTRCIVSKDGIGKKNVKIVQLKEHGEPHVVSIPISQISTLASIRILIPNDLLPLEARENTLKKISEVLSRFPKGVPLLDPEEDMKIQSSSYRKAVRRTEALESLFDKHEAAKSTLVEQKLKALHLKQELTAKIRSIKKTLRSSSALAFKDELKARKRVLRRLGYISSDDVVELKGKVACEISSANELTLSELMFNGIFKDIKVEEVVALLSCFVWQEKLQDAAKPREELELLFIQLQDTARRVAKVQLECKVEIDVEGFVNSFRPDIMEAVYAWAKGSKFYEIMEITQVFEGSLIRAIRRLEEVLQQLILAAKSIGETELETKFEEAVSKIKRDIVFAASLYL

SEQ ID NO: 9684 - protein, 183 aa, Zea mays
MAMKPAAAAPPTPAAAHSVFVYGSLMADEVVRTILKRVPPAAPALLPNYHRFNIKGRIYPAILPVESKRVAGRVIMGVTDEELQLLDAFEDVEYTRTRVEISLADSSENMLADTYVWSDAEDLNLYGEWDFEEWKKLHMKDFLAMTNGFMHELEQPESKTRVETYQEFMQQQEQPAPGTQVEG

SEQ ID NO: 9685 - protein, 185 aa, Panicum virgatum
MAMTPPPPAAAADPAAAAHSVFVYGSLMADEVVRAILKRVPPAAPALLPNYHRFNIKGRIYPAILPAESKKVAGMVIMGVTDEELRLLDAFEDVEYTRTRVEISLADPSEKMLADTYVWSDAEDPNLYGEWDFEEWKKLHMKDFLAMTNGFMHEIEQPEAKTRVETYQSFMQQQEQPASETQVEG

SEQ ID NO: 9686 - protein, 193 aa, Saccharum officinarum
MASPPPQQTLPPAPAAAAGAHTVFVYGSLMADEVVRTILKRVPPAAPALLPNYHRFNIKGRIYPAILPVESKRVAGRVITGVTDEELQLLDAFEDVEYTRTRVEISLTDSSEKMLADTYVWSDAEDPNLYGEWDFEEWKKLHMKDFLAMTNGFMHELEQPESKTPVETYESFMQQQEQACARDPRLRVESCNL

SEQ ID NO: 9687 - protein, 184 aa, Setaria italica
MAMTPPPPAPAAAAKAGAHSVFVYGSLMADEVVRAILKRVPPAAPAILPNYHRFNIKGRIYPAILPVESKKVAGMVVMGVTDEELQVLDAFEDVEYTRTRVEISLTDSSEKMLADTYVWSDAQDPDLYGEWDFEEWKRLHMKDFLAMTNGFMHGLEQPEAKTRVETYQSFMQQQEQPASETRES

SEQ ID NO: 9688 - protein, 190 aa, Panicum virgatum
MAMTPPPPHPAADPAAAAAKAGAHSVFVYGSLMADEVVRAILKRVPPAAPALLPNYHRFSIKSRIYPAILPAESKKVAGLVIMGVTDEELQVLDAFEDVEYTRTRVEISLVDSSEKMLVDTYVWSDAEDPNLYGEWDFEEWKKLHLKDFLAMTNGFMHELEQPEAKTWVETYQSFMQQQEQPASETQVEG

SEQ ID NO: 9689 - protein, 195 aa, Panicum virgatum
MAMTPPPPPPPPPPPAAAPAAAAAKAGAHSVFVYGSLMADEVVRAILKRVPPAAPPLLPNYHRFSIKSRIYPAILPAESKKVAGLVIMGVTDEELQVLDAFEDVEYTRTRVEISLVDSSEKMLVDTYVWSDAEDPNLYGEWDFEEWKKLHLKDFLAMTNGFMHELEQPEAKTRVETYQSFMQQQEQPASETQVEG

SEQ ID NO: 9690 - protein, 170 aa, Pennisetum glaucum
AGAHNVFVYGSLMTAEVVRAIIKRVPPAAPALLPNYHRFNIKGRIYPAILPVESKKVAGMVVMGVTDEELQVLDAFEDVEYTRTRVEISLTDSLEKMFADTYVWSDAQDPDLYGEWDFEEWKRLHMKDFLAMTNGFMHGLEQPEAKTRVETYQSFMQQQEQPASETQVES

SEQ ID NO: 9691 - protein, 161 aa, Panicum virgatum
GSLMADEVVRAILKRVPPAAPALLPNYHRFNIKGRIYPAILPAESKKVAGMVIMGVTDEELRLLDAFEDVEYTRTRVEISLADPSEKMLADTYVWSDAEDPNLYGEWDFEEWKKLHMKDFLAMTNGFMHEIEQPEAKTRVETYQSFMQQQEQPASETQVEG

SEQ ID NO: 9692 - protein, 642 aa, Sorghum bicolor
MGKGKKSKEKEMEKKPVDILAGSDEDSDGGEDLSKVQINEEYARRFEHNKRREALQRLEERRKQGLVPASDDGESDSESESSEEDEEAAIASRLVDRRVFEVIRRIRSGDPRILDKDAKVYSESEEEEGSEEGEGAEKEEEFKQGKKKAKKEKPLYLKDVNARHLLEEGPEFAAQASRSSSKFERISYDEQQKKGLEAFLEAQKEVLRGDDDDDDLFQVKPKARAGADDEVEEDEEEKQTKELAGKVFGNDEELDENEKFLKEFFLKRPYLEAEKRKSYLDDIQELSDDEEELEIQEENEHGYNYRHEEAMASGAVVADRVMGHSRVVEGSVRKKESSRKQQRKSKEERMARVKQEQAEELKHLKNLKKKEIAEKLERILMIAGIEGDAACKLGADDLEEDFDPEDYDKKMQEMFDDSYYEADDVDPEFGSGEEMDLKKPYFDKEDELLGLPKGWASEHSKEESTATDAKGAKGKISLKDKVELEKEMEEYYKLDYEDTIGDIKTRFKYKQVKPNSFGLSACDILEADDKDLNQYVSIKKLSPYREDEWKVTHHKRQSKDFILGGQKKGKKDKSVKKSRSEEGGPSSSKTEKDRLTNGQESTDDKKKTTRSERRKRRKADLKISDDRLVAFGKTNSKRHKSH

SEQ ID NO: 9693 - protein, 638 aa, Zea mays
MGRRKKSKEMEKKPLDILSGSDEDFDSGENLSKIQINEEYARRFEHNKRREALQRLEERRKQGLVPASDDDESESESSSEEEDEAAAIASRLVDRRMFEVIRRIRSGDPRILDKDAKVYSSEEEGGEEGEDAKKQEESKQEKEKTKKEKPLYLKDVNARHLLEEGPEFAAQPSRSSSKFERIAYDEQQKKGLEAFLEAQKEALGDGGDDDGDLFQVKEKARAGADDEAEEDEEEKQTKDLAGEVFGKDEELDENEKFLKEFFLKRPYLETEKSKSYLDNIQELSDEEELEIQEEYEHAYNYRHEEAMASGAVVADRVLGHSRVVEGSVRKKESSRKQQRKSKEERMARVKQEQAEELKHLKNLKKKEIAEKLERIRMIAGIEGDAACKLGADDLEEDFDPEDYDKKMQEMFDDSYYEADEVDPEFGSGEEMDLEKPDFGKEDELLGLPKGWASDHSKEESTATDAKGEKGKISLKDKVELEKEMEEYYKLDYEDTIGDIKTRFKYKQVKPNSFGLSTYDILASDDKDLNQYVSVKKLAPYREDEWKVTHHKKQSKDLILGGQKKEGKKDKSGKKSRSEEDPSSSKTENDRMTNGQESTDAKKKSTRSERRKRRKSELRPSSDRLEAYGKINSKRHKSH

SEQ ID NO: 9694 - protein, 629 aa, Panicum virgatum
MGKGGKEKEKKSLDILAGSDEDSDSGGEDLSKIQINEEYARRFEHNKRREALQRYEELKKKGLAPASDDESDDNEESSEEEEDEDAIASRRVDRRVFEVIRRIRSGDPRILDKDAKVYSSEEEGKEEKKEEPKQKKKAKKEKPLYLKDVNARHLLEEGPEFTAQTSRSSRYDRIAYDEQQKKGLQAFLEAEKEVLGDDDDDDDLFHEKPKAGAGADDEEDEEENETKELAGEVFGKDEELDENERFLKEFFLKRPYLESGKEKKSYLDDMQELSDVEEINEQEIYEHVYNFRHEEAEASGAVVADRVMGHSRVVEGSVRKKESSRKQQRKSKEERIARAKQEQAEELKHLKNLKKKEIAEKLERIRMIAGIEGDAACKLGADDLEEDFDPEDYDKKMQEMFDDCYYEADDVDPEFGSDEEMDLEKPDFDKEDELLGLPKGWASEKDKEESSATDGKATKGKISLKDKVELEKEMEEYYKLDYEDTIGDLKTRFKYKKVNPNSFGLSTYDILASDDMDLNQYVSMKKLAPYRESEWKVTHHKKLSKDLILGGQKKEGKKDKSGKKSKSAEGGSSSSKPEKDKLPIEQESTDDKKKSTRSSRRKRRNEDLKIPSGRLEAYGKINSKRHKSH

SEQ ID NO: 9695 - protein, 622 aa, Setaria italica
MGKGKKEKKPLDILAGSDDDSDGGGEDSSKIQINEEYARRFEHNKRREALQYYENLKKQGLAPPSDDEKDYGEVSSEEDEDAIASRTVDRRLFEVIRRIRSGDPAILDKDAKVYSSEEEGGEKKEGESKKKKKAKKEKPLYLKDVNARHLLEEGPEFTAQTSRSSRYDRIAYDEQQKKGLEAFLEAQKEVLGDDDDDDLFHEKPKAGAAADEDEDEEEKQTKELAGEVFGKDEELDENEKFLKEFFLKRPYLDSGKKSYLEDIQELSDEEELKDQEKYEYVYSFRHEEAEASGAVVADRVMGHSRVVEGSVRKKESSRKQQRKSKEERMARAKQEQAEELKHLKNLKKKEIAEKLERIRMIAGIEGDAACKLGADDLEEDFDPEDYDKKMQEMFDDSYYEADDVDPEFGSGEEMDLKKPDFDKEDELLGLPKGWDSENCKEESSATDGKATKGKISLKDKVELEKEMEEYYKLDYEDTIGDLKTRFKYKKVNPNSFGLSTYEILASDDKDLNQYVSMKKLAPYRESEWKITHHRKLSKDLILGGQKKVGKKDKSGKKSGSAEGGPSSSKPEKDKLPIEQELTDDKKKSTRSRRRKRRNEDLKMSADRLGAYGKLNSKRHKSH

SEQ ID NO: 9696 - protein, 624 aa, Panicum virgatum
MGKWKKEKKSLDILAGSDEDSDSGGEDLSKIQINEEYARRFEHNKRREALQRYEELKKKGIVSASDDESEENEESSEEEDEDAIASRRVDRRVFEVIRRIRSGDPRILDKDAKVYSEEEEGEEEKKEEPKQKKKAKKEKPLYLKDVNARHLLEEGPEFTSQTSRSSRYDRIAYNEQQKKGLQAFLEAEKEVLGDDDDDDDLFHEKPKAGAGADDEEDEEENETKKLAGEVFGKDEELDENERFLKEFFLKRPYLESGKKKSYLDDMQELSDVEDVTEQEIYEYVYNFRHEEAEASGAVVADRVMGHSRVVEGSVRKKESSRKQQRKSKEERIARAKQEQAEELKHLKNLKKKEIAEKLERIRMIAGIEGDAACKLGADDLEEDFDPEDYDKKMQEMFDDSYYEADDVDPEFGSGEEMDLDKPDFDKEDELLGLPKGWASEKDKEESTATDGKATKGKISLKDKVELEKEMEEYYKLDYEDTIGDLKTRFKYKKVNPNSFGLGTYDILASDDKDLNQYVSMKKLAPYRESEWKVTHHKKLSKDLILGGQKKEGKDKSGKKSKSAEGGPSSSKQEKDKLPVEQELTDDKEKSTRSRRRKRRKEDLKLSSGRLGAYGKINSKRHKSN

SEQ ID NO: 9697 - protein, 156 aa, Cajanus cajan
MDIRLMDLDSPLFNTLHRIMDLTEDAEKNLNAPTRTYVRDAKAMAATPADVKEYPNSYVFVIDMPGLKSGDIKVQVEEDNVLLISGERKREEEKEGSKYLRMERRVGKFMRKFTLPENANTDAISAVCQDGVLTVTVNKLPPPEPKKPKTIEVKIA

SEQ ID NO: 9698 - protein, 158 aa, Glycine max
MDMRLMDLDSPFFNTLHRIMDLTEDAEKNLNAPTRTYVRDAKAMAATPADVKEYPNSYVFVIDMPGLKSGDIKVQVEDDNVLLISGERKREEEKEKEGGKYLRMERRLGKLMRKFTLPENANTDAISAVCQDGVLTVTVNKLPPPQPKKPRTIEVKIA

SEQ ID NO: 9699 - protein, 158 aa, Glycine max
MAIRLMDLDSPFFNTLHRIMDLTEDAEKNLNAPTRTYVRDAKAMAATPADVKEYPNSYVFVIDMPGLKSGDIKVQVEDDNVLLISGERKREEEKEKEGGKYLRMERRLGKLMRKFTLPENANTDAISAVCLDGVLTVTVNKLPPPQPKKPKTIEVNIA

SEQ ID NO: 9700 - protein, 156 aa, Phaseolus coccineus
MDIRLMDLDSPLFSTLHRIMDLTEDAEKNLSAPTRTYVRDAKAMAATPADVKEYPNSYVFVVDMPGLKSGDIKVQVEEDNVLLISGERKREEEKEGARYLRMERRVGKFMRKFTLPDNANTDTVSAVCQDGVLTVTVNKLPPPEPKKPKTIEVKIG

SEQ ID NO: 9701 - protein, 156 aa, Vigna unguiculata
MDIRLMELDSPLFSTLHRMMDMTEDAEKNLSAPTRTYVRDAKAMAATPVDVKEYPNSYVFVIDMPGLKSGDIKVQVEEDNVLIISGERKREEEKEGAKYLRMERRVGKFMRKFTLPDNANTDAISAVCQDGVLTVTVNKLPPPEPKKPKTIEVKIG

SEQ ID NO: 9702 - protein, 157 aa, Trigonella foenum-graecum
MDFRLMGLDSPLFNTLHHIMDLTDDTTEKNLNAPTRTYVRDAKAMAATPADVKEYPNSYVFVVDMPGLKSGDIKVQVEDDNVLLISGERKREEEKEGGKYLKMERRVGKFMRKFVLPENADVEGVSAVCQDGVLTVTVNKLPPPEPKKPKTIEVKIA

SEQ ID NO: 9703 - protein, 157 aa, Lotus japonicus
MDIRLMGLDSPLLNTLHHIMDLPDDSTEKNSHAPTRTYLRDAKAMAATPADVKEYPSSYVFVIDMPGLKSGDIKVQVEDDNVLLISGERKRDEEKEGSKYVRMERRVGKFMRKFVLPENANVHAISAVCQDGVLTVTVNKLPPPEPKKPKTIEVKVA

SEQ ID NO: 9704 - protein, 158 aa, Arachis hypogaea
MDFRLMGLDSPLLSTIHHMMDMSDDNADAKNINAPTRTYVRDAKAMAATPADVKEYPQSYVFVIDMPGLKSGDIKVQVEDDNVLIISGERKRDEEKEGAKYLRMERRVGKFMRKFVLPENANTDAISAVCQDGVLTVTVQKLPPPEPKKPKTIEVKIA

SEQ ID NO: 9705 - protein, 157 aa, Cicer arietinum
MDFRLMGLDSPLLNTLHHIMNITDDTTEKNLNAPTRTYVRDAKAMAATPADVKEYPNSYVFVVDMPGLKSGDIKVQVEDDNVLLISGERKREEEKEGVKYLKMERRVGKFMRKFVLPENGDVEGISAVCEDGVLTVTVNKLPPPEPKKPKTIEVKIA

SEQ ID NO: 9706 - protein, 158 aa, Medicago truncatula
MDFRLMGLDSPLFNTIHHIMDLTDDTTEKNLNAPTRTYVRDAKAMAATPADVKEYPNSYVFVVDMPGLKSGDIKVQVEDENVLLISGERKREEEKEGGKYLKMERRVGKFMRKFVLPENADVEGGVSAVCQDGVLTVTVNKLPPPEPKKPKTIQVKVA

SEQ ID NO: 9707 - protein, 156 aa, Malus domestica
MDIRIPGFDAPLFSTLQHIMDVADDAEKSFNAPTRTYVRDAKAMAATPADVKEYPNSYVFVVDMPGLKSGDIKVQVEDDNVLLISGERKREEEKEGVKYVRMERRVGKFMRKFVLPENANVDAISAVCQDGVLTVTVEKLPPPEPKKPKTIEVKIG

SEQ ID NO: 9708 - protein, 156 aa, Euonymus alatus
MDFRIVGSDSPIFNTLHQLMDIGEDAEKSFNNPSRTYVRDAKAMAATPADVKEYPNSYVFVVDMPGLKSDDIKVQVEDDNVLLISGERKREEGKEEAKYVRMERRVGKFMRKFVLPENANTDAISAVCQDGVLTVTVQKLPPPQPKKPKTIEVKIA

SEQ ID NO: 9709 - protein, 156 aa, Vitis vinifera
MDLRVMDFDSPLFSTLQHMLDAVEDSDKSLNAPTRTYVRDAKAMAATPADVKEYPNAYAFIIDMPGLKSGDIKVQVEDDNVLMISGERKREEEKEGAKYVRMERRVGKFMRKFVLPENANTDKISAVCQDGVLTVTVEKLPPPEPKKPKTIEVKIA

SEQ ID NO: 9710 - protein, 157 aa, Pisum sativum
MDFRLMDLDSPLFNTLHHIMDLTDDTTEKNLNAPTRTYVRDAKAMAATPADVKEHPNSYVFMVDMPGVKSGDIKVQVEDENVLLISGERKREEEKEGVKYLKMERRIGKLMRKFVLPENANIEAISAISQDGVLTVTVNKLPPPEPKKPKTIQVKVA

SEQ ID NO: 9711 - protein, 157 aa, Juglans hindsii x Juglans regia
MDLRIMGVDSPLFSTLHQMMDLTEDTDKSSFNAPTRTYVRDAKAMAATPADVKEYPTSYVFIIDMPGLKSGDIKVQVEDDNVLVISGERKRDEEKEGPKYVRMERRIGKFMRKFVLPENANTDAISAVCQDGVLTVTVEKLPPPEPKKPKTIEVKIA

SEQ ID NO: 9712 - protein, 156 aa, Malus domestica
MDVRIQGLDAPLFSTLQHIIDAADDAEKSFNAPTRTYVRDAKAMASTPADVKEYPTSYVFVVDMPGLKSGDIKVQVEDDNVLLISGERKREEEKEGAKYVRMERRVGKFMRKFVLPENANVDAISAVCQDGVLTVTVQKLPPPEPKKPKTIEVKIA

SEQ ID NO: 9713 - protein, 156 aa, Hevea brasiliensis
MDIRLLGLESPLFSTIQHLMDTTDEAEKSFNAPTRTYVRDAKAMASTPADVKEYPNSYVFIIDMPGLKSGDIKVQVEDDNMLLISGERKREEEKEGAKYVRMERRVGKLMRKFVLPENANADAISAVCQDGVLTVTVEKLPPPEPKKPKTIEVKIA

SEQ ID NO: 9714 - protein, 161 aa, Vigna unguiculata
MDFRVMGLESPLFHTLHRMMDMSEEGAGEKTHNAPTQTYMRDAKAMAATPADVKEYPNSYVFVVDMPGLKSGDIKVQVEDDNVLLISGERKREEEKEEKEGVKFLRMERRVGKFMRKFVLPENANTDAISAVCQDGVLSVTVQKLPPPQPKKPRTIEVKIA

SEQ ID NO: 9715 - protein, 157 aa, Nicotiana benthamiana
MDFRLMGMDTPFFHTLQQLMDAAGEDSDKSVNAPSRNYVRDAKAMAATPADVKEYPNSYVFVVDMPGLKSGDIKVQVEDDNVLLISGERKREEEKEGAKYIRMERRIGKFMRKFTLPENANTDAISAVCQDGVLTVTVQKLPPPEPKKPKTIEVKIA

SEQ ID NO: 9716 - protein, 157 aa, Populus trichocarpa
MDFRIMGLDAPLFNTLQHMMDASDHEADKSFNAPTRTYVRDAKAMASTPADVKEYPNSYAFVIDMPGLKSGDIKVQVEDDNVLVISGERKRGEEKEGAKYVRMERRVGKFMRKFVLPENANTDAISAVCQDGVLTVTVEKLPPPEPKKPKTIEVKIA

SEQ ID NO: 9717 - protein, 157 aa, Jatropha curcas
MDVRFVGLDSPLLHTLQQMMDIGDDADHKSFNAPTRTYVRDAKAMASTPADVKEYPNSYVFIIDMPGLKSGDIKVQVEDDNVLLISGERKREEEKEGAKYVRMERRVGKLMRKFALPENANTDAISAVCQDGVLTVTVQKLPPPEPKKPKTIEVKIA

SEQ ID NO: 9718 - protein, 156 aa, Malus domestica
MDLRIPGLEAPLFSTLQHIMDAADDAEKSFNAPTRTYVRDAKAMASTPADVKEYPTSYVFVVDMPGLKSGDIKVQVEDDNVLLISGERKREEEKEGAKYVRMERRVGKFMRKFVLPENANVDAISAVCQDGVLTVTVQKLPPPEPKKPKTIEVKIG

SEQ ID NO: 9719 - protein, 156 aa, Euonymus alatus
MDFRIMGLDAPIFNTLHQMMDIGEDAEKSFNNPSRTYVRDAKAMAATPADVKEYPNSYVFVVDMPGLKSGDIKVQVEDDNVLVVSGERKREEEKEGARYVRMERRVGKFMRKFVLPENANIEAISAVCQDGVLTVTVQKLPPPEPKKPKTIEVKIA

SEQ ID NO: 9720 - protein, 156 aa, Prunus persica
MDVRIAGLDSPLFSTLQHIMDFTDEPDKSFNAPTRTYVRDAKAMASTPADVKEYPNSYVFVVDMPGLKSGDIKVQVEDDNVLLITGERKREEEKEGAKYVRMERRVGKFMRKFVLPENANVEAISAVCQDGVLTVTVEKLPPPEPKKPKTIEVKIA

SEQ ID NO: 9721 - protein, 156 aa, Fragaria vesca
MDFRIMGLDAPILTALQHLADLPEDAEKTFNAPTRTYVRDAKAMAATPADVKEYPNSYVFVIDMPGLKSGDIKVQVEDDNVLVISGERKREDEKEGAKYVRMERRVGKFMRKFSLPENANVEAISAVCQDGVLTVNVEKLPPPQPKKPKTIEVKIA

SEQ ID NO: 9722 - protein, 159 aa, Cannabis sativa
MDFRILGLDSPLFTTLNQMIDNSEDSADHSKSINAPTRTYVRDAKAMAATPADVKEYPNSYVFIIDMPGLKSGDIKVQVEDDNVLLISGERKREEEKEGAKYVRMERRVGKFMRKFVLPENADTDAISAVCQDGVLTVTVQKLPPPEPKKPKTIEVKIA

SEQ ID NO: 9723 - protein, 497 aa, Ricinus communis
MGKKKNMLYTKPPSGAAGKSETRQLTRPERSGFYARREAANVLKRVLQGHAQRRATGSIKSLVYSPSVRNKRATFALVCQTLKHLPVIKDVLESAGALNTHSKKKEELMYIVAYDILFGQEIPLVVGDVEKFLLRRKNDLQRALAKVLVRKKAKTIDDLLALYRPPDVSKPCYVRVNTLKSDVDSALLELGRQFTVQKDDMVPNLFVLPPNSDLHNHPLVLDGSIFVQGKASSMVAVALDPKPGWEVLDACSAPGNKTVHVAALMRGKGRIIACELNKDRIKRLEDTVRLSGAANIEVRHCDFLNLNPRDSPFSKIRAILLDPSCSGSGTAAQRLDHLLPSHATDPNNMERLKKLAAFQKKALAHALSFPAVERVVYSTCSINQTENEDVIISILPIAASHGFQLVTPFPQWHRRGLSVFEGSEHLLRTDPVEDKEGFFIALFVKKGTVDESGKLPKNVPVSLATEKYKLKRKSHVNRKKLLMPLLFNRVSKFWLLN

SEQ ID NO: 9724 - protein, 158 aa, Ricinus communis
MDLRLMGIDSPLFQTLQQMMDITHGDESDKSFSAPTRTYVRDAKAMASTPADVKEYPNSYVFIIDMPGLKSGDIKVQVEDDNVLLISGERKRQEEKEGAKYVRMERRVGKFMRKFVLPENANTDAISAVCQDGVLTVTVEKLPPPEPKKPKTIEVKIA

SEQ ID NO: 9725 - protein, 97 aa, Catharanthus roseus
MDLRLMGIDAPLIHTLQHIMDAATEDSDKSGNAPTRNYVRDAKAMAATPADVKEYPNSYVFVVDMPGLKSGDIKVQVEDDNVLIISGERKEKRKKKE

SEQ ID NO: 9726 - protein, 157 aa, Nicotiana benthamiana
MDFRLMDIDTPLFHTLQHLMDAVGDDSDKSVNAPSRNYVRDAKAMAATPADVKEYPNFYVFVVDMPGLKSGEIKVQVEDDNVLLISGERKREEEKEGAKYIRMERRIGKLMRKFTLPENANTDAISAVCQDGVLTVTVQKLPPPEPKKPKTIEVKIA

SEQ ID NO: 9727 - protein, 157 aa, Populus trichocarpa
MDFRIMGLDAPLFNTLQHMMDASDHEADKSFNAPTRTYVRDAKAMASTPADVKEYPSSYAFVIDMPGLKSGDIKVQVEDDNVLVISGERKRGEEKEGAKYVRMERRVGKFMRKFVLPENANTDAISAVCQDGVLTVTVEKLPPPEPKKPKTIEVKIA

SEQ ID NO: 9728 - protein, 157 aa, Nicotiana tabacum
MDFRLMGIDTPLFHTIHHLMDTAGDDSDKSVNAPSRNYVRDAKAMAATPADVKEYPNSYVFVVDMPGLKSGDINVQVEDDNVLLISGERKREEEKEGAKYIRMERRVGKFMRKFTLLENANTDAISAVCQDGVLTVTVQKLPPPEPKKPKTIEVKIA

SEQ ID NO: 9729 - protein, 157 aa, Nicotiana tabacum
MNFRLMGIDTPLFHTLQHLMDAAGEDSDKSVNAPSRNYVRDAKAMAATPADVKEYPNSYVFVVDMPGLKSGDIKVQVEDDNVLLISGERKREEEKEGAKYIRMERRIGKFMRKFTLPENANTDAISAVCQDGVLTVTVQKLPPPEPKKPKTIEVKIG

SEQ ID NO: 9730 - protein, 491 aa, Malus domestica
MSLRNLGFDPNLLETLHDLLDISDEQNQQSYQAPSRRYVREAKAMAATPADVKETKDAYVFVVDVPGLRPDMINVKIEEDNVLVVSGERKKEKERDQGIKYLRMERRLGKYLKKFVLPDNADIERISAECQDGVLTVTVAKKPPPEQKKPKTIQIQISSNQGGGQGGKGGQGWEEGGEEERGKQGGGQGWEHVKQDGGQGGEGGQGWEEGGQVERGRQGRGQGDQGGGQGGKGGQGWEEGGQEERGRQGGEQGGEHGRQGGQSGGERGAGGYEGQVEGRDKTFLPFLLTHVINSSYKYPEPPPSSVTVTRFPLENSRKPSNRNRKAKIPPTKKRRMDIRNPGLEAQLFSTLQHIMDAADDAEKSFNAPTRTYVRDAKAMASTPADVKEYPTSYVFEVDMPGLKSGDIKVQVEDDNVLLISGERKREEEKEGAKYVRMERRVGKFMRKFVLPENANVDAISAVCQDGVLTVTVQKLPPPEPKKPKTIEVKIG

SEQ ID NO: 9731 - protein, 156 aa, Prunus mume
MDVRIAGLDSPLFSTLQHIMDFNDEPDKSFNAPTRTYVRDAKAMASTPADVKEYPNSYVFVVDMPGLKSGDIKVQVEDDNVLVISGERKREEEKEGAKYVRMERRVGKFMRKFVLPENANLEAISAVCQDGVLTVTVEKLPPPEPKKPKTIEVKIA

SEQ ID NO: 9732 - protein, 159 aa, Fagus grandifolia
MDLRIMGLESPLLSTLQHMMELSEDSDKSSSSINAPTRTYVRDAKAMASTPADVKEYPNSYVFVVDMPGLKSGDIKVQVEDDNVLLISGERKREEEKEGAKYLRMERRVGKFMRKFVLPENANTDAISAVCQDGVLTVTVNKLPPPEPKKPRTIQVSIA

SEQ ID NO: 9733 - protein, 158 aa, Cajanus cajan
MDFRVMGLESPLFHTLQHMMDLSDDGAGDKTHNAPTRSYVRDAKAMAATPADVKECPKSYVFEIDMPGLKSGDIKVQVEDDNVLLISGERKREEEKEGSKYLRMERRVGKFMRKFILPENANTDAISAVCQDGVLSVTVQKLPPPQPKKPKTIEVKVA

SEQ ID NO: 9734 - protein, 157 aa, Nicotiana benthamiana
MDFRLMGIDTPLFHTLQHLMDAAGDDSDKSVNAPSRNYVRDAKAMAATPADVKEYPNSYVFVVDMPGLKSGDIKVQVEDDNVLLISGERKREEEKEGSKYIRMERRVGKFMRKFTLPENANSDAISAVCQDGVLTVTVQKLRPPEPKKPKTIEVKIA

SEQ ID NO: 9735 - protein, 156 aa, Nicotiana benthamiana
MDFRLMGIDNPLFHTLQHLMDAGGEDSDKSVNAPSRNYVRDAKAMAATPADVKEYPNSYVFVVDMPGLKSGDIKVQVEDDNVLLISGERKREEEKEGAKYIRMERRIGKFMRKFALPENANTDAISAVCQDGVLTVTVQKPPPEPKKPKTIEVKVA

SEQ ID NO: 9736 - protein, 157 aa, Rosa hybrid cultivar
MDFRIMGLDAPILTALQHLADLPEETEKTFNNAPTRTYVRDAKAMAATPADVKELPNSYVFVIDMPGLKSGDIKVQVEDDNVLLISGERKREEEKEGAKYVRMERRVGKFMRKFVLPENANADTISAVCQDGVLTVTVEKLPPPQPKKPKTIEVKIG

SEQ ID NO: 9737 - protein, 156 aa, Tabernaemontana elegans
MDLRLMGIDAPLLHTLQHMIDNANDDADKSNGPSRTYVRDAKAMAATPADVKEYSKSYVFVVDMPGLKSGDIKVQVEDDNVLIISGERKREEEKEGAKYLRMERRVGKFMRKFVLPENANTDAISAVCQDGVLTVTVEKLPPPEPKKPKTIEVKIA

SEQ ID NO: 9738 - protein, 157 aa, Nicotiana benthamiana
MDFRLMGIDAPLFHTLQHLMDAAGEDSDKSVNAPSRNYVRDAKAMASTPADVKEYPNSYVFVVDMPGLKSRDIKVQVEDDNVLLISGERKREEEKEGAKYIRMERRIGKFMRKFTLPENANTDAISAVCQDGVLIVTVQKLPPPEPKKPKTIEVKIA

SEQ ID NO: 9739 - protein, 156 aa, Theobroma cacao
MDFRIMGLDSPLIHTLQHIMDLPDEMEKTTNVPSRTYVRDAKAMAATPADIKEYPNSYVFIVDMPGLKSGDIKVQVEDDNVLLISGERKREEEKEGAKYVRMERRVGKLMRKFVLPENANADAISALCQDGVLTVTVEKLPPPEPKKPKTIEVKIA

SEQ ID NO: 9740 - protein, 156 aa, Manihot esculenta
MDLRLFGLETPLIHTIHQMMDTTDEADKSFNAPTRTYVRDAKAMASTPADIKEYPNSYVFIIDMPGLKSGDIKVQVEDDNVLLISGERKRDEEKEGAKYVRMERRVGKFMRKFVLPENANTDTISAVCQDGVLTVTVEKLPPPEPKKPKTIEVKIA

SEQ ID NO: 9741 - protein, 156 aa, Coffea canephora
MDVRLLGLDAPLVNALHHLIDAADDGDKIANAPTRTYVRDAKAMAATPADVKEYPNSYVFIVDMPGLKSGDIKVQVEDDNVLVVSGERKREEEKEGARYVRMERRVGKFMRKFVLPENANTDAISAVCQDGVLTVTVHKLPPPEPKKPKTIEVKIA

SEQ ID NO: 9742 - protein, 155 aa, Vitis vinifera
MDLRIMGFDSPLSTLQHMLDGVDDADKPVSAPTRTYVRDAKAMAATPADVKEYPNSYVFIIDMPGLKSGDIKVQVEDDNVLVISGERKREEEKEGAKYVRMERRVGKFMRKFVLPENANTDKISAVCQDGVLTVTVEKLPPPEPKKPKTIEVKVA

SEQ ID NO: 9743 - protein, 159 aa, Tropaeolum majus
MDFRLMGLDSPLFVNLHNIMDLADQEAATEKSSNAPTRTYVRDAKAMAATPADVKEYPNSYVFVIDMPGLKSGDIKVQVEEDNFLMISGERKKEEEKEGVKYLRIERRIGKFMRKFVLPDNANTDAISAVCQDGVLTVAVEKLPPPEPKKPKTIEVKIA

SEQ ID NO: 9744 - protein, 158 aa, Humulus lupulus
MDFRILGLDSPLFTTLNQMVDPSDESNDHKSFNAPTRTYVRDAKAMAATPADVKEYPNSYVFIIDMPGLKSGDIKVQVEDDNVLLISGERKREEEKEGAKYVRMERRVGKFMRKFVLPENADTDSISAVCQDGVLTVTVKKLPPPEPKKPKTIEVKIA

SEQ ID NO: 9745 - protein, 156 aa, Nicotiana benthamiana
MDLRLMGIDTPLFHTLHHLMDTAGEDSDKSVNVPSRNYVRDAKAMAATPADVKEYPNSYIFVVDMPGLKSGDIKVQVEDDNVLLISGERKREEEKEGAKYIRMERRIGKFMRKFALPENANTDAISAVCQDGVLTVTVQKPPPEPKKPKTIEVKVA

SEQ ID NO: 9746 - protein, 157 aa, Nicotiana benthamiana
MDFRLMGMDTPLFHTLQHLVDAAGDDSDKSVNAPSRNYVRDAKAMAATPADVKEYPNSYVFVVDMPGLKCGDIKVQVEDDNVLLISGERKREEEKEGAKYIRMERKIGKFMRKFTLPENANTDAISAVCQDGVLTVTVQKLPPPEPKKPKTIEVKIA

SEQ ID NO: 9747 - protein, 157 aa, Olea europaea
MDFRLMGFDTPLFHTLHHLVDSAEDGENRSMSAPTRTYVRDAKAMAATPADIKEYPNSYVFIVDMPGLKSNDIKVQVEDDNVLLISGERKRDEEKEGAKYVRMERRVGKFMRKFVLPENANTNAISAVCQDGVLTVTVQKLPPPEPKKPKTIEVKIA

SEQ ID NO: 9748 - protein, 97 aa, Fraxinus spp
MDFRLMGFDTPLFHTLHHLVDAAEDGENKSMSAPTRTYVRDAKAMAATPADIKEYPNYYAFVVDMPGLKSGDIKVQVEEDNVLLISGERKREEEKRV

SEQ ID NO: 9749 - protein, 156 aa, Eucalyptus grandis
MDFRLTGLESPLFATLHHLMDVPEEAEKSANAPTRTYVRDARAMAATPADVKELPGSYAFVVDMPGLGSGDIKVQVEDDNVLVISGERRREEEKEGAKYLRMERRVGKFMRKFVLPENANTEAVSAVCRDGVLTVTVEKLPPPEPKKPKTIEVKIA

SEQ ID NO: 9750 - protein, 156 aa, Citrullus lanatus
MDLRIMGLDSPIFSTLQHVMDLADEADKSFSAPTRTYVRDAKAMAATPADVKEYPNSYVFVVDMPGLKVGDIKVQVEDDNVLLISGERKREEEKEGAKYVRMERRVGKLMRKFVLPENANTDAISAVCQDGVLTVTVQKLPPPEPKKPKIVEVKVN

SEQ ID NO: 9751 - protein, 158 aa, Lotus japonicus
MDFRVMGLNSPLFHTLYDMMDMSDDTASDKTLNAPTRTYVRDAKAMAATPADVKENPNSYFFVIDMPGLKSGDIKVQVEDDNVLVITGERKREEEKEGVKYLRMERRVGKFMRKFVLPENANTDAISAVCQDGVLSVTVQKLPPPEPKKPRTIEVKLA

SEQ ID NO: 9752 - protein, 158 aa, Solanum lycopersicum
MDLRLLGIDNTPLFHTLHHMMEAAGEDSDKSVNAPSRNYVRDAKAMAATPADVKEYPNSYVFVVDMPGLKSGDIKVQVEEDNVLLISGERKREEEKEGAKFIRMERRVGKFMRKFSLPENANTDAISAVCQDGVLTVTVQKLPPPEPKKPKTIEVKVA

SEQ ID NO: 9753 - protein, 501 aa, Mimulus guttatus
MARWKPTAALRSTVKERKPIDKKPSNAERSALFARREAAKVLRSTLQGDARRRAVGSIKSLVYSPSVRNKKATFALVCQTLKHLSIIKDVLEEANVLSAKWKKHQELMYIIAYDLLFGQEVSLSGDAEKYLMLKKDALQSALSRILRRKGVKTVEDLLGLDKKSEVRKPRYVRVNTLKIDAEYAKSELRQQYSVQEDDMVPDLLILPPGADLHNHPLVKNGSIFLQGRASSMAAVALGPKPGWKVIDACSAPGNKTVHLAALMKGKGKIIACELNKDRVKRLQDNVKLAGAINVKVKHGDFLNLDPKDPSYSKVRAILLDPSCSGSGTAFDRLDHLLPSHSAEGTSDHVDVKRLQKLAGFQKKALEHALSFPSVERIVYSTCSIHQTENEDVVNSVLHFASSLGFQLATAFPQWPRRGLPTFDGSEHLLRTDPTIDKEGFFISLFVREGLAQNEEHQIRRNSHSRARKPLNIFVAKMLKVSRHHRFKLSCNRANAASSRGI

SEQ ID NO: 9754 - protein, 157 aa, Mimulus guttatus
MDFRLMGFDAPLLHTLHNMLDTDDSDSTKSVSAPTRTYVRDAKAMAATPADVKEYPNSYVFVIDMPGLKSGDIKVQVEEDNLLLISGERKREEEKEGAKYVRMERRIGKFMRKFVLPENANTDKITAVCQDGVLTVTVEKLPPPEPKKPKTIEVKIA

SEQ ID NO: 9755 - protein, 157 aa, Nicotiana benthamiana
MDFRLMGIDTPLLHTLHHLMETAGDDSDKSVNAPSRNYVRDAKAMAATPADVKDYPNSYVFVVDMPGLKSGDIKVQVEDDNVLLISGERKREEEKEGEKYIRMERRVGKFMRKFTLPENANTDAIAAVCQDGVLTVTIQKLPPPEPKKPKTIEVKIA

SEQ ID NO: 9756 - protein, 157 aa, Orobanche aegyptiaca
MDFRLMGLDAPLIHTLHNMLDSDESDAGKSVSAPTRTYVRDARAMAATPADVKEYPNSYVFVIDMPGLRSGDIKVQIEEDNLLLISGERKREEEKEGAKYVRMERRIGKFMRKFVLPENANTDKIAAVCQDGVLTVTVEKLPPPEPKKPKTIEVKIA

SEQ ID NO: 9757 - protein, 157 aa, Nicotiana tabacum
MDFRLMGIDTPLLHTLQHFMDAAGEDSDKSINAPSRNYVRDAKAMAATPADVKEYQNSYVFIVDMPGLKSGDIKVQVEDDNVLLISGERKREEEKEGAKYIRMERRIGKFMRKFTLPENANTDAISAVCRDGVLTVIVQKLPPPEPKKPKTIEVKIA

SEQ ID NO: 9758 - protein, 152 aa, Nicotiana tabacum
  misc_feature (96)..(96): Xaa can be any naturally occurring amino acid
MGIDTPLFHTLQHLMDTAGEDSDKSVNAPSRNYVRDAKAMAATPADVKEYPNSYVFVVDMPGLKSGDIKVQVEDDNVLLISGERKREEEKEGAKYXRMERRIGKFMRKFSLPENANTDAISAVCQDGVLTVTVQKLPPPEPKKPKTIEVKIA

SEQ ID NO: 9759 - protein, 157 aa, Juglans hindsii x Juglans regia
  misc_feature (8)..(8): Xaa can be any naturally occurring amino acid
  misc_feature (145)..(145): Xaa can be any naturally occurring amino acid
  misc_feature (149)..(149): Xaa can be any naturally occurring amino acid
  misc_feature (156)..(156): Xaa can be any naturally occurring amino acid
MDFRIMGXDSPLFSTLQQMMDLADDTDKSSFNAPTRTYMRDAKAMAATPADVKEYPSSYVFIIDMPGLKSGDIKVQVEEDNVLVISGERKREEEKEGAKYVRMERRVGKFMRKFVLPENANTDAISAVCQDGVLTVTVEKLPPPXPKKXKKIEVKXA

SEQ ID NO: 9760 - protein, 66 aa, Cucurbita pepo
MDLRVMGLDSPLFSTLQQVMDFADDADKSSAPRPVPTSGTPRPWQPLRPTSRSIRIPMFLSSTCRG

SEQ ID NO: 9761 - protein, 156 aa, Eucalyptus grandis
MDFRLTGLESPLFATLHHLMDVPEEAEKSASAPTRTYVRDARAMAATPADVKELPGSYAFVVDMPGLGSGDIKVQVEDDNVLVISGERRREEEKEGAKYLRMERRVGKFMRKFVLPENANTEAVSAVCRDGVLTVTVEKLPPPEPKKPKTIEVKIA

SEQ ID NO: 9762 - protein, 156 aa, Vitis vinifera
MDLRVMGFDSPLFSTLQHMLDAGDDSDKSLNAPTRTYVRDAKAMAATPADVKEYPNSYTFIVDMPGLRSGDIKVQVEDGNVLVISGERKREEEKEGAKYVRMERRVGKFMRKFVLPENANSDKISAVCQDGVLTVTVEKLPPPEPKKPKTIEVKIA

SEQ ID NO: 9763 - protein, 159 aa, Tropaeolum majus
MDYRMMGLESPLFATLHNMMDLTDQEGQGEKSSSHAPTRTYVRDAKAMASTPADVKEYAKSYVFVVDMPGLKSGDIKVQVEDNVLLISGERKREEEKEGAKYVRMERRIGKFMRKFALPDNANTDAISAVCQDGVLTVTVEKLPPPEPKKPKTIEVKIA

SEQ ID NO: 9764 - protein, 516 aa, Citrus clementina
MARTKTAATAPSGASAKTSRNGRLSNAERSAYFARREAAKVLRLVLRGDARRRAVGSIKSLVYSPSVKNKKATFALVCQTLKHLSIIKQVLDSASILNSKWKRQEELVYILTYDILFGQEISLVGDAEKFLMLHKGAIQSALARLLVRNKVKSIEDLMALYQTPDVPKPRYVRVNTLKMDVDSAVLELGKQFVVQKDDLVPDLLILPPGCDLHDHPLIVNGCVFLQGKASSMVAAALAPKPGWKVLDACSAPGNKTVHLAALMKGKGKIVACELNKERVRRLKDTIKLSGAANIEVLHGDFLNLDPKDPAYSEVRAILLDPSCSGSGTAAERLDHLLPSHASGHTADPTEMERLNKLSAFQKKALRHALSFPGVERVVYSTCSIHQVENEDVIKSVLPIAMSFGFQLATSFPQWNCRGLPVFEGSEHLLRTDPVEDKEGFFIALFVKGNIIDRSKNPTMPSSYNSKVSEHIKGNKTITKTKRMKLFMHNRMFKIWSHCLLRSRRLVLDLKNDKQLR

SEQ ID NO: 9765 - protein, 441 aa, Citrus sinensis
MARTKTAATAPSGASAKTSRNGRLSNAERSAYFARREAAKVLRLVLRGDARRRAVGSIKSLVYSPSVKNKKATYALVCQTLKHLSIIKQVLDSASILNSKWKRQEELVYILTYDILFGQEISLVGDAEKFLMLHKGAIQLALAQLLVRNKVKSIEDLMALYQTPDVPKPRYVRVNTLKMDVDSAVLELGKQFVVQKDDLVPDLLILPPGCDLHVHPLIVNGCVFLQGKASSMVAAALAPKPGWKVLDACSAPGNKTVHLAALMKGKGKIVACELNKERVRRLKDTIKLSGAANIEVLHGDFLNLDPKDPAYSEVRAILLDPSCSGSGTAAERLDHLLPSHASGHTADPTEMERLNKLSAFQKKALRHALSFPGVERVVYSTCSIHQVENEDVIKSVLPIAMSFGFQLATPFPNGTAEASQFLKALSIYFEPIQWKTKKAFL

SEQ ID NO: 9766 - protein, 73 aa, Tropaeolum majus
MNLPILLSILKYLTPSFSSSFFLSPLIISKLSSSTWTLISPDFKPGMSMTNTYEFGYSFTSAGVAAIAFASRT

SEQ ID NO: 9767 - protein, 159 aa, Fagus grandifolia
MDLRIMGLESPLLSTLQHMMELSDDSDKSSSSINAPTRTYVRDAKAMASTPADVKEYPNSYVFVVDMPGLKSGDIKVQVEDDNVLLISGERKREEEKEGAKYLRMERRVGKLMRKFVLPENANTDAICAVCQDGVLTVTINKLPPPEPKKPKTIQVSIA

SEQ ID NO: 9768 - protein, 159 aa, Lotus japonicus
MDFRLMGLESPLFHTLNQMMDVSDHDTASDKTNNALTQTYVRDAKAMAATPADVKEYPNSYVFVIDMPGLKSGDIKVQVEDDNVLVITGERKREEEKEGVKYLRMERRVGKFMRKFVLPENANTDAVSAVCQDGVLSVTVQKLPPPEPKKPRTIEVKIA

SEQ ID NO: 9769 - protein, 159 aa, Tropaeolum majus
MDFRLMGLDSPLFVNLHNIMELADQEAATEKSSNAPTRTYVRDAKAMAATPVDVKEYPNSYVFVIDMPGLKSGDIKVQVEEDNLLMISGERKKEEEKEGVKYLRIERRIGKFMRKFVLPDNANTDAISAVCQDGVLTVAVEKLPPPEPKKPKTIEVKIA

SEQ ID NO: 9770 - protein, 159 aa, Glycine max
MDFRVMGLDSPLFHTLQHMMDMSEDAAGDNKTYSAPTRSYVRDAKAMAATPADVKEYPNSYVFEIDMPGLKSGDIKVQVEDDNVLLISGERKRDEEIEGVKYLRMERRIGKFMRKFVLPENANTDAISAVCQDGVLSVIVQKLPPPEPKKPKTIEVKVA

SEQ ID NO: 9771 - protein, 158 aa, Phaseolus coccineus
MDLRVMGLESPLFHTLHHIMDMSEEGAGDKAHNAPTRSYVRDAKAVAATPADVKEYPNSYVFQIDMPGLKCGDIKVQVEDDNMLLISGERKREEEKEGAKYLRMERRVGKFMRKFVLPENANTDEISAVCEDGVLSVTVQKLPPPEPKKPRTIEVKVA

SEQ ID NO: 9772 - protein, 158 aa, Phaseolus coccineus
MDFRVMGLESPLFHTLHRMMDTSEEGAGDKTHNAPTQTYVRDAKAMAATPADVKEYPNSYVFQIDMPGLKSGDIKVQIEDDNVLLISGERKREEEKEGVNFLRMERRVGKFMRKFVLPENANTDAISAVCQDGVLSVTVQKLPPPEPKKPRTIQVKVA

SEQ ID NO: 9773 - protein, 158 aa, Unknown
  Sequence found in Organisms: Euphorbia peplus, Euphorbia esula
MDFRIMGGIESPLFQALHQMMDAGGEETDKSYNAPTRTYVRDAKAMASTPADVKEYPNSYVFIIDMPGLKSGDIKVQVEDDNVLIISGERKRDEEKEGAKYVRMERRIGKFMRKFTLPENANTDAISAVCQDGVLTVTVNKLPPPEPKKPKTIQVQVA

SEQ ID NO: 9774 - protein, 158 aa, Solanum phureja
MDLRLLGIDNTPLFHTLQHMMEAAGEDSDKSVNAPSRNYVRDAKAMAATPADVKEYPNSYVFVVDMPGLKSGDIKVQVEEDNVLLISGERKREEEKEEAKFIRMERRVGKFMRKFSLPENANTDAISAVCQDGVLTVTVQKLPPPQPKKPKTIEVKVA

SEQ ID NO: 9775 - protein, 157 aa, Amsonia hubrichtii
MDLRLIGLDAPLLHTLQHMIDAATDDADKSTNGPSRTYVRDAKAMAATPADVKEYPNSYVFVVDMPGLKSADIKVQVEDDNVLIISGERKREEEKEGAKYVRMERRVGKFMRKFVLPENANTDAISAVCQDGVLTVTVQKLPPPEPKKAKTVEVKVA

SEQ ID NO: 9776 - protein, 144 aa, Nicotiana benthamiana
  misc_feature (142)..(143): Xaa can be any naturally occurring amino acid
MDFRLMGIDAPLFHTLQHLMDAAGEDSDKSVNAPSRNYVRDAKAMASTPADVKEYPNSYVFVVDMPGLKSGDIKVQVEDDNVLLISGERKREEEKEGAKYIRMERRIGKFMRKFTLPENADTDAISAVCQDGVLIVTVQKLXXS

SEQ ID NO: 9777 - protein, 157 aa, Orobanche aegyptiaca
MDFRLMGFDSPLIHTLHNMLDSDESDAGKSVSAPTRTYVRDARAMAATPADVKEFPNSYVFVIDMPGLKSGDIKVQIEEDNVLLISGERKREEEKEGAKYVRMERRIGKFMRKFVLPENANTDKIAAVCQDGVLSVTVEKLPPPEPKRPKTIEVKIA

SEQ ID NO: 9778 - protein, 157 aa, Carica papaya
MDVRMFELESPILSSLRQLMELQDTETEKSFNAPTRTYVRDAKAMAATPADVKEYPNSYVFVIDMPGLKSGDIKVQVEDDNVLQISGERKREEEKDGVKYLRMERRIGKFMRKFSLPDNANTDAISAVCQDGVLTVTVQKLPPPEPKKPKTIEVKIA

SEQ ID NO: 9779 - protein, 156 aa, Vitis vinifera
MDSRMMGFDSPLFSALQHMLDATDDSDKSVSAPTRTYVRDAKAMAATPADVKEYPNSYTFIVDMPGLKSGDIKVQVEDDNVLVISGERKREEEKEGVKYVRMERRVGKFMRKFALPENANTDKISAVCQDGVLTVTVEKVPPPEPKKPKTIEVKIA

SEQ ID NO: 9780 - protein, 156 aa, Unknown
  Sequence found in Organisms: Gossypium hirsutum, Gossypium raimondii
MDLRIMGFDSPLLNTLQHMMDLSDDTEKIPNAPSKVYMRDAKAMAATPADIKEYPKSYVFIVDMPGLKSGDIKVQVEDDNMLLISGERKREEEKEGAKYVRMERRVGKLMRKFALPENANTDAISAICQDGVLTVTVEKLPPPEPKKPKTIEVKIA

SEQ ID NO: 9781 - protein, 156 aa, Gossypium hirsutum
MDLRIMGFDSPLLNTLQHMMDLSDDTEKIPNAPSKVYMRDAKAMAATPADIKEYPKSYVFIVDMPGLKSGDIKVQVEDDNMLLISGERKREEEKEGAKYVRMERRVGKFMRKFALPENANADAISAICQDGVLTVTVEKLPPPEPKKPKTIEVKIA

SEQ ID NO: 9782 - protein, 504 aa, Vitis vinifera
MVSSKTAATTASRAKKPKEQRLSKADRSSYFARREAAKVLQCVLQGDAKRRAVGSIKSLVYSPSVRNKKATFALVCQTLKHLSIIKDVLDSARILNAKWKRQEGLMYIITYDILFGQEISSVGDAEKFLLLQKDAIQLALARLLVRKKVKRVEDLMALYQIPDVSKPRFVRVNTLKLDVESAFHELGKQNMVQKDDMVPDLLILPPGSDLHNHPLVRNGSGKASSMVAVALGPEPGWEVLDACSAPGNKTVHLAALMNGKGKIIACELDNERVKRLEDTVRLSGAANIEVLHGDFLNLNPMDPSYSKVRAILLDPSCSGSGTTAERLDHLLPSYAAGDATDVAGTERLNKLAAFQKKALEHALSFPAVEKVVYSTCSIHQIENEDVIKSVLPLAASHGFQLATPFPQWPRRGLPVFEGSEHLLRTHPVEDKEGFFIALFVRKSIARSLEQPIKTRKNNKVKSAKRNATMNHNKSVMPFPFTRLSKLLLHSHLRLQTYKKLNLST

SEQ ID NO: 9783 - protein, 113 aa, Carpinus betulus
MAATPADVKEYPNSYVFIIDMPGVKSGDIKVQVEADNVLVISGERKREEEKEGPKYVRMERRIGKLMRKFVLPENANTDAISAVCQDGVLTVTVQKLPPPEPKKPKTIEVKIA

SEQ ID NO: 9784 - protein, 184 aa, Fagus grandifolia
MDLRIMGLESPLLSTLQHMMELSEDSDNSSSSINAPTRTYVRDANAMASTPADVKEYPNSYVFVVDMPGLKSGDIKVQVEDDNVLLISGERKREEEKEGAKYLRLERRVGKFMRSLCCLRMPTLMLSLRCARTVCLLSLSTSCHLQSPRSPRLFRFPLPKTKTKATVSHVIWPSISYGNKLVEF

SEQ ID NO: 9785 - protein, 510 aa, Quercus alba
MAAVGRGKTRLSNGERSAYFARREAAKVLGSVLQGDARRQAVASIKSLIYRPCIRNKKATFALVCQTLKHLPIIKDVLDAATILNAKWKRQQDLIYIITYDILFGQAVSLVGDAEKFLMHQKDALQTALARLLVKKKVKTPQDLVDLYRIPEISKPRYVRVNTLKMDVDSALLELGQQNMVKKDNMVPDLLILPPSTDLHNHPLVTNGSVFMQGKASSMVAAALDPKPGWEVLDACSAPGNKTVHLAALMRGKGKIIACELNKERVIRLKETIKLSGASNIEVLHGDFLNCNPNDPSFSKVRAILLDPSCSGSGTASVRLDHLLPSNAAGHAADVTDTERLNKLAAFQRKVLMHALSFPAVERVVYSTCSIHQIENEDVVKSVLPLAASYGFQLATPFPQWQRRGLPVFEGFQHLLRTDPVEDGEGFFIALFTKRDDKNHSEKQATCRNNSKSLARDGCTSRFRSGKKRIVINFAHTKLFLMWLHAKQSRRKRDNFNTGGSYRPMTTDCF

SEQ ID NO: 9786 - protein, 160 aa, Tropaeolum majus
MDIRFMGLDSPLFSTLHHVMDMADHESAGEKSSNAPTKIYLRDAKAMAATPADVKEYPNSYAFVIDMPGLKSGDIKVQVEDGNVLLITGERKREEEKKEEAKYVRMERRIGKFMRKFVLPDNANTDAISAVCQDGVLTVSVEKLPPPEPKKPKTIEVRVA

SEQ ID NO: 9787 - protein, 159 aa, Glycine max
MDFRVMGLEPPLFHTLQHMMDMSEDAAGENKTYSAPTRSYVRDAKAMAATPADVKEYPNSYVFEIDMPGLKSGDIKVQVEDDNVLLISGERKRDEEKEGVKYLRMERRVGKFMRKFVLPENANTDAISAVCQDGVLSVTVQKLPPPEPKKPRTIEVKVF

SEQ ID NO: 9788 - protein, 158 aa, Capsicum annuum
MDFRLMGMDNTPIFHVLQHMMDSAGDESDKSVNAPSRNYVRDAKAMAATPADVKEYPNSYVFVVDMPGLKSGDIKVQVEEENVLLISGERKREEEKEGAKYIRMERRVGKFMRKFTLPENANTDAISAVCQDGVLTVTVQKLPPPEPKKPKTIEVKVA

SEQ ID NO: 9789 - protein, 158 aa, Solanum phureja
MDLRLLGIDNTPLFHTLQHMMEAAGEDSDKSVNAPSRNYVRDAKAMAATPADVKEYPNSYVFVVDMPGLKSGDIKVQVEEDNVLLISGERKREEEKEGAKFIRMERRVGKFMRKFSLPENANTDAISAVCQDGVLTVTVQKLPPPEPKKPKSIEVKVA

SEQ ID NO: 9790 - protein, 176 aa, Glycine max
MANWVQKKITDPLLSIIRRGAEPNHLAFSAALGVTLGLFPICGVTVFLCGMAIALLGSFCHAPTVMLANFIATPIELSLVVPFLRFGEVISGGSHFPLTSDALKKVLTGQASREVLLSVAHALLGWLVASPFILGTLYIVLLPCFKILVHKFSSVPLSPKKPLNPHSEVKLKVRDV

SEQ ID NO: 9791 - protein, 183 aa, Cajanus cajan
MANGKVRITNWVQKKITDPLLAIIRRGAEPSQLAFSGALGITLGVFPICGVTVFLCGMAIALLGSFCHAPTVMLANFIATPIELSLVVPFLRFGELITGGSHFPLTSDALKKVLTGQASQEVILSVARAILGWLVASPFILGALYIVLLPCFKILVHKFSGVPSSPRKPLHPHSDVKAKVRDV

SEQ ID NO: 9792 - protein, 184 aa, Lotus japonicus
MAIGKMGITDWFHRKITDPLLSIIRRGAEPNQLAFSAALGITFGVFPICGVTVFLCAMAIALLGSYCHAPTVMLANFVATPIELSLVVPFLRFGEVISGGPHFPLTSDALKKVFTGQASREVLLSVAHALLGWLVASPFILGTLYIVLLPCFKFLVQKFSTVPLSPKKPLLHPHSEISLKVRDV

SEQ ID NO: 9793 - protein, 183 aa, Phaseolus coccineus
MANGKVGTTNWFQKKVTDPLLSIIRRGAEPNQLAFSAALGLTLGVFPICGVTVFLCGVAIALLGPLCHAPTVMLANFIATPIELSLVVPFLRFGEAITGGSHFPLTSDALKKVFTGQASHEVILSIAHALLGWLAASPIILGILFIVLLPCFKILVHKFSSVPSSPKKPLHPHSETKLKVRAI

SEQ ID NO: 9794 - protein, 184 aa, Cicer arietinum
MTIGKMEITNWFHKKITDPLFSILQRGVEPKQLAFSAALGITLGVFPICGVTVFLCGMAIAFLGSFCHAPTLMLANFMATPIELSLIVPFLRFGEVMSGGPHFPLTSDALKKVLTGQASHEVILSVAHALLGWLTASPFILGTLYIVFLPCFKYLIQKFSSVPLSPKKSLLNPHSEVRLKVRDV

SEQ ID NO: 9795 - protein, 136 aa, Glycine max
MSAFDNVVGGKLKLKGKALDVAGGVKKKKKKNKRNQEQLLQVAEDEVSAGGNTEQAKDPNDGDINDVSELSGKGKTAHYDDHLTPAERRYIEQREQLDVHRLAKISNKSHRDRIQDFNQYLANMSEHYDIPKVGPG

SEQ ID NO: 9796 - protein, 136 aa, Cajanus cajan
MSAYDNVVGGKLKLKGKALDVAGGVKKKKKKNKRNQDQLLQVTEDEISAGGNTEQAKDPNDQDVNDANELSGKGKSAHYDDHLTPAERRYIEQREQLDVHRLAKIANKSHRDRIQDFNQYLANMSEHYDIPKVGPG

SEQ ID NO: 9797 - protein, 423 aa, Phaseolus coccineus
MKKKTMEKSKSANSDTVHSPLVTYASMISLLTLCPPFVILLWYTMTSADGSVAQTWNYLKQNGVQGFLHIWPRPTATACKIIVVYAVFEAALQLLLPAKTVYGPISPTGHRPVYKANGVAAYLVTLITYIALWWFGIFNPTIVYDHLGEIYSALIFGSFVFCILLYIKGLLAPSSTDSGSSGNIIIDFYWGMELYPRIGKYFDIKVFTNCRFGMMSWAVLALTYCIKQYEENGKVSDSMLVNTALMLVYVTKFFWWEAGYWNTMDIAHDRAGFYICWGCLVWVPSVYTSPGMYLVNHPVNLGIELALSILLAGILCIFINYDCDRQRQEFRRTNGKSTVWGKAPSKIEASYTTTTGETKRSLLLTAGWWGLSRHFHYVPEILAAFFWTVPALFNHFLPYFYVIFLTILLFDRAKRDDDRCRSK

SEQ ID NO: 9798 - protein, 571 aa, Phaseolus coccineus
MKKKTMEKSKSANSDTVHSPLVTYASMISLLTLCPPFVILLWYTMTSADGSVAQTWNYLKQNGVQGFLHIWPRPTATACKIIVVYAVFEAALQLLLPAKTVYGPISPTGHRPVYKANGVAAYLVTLITYIALWWFGIFNPTIVYDHLGEIYSALIFGSFVFCILLYIKGLLAPSSTDSGSSGNIIIDFYWGMELYPRIGKYFDIKVFTNCRFGMMSWAVLALTYCIKQYEENGKVSDSMLVNTALMLVYVTKFFWWEAGYWNTMDIAHDRAGFYICWGCLVWVPSVYTSPGMYLVNHPVNLGIELALSILLAGILCIFINYDCDRQRQEFRRTNGKSTVWGKAPSKIEASYTTTTGETKRSLLLTAGWWGLSRHFHYVPEILAAFFWTVPALFNHFLPYFYVIFLTILLFDRAKRDDDRCRSKYGKYWKLYCDKMSSYDNVVGGKLKLKGKALDVAGGVKKKKKKNKRNQDQLLQVAEDEISAGGSAEEAKDLNDEDTITAGELSSGKGKGAHYDDHLTPAERRYIEQREQLDVHRLAKISNKSHRDRIQDFNQYLANMSEHYDIPKVGPG

SEQ ID NO: 9799 - protein, 137 aa, Cicer arietinum
MSAYENVVGGKLKLKGKALDVAGGVKKKKKKNKRNQEQFLQAAEDEISTGGSTEQAKDPNDDEEVNDGSKLSREDKPAHYDDHLTPAERRYIEQREQLDVHRLAKIANKSHRDRIQDFNQYLANMSEHYDIPKVGPG

SEQ ID NO: 9800 - protein, 137 aa, Vigna unguiculata
MSSYDNVVGGKLKLKGKALDVAGGVKKKKKKNKRNQDQLLQVAEDDISAGGSTEEGKDGNEEDTNTARELSSGKGKVAHYDDHLTPAERRYIEQREQLDVHRLAKISNKSHRDRIQDFNQYLANMSEHYDIPKVGPG

SEQ ID NO: 9801 - protein, 563 aa, Cicer arietinum
MGESKNDTVHSPIVTYFSMISLLTLCPPFVILLWYTMTAADGSILRTFDYLINNGLNGFVDLWPKPTLLACKIIGVYAVFEAALQLFLPGHTVYGPISPSGNRPVYKANGVAAYLVTLVTYVVLWWFGIFNPTIVYDHLGEIYSTLIFGSFIFCIFLYIKGHLAPSSTDSGSSGNIIIDFYWGMELYPRIGKYFDIKVFTNCRFGMMSWAVLALTYCIKQYEENGKVADSMLVNTTLMLVYVTKFFWWEAGYWNTMDIAHDRAGFYICWGCLVWVPSIYTSPGMYLVNHPVNLGIQLALFILVAGILCIYINYDCDRQRQEFRRTNGKGSVWGKAPSKIEASYTTTSGETKRSLLLTSGWWGLARHFHYVPEILAAFFWTVPALFNHFLPYFYVIFLTILLFDRAKRDDDRCRSKYGKYWKLYCDRMSAYENVVGGKLKLKGKALDVAGGVKKKKKKNKRNQEQFLQAAEDEISTGGSTEQAKDPNDDEEVNDGSKLSREDKPAHYDDHLTPAERRYIEQREQLDVHRLAKIANKSHRDRIQDFNQYLANMSEHYDIPKVGPG

SEQ ID NO: 9802 - protein, 136 aa, Medicago truncatula
MSDYENVVGGKLKLKGKALDVAGGIKKKKKKNKRNQQQFLQATEDEISAGGSTEQAKDPNDQEVNDESELSREEKPAHYDDHLTPAERRYIEQREQLDVHRLAKISNKSHRDRIQDFNQYLANMSEHYDIPKVGPG

SEQ ID NO: 9803 - protein, 136 aa, Trigonella foenum-graecum
MSAYENVVGGKLKLKGKALDVAGGIKKKKKKNKRNQEQFLQATEDEISAGGSTEQAKDPNDQEVNDGRELNREEKPAHYDDHLTPAERRYIEQREQLDVHRLAKISNKSHRDRIQDFNQYLANMSEHYDIPKVGPG

SEQ ID NO: 9804 - protein, 138 aa, Cyamopsis tetragonoloba
MSGYDNVVGGKLKLKGKALDVAGGVKKKKKKKNKRNNQDLLLQATEDEISAGGSTELDKDPNDEDTNDVSKLNEEGKPAHYDDHLTPAERRYIEQREKLDVNRLAKISNKSHRDRIQDFNQYLANMSEHYDIPKVGPG

SEQ ID NO: 9805 - protein, 137 aa, Lotus japonicus
MSSYDNVVGGKLKLKGKALDVAGGIKKKKKKNKRNQEQFSQVVDDEISAGGSTEQAKEPDEQDEINDDGRLSGEEKTAHYDDHLTPAERRYIEQREKLDVNRLAKISNKSHRDRIQDFNQYLANMSEHYDIPKVGPG

SEQ ID NO: 9806 - protein, 138 aa, Arachis hypogaea
MSAYENVVGGKLKLKGKALDVKAGGVKKKKKKNKRDHENQILQTTEDDISAGGSTEQSLATDDQNANDEGKLSGEGKDAHYDDHLTPAEKRYIEQREQLDVHRLAKISNKSHRDRIQDFNQYLANMSEHYDIPKVGPG

SEQ ID NO: 9807 - protein, 138 aa, Arachis hypogaea
MSSYENVVGGKLKLKGKALDVKAGGVKKKKKKNKRDHENQILQTTEDDISAGGSTEQSLGTDDQNANDEGKLSGEGKAAHYDDHLTPAEKRYIEQREQLDVHRLAKIANKSHRDRIQDFNQYLANMSEHYDIPKVGPG

SEQ ID NO: 9808 - protein, 136 aa, Acacia harpophylla
MSAYENVVGGKLKLKGKALDVKAGGVKKKKKKNKNHDQILESSENELLAGGSAEQANDPNDHDKDDVNKSTGEEKPPHYDDHLTPAERRYIEQREQLDVHRLAKIANKSHRDRIQDFNQYLANMSEHYDIPKVGPG

SEQ ID NO: 9809 - protein, 777 aa, Phaseolus coccineus
MGRNGGGRSLQQALRRRIDTCKSKYSTAEEIANHLRSTYPDYHRTKHQTLIRFVQEAVHSTAQHNQTSTPKYSDGDDDDNMESRSASRKRRKKIDEGEERLKKMEALHARRRVQDPSSSSSASSESDDEEAVSTSEDAIYGEKVEPQFDLMKEMLRKSYTPKKVVAAAAVEKNVELEMSNRSKGTVLNEVNEVRKQSLRSVSNSEVSNGEGKGKDGPRFKDLGGMKEVLEELKMEVIVPLFHPQLPKQLGVKPMAGILLHGPPGCGKTKLAHAIANETGLPFYQISATEVVSGVSGASEENIRELFAKAYRTAPSIVFIDEIDAIASKRENLQREMEKRIVTQLMTCMDQSSRLPTDDSESAGYVLVIGATNRPDAVDPALRRPGRFDREIIIGHPDEFAREEILSVLTSNLRLEGLFDLQKIARATSGFVGADLAALVDKAGNLAMKRIIDERRRELSEELTSEHVEDWWREPWSAEEVDKLAIKMSDFEEASKKVQPSLRREGFSIIPNVKWEDVGGLDLLRKEFERYIVRRIKYPEDYEGLGVDLETGFLLYGPPGCGKTLIAKAVASEAGASFIHIKGPELLNKYVGESELAVRTLFSRARTCAPCILFFDEVDALTTKRGKEGGWVIERLLNQLLIELDGAGHRRGVFVIGATNRPEVMDRALLRPGRFGKLLYVPLPSPDQRVLILKALARNKAIDATVDLSAMATMAGCENLSGADLAALMNEAAMAAVEEKHKTINSTHFEVALSKVSPSVSDRQKKYYQHLSESFKVA

SEQ ID NO: 9810 - protein, 752 aa, Cajanus cajan
MGRRNGGRSLQETLRRRLDSCKSKYSTAEEIATHLRSTYPDYHRTKHQTLIRFVQEALHSAAKPDHIPTLKHFSDDDDDRDFPSPSPKRRKEEDEDREEAVVSSSEDAVFGKKMEPEFGLRKTVLRNSYKKIAAEEKNVELEVGGGRKGIVASSVVNEERKEVRGSVSNGEVKGKDGPRFRDLGGMKEVLEELKMEVIVPLCHPQLPRQLGVRPMAGILLHGPPGCGKTKLAHAIANEAGLPFYHISATEVVSGVSGASEENIRELFSKAYKTAPSIVFIDEVDAIASKRENLQREMEKRIVTQLMTCMDQSNRLLQKGDESESSDGQHPGYVLVIGATNRPDAVDPALRRPGRFDREIIIGIPNESAREEILSTLTSNLKVEGLFDLRKIARATPGFVGADLAALVNKAGNLAMKRIIDERKRELSQVLMNEGDEDWWREPWLTEEIDKLAIKMSDFEEAVKMVQPSSRREGFSSIPNVKWEDVGGLDFLRQEFERYIVRRIKYPDDYEGLGVDLETGFLLYGPPGCGKTLIAKAVANEAGANFIHIKGPELLNKYVGESELGVRTMFSRARTCAPCILFFDEVDALTTNRGKEGSWVIERLLNQLLVELDGAEQRRGVFVIGATNRPEVMDRALLRPGRFGKLLYVPLPGPDERVLILKALARKKPVDSSVDLSAIAKMEACENLSGADLSALMNEAAMAALEEKLTETTYDTVTIKKNHFEVALSKVSPSVSDRQKHYYQHLSESFKVA

SEQ ID NO: 9811 - protein, 767 aa, Cajanus cajan
MGRRNGGRSLQDTLRRRLESCKSKYSTAEQIANHLRSTYPDYHRTKHQTLIRFVQEALNSTPSLNHSSDDDHEAQPPTASRKRRKRVDQSEERLQRIEALHVRRRLQTDSSSEEENVSSSEDAIYGEKVEPQFDLMKTMLRKSYMPKKEKNVELEVGNSNKGTVTSTLMNEEGKEVRGSVSNVDVKGNDWPRFRDLGGMKEVLEELKMEVIVPLYHPQLPRQLGVRPMAGILLHGPPGCGKTKLAHAIANETGLPFYQISATEVVSGVSGASEENIRELFSKAYRTAPSIVFIDEIDAIASKREDLQREMEKRIVTQLMTCMDQSNRLLQPENESEGSDGQHPGYVLVIGATNRPDAIDPALRRPGRFDREIIIGIADESAREEILSTLTNNLTTEGLFDLRKIAKDTAGYVGADLVALVNKAGNLAMKRIIVGRRHDLSQDHMNEHAEDWWRVHWLPEEINKLAVKMSDFEEAVNMVQPSLRRDGFSPIPDVKWEDVGGLDLLRQEFERYIVRRIKYPEDYEGLGIDLEMGFLLYGPPGCGKTLIAKAVAHEAGANFIHVKGPSLLNKYVGESELAVRRMFSDARTCAPCIIFFDEVDALTTTRGKEGGWVIERLLNQLLIELDGAERRRGVFVIGATNRPEVMDRALLRPGRFGKLLYVPLPSPDERVLILKALARKKCIDASVDLSAIAKMEACENLSGADLSALMNEAAMAVIDEKETLTDLTHYTRTIKRNHFEVALRKVSPSVSDRQKQYYQRLSQSFKAA

SEQ ID NO: 9812 - protein, 208 aa, Cyamopsis tetragonoloba
MGWLTRFITAVAFLAIGVIFSPETLGSKSTALSTYLKLAHLLSFSTAFGAALWVTFIGGIIMFKNLPRHQFGNLQSKMFPAYFSMVGVCCAVSVASFGYLHPWKTSSTTERYQLGFLLSSFAFNLTNLFVFTPMTIEMMKQRHKVERENNIGEEVGWSKNVEVAKKNPKLAAMNKKFGMIHGLSSLANIMSFGSLAIHSWYLAGKINL

SEQ ID NO: 9813 - protein, 208 aa, Vigna unguiculata
MGWLSRFITAVAFLAVGVIFSPETLGSKSPTLSTYLKLAHLLSFSTAFGAALWVTFIGGIIMFKNLPRHQFGNLQSKMFPAYFSMVGVCCAVSVASFGYLHPWKTSSTTERYQLGFLLSSFAFNLTNLFVFTPMTIEMMKQRHKVERENSIGEEVGWSKNVEVAKSNPKLKAMNKKFGMIHGLSSLANIMSFGSLAVHSWYLAGKIDL

SEQ ID NO: 9814 - protein, 208 aa, Phaseolus coccineus
MGWLSRFIAAVAFLAIGVIFSPETLTSKSTTLSTYLKLAHLLSFSTAFGAALWVTFIGGIIMFKNLPRHQFGNLQSKMFPAYFSMVGACCAISVASFGYLHPWKTSSTTERYQLGFLLSSFAFNLTNLFVFTPMTIEMMKQRHKVERESNIGEEVGWSKNVEVAKSNPKLKAMNKKFGMIHGLSSLANIMSFGSLAIHSWYLAGKIDL

SEQ ID NO: 9815 - protein, 208 aa, Glycyrrhiza uralensis
MGRVAMIITAVAFLAIGVIFSPETFESKSTALSTYLKLAHLLSFSIAFGAALWVTFIGGVIMFKNLPRHQFGNLQSKMFPAYFSMVGICCAVAVASFGYLHPWKTSSTTEKYQLGFLLSSFAFNLANLFVFTPMTIEMMKQRHKVERENNIGEEVGWSKNVEVAKKNPKLAAMNKKFGMIHGLSSLANIMSFGSLAIHSWYLAGKLDL

SEQ ID NO: 9816 - protein, 208 aa, Cicer arietinum
MGRAAPIITAVVFLAVGVIFSPETFGSKSTAISTYLKLAHLLGFSIAFGAALWVTFIGGIIMFKNLPRHQFGNLQSKMFPAYFSMVGVCIAVAVASFGYLHPWKTSSTTEKYQLGFLLSSLAFNLANLFVFTPMTIELMKQRHKVERENSIGEEVGWSKNVEVAKKNPKLAAMNKKFGMIHGLSSLANIMSFGSLAIHSWYLAGKIDL

SEQ ID NO: 9817 - protein, 172 aa, Cicer arietinum
MGRAAPIITAVVFLAVGVIFSPETFGSKSTAISTYLKLAHLLGFSIAFGAALWVTFIGGIIMFKNLPRHQFGNLQSKMFPAYFSMVGVCIAVAVASFGYLHPWKTSSTTEKYQLGFLLSSLAFNLANLFVFTPMTIELMKQRHKVERENSIGEEVGWSKNVEVAKKTQSLQR

SEQ ID NO: 9818 - protein, 208 aa, Lotus japonicus
MGWLSRFLTAVTFLAVGVLFSPETLASKSTALSTYLKLAHLLSFSTAFGSALWVTFIGGIIMFKNLPRHQFGNLQSKMFPAYFSLVGTCGAIAVASFGYLHPWKTASTSERYQLGFLLSSFAFNLTNLFVFTPMTIELMKQRHKVERENNVGEEVGWSKNVEVAKTNPKLAAMNKKFGMIHGLSSLSNIMSFGSLAVHSWYLAGKINL

SEQ ID NO: 9819 - protein, 208 aa, Trigonella foenum-graecum
MGRAALITTAVVFLAIGVIFSPETFGSKSTALSTYLKLAHLLGFSIAFGAALWVTFIGGIIMFKNLPRHQFGNLQSKMFPAYFSMVGVCIATSVASFGYLHPWKTSSTAERYQLGFLISALAFNLTNLFVFTPMTIEMMKQRHKLERENNIGEEVGWSKNVEVAKKNPKLAKMNKKFGMIHGLSSLANIMSFGSLAIHSWYLAGKLDL

SEQ ID NO: 9820 - protein, 208 aa, Medicago truncatula
MGRATLITTAVVFLAIGVIFSPETFGSKSTTLSTYIKLAHLLGFSIAFGAALWVTFIGGIIMFKNLPRHQFGNLQSKMFPAYFSMVGVCIAVTVASFGYLHPWKTSSTSQRYQLGFLISALAFNLTNLFVFTPMTIEMMKQRHKVERENSIGEEVGWSKNVEVAKKNPKLAKMNKKFGMIHGLSSLANIMSFGSLAIHSWYLAGKLDL

SEQ ID NO: 9821 - protein, 208 aa, Pisum sativum
MGRAALITTAVVFLAVGVIFSPETFGSKSTTLSTYLKLAHLLGFSIAFGAALWVTFIGGIIMFKNLPRHQFGNLQSKMFPAYFSMVGVCISVAVASFGYLHPWKTSSTSEKYQLGFLLSALAFNLTNLFVFTPMTIEMMKQRHKVERENKIGDEVGWSKNVEVAKKNPKLAAMNKKFGMIHGLSSLANILSFGSLAIHSWYLAGKLDL

SEQ ID NO: 9822 - protein, 209 aa, Populus trichocarpa
MGWLSRFLAAIAFFAIGVLFSPETFGSKSVTHLSAYLKLAHLLCFSTAFGSALWVTFIGGIIMFKNLPRHQFGNLQSKMFPAYFLLVGVCCAISVAAFGYLHPWKSASTAEKYQLGFLLSSFAFNLTNLFVFTPMTIEMMKQRHKVEREENIGTEVGWSKNREVAKANPKLAAMNKKFGMIHGLSSLANIMSFGSLAMHSWYLAGKINL

SEQ ID NO: 9823 - protein, 209 aa, Populus trichocarpa
MGWLSRFLAAIAFFAIGVLFSPETFGSKSVTHLSAYLKLAHLLCFSTAFGSALWVTFIGGIIMFKNLPRHQFGNLQSKMFPAYFLLVGVCCAISVAAFGYLHPWKSASTAEKYQLGFLLSSFAFNLTNLFVFTPMTIEMMKQRHKVEREENIGTEVGWSKNKEVAKANPKLAAMNKKFGMIHGLSSLANIMSFGSLAMHSWYLAGKINL

SEQ ID NO: 9824 - protein, 213 aa, Prunus mume
MAWLTRFLAAVAFLAIGVIFSPETFGSKSDGLNSPTLSTYLKLAHLLTFSTAFGAALWVTFIGGIIMFKNLPRHQFGNLQSKMFPAYFSMVGICCAVSVASFGYLHPWNSSSVAEKYQLGFLLSSLAFNLTNLFVFTPMTVEMMKQRHKVEREQNIGEEVGWSKNVEVAKVNPKLAAMNKKFGMIHGLSSLANIMAFGSLAMHSWYLASKLNL

SEQ ID NO: 9825 - protein, 209 aa, Ricinus communis
MGWLTRFVAAVAFLAIGIIFSPETFGSKSVGQLSTYLKLAHLLCFSTAFGAALWVTFIGGIIMFKNLPRHQFGNLQSKMFPAYFWLVGVCCAICVASFGYLHPWKSASTAEKYQLGFLLSSLAFNLANLFVFTPMTIEMMKQRHKVEREQNIGEEVGWSKNQEIAKTNPKLAAMNKKLGMIHGFSSLANIMSFGSLAMHSWYLAGKMNL

SEQ ID NO: 9826 - protein, 213 aa, Prunus persica
MAWLTRFLAAVAFLAIGVIFSPETFGSKSDGLNSPTLSTYLKLAHLLTFSTAFGAALWVTFIGGIIMFKNLPRHQFGNLQSKMFPAYFSMVGICCAVSVASFGYLHPWNSSSVAEKYQLGFLLSSLAFNLTNLFVFTPMTVEMMKQRHKVEREQNIGEEVGWSKNVQVAKVNPKLAAMNKKFGMIHGLSSLANIMAFGSLAMHSWYLASKLNL

SEQ ID NO: 9827 - protein, 209 aa, Manihot esculenta
MGWLSRFVAAVAFLAIGVIFSPETFGSNSIVQLPTYLKLAHLLSFSTAFGAALWVTFIGGIIMFKNLPRHQFGNLQSKMFPAYFWLVGVCCAISVASFGYLHPWKSASAAEKYQLGFLLSSLAFNLANLFVFTPMTIEMMKQRHKVEREQNIGNEIGWSKNQEVAKANPKLAAMNKKFGMIHGFSSLANIMSFGSLAMHSWYLAGKMNL

SEQ ID NO: 9828 - protein, 209 aa, Hevea brasiliensis
MGWLSRFVAAVAFLAIGVIFSPETFGSNSIAQLPTYLKLAHLLSFSTAFGAALWVTFIGGIIMFKNLPRHQFGNLQSKMFPAYFWLVGVCCAISVASFGYLHPWKSASPSEKYQLGFLLSSLAFNLTNLFVFTPMTIEMMRQRHKVEREENIGNEIGWSKNQEVAKANPKLAAMNKKFGMIHGFSSLANIMSFGSLAMHSWYLAGKMNL

SEQ ID NO: 9829 - protein, 208 aa, Scabiosa columbaria
MGWLTRFLAAVSFLAIGILYSPETFGSKSPNIPTFIKLAHLLCFSTAWGAALWVTFIGGIIMFKNLPRHQFGNLQSKMFPAYFSMVGVCCAVSVAAFGYLHPWKSSSSAEKYQLGFLLSAFAFNLTNLFIFTPMTIEMMKQRHKVERESNIGEEVGWTKNKEIAKVNPKLAAMNKKFGMIHGLSSLANIMSFGSLAMHSWYLAGKIDL

SEQ ID NO: 9830 - protein, 213 aa, Malus domestica
MAWLTRFLAAVAFLAIGVIFSPETFGSKSDGLKSPTLSTYLKLAHLLCFSTAFGAALWVTFIGGIIMFKNLPRHQFGNLQSKMFPAYFTMVGICLAVSAGSFGYLHPWSSSSVTDKYQLGFLLSSFAFNLTNLFVFTPMTIEMMKQRHKVEREQNIGEEVGGSKNVQVAKVNPKLAAMNKKFGMIHGLSSLANILAFGSLAMHSWYLAGKLDL

SEQ ID NO: 9831 - protein, 213 aa, Rosa hybrid cultivar
MGWLTRFLAAVAFLAIGVIFSPETFGSKSDGLKSPTLSTYLKLAHLLSFSTAFGAALWVTFIGGIIMFKNLPRHQFGNLQSKMFPAYFSLVGICCAISVASFGYLHPWNSSTVADKYQLGFLLSSLAFNLTNLFVFTPMTIEMMKQRHKVEREENIGEEVGWSKNVQVAKVNPKLAAMNKKFGMIHGLSSLANIMAFGSLAMHSWYLAGKLNL

SEQ ID NO: 9832 - protein, 208 aa, Centaurea maculosa
MGWMTRFLTAVAFLAIGVIFSPETFGSKSAKITTFVKLAHLLCFSTAWGAALWVTFIGGIIMFKNLPRHQFGNLQSKMFPAYFMMVGICCAVTVGCFGYSHPWKSSSTAEKYQLGFLVSAFVFNLTNLFVFTPMTIEMMKQRHKVERESNIGEEVGWTKNQEVAKVNPKLAAMNKKFGMIHGLSSLANILSFGSLAMHSWYLAGKIDL

SEQ ID NO: 9833 - protein, 268 aa, Linum usitatissimum
RQQELVSRVAAASRGPTILVLMSGGPIDVSFATNDPKISGIIWAGYPGQAGGAAIADILFGTTNPGGKLPMTWYPQEYLTNLPMTEMGMRAIDSNGYPGRTYRFYKGPVVYPFGHGLSYTTFVENIATAPTTVQVPLHGHRNPNNTVLNKAIKVTHVRCGKLSIGIEADVKNTGRADGTHTLLIYSSSPRASTAKGWAPHKQLIAFRKVHLAAGAGQRVKINIHVCKYLSVVDRVGTRRIPMGTHSIHVGNVQHLVSLQAITLGVIKN

SEQ ID NO: 9834 - protein, 208 aa, Ambrosia trifida
MGWMTRFLTAIAFLAIGVIFSPETFGSKSAKITTFVKLAHLLCFSTAWGAALWVTFIGGIIMFKNLPRHQFGNLQSKMFPAYFMMVGICCAVSVGCFGYTHPWKSSSTAEKYQLGFLVAAFVFNLTNLFVFTPMTIEMMKQRHKIERESNIGEEVGWTKNQEVAKVNPKLAAMNKKFGMIHGLSSLANIMSFGSLAMHSWYLAGKIDL

SEQ ID NO: 9835 - protein, 208 aa, Arnica chamissonis
MGWMTRFLTAIAFLAIGVIFSPETFGSKSAKITTFVKLAHLLCFSTAWGAALWVTFIGGIIMFKNLPRHQFGNLQSKMFPAYFMMVGICCAVSVGCFGYTHPWQSSSTSEKYQLGFLVAAFVFNLTNLFVFTPMTIEMMKQRHKVERESNIGEEVGWTKNQEVAKVNPKLAAMNKKFGMIHGLSSLANIMSFGSLAMHSWYLAGKIDL

SEQ ID NO: 9836 - protein, 208 aa, Cirsium arvense
MGWMTRFLTAVAFLAIGVIFSPETFGSKSAKITTFVKLAHLLCFSTAWGAALWVTFIGGIIMFKNLPRHQFGNLQSKMFPAYFMMVGICCAVTVGCFGYSHPWKSSTTAEKYQLGFLVSAFVFNLTNLFVFTPMTIEMMKQRHKVERESNIGEEVGWTKNQEVAKVNPKLAAMNKKFGMIHGLSSLANILSFGSLAMHSWYLAGKIDL

SEQ ID NO: 9837 - protein, 208 aa, Taraxacum officinale
MAWMTRFLTAVAFLAIGVIFSPETFGSKSAKITSFVKLAHLLCFSTAWGAALWVTFIGGIIMFKNLPRHQFGNLQSKMFPAYFMMVGICCAVTVGCFGYTHPWKSSSTAEKYQLGFLVSAFVFNLTNLFVFTPMTIEMMKQRHKVERESNIGEEVGWTKNQEVAKANPKLAAMNKKFGMIHGLSSLANIMSFGSLAMHSWYLAGKIDL

SEQ ID NO: 9838 - protein, 206 aa, Euphorbia peplus
MGWLTRFLAASAFLAIGVIFSPETCGSNSIGQLSTYLKLAHLLSFSTAFGAALWVTFIGGIIMFKNLPRHQFGNLQSKMFPAYFWLVGVCCATSVASFGYLHPWKSASTTEKYQLGFLLSSLAFNLTNLFVFTPMTIEMMRQRHKVEREEQIGDEIGWSKNQERAKSNPKLAAMNKKFGMIHGFSSLANIMAFGSLAMHSWYLAGK

SEQ ID NO: 9839 - protein, 208 aa, Euphorbia peplus
GWLSRFMAASAFLAIGVIFSPETFGSNSVGQLSTYLKLAHLLSFSTAFGAALWVTFIGGIIMFKNLPRHQFGNLQSKMFPAYFWLVGVCCATSVASFGYLHPWKSATTSEKYQLGFLLSSLAFNLTNLFVFTPMTIEMMKQRHKVEREEKIGDEIGWSKNQERAKANPKLAAMNKKFGMIHGLSSLANIMAFGSLAMHSWYLAGKLNL

SEQ ID NO: 9840 - protein, 208 aa, Flaveria ramosissima
MAWMTRFLTAIAFLAIGVIFSPETFGSKSAKITTFVKLAHLLCFSTAWGAALWVTFIGGIIMFKNLPRHQFGNLQSKMFPAYFMMVGVCCAVSVGCFGYTHPWKSSSTAEKYQLGFLVAAFVFNLTNLFVFTPMTIEMMKQRHKVERESNIGEEVGWTKNQEVAKVNPKLAAMNKKFGMIHGLSSLANIISFGSLAMHSWYLAGKIDL

SEQ ID NO: 9841 - protein, 210 aa, Acacia harpophylla
MAWLTRFLAAVAFLAIGVIFSPELFGSKSDASNSLKLSTYLKLAHLLSFSTAFGAAQWVTFIGGIIMFKNLPRHQFGNLQSKMFPAYFSMVGICCAISVASFGYLHPWKSSSTAERYQLGFLLSSFAFNLANLFVFSPMTIELMRQRHKVERENSIGEEVGWSKNIEVAKKNPKLAAMNKKFGMIHGLSSLANIMSFGGLAMHSWYLAGK

SEQ ID NO: 9842 - protein, 209 aa, Manihot esculenta
MGWLSRFLAAVAFLAIGVIFSPETFGSNSIVQLPTCLKLAHLLSFSTAFGAALWVTFIGGIIMFKNLPRHQFGNLQSKMFHAYFWLVSVCCAISVASFGYLHPWKSASTAEKYQLGFLLSSLSFNLANLFVFTPMTIEMMRQRHKVEREQNIGNEVGWSKNQEVAKVNPKLAAMNKKFGMIHGFSSLANIMSFGSLAIHSWYLAGKLNP

SEQ ID NO: 9843 - protein, 208 aa, Centaurea maculosa
MAWMTRFLTAVAFLAIGVIFSPETFGSKSAKITSFVKLAHLLCFSTAWGAALWVTFIGGIIMFKNLPRHQFGNLQSKMFPAYFMMVGICCAVSVGCFGYSHPWKSSSTAEKYQLGFLVSAFVFNLTNLFVFTPMTIEMMKQRHKVERESNIGEEVGWTKNQEVAKVNPKLAAMNKKFGMIHGLSSLANILSFGSLAMHSWYLAAKIDL

SEQ ID NO: 9844 - protein, 208 aa, Cichorium intybus
MAWMTRFLTAVAFLAIGVIFSPETFGSKSAKITSFVKLAHLLCFSTAWGAALWVTFIGGIIMFKNLPRHQFGNLQSKMFPAYFMMVGICCAVTVGCFGYTHPWKSSSTAEKYQLGFLVSAFVFNLTNLFVFTPMTIEMMKQRHKVERESNIGEEVGWTKNQDVAKVNPKLAAMNKKFGMIHGLSSLANIMSFGSLAMHSWYLAGKIDL

SEQ ID NO: 9845 - protein, 126 aa, Valeriana officinalis
MGWLTRFIGAVSFLAIGIIFSPETFGAKSPNLPTFIKLAHLLCFATAWGAALWVTFIGGIIMFKNLPRHQFGNLQSKMFPAYFSMVGVCCAVCVAVFWVLASMEVFLLCRKVPAWLPFICFCLQPH

SEQ ID NO: 9846 - protein, 213 aa, Malus domestica
MAWLTRFLAAVAFLAIGVIFSPETFGSKSDGLKSPTLSTYLKLAHLLCFSTAFGAALWVTFIGGIIMFKNLPRHQFGNLQSKMFPAYFTMVGICLAVSAGSFGYLHPWSSSSVADKYQLGFLLSAFAFNLTNLFVFTPMTIEMMKQRHKVEREQNIGEEVGWSKNVQVAKVNPKLAAMNKKFGMIHGLSSLANIFAFGSLAMHSWYLAARLDL

SEQ ID NO: 9847 - protein, 207 aa, Actinidia deliciosa
MGWMSRFIAAVTFLAIGVIFSPETFGSTSDGQQPPKLSTFLKLAHLLCFSTAFGAALWVTFIGGIIMFKNLPRHQFGNLQSKMFPAYFAMVGACCAVTVACFGYLHPWKSASTAEKYQLGFLLSAFAFNLTNLFVFTPMTIEMMKQRHKVEREEKIGEEIGWSKNVEVAKVNPKLAAMNKKFGMIHGLSSLANIMSFGSLAIHSWYL

SEQ ID NO: 9848 - protein, 208 aa, Lactuca sativa
MAWMTRFLTAVAFLAIGVIFSPETFGSKSAKITSFVKLAHLLCFSTAWGAALWVTFIGGIIMFKNLPRHQFGNLQSKMFPAYFMMVGICCAVTVGCFGYTHPWKSSSTAEKYQLGFLVSAFVFNLTNLFVFTPMTIEMMKQRHKLERESNIGEEVGWTKNKEVAKVNPKLAAMNKKFGMIHGLSSLANIMSFGSLAMHSWYLAAKIDL

SEQ ID NO: 9849 - protein, 214 aa, Castanea mollissima
MGWLTRFLGAVAFLAVGVIFSPESFGSKSDGGNSTSKLAIYLKLAHLLCYSTAFGTALWVTFIGGIIMFKNLPRHQFGNLQSKMFPAYFSMVGICCAVSVGSFAYLHPWKSSSTAEKYQLGFLLSAFAFNLANLLVFTPMTIEMMKQRHKVERESNIGEEVGWSKNVEVAKVNPKLKAMNKKFGMIHGLSSLANIMSFGSLAMHSWYLAGKLNL

SEQ ID NO: 9850 - protein, 208 aa, Flaveria ramosissima
MAWMTRFLTAIAFLAIGVIFSPETFGSKSAKITTFVKLAHLLCFSTAWGAALWVTFIGGIIMFKNLPRHQFGNLQSKMFPAYFMMVGVCCAVSVGCFGYTHPWKSSSTAEKYQLGFLVAAFVFNLTNLLVFTPMTIEMMKQRHKVERELNIGEETGWTKNQEVAKVSPKLAAMNKKFGMIHGLSSLANIMSFGSLAMHSWYLAGKIDL

SEQ ID NO: 9851 - protein, 208 aa, Helianthus annuus
MAWLTRFLTAISFLAIGVIFSPETFGSNSAKITTFVKLAHLLCFSTAWGAALWVTFIGGIIMFKNLPRHQFGNLQSKMFPAYFMMVGICCAVSVGCFGYTHPWKSSSTAEKYQLGFLVAAFVFNLTNLFVFTPMTIEMMKQRHKVEREANIGEETGWTKNQEVAKVNPKLAAMNKKFGMIHGLSSLANIMSFGSLAMHSWYLAGKIDL

SEQ ID NO: 9852 - protein, 213 aa, Euonymus alatus
MGWLTRFLAAVAFLAVGVIFSPETFGSKSDGQKSSHLSTYLKLAHLLCFSTAFGAALWVTFIGGIIMFRNLPRHQFGNLQSKMFPAYFSLVGACAAMSVASFGYLHPWVTASTVEKYQLGFLLSSFAFSLSNLFVFTPMTIEMMKQRHKVEREQDIGDEVGWSKNREAATVNPKLAAMNKKFGMIHGLSSLANIMSFGSLAMHSWYLAGKMSL

SEQ ID NO: 9853 - protein, 133 aa, Valeriana officinalis
MGWLTRFIGTVSFLAIGILFSPETFGAKSPNLPTFIKLAHLLCFATAWGAALWVTFIGGIIMFKNLPRHQFGNLQSKMFPAYFSMVGVCCAVCVAAFGYLHPWKSSSCAEKYQLGFLLSAFVFNLTNLFIFTP

SEQ ID NO: 9854 - protein, 214 aa, Fagus grandifolia
MGWLTRFLGAVAFLAIGVLFSPETFGSKSDGQNSTTKLATFLKLAHILCYSTAFGSALWVTFIGGIIMFKNLPRHQFGNLQSKMFPAYFSMVGICCAVSVGSFGYLHPWKSSSIAEKYQLGFLLSAFAFNLSNLFVFTPMTIEMMKQRHKVEKESNIGEEVGWSKNVEVAKVNPKLKGMNKKFGMIHGFSSLANILSFGSLAMHSWYLAGKMDL

SEQ ID NO: 9855 - protein, 213 aa, Cucurbita pepo
MAWLTRFLAAVAFLAIGVVFSPETFGSNSKTFNAPNLSLYLKLAHLLCYSTAWGASLWVTFIGGIIMFKNLPRHQFGNLQSKMFPAYFSMVGICCAISVAAFGYLHPWKSAATSERYQLGFLISAFAFNLANLFVFTPMTIELMKQRHKVERENNIGEEVGWTKNVEVAKVNPKLAAMNKKFGMIHGLSSLANILAFGSLAMHSWYLAGKINL

SEQ ID NO: 9856 - protein, 213 aa, Tabernaemontana elegans
MGWTSRFLTAVVFLAIGVIFSPETFGSKSDGQHPGKLLTFLKLAHLLCFSTAWGAALWVTFIGGIIMFKNLPRHQFGNLQSKMFPAYFSMVGVCCAVSVASFGYLHPWKTASTTHKYQLGFLLAAFAFSMSNLLVFTPMTIEMMKQRHKIEREAKIGEEVGWTKNQEVAKVNPQLAAMNRKFGMIHGLSSLANIMSFGCLAMHSWYLAGKIDI

SEQ ID NO: 9857 - protein, 213 aa, Citrullus lanatus
MAWLTRFLTAVVFLAIGVVFSPETFGSNSKTFNAPKLSMYLKLAHLLSYSTAWGAALWVTFIGGIIMFKNLPRHQFGNLQSKMFPAYFSMVGICCATSVAAFGYLHPWKSAATSERYQLGFLISAFAFNLANLFVFTPMTIELMKQRHKVERESNIGEEVGWSKNVEVAKVNPKLAAMNKKFGMIHGLSSLANILAFGSLAMHSWYLAGKINL

SEQ ID NO: 9858 - protein, 208 aa, Tragopogon dubius
MAWMTRFLTAVAFLAIGVIFSPETFGSKSAKITSFVKLAHLLCFSTAWGAALWVTFIGGIIMFKNLPRHQFGNLQSKMFPAYFMMVGICCAVTVGCFGYTHPWKSSSSAEKYQLGFLVSAFVFNLTNLFVFTPMTIEMMKQRHKVERESSIGDEVGWTKNQEVAKVNPKLAAMNKKFGMIHGLSSLANIMSFGSLAMHSWYLAAKIDL

SEQ ID NO: 9859 - protein, 187 aa, Camellia sinensis
MSRFIAAVAFLAIGVIFSPETFGSSSSKLPTYLKLAHLLCFSTAWGAALWVTFIGGIIMFKNLPRHQLEISKQDVSGVFHDGWGLLCHFSGVFGYLHPWKSASIAEKYQLGFLLSAFAFNLSNLFVFTPMTIEMMKQRHKVEREENIGEEIGWSKNQEAAKVNPKLKAMNKKFGMIHDLSSLLISCH

SEQ ID NO: 9860 - protein, 213 aa, Mimulus guttatus
MAWVTRFLTAVAFLAIGVIFSPETFGSKSDGQKSPMFLTVLKLAYLLCFSTAWGAALWVTFIGGIIMFKNLPRHQFGNLQSKMFPAYFSMVGVCCAVAVGSFGYLHPWKTSGATEKYQLGFLLAAFAFNLSNLVIFTPMTIEMMKQRHKIEREANIGEEVGWTKNKEEAKKNPKLAAMNKKFGMIHGLSSLANIFSFGSLAIHSWYLAGKIDF

SEQ ID NO: 9861 - protein, 213 aa, Fragaria vesca
MGWLTRSLAAVAFLAIGVIFSPETFGSKSDGPKSPALSTYLKLAHLLSFATAFGAALWVTFIGGIIMFKNLPRHQFGNLQSKMFPAYFTMVGICCAISVASFGYLHPWSSSTVADKYQLGFLISSLAFNLTNLFVFTPMTIEMMKQRHKIEKEQNIGEEVGWSKNVQVAKVNPKLAAMNKKFGMIHGLSSLANIMAFGSLAMHTWYLAGKLDL

SEQ ID NO: 9862 - protein, 212 aa, Vaccinium corymbosum
MGWMTRFTGAVALLAAGVIFSPETFGSTSSDALQKLSTYLKLAHLLCFSTAFGAALWVTFIGGIIMFKNLPRHQFGNLQSKMFPAYFAMVGVCCAICVTCFGYLHPWKAASTSEKYQLGLLLSAFVFNLANLVVFTPMTVEMMKQRHKVEREENIGEEVGWSKNVEVAKVNPKLKAMNKKFGMIHGLSSLANIMSFGSLAVHSWYLAGKMNL

SEQ ID NO: 9863 - protein, 208 aa, Artemisia annua
MGWMTRFLTAIAFLAVGVIFSPETFGSKSAKITTFVRLAHLLCFSTAWGAALWVTFIGGIIMFKNLPRHQFGNLQSKMFPAYFMMVGICCAVSVGCFGYTHPWKSSATAEKYQLGFLVAAFVFNLTNLFVFTPMTIEMMKQRHKIERESNIGEEVGWTKNQEVAKVNPKLASMNKKFGMIHGLSSLANIMSFGSLAMHSWYLAGKLDL

SEQ ID NO: 9864 - protein, 208 aa, Senecio madagascariensis
MGWMTRFLTAIAFLAIGVIFSPETFGSKSANITAFVKLAHLLCFSTAWGAALWVTFIGGIIMFKNLPRHQFGNLQSKMFPAYFMMVGICCAVAVGCFGYTHPWKSSSTAEKYQLGFLVSAFVFNLSNLFVFTPMTIEMMKQRHKLERESNIGEEVGWTKNQEVAKVNPKLAAMNKKFGMIHGLSSLANIFSFGSLAMHSWYLAGKLNL

SEQ ID NO: 9865 - protein, 213 aa, Aquilegia formosa
MAWLTRFLTAVAFLAFGILFSPESFGSKSDGSYSSKLSITLKLFHLLSFATAWGAALWVTFIGGIIMFKNLPRHQFGNLQSKMFPAYFSMVSICCAISVACFGYIHPWKTSSATERYQLGFLLSAFAFNLTNLFVFTPMTIEMMKQRHKIEREESIGEEVGWTKNREVAKKNPKLAAMNKKFGMIHGLSSLANIFSFGSLALHSWYLAGKIDL

SEQ ID NO: 9866 - protein, 213 aa, Amsonia hubrichtii
MGWTSRFLTAVAFLAIGIIFSPETFGSNSDGQHPAKLLTFLKLAHLLCFSTAWGAALWVTFIGGIIMFKNLPRHQFGNLQSKMFPAYFSMVGVCCAVSVASFGYLHPWKTASTTHKYQLGFLLAAFAFNMSNLLVFTPMTIEMMKQRHKIEREVKIGEEVGWTKNQEVAKANPQLAAMNKKFGMIHGLSSLANITSFGCLAMHSWYLAAKIEF

SEQ ID NO: 9867 - protein, 213 aa, Ocimum basilicum
HAVLSRFLTAVAFLAIGVVFSPETFGSKSDGQNSQVLVSALKLAHLLCFSTAWGAALWVTFIGGIIMFKNLPRHQFGNLQSKMFPAYFSMVGVCCAVAVGSFGYLHPWKTSGPTEKYQLGFLIAAFAFNLSNLVIFTPMTIEMMKQRHKIEREANIGEEVGWTKNQEVAKKNPKLAAMNKKFGMIHGLSSLANIFSFGSLAMHSWYLASKIDL

SEQ ID NO: 9868 - protein, 213 aa, Catharanthus roseus
MGWMSRFLTAVAFLAIGVIFSPEIFGSKPDGQHPPKLLTFLKLAHLLCFSTAWGAALWVTFIGGIIMFKNLPRHQFGNLQSKMFPAYFSMVGVCCAVSVASFGYLHPWKTASTTHKYQMGFLLAAFAFNMSNLLIFTPMTIEMMKQRHKVERDAKIGDEVGWTKNQEVAKVNPQLAAMNKKFGMIHGLSSLANIMSFGCLAMHSWYLAGKIDF

SEQ ID NO: 9869 - protein, 213 aa, Unknown
  Sequence found in Organisms: Solanum lycopersicum, Solanum tuberosum
MGWMTRFLSAVAFLAIGVLFSPETFGSKSDGQHPPKLATFLKLAHLLCFSTAFGAALWVTFIGGIIMFKNLPRHQFGNLQSKMFPAYFSMVGVCCAVSVGSFGYLHPWKTASASEKYQLGFILAAFAFNLSNLFVFTPMTIQMMKERHKIEREANIGEEVGWTKNQEVAKVNPKLSAMNKKFGMIHGLSSLANIFSFGCLAMHSWYLAGKLDL

SEQ ID NO: 9870 - protein, 213 aa, Triphysaria pusilla
MAWLTRFLTAVAFLAIGVIFSPETFGSKSDGENSPVLVTGLKLAHLLCFSTAWGAALWVTFIGGIIMFKNLPRHQFGNLQSKMFPAYFSMVGVCCAVSVGSFGYLHPWKTSTATEKYQLGFLLAAFTFNLSNLVIFTPMTIEMMKQRHKIEREANIGEEVGWTKNKEAAKKNPKLASMNKKFGMIHGLSSLANIFAFGSLAMHSWYLAGKLNL

SEQ ID NO: 9871 - protein, 213 aa, Vinca minor
GWASRFLTAVAFLAIGVIFSPETFGSKPDGGQHPPKLLTFLKLAHLLCFSTAWGAALWVTFIGGIIMFKNLPRHQFGNLQSKMFPAYFSMVGVCCAVSVASFGYLHPWKTATTTHKYQLGFLLAAFAFNMSNLLVFTPMTIEMMKQRHKVERDAKIGEEVGWTKNQEVAKVNPQLAAMNKKFGMIHGLSSLANIFSFGCLAMHSWYLAGKINF

SEQ ID NO: 9872 - protein, 213 aa, Nicotiana benthamiana
MAWMTRFLAAVAFLAIGVLFSPETFGSKSEGQHPPKLVTLLKLAHLLCFSTAFGAALWVTFIGGIIMFKNLPRHQFGNLQSKMFPAYFSMVGVCCAVSVGSFGYLHPWKAASAAEKYQLGFILAAFAFNLSNLFVFTPMTIQMMKQRHKIEREANIGEEVGWTKNQEVAKANPKLAAMNKKFGMIHGLSSLANIFSFGCLAMHSWYLAGKLNL

SEQ ID NO: 9873 - protein, 213 aa, Sesamum indicum
MAWMTRFLTAVAFLAVGVIFSPETFGSKSDGYNSPLLITLLKLAHLLCFSTAWGAALWVTFIGGIIMFKNLPRHQFGNLQSKMFPAYFSMVGVCCAIAVGAFGYLHPWKTSGAAEKYQLGFLVTAFAFNLSNLIIFTPMTIEMMKQRHKIEREANIGEEVGWTKNQEVAKKNPKLAAMNKKFGMIHGLSSLANILSFGSLAIHSWYLAGKINL

SEQ ID NO: 9874 - protein, 213 aa, Solanum melongena
MGWMTRFLAAVAFLAIGVLFSPETFGSKSDGQHPPKLATFLKLAHLLCFSTAFGAALWVTFIGGIIMFKNLPRHQFGNLQSKMFPAYFSMVGVCCAVSVGSFGYLHPWKAASSAEKYQLGFILAAFAFNLSNLFVFTPMTIQMMKQRHKIEREANIGEEVGWTKNQEVAKVNPKLAAMNKRFGVIHGLSSLANIFSFGCLAMHSWYLAGKLDL

SEQ ID NO: 9875 - protein, 213 aa, Lippia dulcis
MAWLTRFLTAVAFLAIGVVFSPETFGSKSDGQHSQLLLSSLKLAHLLCFSTAWGAALWVTFIGGIIMFKNLPRHQFGNLQSKMFPAYFSMVGVCCAVAVGSFGYLHPWKTSGSTEKYQLGFLLAAFAFNLSNLVIFTPMTIEMMKQRHKIEREVNIGEEVGWTKNQEVAKKNPKLAAMNKKFGMIHGLSSLANIFAFGSLGLHSWYLAGKLNL

SEQ ID NO: 9876 - protein, 213 aa, Solanum phureja
MGWMTRFLSAVAFLAIGVLFSPETFGSKSDGQHPPKLATFLKLAHLLCYSTAFGAALWVTFIGGIIMFKNLPRHQFGNLQSKMFPAYFSMVGVCCAVSVGSFGYLHPWKTASASEKYQLGFILAAFAFNLSNLFVFTPMTIQMMKERHKIEREANIGEEVGWTKNQEVAKVNPKLSAMNKKFGMIHGLSSLANIFSFGCLAVHSWYLAGKLDL

SEQ ID NO: 9877 - protein, 209 aa, Fagopyrum esculentum
MGWLSRFVVAVAFLAIGVIFSPESFGSSSGVGSSPYLKLVHLLCFSTAFGAALWVTFIGGIIMFKNLPRHQFGNLQSKMFPAYFTLVGVCCAAAVAAFGYLHPWKSCSQTEKYQLGFLAGSFLFNLSNLFIFTPMTIQMMKKRHKVEREQNIGEEVGWSKNREAAKVNPELAGMNKKFGMIHGLSSLANILSFGCLAMHSWYLAGKLDL

SEQ ID NO: 9878 - protein, 215 aa, Vinca minor
MGWTSRFLTAVAFLAIGVIFSPETFGSKPDGGGQHPPKLLTFLKLAHLLCFSTAWGAALWVTFIGGIIMFKNLPRHQFGNLQSKMFPAYFSMVGVCCAVSVASFGYLHPWKTASITHKYQLGFLLAAFAFNLSNLLVFTPMTIEMMKQRHKVERDAKIGDEVGWTKNQEAAKVNPQLAAMNKKFGMIHGLSSLANITSFGCLAMHSWYLAGKINF

SEQ ID NO: 9879 - protein, 192 aa, Flaveria ramosissima
MAWMTRFLTAITFLAIGVIFSPESFGSKSAKITTFVKLTHLLCFSTAWGAALWVTFIGGIIMFKNLPRHQFGNLQSKMFPAYFTMVGVCCAVSVGCFGYTHPWKSSSTGEKYQLGFLVAAFVFNLANLLVFTPMTIEMMKQRHKVERELNIGEETGWTRTRRLRGKPKASSNEQEVWYDSWTIFSSQHNVFW

SEQ ID NO: 9880 - protein, 165 aa, Guizotia abyssinica
MAWMRRFLTAIAFLANGVIFSPETFGSKSAKITTFVKLAHLLCFSTTWGAALWVTFIGGIIRVKNLPRHQCGNLQSKMFPAYFMMVGICCAVSVGCFGYTHPWKSSSSAEKYQLGFLVAAFVFNLTNLFVFTPMTIEMMKQRHKVERESNIGEEVDGQRTRRLQR

SEQ ID NO: 9881 - protein, 213 aa, Capsicum annuum
MAWMTRFLGAVAFLAIGVLFSPETFGSKSDGQHPPKLATFLKLAHILCFSTAFGAALWVTFIGGIIMFKNLPRHQFGNLQSKMFPAYFSMVGVCCAVSVGSFGYLHPWKSASASEKYQLGFILAAFAFNLSNLFIFTPMTIQMMKQRHKIEREANIGEEVGWTKNQEVAKVNPKLAAMNKKFGMIHGLSSLANIFSFGCLAMHSWYLAGKLDL

SEQ ID NO: 9882 - protein, 213 aa, Fraxinus spp
MGWMSRFLAAATFLAIGVIFLPEKLGSESEDQHSPKLITLLKLAHLLCFSTAWGAALWVTFIGGIIMFKNLPRHQFGNLQSKMFPAYFSMVGVCCAVAVASFGYLHPWKSSTAAEKYQLGFLMAAFAFNLCNLVVFTPMTIEMMKQRHKIEKEANIGEEVGSTKNQEVAKKNPKLAAMNKKFGMIHGLSSLSNIMSFGSLAMHSWYLAGKIDL

SEQ ID NO: 9883 - protein, 205 aa, Actinidia deliciosa
MGWMSRFIAAVTFLAIGVIFSPETFGSTSSDGQQPPKLPTYLKLAHLLCFSTAFGAALWVTFIGGIIMFKNLPRHQFGNLQSKMFPAYFAMVGACCAITVACFGYLHPWKSASTAEKYQLGFLLSAFAFNLTNLFVFTPMTIEMMKQRHKIEREEKIGEEIGWSKNVEVAKVNPKLAAMNKKFGMIHGLSSLANIMSFGSLAIHS

SEQ ID NO: 9884 - protein, 213 aa, Cucumis melo
MAWLTRFLTAVVFLAMGVVFSPETFGSNSKTFNAPKLSMYLKLAHLLSYSTAWGASLWVTFIGGIIMFKNLPRHQFGNLQSKMFPAYFSMVGICCATSVAAFAYLHPWKSAETSERYQLGFLISAFAFNLANLFVFTPMTIELMKQRHKVERESNIGEEVGWSKNVEVAKVNPKLAAMNKKFGMIHGLSSLANILAFGSLAMHSWYLAGKLNL

SEQ ID NO: 9885 - protein, 213 aa, Olea europaea
MGWMTRFLTAAAFLAVGAVFSPETFGSKSIGLHSPMLITLLKLAHLLCFSTAFGAALWVTFVGGIIMFKNLPRHQFGNLQSKMFPAYFSMVGVCCAVSMGAFGYLHPWKTSTTAEKYQIGFLLAAFAFNLTNLFVFTPMTIEMMKQRHKIEREASIGDEIGWTKNQEVAKKNPKLASMNKKFGMIHGLSSLANIISFGSLAVHSWYLAGKIDL

SEQ ID NO: 9886 - protein, 214 aa, Petunia hybrida
MGWMTRFLAAVAFLAIGVLFSPETFGSKTDGQPHAPKLLTLLKLAHLLCFSTAFGAALWVTFIGGIIMFKNLPRHQFGNLQSKMFPAYFSMVGVCCAVSVGSFGYLHPWKASSAAEKYQLGFILAAFAFNLSNLFVFTPMTIQMMKERHKIEREANIGEEVGWTKNQEVAKVNPKLKAMNKKFGMIHGLSSLANIFSFGCLAMHSWYLAGKLDL

SEQ ID NO: 9887 - protein, 191 aa, Antirrhinum majus
MAWMTRFLTAVTFLAVGVIFSPETFGSKSDGEKSPVLITGLKLAHLLCFSTAWGAALWVTFIGGIIMFKNLPRHQFGNLQSKMFPAYFSMVGVCCAVAVGAFGYLHPWKTAGATEKYQLGFLLAAFAFNLSNLVIFTPMTIEMMKQRHKIEREANWGRSWVDQKQRSRKEKPKAGHYEQEVWNDSWIIFSC

SEQ ID NO: 9888 - protein, 213 aa, Nicotiana benthamiana
MAWMTRFLSAVAFLAVGVLFSPETFGSKSEGQHPPKLVTLLKLAHLLCFSTAFGAALWVTFIGGIIMFKNLPRHQFGNLQSKMFPAYFSMVGVCCAVSVGSFGYLHPWKAASAAEKYQLGFILAAFSFNLSNLFVFTPMTIQMMKQRHKIEREANIGEEVGWTKNQEVAKANPKLAAMNKKFGMIHGLSSLANIFSFGCLAMHSWYLAGKLNL

SEQ ID NO: 9889 - protein, 213 aa, Platanus occidentalis
MAWLTRFLVAVAFLAFGVLFSPETFGSNSEAGYSSKLSISLKLAHLLSFSTAWGSALWVTFIGGIIMFKNLPRHQFGNLQGKMFPAYFSLVGVCGAISVASFGYLHPWRSSSSAEKYQLGFLISSFAFSLTNLFVFTPMTIEMMKQRHKVEKEENIGEEVGRSKNIEVAKVNPKLAAMNKKFGMIHGLSSLANLMSFGSLAMHSWYLAGKINL

SEQ ID NO: 9890 - protein, 213 aa, Salvia sclarea
MAWLTRFLTAVAFLAIGVVFSPETFGSKSDGQHSQLLLSSLKLAHLLCFSTAWGAALWVTFIGGIIMFKNLPRHQFGNLQSKMFPAYFSMVGVCCAVAVGSFGYLHPWKTAGSTEKYQLGFLIAAFAFNLSNLVIFTPMTIEMMKQRHKIEREVDIGEEVGWTKNQEVAKKNPKLAAMNKKFGMIHGLSSLANIFAFGSLALHSWYLAGKLNL

SEQ ID NO: 9891 - protein, 213 aa, Nicotiana tabacum
MAWMTRFLAAVVFLAIGVLFSPETFGSKSEGQHPPKLVTLLKLAHLLCFSTAFGAALWVTFIGGIIMFKNLPRHQFGNLQSKMFPAYFSMVGVCCAVSVGSFGYLHPWKAASAAEKYQLGFILAAFAFNLSNLFVFTPMTIQMMKQRHKIEKEANIGEEVGWTKNQEVAKANPKLAAMNKKFGMIHGLSSLANIFSFGCLAMHSWYLAGKLNL

SEQ ID NO: 9892 - protein, 166 aa, Fagopyrum esculentum
MFLHRFRRCSLVTFIGGIIMFKNLPRHQFGNLQSKMFPAYFTLVGVCCAAAVAAFGYLHPWKSCSQSEKYQLGFLAGSFLFNLSNLFIFTPMTIQMMKKRHKVEREQNIGEEVGWSKNREAAKVNPELAGMNKKFGMIHGLSSLANILSFGCLAMHSWYLAGKLDL

SEQ ID NO: 9893 - protein, 198 aa, Arnica chamissonis
IAFLAIGVIFSPETFGSKSAKITTFVKLAHILCFSTAWGAAVWVTFIGGIIMFKNLPRHQFGNLQSKMFPAYFMMVGICCAVSVGCFGYTHPWKSSSTAEKYQLGFLVSALAFNLANLFVFTPMTIEMMKQRHKMERESNIGEEVGWTKNQEVAKVNPKLAAMNKRFGMIHGLSSLANIMSFGSLAIHSWYLAGKIDL

SEQ ID NO: 9894 - protein, 218 aa, Liriodendron tulipifera
MAWLTRFLSALAFLAIGILFSPETFGSKSDGGHSSTLTISLKLAHLLSFATAWGAALWVTFIGGIIMFKNLPRHQFGNLQSKMFPAYFLTVGACGAISVAAFGYLHPWKTASSSERYQLGFLLSSFAFNLTNLFVFTPMTIEMMKQRHKVEREEKIGEEVGWTKNVEVAKVNPKLAAMNKKFGMIHGLSSLANIMSFGSLAMHSWYLAGKIHFKYVCF

SEQ ID NO: 9895 - protein, 213 aa, Silene vulgaris
MGWLSRFTIAVAFLAVGVIFSPETFKSDGSDSSSPALNTALKLSHLLCFSTAWGAALWVTFIGGIIMFKNLPRHQFGNLQSKMFPAYFTMVGICCAVSMAAFGYLHPWKSASSTEKYQLGFLGFAFFFNLTNLVIFTPMTIEMMKQRHKVERENNVGEEVGWSKNKEVAKSNPQLASMNKKFGMIHGLSSLANIFAFGCLAMHSWYLAGKLNL

SEQ ID NO: 9896 - protein, 213 aa, Utricularia gibba
MGWMTRFVTAVAFLAVGVIFSPETFGSKSGTEKSPVVVTVLKLVHLLCFATAWGAALWVTFIGGIIMFKNLPRHQFGNLQSKMFPAYFSMVGVCCAAAVGAFAYLHPWRSSGATEKYQLGFLVAAFAFNLSNLVVFTPMTIEMMKERHKVEREANIGEEVGWSKNQQEAKKNPKLAAMNKKFGMIHGLSSLANIFSFGSLAIHSWYLAGKINL

SEQ ID NO: 9897 - protein, 175 aa, Plantago ovata
MAWLTRFLTAVTFLAVGVVFSPVNLGSSGDKSLLLMNGLKLAHLLCFSTAWGAALWVTFIGGIIMFKNLPRHQFGNLQSKMFPAYFSMVGVCCAVALGCFGYLHPWQTSGVTEKYQLGFLLAAFVFNLSNLIIFTPMTIEMMKQRHKIEREANIGEEVGWTKNKAEAKKTRSLLP

SEQ ID NO: 9898 - protein, 213 aa, Ipomoea batatas
MGWMTRFSTVLAFLAIGVVFSPETFGSKSDGQYPLKAVTFLKLAHLLCFSTAWGAALWVTFIGGIIMFKNLPRHQFGNLQSKMFPAYFTLVGVCCAVSVAAFGYMHPWKTSSSAEKYQIGFILGAFAFNLSNLFVFTPMTIQMMKQRHKIERESNIGDEVGWTKNQEVAKVNPKLAAMNKKFGMIHGLSSLANIVSFGCLAMHSWYLAGKINF

SEQ ID NO: 9899 - protein, 141 aa, Chelidonium majus
MAWITRFLVAVAFLAFGILFSPETFGSKSDGEYSSKLIIALKLGHLLSFSTSFGAALWVTFIGGIIMFKNLPRHQFGNLQSKMFPAYFSMVTVCSATSLASFGYLHPWKSSSSAEKYQLGFLSLYLRFQSIQFVRLHPHDH

SEQ ID NO: 9900 - protein, 217 aa, Coffea canephora
MGWMSRFLAAVTFLAVGVIFSPETFGSTSPQDGQQHHHPKLLSFLKLAHLLCFSTAWGAALWVTFIGGIIMFKNLPRHQFGNLQSKMFPAYFSMVGVCCAVCVASFAYLHPWKTASMAHKYQLGFLLAAFAFNLTNLLVFTPMTIEMMKQRHKIEREAQIGEEVGWTKNQEVAKANPKLAAMNKKFGMIHGLSSLANIMSFGSLAMHSWYLSGKINF

SEQ ID NO: 9901 - protein, 213 aa, Olea europaea
MGWMSRFLAAATFLAIGVTFLPEKSESESANQHSPKLVNLLKLAHLLCFSTAWGAALWVTFIGGIIMFKNLPRHQFGNLQSKMFPAYFSMVGVCCAVAAAAFGYLHPWKASTAAEKYQLGFLTSAFAFNLCNLVVFTPMTIEMMKQRHKIEREANIGEEVGSTKNQEVAKKNPKLAAMNKKFGMIHGLSSLSNIMSFGSLAMHSWYLAGKIDL

SEQ ID NO: 9902 - protein, 211 aa, Beta vulgaris
MGWLTRFIVALSFLAIGIIFSPETFKSDASNSSSLSTFLKLSHLLCFSSAWGAALWATFIGGIIMFKNLPRHQFGNLQSKMFPAYFTLVGVCCAISTASFGYLHPWKSSSSTEKYQLGFLGFAFLFNLSNLLVFTPMTIKMMKQRHKVERENNIGEEVGWTKNKEVAKTNPQLAAMNKKFGMIHGLSSLANLFSFGCLAMHSWYLACKLDL

SEQ ID NO: 9903 - protein, 279 aa, Glycine max
MSTSAASLALPTLTLRTRQPLCSPQCFSSSLSLTPNSKPISISAVFLKTTLSSSSPLSLSSRFVPHVSVLEQEEDTFGDGDGPSFSRDLKLFVGNLPFSVDSARLAELFESAGNVEVVEVIYDKTTGRSRGFGFVTMSSVEEAEAAAKQFNGYELDGRSLRVNSGPPPARNESAPRFRGGSSFGSRGGGPSDSENRVHVGNLAWGVDDVALESLFREQGKKVLEARVIYDRESGRSRGFGFVTFGSPDEVKSAIQSLDGVDLNGRAIRVSLADSKPKRF

SEQ ID NO: 9904 - protein, 279 aa, Cajanus cajan
MSTSAASLALPTLTLRTRQPLCSPQCFSSLSLAPNSKPISISAVFLKPTTLSLSSRFVPRVAVSSELEQEEDTFSDGDGDSDSPSFSPDLKLFVGNLPFSVDSAQLAELFESAGNVEVVEVIYDKTTGRSRGFGFVTMSSVEEVEAAAQQFNGYELEGRALRVNAGPPPSRSESSPRFRGSSGPRGGGGGFSDSENRVHVGNLAWGVDNLALESLFREQGKVLEARVIYDRESGRSRGFGFVTYSSPDEVNSAIQSLDGVDLNGRAIRVSMADSKPKRF

SEQ ID NO: 9905 - protein, 210 aa, Glycine max
MRSSKMWMVFMCLTVSFFARIESLSVTVNDVECVYEYVLYEGDTVSGNFVVVDHDIFWSSDHPGIDFTVTTAAGNTVHSIKGTSGDKFSFKAPSHGMYKFCFHNPYSTPETVSFYIHVGHIPSEHDLAKDEHLDPINVKIAELREALESVTAEQKYLKARDARHRHTNESTRKRVVFYTVGEYLLLAAVSALQVIYIRRLFSKSVAYNRV

SEQ ID NO: 9906 - protein, 210 aa, Cajanus cajan
MRGANVWTVFMCLMLSFFARIQSLSVTVNDVECVYEYVLYEGDTVSGNFVVVDHDIFWSSDHPGIDFTVTTPAGNTVQNIKGTSGDKFSFKAPTHGMYKFCFHNPYSTPETVSFYIHVGHIPSEHDLAKDEHLDPVNVKIAELREALESVTAEQKYLKARDARHRHTNESTRKRVIFYTVGEYLLLAAVSALQVIYIRRLFSKSVAYNRV

SEQ ID NO: 9907 - protein, 210 aa, Phaseolus coccineus
MRSVKMWTVLMCLILIFFARIESLSVTVNDVECVYEYVLYEGDTVTGNFVVVDHDIFWSSDHPGIDFTVTSPGGNTVTNIKGTSGDKFDFKAPKHGMYKFCFHNPQSTPETVSFYIHVGHIPSEHDLAKDEHLDPVNVKIAELREALESVTAEQKYLKARDARHRHTNESTRKRVVFYTVGEYFLLAAVSALQVLYIRRLFSKSVAYNRV

SEQ ID NO: 9908 - protein, 210 aa, Vigna unguiculata
MRSAKMWTVLMCLIMSLFTRTESLSVTVNDVECVYEYVLYEGDTVSGNFVVVDHDIFWSSDHPGIDLEVTSPGGNTVKSIKGTSGDKFDFKAPTHGMYKFCFHNPYSTPETVSFYIHVGHIPSEHDLAKDEHLDPINVKIAELREALESVTAEQKYLKARDARHRHTNESTRKRVVFYTVGEYFLLAAVSALQVLYIRRLFSKSVAYNRV

SEQ ID NO: 9909 - protein, 211 aa, Cyamopsis tetragonoloba
TRRSAKMWMVLMCLMISFFGRIESLSVTVNDVECVYEYVIYEGDTVSGNFVVVDHDIFWSSDHPGIDFTVTSPSGNTVHDIKGTSGDKFQFKAPVHGMYKFCFHNPYSTPETVSFYIHVGHIPSEHDLAKDEHLDPINVKIAELREALESVTAEQKYLKARDARHRHTNESTRKRVVFYTIGEYFMLAAVSALQVIYIRRLFSKSVAYNRV

SEQ ID NO: 9910 - protein, 216 aa, Arachis hypogaea
MEQTQWKRSSKMWMVLACLMMSFFSGIESLSVTVNDVECVYEYVLYEGDTISGNFVVVDHDIFWGSDHPGIDFTVTSPAGNTVQNIKGTSGDKFQFKAPTHGMYKFCFHNPHSTPETVSFYIHVGHIPSEHDLAKDEHLDPINVKIAELREALESVTAEQKYLKARDARHRHTNESTRKRVIFYTVGEYLLLAGVSALQVIYIRRLFSKSVAYNRV

SEQ ID NO: 9911 - protein, 212 aa, Medicago truncatula
MEKRNAKMWMALMCLVFIFVDRIESLSVTVQDVECLYEYVLYEGDTVSGNFVVVDHDIFWSSDHPGIDFTVTSPGGNVVQDIKGTSGDKFQFKAPVHGMYKFCFHNPYSTPETVSFYIHVGHIPSEHDLAKDEHLDPINVKIAELREALESVTAEQKYLRARDARHRHTNESTHKRVIFYTVGEYLLLAAVSALQVIYIRRLFSKSVAYNRV

SEQ ID NO: 9912 - protein, 214 aa, Lotus japonicus
MEGKRIANKMWMVLMCLMLSFVARIESLSVTVHEVECIYEYVLYEGDTVSGNFVVVDHDIFWGSDHPGIDLTVTSPAGNTVHDIKGTSGDKFQFKAPASGMYKFCFHNPYSTPETVSFYIHVGHIPNEHNLAKDEHLDPINVKIAELREALESVTAEQKYLKARDTRHRHTNESTRSRVIFYTVGEYLLLAAVSTLQVIYIRRLFSKSVAYNRV

SEQ ID NO: 9913 - protein, 216 aa, Cicer arietinum
MEQAQGKRSAKMWMALMCLMFIFVDRIESLSVTVNDVECIYEYVLYEGDTVSGNFVVVDHDIFWSSDHPGIDFTATSPGGNVVQDIKGTSGDKFQFKAPVHGMYKFCFHNPYSTPETVSFYIHVGHIPSEHDLAKDEHLDPINVKIAELREALESVTAEQKYLRARDARHRHTNESTHTRVIFYTVGEYLLLAAVSVLQVIYIRRLFSKSVAYNRV

SEQ ID NO: 9914 - protein, 216 aa, Trigonella foenum-graecum
MERVKGKRIAKMWMVLMCLVFIFVDRIESLSVTVQEVECLYEYVLYEGDTVSGNFVVVDHDIFWSSDHPGIDFTVTSPGGNVVQDIKGTSGDKFQFKAPVHGMYKFCFHNPYSTPETVSFYIHVGHIPSEHDLAKDEHLDPINVKIAELREALESVTAEQKYLRARDARHRHTNESTHKRVIFYTVGEYLLLAAVSALQVVYIRRLFSKSVAYNRV

SEQ ID NO: 9915 - protein, 219 aa, Cannabis sativa
MDRKLRYGNGSSMAQLLLCFLLLTSFVGRIASLSVTVNDVECVYEYVLYEGDTVSGNFVVVDHDIFWNADHPGIDFTVSAPGGNTVHTLKGTSGDKFEFKAPRNGMYKFCFHNPYSTPETVSFYIHVGHIPNEHDLAKDEHLNPINVKIAELREALESVTAEQKYLKARDARHRHTNESTRKRVVFYTVGEYLLLAAVSSLQVLYIRRLFSKSVAYNRV

SEQ ID NO: 9916 - protein, 212 aa, Theobroma cacao
MEKGWGKMWALMVLLLLNWVSNVSSLSVTVNEVECVYEYVLYEGDTVSGNFVVVDHDIFWSSDHPGIDFTVTSPGGNTVQNLKGTSGDKFEFKAPRSGMYKFCFHNPYSTPETVSFYIHVGHIPTEHDLAKDEHLDPINVKIAELREALESVTAEQKYLKARDARHRNTNESTRKRVIGYTVGEYVLLALASALQVIYIRQLFSKSVAYNRV

SEQ ID NO: 9917 - protein, 212 aa, Heritiera littoralis
MERRWGKMTALIILLLLNWVSNVSSLSVTVNDVECVYEYVLYEGDTVSGNFVVVDHDIFWSSDHPGIDFTVTSPGGNTVQNLKGTSGDKFEFKAPRSGMYKFCFHNPYSTPETVSFYIHVGHIPTEHDLAKDEHLDPINVKIAELREALESVTAEQKYLKARDTRHRHTNESTRKRVIGYTVGEYILLALASSLQVIYIRRLFSKSVAYNRV

SEQ ID NO: 9918 - protein, 211 aa, Populus trichocarpa
MERRRKQIYVVAALLMSFISRIYSLSVTVNDVECVYEYVLYEGDTVSGNFVVVDHDIFWGSDHPGIDFTATSPGDNTVHTVKGTSGDKFEFKAPRSGMYKFCFHNPYATPETVSFYIHVGHIPSEHDLAKDEHLNPVNVKIAELREALESVTAEQRYLKARDIRHRHTNESTRRRVIAYTVGEYLLLAAASTLQVVYIRRLFSKSVAYNRV

SEQ ID NO: 9919 - protein, 210 aa, Momordica charantia
RERRFGYLLAGLLLVSLIAGIDSISVTVNEIECVYEYVLYEGDTVSGNFVVVDHDIFWGADHPGIDFTVTSPAGNVVHSLKETSGDKFEFKAPRSGMYKFCFHNPYSTPETVSFHIHVGHIPNEHDLAKDEHLDPINVKIAELREALESVTAEQKYLKARDTRHRHTNESTRKRVIFYTVGEYLLLAVVSGLQVIYIRRLFSKSVGYNRV

SEQ ID NO: 9920 - protein, 218 aa, Salvia sclarea
METTGGITRCGGAAYALLGLLLLSALSRISALSVTVNDVECIYEYVLYEGDTVSGNFVVVDHDIFWSSDHPGIDFTVTSPAGNSVHTLKGTSGDKFEFKAPRSGMYKFCFHNPYSTPETVSFYIHVGHIPTEHDLAKDEHLDPINVKLAELKEALESVTAEQKYLKARDTRHRHTNESTRRRVIFYTVGEYLLLALVSGLQVVYIRRLFSKSVAYNRV

SEQ ID NO: 9921 - protein, 214 aa, Fagus grandifolia
ERRERCGKMCMLMGMVVMSFLIGRISSLSVTVNDMECVYEYVLYEGDTVSGNFVVVDHDIFWSSDHPGIDFTVTSPAGNVVQTLKGTSGEKFNFKAPRSGMYKFCFHNPYSTPETVSFYIHVGHIPNEHDLAKDEHLDPINVKIAELRESLESVTAEQKYLKARDARHRRTNESTRKRVIFYTVGEYILLAAASALQVIYIRQLFSKSVAYNRV

SEQ ID NO: 9922 - protein, 213 aa, Castanea mollissima
MEVRSEKKMWMVLVMVTLSLVGKISSLSVTVNEVECVYEYVLYEGDTVSGNFVVVDHDIFWSSDHPGIDFTVTSPAGNVVQTLKGVSGDKFDFKAPRSGMYKFCFHNPYSTPETVSFYIHVGHIPNEHDLAKDEHLDPVNVKIAELREALESVTAEQKYLKARDTRHRHTNESTRKRVLFYTLGEYLLLAIASGLQVIYIRQLFSKSVGYNRV

SEQ ID NO: 9923 - protein, 219 aa, Tabernaemontana elegans
MEKRRDRTGCLKVYGLVVLLLLSFVGDLSVSALSVTVNDVECVYEYVLYEGDTVSGNFVVVDHDIFWSSDHPGIDLVVTAPGGNTVHTVKGTSGEKFEFKAPRSGMYKFCFHNPYSTPETVSFYIHVGHIPSEHDLAKDEHLDPINVKIAELREALESVTAEQKYLKARDARHRHTNESTRKRVIFYTVGEYILLALASALQVIYIRRLFSKSVAYNRV

SEQ ID NO: 9924 - protein, 219 aa, Mimulus guttatus
MERGRGGIIRCGAAAYALLCLLILSTVSRVPALSVTVNDEECIYDYVLYEGDTVSGNFVVVDHDIFWNSDHPGIDFTVTSPAGDTVHNLKGTSGDKFEFKAPKSGMYKFCFHNPFSTPETVSFYIHVGHIPTEHDLAKDEHLDPINVKIAELREALESVTAEQNYLKARDTRHRHTNESTRKRVIFYTVAEYILLALVSGLQVAYIRRLFSKSVAYNRV

SEQ ID NO: 9925 - protein, 209 aa, Manihot esculenta
MERRQIYVVAALLFTLIGRISSISVTVNDVECVYEYVLYEGDTVSGNFVVVDHDIFWSSDHPGIDLTVTSPADNVVHTVKGTSGDKFEFKAPKSGMYKFCFHNPYSTPETVSFYIHVGHIPNEHDLAKDEHLNPINVKIAELREALESVTAEQKYLKARDARHRRTNESTRKRVIGYTVGEYILLAIVSVLQVVYIRRLFSKSVAYNRV

SEQ ID NO: 9926 - protein, 215 aa, Citrullus lanatus
MERRLREKGFRYLLAGLLLASLIARIDSISVTVNEIECVYEYVLYEGDTVSGNFVVVDHDIFWGADHPGIDFTVTSPAGNVVHSLKETSGDKFEFKAPRSGMYKFCFHNPYSTPETVSFYIHVGHIPNEHDLAKDEHLDPINVKIAELREALESVTAEQKYLKARDARHRHTNESTRKRVIFYTVGEYLLLAVASGLQVIYIRRLFSKSVAYNRV

SEQ ID NO: 9927 - protein, 140 aa, Tripterygium wilfordii
RRGRPRCGGGIYLLALLIVSSIGRISGLSVTVTDKECVQDYVLYEGDTVSGNFVVVDHDIFWNSDHPGIDFTVTSPAGNVVQTFKGTSGDKFEFKAPRSGMYKFCFHNPYSTPESVSFYIHVGHIPSEHDLAKDERFGPN

SEQ ID NO: 9928 - protein, 219 aa, Mimulus guttatus
MERGRGGIIRCGAAAYALLCLLILSTVSRVPALSVTVNDEECIYDYVLYEGDTVSGNFVVVDHDIFWNSDHPGIDFTVTSPAGDTVHNMKGTAGDKFEFKAPKSGMYKFCFHNPFSTPETVSFYIHVGHIPTEHDLAKDEHLDPINVKIAELREALESVTAEQNYLKARDTRHRHTNESTRKRVIFYTVAEYILLALVSGLQVAYIRRLFSKSVAYNRV

SEQ ID NO: 9929 - protein, 210 aa, Ricinus communis
MTRRQIYVVGILLLMNLIGRISSLSVTVNDVECVYEYVLYEGDTVSGNFVVVDHDIFWSSDHPGIDLTVTSPADNVVHTVKGTSGDKFEFKAPRSGMYKFCFHNPYSTPETVSFYIHVGHIPNAHDLAKDEHLNPINVKIAELREALESVTAEQKYLKARDARHRRTNESTRKRVIGYTVGEYILLGLVSTLQVVYIRRLFSKSVAYNRV

SEQ ID NO: 9930 - protein, 216 aa, Carica papaya
MEIQRRHRNTLVLCFIGILLFSFIERISCLSVTVNDQECVYEYVLYEGDTISGNFVVVDHDIFWSSDHPGIDFTVTSPAGNTVHTLKGTSGDKFEFKAPRSGMYKFCFHNPYNTPETVSFYIHVGHIPNEHDLAKDEHLDPINVKIAELREALESVTAEQKYLKARDARHRHTNESTRKRVIGYTVGEYILLAIASALQVVYIRRLFSKSVAYNRV

SEQ ID NO: 9931 - protein, 213 aa, Quercus alba
MEVRSEKKTWMVMVMVLLSLTGKISSLSVTVNEVECVYEYVLYEGDTVSGNFVVVDHDIFWSSDHPGIDFTVTSPAGNVVQSLKGVSGDKFDFKAPRSGMYKFCFHNPYSTPETVSFYIHVGHIPNEHDLAKDEHLDPVNVKIAELREALESVTAEQKYLKARDTRHRHTNESTRNRVIFYTVGEYLLLAIASGLQVIYIRQLFSKSVGYNRV

SEQ ID NO: 9932 - protein, 219 aa, Amsonia hubrichtii
MEKRRERIGCMKVYGLVGLLLLSFVGNLSVSALSVTVNDVECVYEYVLYEGDTVSGNFVVVDHDIFWSSDHPGIDLIVTAPGGNTVQTLKGTSGDKFEFKAPRSGMYKFCFHNPYSTPETVSFYIHVGHIPTEHDLAKDEHLDPINVKIAELREALESVTAEQKYLKARDSRHRHTNESTRKRVIFYTVGEYILLALASALQVIYIRRLFSKSVAYNRV

SEQ ID NO: 9933 - protein, 217 aa, Brassica rapa
MERRQARSSKIHVFVLVCLILFSSIERISSLSVTVSDDECVQEYVLYEGDNVSGNFVVVDHDIFWGSDHPGLDFTVTSPAGNIVHTLKGTSGDKFEFKAPRSGMYKFCFHNPYSTPETVSFYIHVGHIPNEHDLAKDEHLDPVNVKIAELREALESVVSEQKYLKARDTRHRHTNESTRKRVIFYTVGEYIFLAAASGLQVLYIRKLFSKSVAYNRV

SEQ ID NO: 9934 - protein, 212 aa, Gerbera hybrid cultivar
TERSMKVYAVLGLLLLSTFAGDVSALSVTVNDVECVYEYVLYEGDTVSGNFVVVDHDIFWSSDHPGIDFIVSSPGGNVVHTMKGTSGDKFEFKAPRSGMYQFCFHNPYSTPETVSFYIHVGHIPNEHDLAKDEHLDPVNVKIAELREALESVNAEQKYLKARDARHRHTNESTHKRVIFYTIGEYILLALASGLQVVYIRRLFSKSVAYNRV

SEQ ID NO: 9935 - protein, 217 aa, Vinca minor
MRRDKIRCLKVYGLIMLLLLSFAGDISVTALSVTVNEVECVYEYVLYEGDTVSGNFVVVDHDIFWSSDHLGIDLVVTAPGGNTVQTLKGTSGDKFEFKAPRSGMYKFCFHNPYPTPETVSFYIHVGHIPSEHDLAKDEHLDPINVKIAELREALESVTAEQKYLKARDARHRHTNESTRKRVIFYTVGEYILLALASSLQVVYIRRLFSKSVAYNRV

SEQ ID NO: 9936 - protein, 219 aa, Olea europaea
MESRRGRFRCSSKAAYALTGLFLLSLVSRLSALSVTVNEEECVYEYVLYEGDTVSGNFVVVDHDIFWSSDHPGIDLTVTSPGGNTVHTLKGTSGDKFEFKAPRSGMYKFCFHNPYSTPETVSFYIHVGHIPSEHDLAKDEHLDPINVKIAELREALESVTAEQKYLKARDGRHRHTNESTRRRVIFYTVAEYILLAVASALQVVYIRRLFSKSVAYNRV

SEQ ID NO: 9937 - protein, 213 aa, Rhizophora mangle
MERRQICVVAALLLTFICRTASLSVTVHDVECVEEYVLYEGDTVSGNFVVVDHEIFWSSDHPGIDLIVTSPGGNTVHTVKGTSGDKFEFKAPKSGMYKFCFHNPQSAPETVSFYIHVGHIPNEHDLAKDEHLDPINVKIAELREALESVTAEQKYLKARDARHRHTNESTRRRSLPTLLESTFCWLPSVLFKSYIFDAFSASPWHTIGFKALV

SEQ ID NO: 9938 - protein, 219 aa, Olea europaea
MESRRGSIRCSSKAVCTLIGLLLLNSASRLSALSVTVNDVECVYEYVLYEGDTVSGNFVVVDHDIFWSSDHPGIDFSVTSPDGNTVHTLKGTPGDKFEFKALRSGMYKFCFHNPYSTPETVSFYIHVGHIPSEHDLAKDEHLDPINVKIAELREALESVTAEQKYLKARDGRHRHTNESTRRRVIFYTVAEYILLALASSLQVVYIRRLFSKSVAYNRV

SEQ ID NO: 9939 - protein, 214 aa, Cleome spinosa
METGQARDPKSLLVGLLLLSLVGRISSLSVTVNNVECVYEYVLYEGDTVSGNFVVVDHDIFWGSDHPGLDFEVSSPAGNVVHSLKGTSGDKFEFKAPKSGMYKFCFHNPYSTPETVSFYIHVGHIPNEHDVAKDEHLDPINVKIAELREALESVISEQKYLKARDARHRHTNESTRKRVIFYTVGEYLLLAAASALQVLYIRKLFSKSVAYNRV

SEQ ID NO: 9940 - protein, 215 aa, Cucurbita pepo
MERRLRETGFGYLLAGLLLASLFAGIDSISVTVNELECVYEYVLYEGDTVSGNFVVVDHDIFWGADHPGIDFSVTSPAGNVVHSLKETSGDKFEFKAPRSGMYKFCFHNPYSTPETVSFYIHVGHIPNEHDLAKDEHLDPINVKIAELREALESVTAEQKYLKARDARHRHTNESTRKRVIFYTVGEYLLLAVASGLQVVYIRRLFSKSVAYNRV

SEQ ID NO: 9941 - protein, 212 aa, Gossypium hirsutum
MEKRWGKKWALICLFLFNWARNVSSLSVTVSDMECVYEYVLYEGDTISGNFVVVDHDIFWSSDHPGIDFTVTSPGGNTVHSLKGTSGDKFEFKAPRSGMYKFCFHNPYSTPETIAFYIHVGHIPTDHDLAKDEHLNPINVKIAELREALESVTAEQKYLKARDTRHRHTNESTRKRVIGYTVGEYLLLVVASVLQVIYIRRLFSKSVAYNRV

SEQ ID NO: 9942 - protein, 195 aa, Catharanthus roseus
MEKGRDKIGCLKVYLLVLLLLLSFVGDLSVSALSVTVNDVECVYEYVLYEGDTVSGNFVVVDHDIFWSSDHPGIDLVVTAPGGNTVHTLKGTSGDKFEFKAPRSGMYKFCFHNPYSTPETVSFYIHVGHIPSEHDLAKDEHLDPINVKIAELREALESVTSEQKYLKARDTRHRHTNERHKKACDLLLQLESTFY

SEQ ID NO: 9943 - protein, 220 aa, Vinca minor
MEMRRDNKIGCLKVYGIVVILLLSFAGDISVSALSVTVNDVECVYEYVLYEGDTVSGNFVVVDHDIFWSSDHPGIDLVVTAPGGNTVQTLKGTSGDKFEFKAPRSGMYKFCFHNPYSTPETVSFYIHVGHIPSEHDLAKDEHLDPINVKIAELREALESVTAEQKYLKARDTRHRHTNESTRFRVIFYTVGEYILLALASSLQVIYIRRLFSKSVAYNRV

SEQ ID NO: 9944 - protein, 212 aa, Flaveria ramosissima
METTMKVYAVLGLLLLSTFARDVSALSVTVNDVECVYEYVLYEGDTVSGNFVVVDHDIFWSSDHPGIDFIVSSPGGNVVQTMKGTSGEKFEFKAPRSGMYQFCFHNPYSTPETVSFYIHVGHIPNEHDLAKDEHLDPVNVKIAELREALESVTAEQKYLKARDARHRHTNESTHKRVIFYTIGEYILLALASGLQVVYIRRLFSKSVAYNRV

SEQ ID NO: 9945 - protein, 210 aa, Ipomoea batatas
TARFRAYPLLLMMLFSFVTNLSALSVTVNDVECVYEYVLYEGDTISGNFVVVDHDIFWNSDHPGIDFTVTSPGDNVVHSMKGTSGDKFEFKAPRSGMYKFCFHNPYSTPETVSFYIHVGHIPNEHNLAKDEHLDPINVKIAELREALESVTAEQKYLKARDARHRHTNESTRRRVIFYTVGEYILLALASSLQVVYIRRLFSKSVAYNRV

SEQ ID NO: 9946 - protein, 217 aa, Eutrema parvulum
MERRQAMNSKIHVFVLVGFILLSSIERISSLSVTVNDDECVQEYVLYEGDTVSGNFVVVDHDIFWGSDHPGLDFTVTSPAGNIVQTVKGTSGDKFEFKAPRSGMYKFCFHNPYSTPETVSFYIHVGHIPNEHDLAKDEHLDPVNVKIAELREALESVVAEQKYLKARDTRHRHTNESTRKRVVFYTVGEYIFLAAASGLQVLYIRKLFSKSVAYNRV

SEQ ID NO: 9947 - protein, 215 aa, Tragopogon dubius
MERGERTMKVYAVLGLLLFSTFAADVSALSVTVNDVECVYEYVLYEGDTVSGNFVVVDHDIFWSSDHPGIDFIVSSPGGNVVQTMKGTSGEKFEFKAPRSGMYQFCFHNPYSTPETVSFYIHVGHIPNEHDLAKDEHLDPVNVKIAELREALESVTAEQKYLKARDARHRHTNESTHKRVIFYTIGEYILLALASGLQVVYIRRLFSKSVAYNRV

SEQ ID NO: 9948 - protein, 210 aa, Euphorbia peplus
MQRRQINLTAVFLLLSLIGRISAISVTVNDIECVYEYVLYEGDSVSGNFVVVDHDIFWSSDHPGIDFSVTSPSNNLVHTIKGTSGDKFEFKAPRSGMYKFCFHNPYSTPETVSFYIHVGHIPNEHDLAKDEHLNPINVKIAELREALESVIAEQKYLKARDVRHRRTNESTRKRVVGYTVGEYLLLAIVSSLQVVYIRRLFSKSVAYNRV

SEQ ID NO: 9949 - protein, 214 aa, Valeriana officinalis
MERRERMRCSYVMLALVLFNLVSDLSALSVTVNDVECVYEYVLYEGDTVSGNFVVVDHDIFWGSDHPGIDFIVTSPAGNNVQSLKGTSGDKFEFKAPRGGMYKFCFHNPQSTPETVSFYIHVGHIPNEHDLAKDEHLDPINVKIAELREALESVTAEQKYLKARDTRHRHTNESTRKRVIFYTIGEYLLLALASGLQVVYIRRLFSKSVGYNRV

SEQ ID NO: 9950 - protein, 213 aa, Antirrhinum majus
MEGRGRTISCLLLVLLILGTLTRVPALSVTVNDVECVSEYVLYEGDTISGNFVVVDHDIFWSSDHPGIDFTVTSPAGNTVHSIKGTSGDKFELKAPKSGMYKFCFHNSHSTPETVSFHIHVGHIPTEHDLAKDEHLDPINVKIAELREALESVTAEQKYLKARDARHRHTNESTRKRVIFYTVGEYILLALVSGLQVVYIRRLFSKSFAYNRV

SEQ ID NO: 9951 - protein, 218 aa, Sesamum indicum
MDGSGRITRSGRLAYALLGLLLLSLLSRTSALSVTVNDIECVYEYVLYEGDTVSGNFVVVDHDIFWSSDHPGIDFTVTSPAGNTVHTLKGTSGDKFEFKAPRSGMYKFCFHNPYSTPETVSFYIHVGHIPTEHDLAKDEHLDPINVKIAELREALESVTAEQKYLKARDARHRHTNESTRRRVIFYTVAEYILLALVSGLQVVYIRKLFSKSVAYNRV

SEQ ID NO: 9952 - protein, 212 aa, Cynara scolymus
GRREMKAYAVLGLLLLSTFAGDVSALSVTVNDVECVYEYVLYEGDTVSGNFVVVDHDIFWSSDHPGIDFIVSSPGGNVVQTMKGTSGEKFEFKAPRSGMYQFCFHNPYSTPETVSFYIHVGHIPNEHDLAKDEHLDPVNVKIAELREALESVTAEQKYLKARDARHRHTNESTHKRVIFYTIGEYILLALASGLQVVYIRRLFSKSVAYNRV

SEQ ID NO: 9953 - protein, 218 aa, Orobanche aegyptiaca
MERKGGIIWCGAAAYAISCLLLLSTTSRISALSVTVNDVECIYEYVLYEGDTVSGNFVVVDHDIFWSSDHPGIDLTVTSPAGNTVHTLKGTSGDKFEFKAPKSGMYKFCFHNPHSTPETVSFYIHVGHIPSEHDLAKDEHLDPINVKIAELKEALESVTAEQKYLKARDARHRHTNESTRKRVIFYTVGEYLLLALVSGLQVVYIRRLFSKSVRYNRV

SEQ ID NO: 9954 - protein, 218 aa, Lippia dulcis
MEKKGRNIRCGKASYALLILLILSMIGRISALSVTVNEVECIYEYVLYEGDTVSGNFVVVDHDIFWSSDHPGIDFTVTSPAGNNVHTLKGTSGDKFEFKAPRSGMYKFCFHNPYSTPETVSFYIHVGHIPTEHDLAKDEHLDPINVKIAELREALESVTAEQKYLKARDARHRHTNESTRRRVIFYTVGEYILLALVSGLQVVYIRRLFSKSVGYNRV

SEQ ID NO: 9955 - protein, 217 aa, Cleome spinosa
METRIGRDPKTHLVLFVGLLLLSSIGRISSLSVTVNDVECVYEYVLYEGDTVSGNFVVVDHDIFWGADHPGLDFEVSSPAGNVVHSLKGTSGDKFEFKAPKSGMYKFCFHNPYSSPETVSFYIHVGHIPNEHDIAKDEHLDPINVKIAELREALESVISEQKYLKARDARHRHTNESTRKRVIFYTVGEYLLLAAASALQVLYIRKLFSKSVAYNRV

SEQ ID NO: 9956 - protein, 216 aa, Papaver somniferum
MERSGRKMGSMKICLILGFLLSFVSHISSLSVTVNDMECVYEYVLYEGDTVSGNFVVVDHDIFWSSDHPGIDFTVTSPGGNVVNSLKGTSGDKFEFKAPRAGMYKFCFHNPYSTPETVSFYIHVGHIPNEHDLAKDEHLDPINVKIAELREALESVTAEQKYLKARDSRHRHTNESTRRRVVFYTILEYLVLCLASGLQVMFIRRLFSKSVAYNRV

SEQ ID NO: 9957 - protein, 213 aa, Centaurea maculosa
MEERRMKTYAILGLLLLSTFACDVSALSVTVNDVECVYEYVLYEGDTVSGNFVVVDHDIFWSSDHPGIDFVVSSPGGNVVQTLKGTSGEKFEFKAPRSGMYQFCFHNPYSTPETVSFYIHVGHIPNEHDLAKDEHLDPVNVKIAELREALESVTAEQKYLKARDARHRHTNESTHKRVIFYTIGEYILLALASGLQVVYIRRLFSKSVAYNRV

SEQ ID NO: 9958 - protein, 213 aa, Centaurea maculosa
MEERRMKTYAILGLLLLSTFAGDVSALSVTVNDVECVYEYVLYEGDTVSGNFVVVDHDIFWSSDHPGIDFIVSSPGGNVVQTMKGTSGEKFEFKAPRSGMYQFCFHNPYSTPETVSFYIHVGHIPNEHDLAKDEHLDPVNVKIAELREALESVTAEQKYLKARDARHRHTNESTHKRVIFYTIGEYILLALASGLQVVYIRRLFSKSVAYNRV

SEQ ID NO: 9959 - protein, 254 aa, Cichorium intybus
MAATPMLPPNLAPGDGNAPAAPPPPGTDMTGICFRDQLWLNTYPLDRNLVFDYFALSPFYDYTCNNEQLRMRSIHPLDISHLSKMTGVEFMLNEVIEPHLFVIRKQKRDGPEKVTPMLTYYVLDGSIYQAPQVCNVFAARVGRTLYHISKAFTTAASRLEKIGHADSENESVSNEPKAAKETIDFKEVKRVDHILASLQRKLPPAPQPPPFPEGYAPPSNAEGEQGTETEQADPKIPLVDPILDQGPSKRQKYT

SEQ ID NO: 9960 - protein, 213 aa, Cirsium arvense
RRERTMKVYAILGLLLLSTFAGDVSALSVTVNDVECVYEYVLYEGDTVSGNFVVVDHDIFWSSDHPGIDFIVSSPGGNVVQTMKGTSGEKFEFKAPRSGMYQFCFHNPYSTPETVSFYIHVGHIPNEHDLAKDEHLDPVNVKIAELREALESVTAEQKYLKARDARHRHTNESTHKRVIFYTIGEYILLALASGLQVVYIRRLFSKSVAYNRV

SEQ ID NO: 9961 - protein, 213 aa, Carthamus tinctorius
MEERRMKVYAILGLLLLSTFAGHVSALSVTVNDVECVYEYVLYEGDTVSGNFVVVDHDIFWSSDHPGIDFIVSSPGGNVVQTLKGTSGEKFEFKAPRSGMYQFCFHNPYSTPETVSFYIHVGHIPNEHDLAKDEHLDPVNVKIAELREALESVTAEQKYLKARDARHRHTNESTHKRVIFYTIGEYILLALASGLQVVYIRRLFSKSVAYNRV

SEQ ID NO: 9962 - protein, 215 aa, Cucumis melo
MERRVREKGLGYLLAALLLLSLIAGIDSISVTVNEIECVYEYVLYEGDSVSGNFVVVDHDIFWGADHPGIDFTVTSPAGNVVHSLKETSGDKFEFKAPRSGMYKFCFHNPYSTPETVSFYIHVGHIPNENDHAKDEHLDPINVKIAELREALESVTAEQKYLKARDARHRHTNESTRKRVIFYTVGEYLLLAVASGLQVIYIRRLFSKSVAYNRV

SEQ ID NO: 9963 - protein, 215 aa, Eschscholzia californica
MEKRNRTGSMKICIVLGFLFSFFSHLSALSVTVNDMECVYEYVLYEGDTISGNFVVVDHDIFWGSDHPGIDFTVTSPGGNVVHSLKGTSGDKFEFKSPRSGMYKFCFHNPYSTPETVSFYIHIGHIPNEHDLAKDEHLDPINVKIAELREALESVTSEQKYLKARDARHRHTNESTRKRVIFYTILEYMVLCLASGLQVMFIRRLFSKSVAYNRV

SEQ ID NO: 9964 - protein, 114 aa, Fraxinus spp
MYKFCFHNPYSTPETVSFYIHIGHIPSEHDLAKDEHLDPINVKIAELREALESVTAEQKYLKARDGRHRHTNESTRRRVIFYTVAEYILLAVASALQVVYIRRLFGKSVAYNRV

SEQ ID NO: 9965 - protein, 213 aa, Rosa hybrid cultivar
MESWQSTKGVILMGILLVSFVGRIASLSVTVNDMECVYEYVLYEDDVVSGNFVVVDHDIFWASDHPGLDLIVTSPGGNTVHTSKGTSGDKFEFKAPRSGMYKFCFHNPYSTPETVSFNIHVGHIPTEHNIAKDEHLDPINVKIAELREALESVTLEQKYLKARDARHRHTNESTRKRVVLYTVGEYFMLVAASALQVVYIRRLFSKSIGYNRV

SEQ ID NO: 9966 - protein, 213 aa, Ipomoea nil
MEITAGIRAYALLLMMLFSFVTNLSALSVTVNDVECVYEYVLYEGDTISGNFVVVDHDIFWNSDHPGIDFTVTSPGDNVVHSMKGTSGDKFDFKAPRSGMYKFCFHNPYSTPETVSFYIHVGHIPNEHNLAKDEHLDPINVKIAELREALESVTSEQKYLKARDARHRHTNESTRKRVIFYTVGEYILLALASSLQVVYIRRLFSKSVAYNRV

SEQ ID NO: 9967 - protein, 212 aa, Cirsium arvense
EERRMKTYAILGLLLLSTFAGDVSALSVTVNDVECVYEYVLYEGDTVSGNFVVVDHDIFWSSDHPGIDFIVSSPGGNVVQTMKGTSGEKFEFKAPRSGMYQFCFHNPYSTPETVSFYIHVGHIPNEHDLAKDEHLDPVNVKIAELREALESVTAEQKYLKARDARHRHTNESTHKRVIFYTIGEYILLALASGLQVVYIRRLFSKSVAYNRV

SEQ ID NO: 9968 - protein, 217 aa, Cleome gynandra
METRQARDRTTHVVLLIGLFLLSSIGQISSLSVTVNTVECVYEYVLYEGDTVSGNFVVVDHDIFWGSDHPGLDFEVTSPSGNVVHSLKGTSGDKFEFKAPKSGMYKFCFHNPYSTPETVSFYIHVGHIPNEHDLAKDEHLDPINVKIAELREALESVISEQKYLKARDARHRHTNESTRKRVIFYTVGEYVLLAAASALQVLYIRKLFSKSVAYNRV

SEQ ID NO: 9969 - protein, 212 aa, Flaveria ramosissima
METTMKVYAVLGLLLLSTFAGDVSALSVTVNDVECVYEYVLYEGDTVSGNFVVVDHDIFWSSDHPGIDFIVSSPGGNVVQTMKGTSGEKFEFKAPRSGMYQFCFHNPYSTPETVSFYIHVGHIPNEHDLAKDEHLDPVNVKIAELREALESVTAEQKYLKARDARHRRTNESTHKRVIFYTIGEYILLALASGLQVVYIRRLFSKSVAYNRV

SEQ ID NO: 9970 - protein, 217 aa, Carpinus betulus
MGRRQRQGSERMCASMIVLVLLSLVGRISSLSVTVNDVECVSEYVLYEGDMVSGNFVVVDHDIFWTSDHPGIDFTVTSPAGNMVHTLKGKSGDKFEFKAPRSGMYKFCFHNPYSTPETVSFYIHVGHIPNEHDLAKDEHLNPINVKIAELREALESVTAEQKYLKARDSRHRHTNESTRKRVVFYTVGEYILLAIVSGLQVVYIRQLFSKSVAYNRV

SEQ ID NO: 9971 - protein, 218 aa, Sarracenia psittacina
MGRRERMREPKIYAVVLVGLLLLSFVGDLAALSVTVNDVECVYEYVIYEGDTISGNFVVVDHEIFWNSDHPGIDFIVTSPAGNVVHSLKGTSGDKFEFKAPRSGMYKFCFHNPETTPETVSFYIHVGHIPNEHNLAKDEHLDPINVKIAELREALESVTAEQKYLKARDTRHRHTNESTRKRVIFYTMGEYIFLALLSGLQVVYIRRLFSKSVAYNRV

SEQ ID NO: 9972 - protein, 217 aa, Eutrema halophilum
MESRQARNSKIHVFVLVGLILLSSIERISSLSVTVNDDECVQEYVLYEGDTVSGNFVVVDHDIFWGSDHPGLDFTVTSPAGNIVQTLKGTSGDKFEFKAPRSGMYKFCFHNPYSTPETVSFYIHVGHIPNEHDLAKDEHLDPVNVKIAELREALESVVAEQKYLKARDTRHRHTNESTRKRVIFYTVGEYIFLAAASGLQVLYIRKLFSKSVAYNRV

SEQ ID NO: 9973 - protein, 211 aa, Malus domestica
MEGRARGLTLIGLLLVSFVGKIASLSVTVSDVECVYEYVLYEGDTVSGNFVVVDHDIFWGADHPGLDLIVTSPGDNTVHTSKGTSGDKFEFKAPRSGMYKFCFHNPYSTPETVSFNIHVGHIPNEHNIAKDEHLDPINVKIAELREALESVTLEQKYLKARDVRHRHTNESTRRRVVLYTVAEYLALAAASALQVVYIRKLFSKSVAYNRV

SEQ ID NO: 9974 - protein, 215 aa, Vitis vinifera
MERRHTHRCATGFIFIALFFSFIHRISALSVTVNEVECVYEYVIYEGDTVSGNFVVVDHDIFWGSDHPGIDFTVTSPAGNTVHTLKGTSGDKFEFKAPRSGMYKFCFQNSYATPETVSFYIHVGHIPNEHNLAKDEHLDPINVKIAELREALESVTAEQKYLKARDTRHRHTNESTRKRVIFYTLGEYLLLALASGLQVVYIRRLFSKSVAYNRV

SEQ ID NO: 9975 - protein, 215 aa, Lactuca sativa
MERGERTMKVYAILGLLLFSAFVGDVSALSVTVNDVECVYEYVLYEGDTVSGNFVVVDHDIFWSSDHPGIDFIVSSPGGNVVQTMKGTSGEKFEFKAPRSGMYQFCFHNPYSTPETVSFYIHVGHIPNEHDLAKDEHLDPVNVKIAELREALESVTAEQKYLKARDARHRHTNESTHKRVIFYTIGEYILLALASGLQVVYIRRLFSKSVAYNRV

SEQ ID NO: 9976 - protein, 216 aa, Vaccinium corymbosum
MERGERKKAHAWVMLGLLALSFFVGDVLSLSVTVNDVECVSEYVFYEGDSVSGNFVVVDHDIFWSSDHPGIDFIVSSSAGNVVHSLKGTAGDKFEFKAPRSGMYKFCFHNPHSTPETVSFYIHVGHIPNEHDLAKDEHLDPINVKIAELREALESVTAEQKYLKARDVRHRHTNESTRKRVIFYTLGEYILLAMASGLQVVYIRRLFSKTVGYNRV

SEQ ID NO: 9977 - protein, 216 aa, Vaccinium corymbosum
MERGERKKAHAWVMLGLLALSFFVGDVSSLSVTVNDVECVSEYVFYEGDSVSGNFVVVDHDIFWSSDHPGIDFIVSSSAGNVVHSLKGTAGDKFEFKAPRSGMYKFCFHNPHSTPETVSFYIHVGHIPNEHDLAKDEHLDPINVKIAELREALESVTAEQKYLKARDVRHRHTNESTRKRVIFYTLGEYILLAMASGLQVVYIRRLFSKTVGYNRV

SEQ ID NO: 9978 - protein, 208 aa, Taraxacum officinale
MKVYAILGLLLFSAFTIDVSALSVTVNDVECVYEYVLYEGDTVSGNFVVVDHDIFWSSDHPGIDFIVSSPGGNVVQTMKGTSGEKFEFKAPRSGMYQFCFHNPYSTPETVSFYIHVGHIPNEHDLAKDEHLDPVNVKIAELREALESVTAEQKYLKARDARHRHTNESTHKRVIFYTIGEYILLALASGLQVVYIRRLFSKSVAYNRV

SEQ ID NO: 9979 - protein, 215 aa, Cucumis sativus
MERRVREKGLGFLLAAFLLLSLIAGIDSISVTVNEVECVYEYVLYEGDSVSGNFVVVDHDIFWGADHPGIEFTVTSPAGNVVHSLKETSGDKFEFKAPRSGMYKFCFHNPYSTPETVSFYIHVGHIPNEHDHAKDEHLDPINVKIAELREALESVISEQKYLKARDARHRHTNESTRKRVIFYTVGEYLLLAVASGLQVIYIRRLFSKSVAYNRV

SEQ ID NO: 9980 - protein, 210 aa, Euphorbia peplus
MQRRQINLAVVVLLWCLIGRIAAISVTVNDIECVYEYVLYEGDSVSGNFVVVDHDIFWSSDHPGIDFSVTSPSNNLVHTIKGTSGDKFEFKAPRSGMYKFCFHNPYSTPETVSFYIHVGHIPNEHDLAKDEHLNPINVKIAELREALESVIAEQKYLKARDVRHRRTNESTRKRVIGYTVGEYLLLAIVSSLQVVYIRRLFSKSVAYNRV

SEQ ID NO: 9981 - protein, 212 aa, Gossypium raimondii
MAKIWGKMWALMGLLLFNSVCNVSSLSVNVNNIECVYEYVLYEGDTISGNFVVVDHDIFWGSDHPGIDFTVTSPLGNTVHELKGTSGDKFEVKAPRSGMYKFCFHNPHSAPETVSFHIHVGHIPTEHDLAKDEHLDPINVKIAELREALESVTAEQKYLKARDTRHRHTNESTRKRVIGYTVGEYILLTLVSALQVIYIRQLFSKSVAYNRV

SEQ ID NO: 9982 - protein, 216 aa, Liriodendron tulipifera
MERRKTFRSAGEIFLLLVFFFGFFRHLSAISITVNDVECVYEYVLYEGDTVSGNFVVVDHDIFWSSDHPGIDLTVTSPGGNTVHQLKGTSGDKFEFKAPRSGMYKFCFQNPYSTPETVSFYIHVGHIPNEHDLAKDEHLDPVNVKIAELREALESVTAEQQYLKARDARHRHTNESTRRRLIFYTLAEYLALACASGLQVVYIRRLFSKSVAYNRV

SEQ ID NO: 9983 - protein, 192 aa, Olea europaea
SRLSALSVTVNDVECVYEYVLYEGDTVSGNFVVVDHDIFWSSDHPGIDFSVTSPGGNTVHTLKGTPGDKFEFKALRSGMYKFCFHNPYSTPETVSFYIHVGHIPSEHDLAKDEHLDPINVKIAELREALESVTAEQKYLKARDGRHRHTNESTRRRVIFYTVAEYILLALASSLQVVYIRRLFSKSVAYNRV

SEQ ID NO: 9984 - protein, 214 aa, Platanus occidentalis
MERRRLGSAKMLIILGFLFSFLRHLSALSVTVNDVECVYEYVLYEGDSVSGNFVVVDHDVFWSSDHPGIDFIVTSPGGNTVHSLKGTSGDKFEFKAPRSGMYKFCFHNPYSTPETVSFYIHVGHIPSEHDLAKDEHLDPINVKIAELREALESITAEQKYLKARDTRHRYTNESTRKRVIFYTLAEYLLLACASGLQVVYIRRLFSKSVAYNRV

SEQ ID NO: 9985 - protein, 218 aa, Triphysaria pusilla
MKREGGNINRGAAAYALLALLLLSTASHVSALSVTVNDVECIYEYVLYEGDTVSGNFVVVDHDIFWSSDHPGIEFIVTSPAGNTVHTLKGTSGDKFEFKSPKSGMYKFCFHNPHSTPETVSFHIHVGHIPTEHDLAKDEHLDPINVKIAELREALESVTSEQKYLKARDSRHRRTNESTRKRVIFYTVAEYLLLALVSGLQVVYIRRLFSKSFGYNRV

SEQ ID NO: 9986 - protein, 225 aa, Vigna unguiculata
MIKHVLCFLVFLHAFHRTHGVEYSVTNKALSTPGGVAFRDKIGADYAKRTLDSATQFIWRVLQLNNPGDRKSVQKVSLFVDDMDGVAYTSNDQIHLSARYVGNYQGDVKREVSGVLYHEMVHVWQWNGNGGAPGGLIEGIADFVRLKANYAPSHWVKAGQGQKWDQGYDVTARFLDYCNTLKGGFVAQLNKLMRNGYSDQYFVQLLGKPVDQLWRDYKAKYGNIA

SEQ ID NO: 9987 - protein, 267 aa, Vigna unguiculata
MASLNLLPHPPPFSFSSSSFHRFRCNTLLLAPKLSQRRPSFLVKSAVGVAEPAAYSSGYAGDTSDSISSLKLNLLSAVSGLNRGLAANEDDLRKADGAAKELEAAAGLVDLSDGLDKLQGRWKLIYSSAFSSRTLGGSRPGPPIGRLLPITLGQVFQRIDILSKDFDNIVELQLGAPWPLPPLEVTATLAHKFELIGSSKIKIVFEKTTVKTAGNLAQLPPLEVPRIPDALRPSSNTGSGEFEVTYLDSDTRITRGDRGELRVFVIS

SEQ ID NO: 9988 - protein, 266 aa, Cajanus cajan
MASLTHSPPSLSHFSSPSLHRPRRNLHLLAPKPSQPRPSLVISSVGVADPSPSSFSYAGDTSDSISSFKLNLLSAVSGLNRGLAANEDDLRKADDAAKELEAAGGVVDLSVGLDRLQGRWKLIYSSAFSSRTLGGSRPGPPIGRLLPITLGQVFQRIDILSKDFDNIVELQLGAPWPLPPLEVTATLAHKFEIIGSSKIKIIFEKTTVKTAGNLSQLPPLEVPRIPDALRPPSNNTGSGEFEVTYLDADTRVTRGDRGELRVFVIS

SEQ ID NO: 9989 - protein, 267 aa, Phaseolus coccineus
MASLNLLPHPSPFSFFSSSLHRSRCNTLLLAPKPSQARPSFLVKSTAGVADPASYSSGYAGDTSDSISSLKLNLLSAVSGLNRGLAASEDDLRKADGAAKELEAAGGLVDISVGLDKLQGRWKLIYSSAFSSRTLGGSRPGPPIGRLLPITLEQVFQRIDILSKDFDNIVELQLGAPWPLPPLEVTATLAHKFELIGSSKVKIVFEKTTVKTGGNLAQLPPLEVPQIPDALRPSSNRGSGEFEITYLDSDTRITRGDRGELRVFVIS

SEQ ID NO: 9990 - protein, 288 aa, Vigna unguiculata
IPSTKSLPNSTLSHSQTHPFFMASLNLLPHPPPFSFSSSSFHRFRCNTLLLAPKLSQRRPSFLVKSAVGVAEPAAYSSGYAGDTSDSISSLKLNLLSAVSGLNRGLAANEDDLRKADGAAKELEAAAGLVDLSDGLDKLQGRWKLIYSSAFSSRTLGGSRPGPPIGRLLPITLGQVFQRIDILSKDFDNIVELQLGAPWPLPPLEVTATLAHKFELIGSSKIKIVFEKTTVKTAGNLAQLPPLEVPRIPDALRPSSNTGSGEFEVTYLDSDTRITRGDRGELRVFVIS

SEQ ID NO: 9991 - protein, 303 aa, Phaseolus coccineus
MASAALQFWYLTAPISHRYPHQLASLTSLKFATPVSATNTIYLPKPLTVRFALTESDSPKSIQPDPQTLLQEIAGNLDLPPDYFAQFPRDLRLDLNDAAFDLSNGPVLDECGQELGETLLNLSRAWELAETATSHSLAKKIPLIEAKLTGSAKSALGKRLISAGRRFQSMGQYGQGEPQKIAKAMIAAGRALCASSMSEVTVEEPKEETRVLKFGELQVEITPDKANIGAVIGFVFGILSWEIAQGIQNIPDSSLEYANDNALLLAKSLKGALLALFYFSTFLSAFTSGGLVLLGLQLKSKKG

SEQ ID NO: 9992 - protein, 305 aa, Cajanus cajan
MASASASLRFWSSIAPISHYYTHQLASLTSLKFGTPISSTNTIYLSKPLAVRFALTESDSPKSIEPDPQTLLQQIADSFDLPPDYFSQLPRDLRLDLNDAAFDLSSGPVLDECGQELGETLLNLSRAWELADTSTSHSLVKKLPLIEAKLTGSSKSALGKRLISAGRRFQSMGQYGQGEPQQISKAMIAAGRALSATSTSAVTVEQPKDETRMLKFGELQVEITPDKANIGAAIGIVFGILSWEIAQGIQNAPDSSLQYANDNALLLAKSLKGALLSLFYFSTFLSAFTSVGLVLLGIQLKSKKD

SEQ ID NO: 9993 - protein, 130 aa, Flaveria ramosissima
MATISSVFILLLTITAVFICNAEASSVKFVKKTVSSHPIVIFSKSYCPYCRRAKGVFKELNKKPYVVELDEREDGSDIQDALSEMVGRRTVPQVFINGKHLGGSDDTVEAYQSGELAKLLGIDSSHKTDL

SEQ ID NO: 9994 - protein, 133 aa, Arnica chamissonis
MTKPATISSIFIVLLTIAAVFVCNAEASSVDFVKKTVSSHPIVIFSKSYCPYCKRAKGVFKELNKKPYVIELDQREDGSNIQDALSEIVGRRTVPQVFINGKHLGGSDDTVEAYQSGQLAKLLGINSSRKTDL

SEQ ID NO: 9995 - protein, 130 aa, Flaveria ramosissima
MATISSLFILLLTITALFICNAEASSVKFVKKTVSSHPIVIFSKSYCPYCRRAKGVFKELNKKPYVVELDEREDGSDIQDALSEMVGRRTVPQVFINGKHLGGSDDTVEAYQSGELAKLLGIDSSHKTDL

SEQ ID NO: 9996 - protein, 130 aa, Flaveria ramosissima
MATISSLFILLLTITALFICNAEASSVKFVKKTVSSHPIVIFSKSYCPYCRRAKGVFKELNKKPYVVELDERDDGSDIQDALSEIVGRRTVPQVFINGKHLGGSDDTVEAYQSGELAKLLGIDSSHKTDL

SEQ ID NO: 9997 - protein, 133 aa, Cynara scolymus
MARSAAVSSIFIILLMITAIFMCNAEASSVDFVKKTVSSHSIVIFSKSYCPYCKRAKGVFKELNKKPYVIELDEREDGWKIQDALSELVGRRTVPQVFINGKHLGGSDDTIEAYESGQLAKLLGIDSGHKTDL

SEQ ID NO: 9998 - protein, 133 aa, Gerbera hybrid cultivar
MARSAAISSIFIILLAIIAVFLCNAEASSVDFVKKTVSSHSIVIFSKSYCPYCKRAKGVFKELKQKPYVIELDEREDGWKIQDALSEIVGRRTVPQVFINGKHLGGSDDTVEAYESGHLAKLLGVALRDKADL

SEQ ID NO: 9999 - protein, 189 aa, Ambrosia trifida
MADVSRRSGLRGIGTWFNKHIVDPFVEILSRGAQPKELAFSAALGITLGVFPIVGVTFFLCVLAVTMLGTSVNAPTIMLANFVATPIELSLIIVFLRFGEFLTGGAHFPLTASALKDVLTGKASKEILLSIVHALLGWLVLAPFILGLLYIVFVPCFTMLVRKFTSSVSSLESDDEPSYTEVMLKVRDA

SEQ ID NO: 10000 - protein, 189 aa, Flaveria ramosissima
MADLSRRCRLQGIGTWVNKQVVEPFVEIISRGAEPKELALSAALGLTLGVFPIVGVTFFLCVLAITMLGTSVNAPTVMLANFVATPIELSLIIVFLRFGEFLTGGAHFPLTADALKKVLTGKASKEILLSIVHALLGWMVLAPLILGLLYVVFVPCFTKLVRKFGSSVTSPGRDDEPSYTEVMLKVRDA

SEQ ID NO: 10001 - protein, 187 aa, Flaveria ramosissima
MADLSRRCRLQGIGTWVNKQVVEPFVEIISRGAEPKELALSAALGITLGVFPVVGVTFFLCVLAITMLGTSVNAPTVMLANFVATPIELSLIIVFLRFGEFLTGGAHFPLTADALKKVLTGKASKEILLSIAHALLGWMVLAPLILGLLYVVFVPCFTKLVRKFGSSVTNPGRDDEPSYTEVMLKVR

SEQ ID NO: 10002 - protein, 191 aa, Parthenium argentatum
MKQPMMPNPMLSSSFPPTNITTDQIQKFLDENKQLILAIMTNQNLGKLAECAQYQALLQKNLMYLAAIADAQPPTPSPAPTISSQMGPLSHAGIPQGGFFMPQHPQAAVMAQQSPSFPQQMPAMPFNSPQVMQQPQMGVRPGGPSGPSSVPPSSAASDIWRGSMQDGGGADASGAGKDGHGAAAGGPEEAK

SEQ ID NO: 10003 - protein, 149 aa, Guizotia abyssinica
MTNQNLGKLAECAQYQALLQKNLMYLAAIADAQPPTPSPTPTISSQMGPLSHAGIPQQGGFFMQQHPQGAVMAQQSPGFPQQMPAMQFNIPQVIQPQMGVRSGGPSVVPPSSAASDIWRGSMQDGGAAESSGAGKDGHGAAAGGTDEAK
